United States Patent 9,551,006 (ISOLATED POLYNUCLEOTIDES AND POLYPEPTIDES, AND METHODS OF USING SAME FOR IMPROVING PLANT PROPERTIES) - sequence listing, part 2

SEQ ID NO: 1133 - DNA, 2534 bp, Setaria italica
ccgccagagggggacgcctgcgccgcctccatcagcacctgccgctaccggagagggcgcgacctctcccgccgccaaatcagggcctcctcctcctgccgcctcgcaaggaataggtagctgagctttgtatcaacaagatggtgcagtacaatttcaagaagatcactgtcgtacctcctgggaaggatttcattgacataatcctgtcccgcactcagaggcagacaccgacagttgtccacaagggttatgcaatctcccgcatccgccagttttatatgcgcaaggttaggtattcccagcagaacttctatgaaaagctgtccaccatcatcgatgagttccctcgactggatgatatccaccctttctatggtgatctcctccatgtgctctacaacaaggatcactacaaacttgccttgggtcagatcaacacagctaggaacatcatcgcaaagatatccaaggactacttgaggctgctcaagtatggagactccctgtacaggtgcaagtgtttgaaggtggctgcactgggtcgcatgtgtactgttgtgaagaggatcagtcctagtttggcatacttggagcagatcaggcagcacatggctaggcttccgtccatagacccaaacacccgtactgtgctgatttgtggctatccaaatgtgggaaagagttctttcatgaataaggttactagggcagatgtggacgtccagccttatgcctttacaacaaaatccctgtttgttggtcatactgattacaagtatctgcgctaccaagtgattgacacaccaggtatccttgatcgtccttttgaggataggaacattatagaaatgtgcagcatcactgctctggcacacttgagggctgcggtgttgttctttctggacatttctggatcttgtgggtacagtattgctcagcaagctgcactcttccacagtataaagtctctgttcatgaataagcctctggtcattgtgtgcaacaagactgacttgcagccgcttgaagggctttctgaggatgacatgaagctagttatggatatgaaggcagaggctatgaagactataacccaagctggtgatccaaatgaagagggtgttctgttgaccatgagcacattaacagatgatggtgtaatggctgttaaaaatgctgcatgtgagaggcttcttgaacagagggtggatgtgaagatgaaatcaaagaagatggttgactgcctgaataggttccatgttgctgttccaaagcctcgtgacaacaaggagaggcctatttgcatccctccggctgtccttgaagctagggcgaatgctgctgcgaaggaaaagaagaagcttgagaaggactttgagcaggagaatggtggagctggtgtctattctaccagcctcaagaaacattatatattggccaacgatgaatggaaggaggatattctccctgagatactggatgggcataatgttgctgattttctggatcctgatatcctcgaaaggtgtgaagagttggaacgagaggaggggcttcgtctggaagagcaagctgcgcaagatgcttttgagattgatggccatgaattaactgaggaacagaaggagattttgtctcagatcaggaagaagaaggcactgctcatccaagagcatagaatgaagaagagaactgcagaaagccgtcccattgttcctaggaagtttgacaaagacaggaaattcacaactaaaaggatgggaaggcagctttcatccatgggtgtggatcctagtgcagccatagctcgcagcaagtcaagagggcgcaagcgtgagaggtcactgagcagagctgctgctgatggtgatgatatggaggtcgacggacagcaatccaacaagaaactgcgactgaggtcaagatccaggtcgaagtcccgggctcctgaggaggtgattccaggtgaaggattcaaggactctgagcagaagaagaaggcgatcaagaaagccaaggacgccacgaggaataggaacaaggaggctcgccgtggtgaggctgaccgtgtcattcccactttgaagccaaagcatctgttctctgggaaacgcacccttgggaagacaagcaggcgataagcgcagcacatcgctggatcagtgctgcaggaaatacaagactggtggaattctggtgcgggcaattggacaaagggagcttcgacttcagtgtctaactggcaccgatgaactactgctatttatgcatgctgtctcgtggtcctcttgagacagttttgctagcttatacttgtactagactgctagtgaattgttttggttactgttactattagctgtgtggcgtttaattttgttgagtggtactaagtcggtttcttccaaacggttaccgtgggattcctgtctggtttaattgtcgtttcaaacgcaatggtgagtttttgaatgttgcaatgacgaagacatgttcacatgcatcccagcatcctttctactgcatttaac

SEQ ID NO: 1134 - DNA, 2481 bp, Oryza sativa
ccgccacgcagagggggacgccgccgccctccgccgccgcctcacgacgtagaaatagtcatctcagctagtgaaaatggtgcaatacaatttcaagcgtatcactgttgttcctcctgggaaggacttcattgacatcatcttgtcccgcacccagaggcaaacaccaactgttgtccacaagggatatgctatctcccgcattcgtcagttttatatgcgaaaggttaagtatacccagtcaaacttctatgagaagctgtccactgtcatcgatgacttcccaaggttggatggcatccatcctttctatggtgatcttcttcatgttctgtacaacaaagatcactacaaacttgccttgggccaaatcaacacagccagaaatatcattgcaaagatagctaaggactatttgaggctgctcaaatatggagactcgctgtaccggtgcaagtgtctcaaggtggctgcattaggtcgtatgtgtactgtcattaagcggatcagtcctagtttggcatacctggagcagatcaggcagcacatggcgaggcttccatctatagacccaaacacccgtactttattgatttgtggctatccaaatgttgggaagagctctttcatgaacaagatcacaagagcagatgtggatgtccaaccctatgctttcacaacaaagtccctgtttgttggtcatgctgattacaagtatttgcggtaccaagtgattgacactccagggatccttgatcggccttttgaggacaggaacatcatagaaatgtgcagtatcactgctcttgcccacttgagggctgctgtgctattcttcctggacatctctgggtcttgtgggtacagtattgctcagcaggctgcactcttccacagtatcaagtccttgttcatgaacaagcctctagtcattgtgtgcaacaagacagatttgcagcctcttgaaaatctgtctgaggaggacatgaagctggtaatggagatgaaggcagaggctatgaagaccataggccatggtggagaagctaatgaagagggtgttttgttgactatgagtactttgactgaaaatggtgtgatggctgtcaaaaatgctgcatgtgagaggcttcttgatcagagggtggagatcaagatgaaatcaaagaagatcaatgactgcctaaatagatttcatgttgctatgccaaagcctcgtgataacaaggagaggcctccttgcatccctcaggctgttctggatgctcgagcaagtgctgatgctgcaaaggaaaagaagaagctggaaaggaaactggagaaggacctagagaatgagaatggaggtgctggggtctattctgcgagtctcaagaagcattacttattggccgatgatgaatggaaggaagacattctgcctgagatattggatgggcataatgttgctgattttctggatccagatatattgcagaggtgtgaagagttggagagagaggagggtcttcgcctcgaagaggaagctgcacaggaagctttccagattgatggccatgaactaactgaagagcagcgtgaaatcttgggtcagattagaaagaagaaggcattgctcatccaggagcatagaatgaagaagagaactgcagaaagtcgtcctattgttcctagaaagtttgacaaagacaggacattcacaactgatagaatgggtcgccaactttcatccatgggttttgatcctagtgcagctatggaccgagcccgcagccggtctagaggtcgcaagcgtgagaggtcactgagcagagctgccagtgatggtgatgatatggatatagatggccagcagtccagcaagaaattgcgcgcgttgtcgaggtccaggtctaggtcgaaatcaagaccacctgaggaggttgttccaggagaaggattcaaggactctgctcagaagaagaaggcaattaagaaagctaaggattctgtgaggaacaggaacaaggaggctcgtcgcggagaggcggaccgtgtcattccaactttgaaaccaaagcatctgttctctggaaaaagttctataggcaagacgagcaggcgataagtgattcagcacagctgctggtcatcactggtttcaggaagtgcagcatcattgcagcatggtgtgggaaattaggcgaaggaaggcctgattatccaatctgctggacttgttgtgctctgtttattcatactgtctgatggattgctgtgtatcccgtctcatcctctgccgagacataattttgttagcttatgttgtagctttacgctacattaatatggtttcgctagtattagttcgttacatggtactatgaaatactactcctgtaatggtgactttgttattatacttgaattccagtcctattcgttataattaattctttataataagatatcacatgattatgttttgacgaaaggaaaata

SEQ ID NO: 1135 - DNA, 2522 bp, Sorghum bicolor
cccgtccgccgccagagggggacacctgcgccgcctccaccagcacttgccggagaggacgcgacctctcccggcgacaagtcggtcctcttcttccgggcttctcacaaggaatcgtattcaagttttgtatcaccaagatggtgcagtacaatttcaagaagatcactgttgtccctcctgggaaggacttcattgacataatcctgtcccgcacccaaaggcagacaccgactgttgtccacaagggatatgctatcaaccgcattcgtcagttttatatgcgcaaggttaggtattcccagcagaacttctatgaaaagctctccaccatcatcgatgagtttcctcgactggatgacatccaccctttctatggtgatctcctccatgtgctctacaacaaggatcactacaagcttgccctgggtcagatcaacacagctaggaacatcattgcaaagatatccaaggactacttgaggcttctcaagtatggagacaccctgtaccggtgcaagtgtctgaaggtggctgcactaggtcgcatgtgcactgtcgtgaagaggatcagtcctagtttggcttacttagagcagatcaggcagcacatggccaggcttccatccatagatccgaacacccgtactgttctgatttgtggatatccaaatgtggggaagagttctttcatgaacaaggttacaagggcagatgtggatgtccaaccgtatgcctttacaacaaaatccctgtttgttggtcatacagattacaagtacctgcgctaccaagtgattgacacaccaggtatacttgatcggccttttgaagataggaacatcatagaaatgtgcagcatcactgctctggcgcatttgagggctgcggtgttgttctttctggacatctctggatcttgtggatacagtattgctcagcaagctgcactcttccacagtataaagtctctgttcatgaataagcctttggtcattgtgtgcaacaagactgacttgcagccgcttgaagggctttctgaggatgacatgaagctagtcatggagatgaaggcagaggctatgaagactataacccaagctggtggtcctaatgaagaaggtgttttgttgactatgagcactttaactgatgatggtgtaatggctgtcaaaaatgctgcatgcgagaggctgcttgaacagagggtggatgtgaagatgaagtcaaagaagatgatggattgtttgaataggtttcatgttgctgttccaaagcctcgtgacaacaaggagaggcctgtttgcatccctcaggctgttctggaagctagggcgaatgctgctgcaaaggaaaagaagaagcttgagaaggacattgagaatgagaatggaggtgctggggtgtattctgcaagtctcaagaaacattatatattggccaatgatgaatggaaggaggatattcttccagagatactggatggtcacaacgttgccgattttctggatccagatatcctagtaaggtgtgaagagttggaaagagaggaagggcttcgtctggaagaacaagctgcagaagatgctttccagattgatggtcatgaactaactcaggaacagaaggagattttggctcagattaggaagaagaaggcattactcatccaagaacatagaatgaagaagagaactgcagaaagccgtcctattgtccctagaaagtttgacaaagataggaaattcacaactgataggatgggacgtcagctttcctccatgggtgtggatcctagtgctgccatgaatagagctcgcagcaagtctaggggccgcaagcgtgagaggtcattgagcagagctgcagctgatggtgacagtatggagatagatggccagcaatccaacaagaaactgcgtcggacatcaaggtctaggtcgaggtcacgggctcctgaggaggtcattcctggagagggattcaaggactctgagcagaagaagaaggctatcaagaaagcgaaggcctctactaggaacaggaacaaggaggctcgccgtggagaggctgatcgtgttattcccactttgaaaccaaagcatctgttctctgggaaacgcactcttggaaagacaagcaggcgataagctcagcacctcattgtatctggtagtaaaggactggtgcaactttggtgtggacaatttgatgaaacgggagcttttgtcttcagccagcacttatttgtgctactatttatgaaatatgtcttgctgtatcggggtcctcttgagacacagttttgctagtttatacatgtattgctctgaattggtttggctactatatattagctttctggtgttaatttctcttgaatggtacgaagttattcatctctcctacttgagaagtctgtattgtgtctgagattcagcatcgattcttctgtgctgctacgtggcagggattctcttaattatgctttttgattttaatcaattagtggcttaccatgg

SEQ ID NO: 1136 - DNA, 2330 bp, Pennisetum glaucum
tatcaacaagatggtgcagtacaatttcaagaagatcactgttgtccctcctgggaaggacttcattgacataatcctgtcccgcactcagaggcagacaccaacagtggtccacaagggttatgcaatctcccgcatccgccagttttatatgcgcaaggttaggtattcccagcagaacttctatgaaaagctgtccaccatcatcgatgagttccctcggctggatgatatccaccctttctatggtgatctcctccatgtgctctacaacaaggatcactacaagcttgctttgggtcagatcaacacagctaggaacatcattgcaaagatatccaaggactacctgaggctgctgaagtatggagataccctgtaccggtgcaagcgtctgaaggtggccgcactgggtcgcatgtgtactgttgtgaagaggatcagtcctagtttggcatacttggagcagatcaggcagcacatggccaggcttccgtccatagatccaaacacccgtactgtgctgatttgtggctatccaaatgtgggaaagagttctttcatgaacaaggttacacgggcagatgtggacgtccagccttatgccttcacaacaaaatccctgtttgttggtcatactgattacaagtatctgcgctaccaagtgattgacacaccgggtatccttgatcgtccttttgaagataggaacatcattgaaatgtgcagcatcactgctctggcacacttgagggctgcggtgttgttctttctggatatttctggatcttgtgggtacagtatcgcccagcaagccgcactcttccacagtataaagtctctgttcatgaataagcctctggtcattgtgtgcaacaagacagacttgcagccccttgaagggctgtctgaggatgacatgaagctagtaatggagatgaaggcagaggctatgaagactataacccaagctggtgatccaaatgaagagggtgttttgttgactatgagcacattaacagatgatggtgtgatggctgttaaaaatgctgcatgcgagaggctgcttgaacagagggtggatgtgaagatgaaatcaaagaagatggttgactgcctgaataggttccatgttgctgttccaaagcctcgtgacaacaaggagaggcctgtttgcatccctcctgctgtcctggaagctagggagaatgctgctgcgaaggaaaagaagaagcttgagaaggactttgagcaggagaatggcggcgctggtgtctattctgccagcctcaagaagcattatatattggccaatgatgaatggaaggaagatattctccctgagatactggatgggcataacgttgctgattttctggatcctgatatcctcgaaaggtgtgaagagttggaacgtgaggagggtcttcgcctggaagagcaagctgcgcaagatgcttttgaaattgatggccacgaattaactgaggaacaaaaggagattttgtctcagatcaggaagaagaaggcacagcttatacaagagcatagaatgaagaagagaactgcagaaagccgtcctgttgttcctaggaagtttgacaaagacagaaagttcacaactaacaggatgggaaggcagctttcctccatgggtgtggatcctagtgcagccatagctcgcagcaagtctagagggcgcaagcgtgacaggtcactgagcagagctgctgctgatggtgatgatatggaggtcgatggacagcaatccagcaagaaactgcgactgaggtcaagatccaggtcgaagtcccgggctcctgaggaggtcattccaggtgaaggattcaaggactccgcgcagaaggcggtggcgatcaggaaagctaaggattccacgaagaagaggaacaagcaggcccgccgtggtgaggctgaccgcgtcattcccactttgaagccaaagcatctgttctctgggaagcgcacccttgggaagacaagcaggcgataagtgcatcatgtcgctggatctgtgttgcaggaaacacaggacgtaactttcgtgtgggaaattgggcaaaggaagcttacacttcagtgtctaactggcaccgatgaactacttctatttgtgcttgctgcctcgtgatcctatattcctattgaattgttttggttactgttactagcaaatacttctagtggattgttttggttacttaatgctgtgtgctgtttaattgtgtcaagtcgtactgagtcggtttcttccaaatggtcacgtgggattcctgtctgatttaattgtcgttctttatgctgcaaat

SEQ ID NO: 1137 - DNA, 2495 bp, Zea mays
catttccccgtccgccgccagagcgggagaacacccgcgccgcctccagcagcacttggcggagagggcgcgacctctcttgccgacaaatcggtcctcttcctccgagcgcctaacgaggaataggtattcaagttttgtatcaccaagatggtgcaatacaatttcaagaagatcactgttgtccctcccgggaaggacttcattgacataatcctgtcccgcactcaaaggcagacaccgactgttgtccacaagggatatgctatctcccgcattcgccagttttacatgcgcaaggttagatattcccagcagaacttctatgaaaagctctccaccatcatcgatgagtttcctcgactggatgacatccaccctttctatggtgatctcctccacgtgctctacaacaaggatcactacaagcttgcgctgggtcaaatcaacacagctaggaatatcattgcaaagatatccaaggactacttgaggctgctcaagtatggagactccctttaccggtgcaagtgtttgaaggtggctgcactaggtcgcatgtgcactgttgtgaagaggatcagtcctagtttggcttacttggagcagatcaggcagcacatggccaggcttccatccatagacccgaacacccgtactgtgctgatttgtggatatccaaatgtggggaagagttcgttcatgaacaaggttacaagggcagatgtggatgtccagccatatgcctttacaacaaaatccctgtttgttggccacacagattacaagtacctgcgctaccaagtgattgacacaccaggtatacttgaccggccttttgaagataggaacatcatagaaatgtgtagcatcactgcgctggcacacttgagggctgcggtgttgttctttctagacatttctggatcttgtgggtacagtatcgctcagcaagctgcactcttccacagtataaagtctctgtttatgaataagcctttggtcattgtgtgcaacaagactgacttgcagccacttgaagggctttctgaggatgacatgaagttagtcatggagatgaaggcagaggctatgaagactataactcaagctgttggtcctaatgaagagggtgttttattgactatgagcactttaacagatgatggtgtaatggctgtgaaaaatgctgcatgcgagaggcttcttgaacagagggtggatgtgaagatgaaatcaaagaagatgatggattgcttgaataggtttcatgttgctgttccaaagcctcgtgacaacaaggagcggcctgtttgcatccctccggctgttctggaagctagggcaaatgctgctgctaaggaaaagaagaagcttgagaaggacattgagaatgagaatggaggtgctggggtatattctgcaagtctcaagaaacattatatattggctaatgatgaatggaaggaagatattcttccagagatactggatggtcacaacgttgcagattttctggatccggatatcctagtaaggtgtgaagagttggaaagggaggaagggcttcgcctggaagaacaagctgcagaagatgctttccagattgatggccatgaactaactcaggaacagaaggagattctggctcagattaggaagaagaaggcattacttatccaagaacatagaatgaagaagagaactgcagaaagccgtcctattgtccctagaaagtttgacaaagataggaaattcacaactaataggatgggacggcagctttcctctatgggtgtggatcctattgctgccatcaatagagctcgtagccagtctaggggccgcaagcgtgagaggtcagtgagcagagctgcagctgatggtgacggtatggagatagatggccagcaatccaacaagaaactgcgtcgtacatcaaggtcgaggtcgaggtcacgggctcctgaggaggtcattcctggagaaggattcaaggactctgagcagaagaagaaggctatcaagaaagcaaaggcctctacaaggaacaggaacaaggatgctcgccgtggagaggctgaccgtgttattcctactttgaaaccaaagcatctgttctctgggaaacgcactcttggaaagacaagcaggcgataagctcagcacctcactgcatctggtaataaaggactggtgcactgttggtttgatcaatttgatgaaacgggtgttttttttgtgttcagccagcacttatttatgctactatttacgaaatttgtcttgatgtctctggtcctcttgatatatagttttagtgtttaattctgttgaatggtacaaagttatccatgtcccctactcaacatgtttgtagtttgcccatgagattttactatcgatccttgctcctctgtgctgctgtgtcgctgcaatttctcttaattatgatttcaaacttaatcaattagtggcatacttagttctggtaa

SEQ ID NO: 1138 - DNA, 2512 bp, Zea mays
tcttcccgtccgccgccagagcggggaacacctgcaccgccttcaccagcacttgccggagaggacgtgacctctcccgccgacaaatcggtcctcttcgtccgggcgtttatcaaggaataggtattcaagttttgtatcaccaagatggtgcagtacaattttaagaagatcacggttgtccctcctgggaaggacttcattgacataatcctgtcccgcacccaaaggcagacaccgacagttgtccacaagggatatgctatctcccgcattcgtcagttttatatgcgcaaggttaggtattcccagcagaacttctatgaaaagctctcgaccatcatagatgagtttcctcgactggatgacatccaccctttctatggtgatctcctccatgtgctctacaacaaggatcactacaagcttgccctgggtcagattaacacagctaggaacatcattgcaaagatatccaaggactacttgaggttgctcaagtatggagactctctttaccggtgcaagtgtctgaaggtggctgcactaggtcgcatgtgcactgtcgttaagaggatcagtcctagtttggcttacttagagcagatccgacagcacatggctaggcttccatccatagacccaaacacccgtactgtgctgatttgtggatatccaaatgtggggaagagttctttcatgaacaaggttacaagggcagatgtggatgtccagccgtatgcctttacaacgaaatccctgtttgttggtcatacagattacaagtacctgcgctaccaagtgattgacacaccgggtatacttgatcggccttttgaagataggaacatcatagaaatgtgcagcatcactgctctggcacacttgagggctgcagtgttgttctttctggacatctctggatcttgtggatacagtattgctcagcaagctgctctcttccacagtataaagtctctgttcatgaataagcctttggtcattgtgtgcaacaagactgacttgcagccacttgaagggctttctgaggatgacatgaagctagtcatggagatgaaggcagaggctttgaagactataatccaagctggtggtcctaatgatgagggtgttttgttgactatgagcactttaactgatgatggtgtaatggctgtcaaaaatgctgcatgcgagaggcttcttgaacagagggtggatgtaaagatgaagtcaaaaaagatgatggattgcttgaatagatttcatgttgctctgccaaagcctcgtgacaacaaggagaggcctgtttgcatccctctggctgttctggaagctagggctaatgctgctgcaaaggaaaagaagcttgagaaggacattgagaatgagaatggaggtgctggggtctattctgcaagtctcaagaaacattatattttggccaatgatgaatggaaggaggatattcttccagagatactggatggtcacaatgttgccgattttctggatccagatatccttgtaaggtgtgaagagttggaaagggaggaagggcttcgtctggaagaacaagctgcagaagatgctttccagattgatggtcatgaactaactcaggaacagaaggagattttggctcagattaggaagaagaaggcattacttatccaagaacatagaatgaagaagagaactgcagaaagccgtcctattgtccctagaaagtttgacaaagataggaaattcacaactgataggatgggacgccagctttcatccatgggtatggatcctagtgctgccatgaatagaattcgcagtcagtctaggggtcgcaagcgtgagaggtcagtgagcagagctgcagcggatggtgacggtatggagatagatggccagcaaagcaacaagaaattgcgtcggacatcaaggtctaggtctaggtctaggtcacgtgctcctgaggaagtccttcctggagaaggattcaaggactctgagcagaagaaaaaggctatcaagaaagcaaaggccgctactaggaacaggaacaaggaagctcgtcgtggagaggctgaccgtgttattcccactttaaaaccaaagcatttgttttctgggaaacgcactcttggaaagacaagcaggcgataagctcagtacctcactggatctggtagtaaaggactggtgcaattttggtgtgagcaatttgatgaaacgggagcttttatgtctagcacttatgtatgctacttatttatgaaatgtcttgctgttgctgtatcatggtcctctttaagacagttttactagtttatacatgtattacttcgaattggttgggttactatatattagctttctggtgtttgattctcttaatggtacgaagttattcaactctcctacttaaaaatgtttgtaatgcatctgttggatctcaccatcggttcttccctccgcagctttgaggcaggaacttctcataatgattagttgctta

SEQ ID NO: 1139 - DNA, 2148 bp, Pennisetum glaucum
cctgtcccgcactcagaggcagacaccgacagttgtccacaagggttatgccatctcgcgcattcgccagttttatatgcgcaaggtgaggtattcacagcagaacttctatgaaaagctgtctaccattatcgatgagttccctcgactggatgatatccatcctttctatggtgatctccttcatgtgctctacaacaaggatcactacaagcttgccttaggtcagatcaacacagctaggaacatcattgcaaagatatccaaggactacctgaggctgctaaagtatagagataccttgtatcagtgcaagtgtctgaaggtggctgcgctgggtcgcatgtgtactgtcgtgaagaggatcagtcctagtttggcatacttggagcagatcaggcagcacatggccaggcttccgtccatagacccaaacacccgtactgtgctgatttgtggctatccaaacgtgggaaagagttctttcatgaacaaggttacacgagcagatgttgatgtccagccttatgcctttacaacaaaatccctgtttgttggtcatactgattacaagtacctgcgctaccaagtgattgacacaccgggtatccttgaccgtccatttgagggtaggaacatcatagaaatgtgcagtatcactgctctggctcacttgagggctgcagtgctgttctttttggatatttctggatcttgtgggtacagtatcgctcagcaagccgcactcttccacagtattaagtctctgttcatgaataagcctctggtcattgtgtgcaacaagacagacttgcagccccttgaagggctttccgaggatgacatgaagctagtaatggagatgaaagcagaggctatgaagactataacccaagctggtgatccaaatgaagagggtgttttgttgactatgagcacattgacagatgatggtgtcatggctgttaaaaatgctgcatgcgagaggcttcttgaacagagggtggatgtgaagatgaaatcaaagaagatggttgattgcctgaataggttccatgttgctgttccaaagcctcgtgacaacaaggagaggcctgtttgcatccctccgtctgtcttggaagctagggtgaatgctgctgcgaaggaaaagaagaagcttgagaaggacttagagcaggagaatggaggtgctggtgtctattctgccagccttaagaagcattatatattggccaatgatgaatggaaggaagatattctccctgagatacttgatggacataacgttgctgattttctggatcctgatatccttgaaaggtgcgaagagttggaacgagaggaggggcttcgtctggaagagcaagctgtgcaagattcttttgagattgatggccatgaattaactgaggaacagaaggagattttgtctcagatcaggaagaagaaggcactgctcatccaagagcatagaatgaagaagagaactgcagaaagccgtcccattgttcctaggaagtttgacaaagacaggaaattcacaactaacaggatgggaaggcagctttcatccatgggtgtggatcctagtgcagccatagctcgcagcaagtcaagagggcgcaagcgtgataggtcactgagcagagctgctgctgatggtgatgacatggaggtcgacggacagcaatcaaacaagagactgcgactgcgttcaagatccaggtcgaagtcccgggctcctgaggaggtcattcctggtgaaggattcaaggactctcagcagaagatgaaggcgatcaggaaagccaaggatgccacgaggaataggaacaaggacgctcgccgcggtgaggctgaccgtgtcattcccactttgaagccaaagcatctgttctctggaaaacgcacacttggaaagacaagcaggcgataagcgtagcatgtctggatcagtgctgtaggatatagaagactggtggaattctggtgcgggcatttgggcaaagggagctttatacttcttctactgctatttacgcattctgtctagtggtcctcttgagacaatggagttttgctagcttatttgtattactgaattgtcttgtttctgttactatttactgtgtggcgtttaatttt

SEQ ID NO: 1140 - DNA, 2486 bp, Malus domestica
gccgcttctctcaaaccctcaaactctgaaactctgaaactctgaaacctgaaaccctgaaatcttcatcatcccctctctcactctgtcgtaaaatcagtaagtaaacatggttcaatataacttcaagaagatgactgttgtaccaaatgggaaggacttcattgacattatcctgtctcgcactcagaggcagaccccaactgtagtccacaagggttatgccatttcccgccttcgtcagttctatatgcgcaaagtcaaatatactcaacagaattttcatgaaaagctctccacaatagttgatgagtttcctaggctggatgacatccaccctttttatggcgacctccttcatgttctctacaacaaagaccactacaagcttgcacttggccaaatcaatactgcaagaaatcttattggaaagatttctaaggattatgtgaagttgttgaagtatggtgattcactttaccgatgcaaatgtctcaaggtcgctgctcttggccgcatgtgcacggttataaagaggatcggtcctagtttagcttacctggaacaaattaggcaacacatggcaaggctaccttcaattgaccctaataccaggacaatattgatttgtgggtatccgaatgttggaaagagctcattcattaacaagatcacaagggctgatgtggatgtccagccctatgcctttaccaccaagtcactctttgtggggcatacagattataaatacctgaggtaccaggtaattgatacaccagggatcttggaccgaccatttgaagaccgtaacattattgagatgtgcagcatcacagctttggcgcacttgagagctgcggtgttgttcttcttggacatctcagggtcttgtgggtacagcattgcccaacaagcagctctttttcatagcatcaagtctctgtttatgaacaaaccattgattatagtctgcaacaagactgatttgcagccattggatggtatatccgaggaagacaagaagttggtcgcagagatgaaatctgaagctatgaagacagtgatcggtcagggaggtgaggctacaaatgatgatggggtactcttgaccatgagtactttgaccgaggagggggtaattgctgtaaagaatgcagcttgtgacaggttgttgaatcagagagttgagctgaagatgaaatccaaaaagataaatgattgcttaaatcgttttcatgttgccatgccaaagcctcgtgacaacaaggaaaggcccccatgcatacctcaggcagttatagaagctaagattaagcaagcagcggagaaggaaaagagacagacagaaagggatttggagaatgagaatggcggtgcaggtgtatactctgccagtttgaagaagcattatatcttagctaatgatgaatggaaagaggatgtcatgccagaaattcttgatgggcacaatgtgtatgactttgttgatcctgatattttacataggcttgaggagttggaacgagaagaaggactccgtcaggaagaggagggtgatgattttgagatggatggattggaattgactccagaagagaaaaagacattggctgcgatcaggaaaaagaaaagcttgctcattcaagaacatagaatcaagaaaagcacagcagagagtcgacccattgtaccaaggaaatttgacaaggatcgggaattcacaacaaagagaatggggaggcaactatcaaaattaggaattgatcctagtagggcaattgaacgggcccgaagcagatctgtgtctaggggacggaagagagagagatcagttgacaggggtgatactgatggtggcgatgctatggaagtggatacacccaacaagaagcagcgtatgttatctagatcccgttcaaggtccaggtcaaggcctccgactgaagtcgtccctggagagggcttcaaggactctaatcagaaggctaaggcactacagaaggccaggaaatctaataagaatagaaacaaggatgctcgtcgtggagaggcagatagggtcattcccactctaaaaccaaagcacttgttctctggaaagcgctcaataggaaaaacccagaggcgttgaaatatttgaggatggttggtttgtgcctttgtagcatgcaccgggaagtgtagttgctgatgagaaagcacttagttctttgaacttgtggttcgtctcggcaggggagtgcagcatgaaagatcatgtaaccagactatttatagtttccgtatttaatatttgtgttatggttttgaatttacacagaattgtttgtttctgttccttttggctttcgtaatttgtagtttgacatactgtgagacgttgcctaagtgaaactgctgtttcttttgcttgcggaatgaaaaaggcttaactttttggcatgtttaagtgaattgcccaaccaaatgagttatttaatcgatta

SEQ ID NO: 1141 - DNA, 2379 bp, Gossypium hirsutum
agcttgtgaactcgatttctgtttggtttgaaggaaaaaaggtcaatagtaaaaatggttcaatataatttcaagaaaatcactgttgtaccgaatgggaaggacttcatagatattattctctcacgtacccaacggcaaactccaactgttgtccacaaagggtatgcgatttcccgtctccgccagttctatatgcgtaaagttaaatatacccagcagaattttcatgagaaactttcgacaataattgatgagttccctcgccttgatgatatccatccattttatggtgatcttcttcatgttctctataacaaggatcactacaagcttgctcttggccagataaatactgctaggaatctcattagcaagattgctaaagattatgtcaagctattaaagtatggtgactcgctatatcggtgcaagtcgctaaaggttgctgcacttggtcgtatgtgtactgtcataaagaggattggccctagtctagcataccttgagcagattaggcaacatatggcaaggttgccatctattgatccaaatactcgaaccatgttgatttgtgggtaccctaatgttggtaagagttcatttatgaacaaaatcacgagggctgatgtggatgtccaaccttatgctttcactaccaagtcactctttgtgggtcatacagattacaagtaccttagatatcaagtaattgatacacctggaattttggacaggccatttgaagatcgaaatattattgagatgtgcagcattacagcattggctcacctacgagctgcagtgttgttctttttggatatatctgggtcatgtgggtacagcattgcccagcaggcagctctttttcacagcattaaatctctctttatgaacaaacccttgatcattgtttgcaataagactgatttgcagccattggatggcatatctgaggaagacaggaaattggtcatggagatgaaagctgaagccatgaagactgtgattggtcaaggaggtgagcctacaaatgaagaaggggtgctattgactatgagcactttgactgaggatggagtgattgctgtgaagaatgcagcttgtgaaaggttactgaatcagagggttgagttgaagatgaaatcgaaaaaaataaatgactgccttaataggtttcatgttgcattaccaaaagcacgtgatcagaaggaacggccagcttgcataccccaggcagttttggaagctaaagccaagcaagcagcagagaaagaaaagaggaagactgaaaaggaattggaggatgagaatggtggtgctggtgtgtattctgctagtttgaggaagaactatatattggcaaatgatgaatggaaagaggacacaatgcctgaaattcttgatggtcacaatgtgtacgattttattgaccctgatatcttgttaaggcttgaagagttggagcgtgaagagggtcttcgacaagcggaggaggaaggtgatgactttgagatggatggccaagaattatccctggaagagcaagaagcactggctgagatcaggaaaaagaagagcttgcttattcaacagcataggatgaagaaaagcactgcagaaagtcggcctgttgtaccaagaaagttcgacacagatagaaagttcacaacagggaggatgggccggcagctatcttctttggggctggatccctctcttgcaattaatcgtgctcgtagcaagtcaagaggccggaaaagggagcgatcagttgataagagagagggtgatggtggagatgctatggatatagatgacaaccaagcaagcaaaaagctccgtctaaggtctacatctcggtcaaggtcacaatcacgacctcctggtgaagttataccgggagagggcttgaaggattctgctcagaagataaaggctattaaattggccaagaaatctgtgttaaagaggaacaagaatgctcggcgtggggaggctgatagagttattcccacattgaaaccaaagcatctgttctctggaaaacgttccattggaaaaactcaaaggcgataagaattggtgttggggagagaagattttgtctgggttttggttggattatggctattttatttatgtttgctgtgtggcagtcggatttaaatggaaattttgttagttggcttgtgatttacatttctctaattattttggttaaacaatatcgtgttggaacagacactaggttgagtggaatattaagatatttaacgttgctctttttcttgtaatctactttttagatatttgaccgagttgaagtagattacatccataaatgaaccccatgagattaacattgggtattagata

SEQ ID NO: 1142 - DNA, 2470 bp, Gossypium hirsutum
aatcccctcttgggctgagccgactaaccgagaagcttgtgaactcgatttctgtttggtttgaaggaaaaaaaggtcaatagtaaaaatggttcaatataatttcaagaaaatcactgttgtaccgaatgggaaggacttcatagatattattctctcacgtacccaacggcaaactccaactgttgtccacaaagggtatgcgatttcccgtctccgccagttctatatgcgtaaagttaaatatacccagcagaattttcatgagaaactttcgacaataattgatgagttccctcgccttgatgatatccatccattttatggtgatcttcttcatgttctctataacaaggatcactacaagcttgctcttggccagataaatactgctaggaatctcattagcaaggttgctaaagattatgtcaagctattaaagtatggtgactcgctatatcggtgcaagtcgctaaaggttgctgcacttggtcgtatgtgtactgtcataaagaggattggccctagtctagcataccttgagcagattaggcaacatatggcaaggttgccatctattgatccaaatactcgaaccatgttgatttgtgggtaccctaatgttggtaagagttcatttatgaacaaaatcacgagggctgatgtggatgtccaaccttatgctttcactaccaagtcactctttgtgggtcatacagattacaagtaccttagatatcaagtaattgatacacctggaattttggacaggccatttgaagatcgaaatattattgagatgtgcagcattacagcattggctcacctacgagctgcagtgttgttctttttggatatatctgggtcatgtgggtacagcattgcccagcaggcagctctttttcacagcattaaatctctctttatgaacaaacccttgatcattgtttgcaataagactgatttgcagccattggatggcatatctgaggaagacaggaaattggtcatggagatgaaagctgaagccatgaagactgtgattggtcaaggaggtgagcctacaaatgaagaaggggtgctattgactatgagcactttgactgaggatggagtgattgctgtgaagaatgcagcttgtgaaaggttactgaatcagagggttgagttgaagatgaaatcgaaaaaaataaatgactgccttaataggtttcatgttgcattaccaaaaccacgtgatcagaaggaacggccagcttgcataccccaggcagttttggaagctaaagccaagcaagcagcagagaaagaaaagaggaaaactgaaaaggaattggaggatgagaatggtggtgctggtgtgtattctgctagtttgaggaagaactatatattggcaaatgatgaatggaaagaggacacaatgcctgaaattcttgatggtcacaatgtgtacgattttatcgaccctgatatcttgttaaggcttgaagagttggagcgtgaagagggtcttcgacaagcggaggaggaaggtgatgactttgagatggatggccaagaattatccctggaagagcaagaagcactggctgagatcaggaaaaagaagagcttgcttattcaacagcataggatgaagaaaagcactgcagaaagtcggcctgttgtaccaagaaagttcgacacagatagaaagttcacaacagggaggatgggccggcagctatcttctttggggctggatccctctcttgcaattaatcgtgctcgtagcaagtcaagaggccggaaaagggagcgatcagttgataagagagagggtgatggtggagatgctatggatatagatgacaaccaagcaagcaaaaagctccgtctaaggtctacatctcggtcaaggtcacaatcacgacctcctggtgaagttataccgggagagggcttgaaggattctgctcagaagataaaggctattaaattggccaagaaatctgtgttaaagaggaacaagaatgctcggcgtggggaggctgatagagttattcccacattgaaaccaaagcatctgttctctggaaaacgttccattggaaaaactcaaaggcgataagaattggtgttggggagagaagattttgtctgggttttggttggattatggctattttatttatgtttgctgtgtggcagtcggatttaaatggaaattttgttagttggcttgtgatttacatttctctaattattttggttaaacaatatcgtgttggaacagacactaggttgagtggaatattaagatatttaacgttgctctttttcttgtaatctactttttagatatttgaccgagttgaagtagattacatccataaatgaaccccatgagattaacattgggtattagatatttgagttttgaacgattggatgggcttcaattacaaactagttttcatttattttt

SEQ ID NO: 1143 - DNA, 2383 bp, Populus trichocarpa
agagagggcctcctgcttgcggcgcccttcttctttctcagttgctctcaacaagtgtggaaagaatataaagatggtgcagtataattttaagaagattactgtggtccctaatgggaaggattttgttgatatcatcctttctcggacccaaaggcaaacaccaacagtggtccataagggttatgctatttctcggcttcggcagttttatatgcggaaggtgaagtatactcagcagaatttccatgagaagctttcaacaatcattgatgagttccctcgtcttgatgacatccatccgttttatggtgaccttcttcatgtgctgtacaataaggatcattacaagcttgcccttggtcagattaatactgccaggaatcttattagcaagattgctaaggattatgtcaagttgttaaagtatggtgattcgttgtatcgatgcaagtctctgaaggttgctgctcttgggcgaatgtgcactgttatgaagaggattggcccaagtttagcttacttggagcaaattagacagcatatggcaaggctaccttcaattgatccaaatactcggacagtcttgatttgcgggtatcctaatgttgggaagagctctttcatcaacaagatcaccagggcagatgtggatgtgcaaccttatgcattcactaccaagtcattgtttgtaggccacacagattacaagtatctgaggtaccaagtgattgatacaccagggattttggatcggccttttgaggatcgtaacattattgagatgtgcagcatcacagctctggcacatcttcgagcggctgtgttattcttcttggacgtctctgggtcatgtggatatagcattgctcaacaggctgctttatttcatagcattaagtctttgtttatgaataaaccattgaccattgtctgcaacaagaccgatttgcaaccacttgaagggatttctgaggaagacatgaagttggtcatggagatgaaatcagaagctatgaagacactggttgctcaaggaggtgaagctaccaatgatgctgatgtgcttttgactatgagtaccttgaccgaggagggggtgattgctgtgaagaacgctgcttgcgagagattgctgaatcagcgagtggaaatgaagatgaaatctaaaaaaattaatgactgcttgaatcggttccatgtagcaatgccaaagccacgtgatcaaaaggaaaggccaccttgtatacctcaaccagttttggaagctaaagctaaggaggcagcagagaaggagaaaagaaaaacagaaaaggatttggaagatgaaaatggtggtgctggtgtatactctgccagtttgaagaagaattacatcttagcccatgatgaatggaaagaagatgtactcccggagattcttgatggccacaatgtgtatgacttcattgatcctgatattttgcaaaggctcgaggagttggaacaagaagaaggtatccgacaggcagaagaaggagatgacgattttgagatggatggtgaggaattaactgctgaagagaaagaagccttggctgagatcaggaaaaagaaaagcttgctcattcaagagcatagaatgaagaaaagcactgcagagagccggcctactgtacctagaaaatttgacaaggacagaaagttcacaacaaaaagaatgggcaggcagctgtcagctatgggagtggatccttctaaagcaattaatcgtcttcgtgagaggtcactctctacgaggggccgcaaaagagagaggtcaactgacaggggacacgatgatggtgatgctatggatatggatgtggaccagccaaataagaagctgcgtttgagatccacatctcggtctaggtcaaggtcacggcctccaaatgaggttgttccaggagagggcttcaaggactcggctcaaaaaagcaaggctcttaagcttttcaagaactctgctaaaaagaggaacaaggatgctagacgtggagaagcagatagagttattcctacactcaaaccaaagcacttgttctctgggaaacgttccattggaaaaacacagaggcgttaaatatttaagggattgttggtataaactgcaacagattatactgaatcatgggatgcacatccatgcttgctgtttaggcaattttgagagatttagttacatgtttgatgctaggttctggaccttcctggataatgtatttttgttgattgcttttctaaattttgcatatttgagatttatttgggtgaatctaacttttgctgcatgttctttccataacatatttttgctcatgaattttgggtatctcatgttttcaattgataatccctttgt

SEQ ID NO: 1144 - DNA, 2360 bp, Prunus persica
cttttaggtcgaaactgacagtttggcctccgcgcctctcaaactctcaactcttcatcccgtctctctgttgtaagtccaataagtaaacatggtgcaatataacttcaagaagatgactgttgtaccgagtgggaaggacttcattgacattatcctatctcgcacccagaggcagactccaactgtagtccacaagggttatgctatttcccgcctccgtcagttctatatgcgtaaggtaaaatatacccaacagaattttcatgagaagctctccacaatcattgatgagtttcctaggctggatgacatccaccctttctatggcgaccttcttcatgttctctacaacaaagaccattacaagcttgcacttggccagatcaatactgcaaggaaccttattggtaagatttccaaagattatgtgaaattgttaaagtatggtgattcactttaccgatgcaaatgtctcaaggtcgctgctcttggccgcatgtgcacggttataaagaggattggtcctagtttagcttacctagaacaaattaggcaacacatggcaaggctaccttcaattgaccctaatactaggacagtattgatttgtggctatccgaatgttggaaagagctcattcattaacaagatcactagggctgatgtggatgtccagccttatgcttttaccaccaagtcactctttgtgggacatacagattataaatacttgaggtaccaggttattgatacaccagggattttggaccgcccatttgaagaccgtaacattattgagatgtgcagcataacagctttggctcacttgagagctgcggtcttgtttttcttggacatctcggggtcttgtgggtacagcattgcccaacaggcagcactttttcacagtattaagtctctgtttatgaacaaaccattgattatagtctgcaacaagactgatttgcagccactggagggtatatccgaggaagacaagaagttggtcacggagatgaaagctgaagctatgaagacagtaattggtcaaggaggtgaggctaccaatgatgagggggtactcttgaccatgagcactctgactgaggagggggttattgctgtaaagaatgcagcttgtgagaggttgttgaatcagagagtggaattgaagatgaaatccaaaaagataaatgactgcttaaatcgttttcatgttgcaatgccaaagccacgtgacaataaggaaagacccccatgtatacctcaggcagttttagaagccaaggctaagcaagcagcagagaaggaaaagagaaacacagaaagggatttggagaatgagaatgggggtgcaggtgtatactctgccagtttgaagaagaattatatcttagctaatgatgaatggaaagaggatgtcatgccagaaattctcgatgggcacaatatatacgactttgttgatcctgatattttgcataggcttgaggaattggaacgagaagaaggacaccgtcaggcagaggagggtgatgatgattttgagatggatggattggaattgactccagaagagcaaaagacattggctgagataaggaaaaagaaaagcttgcttattcaacaacatagaatcaagaaaagtacagcagagagtcgaccaactgtaccaaggaaatttgacaaggacagaaagttcacaacaaagcgaatggggaggcagctatcaaagttgggacttgatccgactaaggcaattaaccgagctcgaagcagatctgtctcaactaggggccggaagagggagagatcacttgacagggatgatacagatggtggtgatgctatggatgtagatacacccaacaagaagcaacgcatgttatctagatcccgttcgaggtcaagatcaaggcctccaactgaagttgtccctggagagggattcaaggactctgctcaaaaggctaaggcactacaaaaggccaataaatctaataagatgagaaacaagaatgctcgccgtggagaggcagatagggtcattcccactttaaaaccaaagcacttgttctctggaaaacgatcaattggaaaaactcaaaggcgttaaaatatttgagggagttaggtttgtgatttgctgtagtatgcaccatggagtgtacttgctgctgaaaaagaacttggttctttcatctctggttcggcaggagattgcagcacttgagatcatgcaaccagagtctcacagtttccttatttttcagttctgtttttgtttacgaaattttggatccgaggcatgcctcagttacagtattttgagtggatttggatttacagacaaatag

SEQ ID NO: 1145 - DNA, 2595 bp, Amsonia hubrichtii
agtactacaatttagcttcaccgccaccgcctcctcatccgcttccttctccatcttcagggaagccgaagcaactggacattcatcttagtgagagatactggtcgttaagatggtgcagtacaactttaaaaagataactgttgtccccagtgggaaggactttgttgatataatcctctctcgcacacaacgccaaactcctactgttgttcacaagggttatgccatctctcgcattcgccagttttacatgcgcaaagtgaaatacacacagcaaaactttcatgataagctttctactattgttgacgagttccctcggcttgatgatatccatcctttttatggagaccttctccatgttctttataacaaggaccactacaagcttgcacttggacagatcaatactgctaggaatctaatcagtaagatagcaaaggattacgtaaaactgttaaagtatggcgactcactctataggtgcaagtctttgaaggttgctgctcttggtcgtatgtgtactgtgataaagcgtattggccccagtctggcttatctagaacagatcaggcaacacatggcaaggctaccttcaatagatccaaacactaggactatcttgatttgtgggtacccaaatgtcggcaagagctcgttcatcaataaaatcacaagggctgatgtagatgtgcagccatatgctttcaccacaaagtctctgttcgttggtcatacagactacaagtacttgagataccaggtcattgacactccagggatattggatagaccttttgaagatcggaatatcattgaaatgtgcagtataactgcccttgctcatctgagagctgctgtgttatttttccttgacatttcagggtcttgtggctatagcattgctcaacaggcagctctctttcacagcataaagtcactgtttatgaacaaacctttaattgtagtttgcaacaagactgacttgcagccactggaagggatatcagaggaagataagaagctggttatggagatgaaagcagaggcaatgaagactgtgattggtcaagggggtgagccaacaaatgaagaaggtgtccttctgactatgagtactctgactgaagagggtgttattgcagtgaaaaatgcagcttgtgagaggttattggatcagagggtagaattgaaaatgaagtcaaaaaaattgaatgactgcttaaatcgcttccatgttgcaatgccaaagcccagggaccagaaagaaaggcctgcatgcatacctgaggccgttcttgaagctagagctaagaaggcagagcaaactgcagagaaagagaaaaggaagcttgagaaggatctggaggatgagaatggtggtgcaggtgtatactctgctagcttgagaaagcattacatcctagcaaatgaggaatggaaggaagatatcatgcctgaaattcttgatggccacaatgtgtatgacttcgttgatcctgatatcttgcaaagacttgaagagttggagcgagaagaaggtcttcgacaggagcaagaaggtgatgatgatttcgagatggatggtgctgatctgacaccagaagagcaagaagcgctggctgagatcaggaaaaagaaaagcttactcattcagcagcataggatgaagaagagcactgctgagagccgatcaattattccaaggatatttgacaaagacaggcagttcactgcaggaaggatgggaaggcagctacaagctctgggacttgatcctacttcggcaatcaatagggctcgcagtagatccaggggtcgtaagagagagagatcatctgtaagaggagaagatgatggtggtgatgccatggacatagataatgaccaacctagcaagaagctgcggtttaggtctagctcgagatcgaagtcaagaccaccaaatgaagtggtccctggagagggtttcagggattctgctcagaaggttaaggcactgaaaatggctaagaactctgtgaagaagaggaacaagaatgctcggcgtggagaggcagatagagtcattcctacattgaaaccaaagcacttattctctggcaagcggtccattggaaaaacgcagaggcgctagtaagattgacggtgatgtctttattgtccaatgctgttcagtgtcctggattgtattctagtttatgtactacgccatattctcacctcgtggaaattgtacacccgcaagttgtgtccgtggagttggcagctaccaactttggcatcggatttcctgtggacaatgtatgccaatagagaattgagaggctttctgaccatttttgccgtggcaattttgaagttcaacaaccttttttatttttgttatttaatgctataatttggctgagttttgagttcctagaatatttgggattcccaaaatatttgcatctttatttgttttcccatttcttggtttcctgcttgcacctcatttcaatttttagatcttattgactacaatgctactctggtttgaaatccttgtaattgttagatttgtagcatttcacataaagtgtcatgata

SEQ ID NO: 1146 - DNA, 2485 bp, Quercus alba
aaggacagagaggtaatcaacaacgccgcatcaaccacgccgccggcctctccaacctccaattttcaatagtaggggggtgatagctggtgaagctttaagatggtgcagtataattttaagaacattactgtagttccaaatgggaaggacttcattgatataattttgtctcgtactcaacggcaaacgccgactgttgtccataagggctatgctatctctcgcctacgccaattttatatgcgtaaagtgaagtatacccagacgaactattatgacaagctctctacaatcatcgacgagtttcctcgtcttgatgatatccatcctttttatggagatcttcttcatgtgctctacaacaaagatcactacaagcttgcccttggccaaatcaataccgcaaggaatctgattagtaagattgctaaagattatgtcaggttgttgaagtatggtgattcgttgtaccgatgcaagtgtctgaaggttgctgctcttggtcgcatgtgcactgtcataaaaagggttgctcctagtttggcttacttagaacagatcagacagcatatggctaggctaccttcgattgatccaaatactcggacggtcttgatttgtgggtatcccaatgtgggcaagagttccttcattaacaagatcactagagctgatgtggatgtccagccctatgctttcaccacaaagtcgctctttgtcggtcatacagactataaatacctaaggtatcaagtcattgatacacctggtattttggaccggccttttgaggatcgcaatattattgagatgtgcagtatcacagctttggcacatcttcgagctgcagtgttgttcttcttagacatctcggggtcttgtggatataccattgcacaacaggctgcactttttcacagcattaagtctctgtttatgaacaaacctttgactattgtatgcaacaagactgatttgcaaccacttgaaggtttatcagaggaagatatgaagttggtcatggagatgaaagctgaagctatgaagacagtggttggtcaaggaggtgagcctactgatgaccaaggggtgctgctgaccatgagtactttgactgaggatggggtaattgctgtgaaaaatgcagcttgtgagaggttattggatcagagggttgaaataaagatgaaatccaaaaagataaatgattgcttaaatcgttttcatgttgcgattccaaagccacgggaccagaaggaaaggccaccttgtatacctcaggcagttttggaagctaaagcgaagcaagcagcagagaaggaaaagaggaaaactgaaaaggatttggagaatgagaatggtggtgcaggagtatactctgctagtttgaagaagaattatatcttagctaatgatgaatggaaagaagatgtattgccagaaattcttgatgggcacaatgtgtatgacttcattgatcctgatattttacaaaggcttgaggagttggaacaagaagaagggctaaggcaggcagaggaagttgatgatgattttgagatggatggcaaggaattgactccggaagagcaacaagcattggctgagattaggaaaaagaaaagcttactcattcaacagcacaggatcaagaaaagcactgcagagagccggcctattgtaccaagaaagtttgacaaggacaagcagttcacaaccaggagaatgggaaggcagctatctgctttggggctggatccatctaaggccattgatcgagcccgtagtaggtcgagaggtcggaagagggagaggtcacctgctaatgatggtggtgatgctatggatatggatgtggacacacctaacaagaggctgcgaatgaggtctagatcccgatcaaggtcagtctcacggccaccgggtgaacttgtccctggagagggcttcagggactctgctcaaaaggttaaggcacaaaagcttgcaaagaaatcttccaagaagaggaacaaggatgcacgtcgtggtgaggcagatagggtaatacctactttgaaaccaaagcatttgttctctgggaagcggtccagcggaaaaactgatagacgttgatttactagagggcatgttggttcatggttcgtggagacagaattccttgggtttacttgcagtcaagaaagaattttgttcgatcaattctttggtttggctgtaggttgtacacttcttgaccatggcagcatatcagcagatttttgttatcttctttgttatagcataatgttgaggcaattttgagtttgagaaacgatttaaattataatttttcctaagtgactagagcgtgacttaatattaaattttttggttggtttttcctcttaatatcgtaatgtgtattagttcacagatgaatttggcttaattgctgtttgttagatactccaagacccaattcaaattatgttttcattga

SEQ ID NO: 1147 - DNA, 3236 bp, Quercus alba
acactactcgtagaaggctgtgttgatgatgatatcccatcacttgtgcccactataggcaattttatttctggggccacagaatcactgtatgaggtaggtcgtcgactcgtgtgattcccagacatgctgaatgacgaagatgaagaggctgaaaaagcatgtgtcccattttccttcttatatgcaggtttaccatataaaccaccggggtcagtagagctaaattggcttgaaccaccacgtccaacatagcggtctgcaccacccctaccaccacgatttgaagtgttattagcaccacgagatctggaatctggtatgtccttgctctcttttttcttttctcgcttgcttttcacctcatgaaagggatcttgagagagaagacgattaacggcctcgtcagggtccatgttacattctttaagcgtgaaatagatctcttgctcggtacagagattgttcactatctccttcaagctctgaaccatctttcttgacgacgccgggattgtggaaatcccattattgcccttcccaccgccgccgccacttccgcctcgaacactcatcctctcaggtgggggggagaagaaactcttggaagtctctcgcagatctgacaaagccgatgatgcgatagggtttttcctctttttcactcgctgtttgggggtttcgtttcgccgcgcgagagaagagaaacaacaaacaacactggctggaaagaaagaaagaaggtctaaaaataacaaagacaaggttatatccaaacttctctctctctctctctctctctctctcaccatcctccagggtgatagctgctgaaccttcaagatggtgcagtataattttaagaacattactgtggttccaaatgggaaggacttcatcgacataattctatctcgtacccaacggcaaacaccgacagttgtccataagggctatgctatctctcgcctccgccaatcttatatgcgtaaagtgaagtatacccagacaaactattatgacaagctctctaccatcatcgacgagtttcccaggcttgatgatatccatcctttttatggagatcttcttcatgtgctctacaacaaagatcactacaagcttgcccttggccaaatcaatactgcaaggaatctgattagtaagattgctaaagattatgtcaggctgttgaagtatggtgattcattgtaccgatgcaagtgtctgaaggttgctgctcttggtcgcatgtgcactgtcataaaaagggttgctcctagtttggcttacttagaacagatcagacagcacatggctaggctaccttcaattgacccaaatactcggacgatcttgatttgcgggtatcccaatgtgggcaagagttccttcattaacaagatcactagagctgatgtggatgtccagccctatgctttcaccacaaagtcgctctttgtcggtcatacagactataaatacctaaggtatcaagtcatcgatacacctggtattttggaccggccttttgaggatcgcaatattattgagatgtgcagtatcacagctttggcacatcttcgagctgcagtgttgttcttcttagacatctcggggtcttgtggatataccattgcacaacaggctgcactttttcacagcattaagtctctgtttatgaacaaacctttgactattgtatgcaacaagactgatttgcaaccacttgaagggatatcagaggaagataagaagttggtcatggagatgaaagctgaagctatgaaaacagtgattggtcaaggaggtgagcctactgatgaccaaggggtgctgctgaccatgagtactttgactgaggatggggtaattgctgtgaaaaatgcagcttgtgagaggttattggatcagagggttgaaataaagatgaaatccaaaaagataaatgattgcttaaatcgttttcatgttgcgataccaaagccacgggaccagaaggaaaggccaccttgtatacctcaggcagttttggaagctaaagcgaagcaagcagcagagaaggaaaagaggaaaactgaaaaggatttggagaatgagaatggtggtgcaggtgtgtactctgctagtttgaagaagaattatatcttagctaatgatgaatggaaagaagatgtattgccagaaattcttgatgggcacaatgtgtatgacttcattgatcctgatattttacaaaggcttgaggagttggaacaagaagaagggctaaggcaggcagaggaagttgatgatgattttgagatggatggcaaggaattgactccagaagagcaacaagcattggctgagattaggaaaaagaaaagcttactcattcaacagcacaggatcaagaaaagcactgcagagagccggcctattgtaccaagaaaatttgacaaggacaagcagttcacaaccaggagaatgggaaggcagctatctgctttggggctggatccatctaaggccattgaccgagcccgtagtaggtcgaggggtcggaagagggagaggtcacctgataatgaatgtggtgatgctatggatattgacgtggacacacctaacaagaagctgcgaatgaggtctagatcccgatcaaggtcagtctcacggccaccgggtgaagttgtccctggagagggcttcaaggactctgctcaaaaggttaaggcacaaaagcttgcaaagaaatcttccaagaagaggaacaaggatgcacgtcgtggtgaggcagatagggtaatacctactttgaaaccaaagcatttgttctctgggaagcggtccagcggaaaaactgatagacgttgatttactagagggcatgttggttcatggttcgtggagacacaattccttgggtttactgcagtcaagaaagaattttgttcgatcaattctttggtttggctgtaggttgtacacttcttgaccatggcagcatatcagcagatttttgttatcttctttgttatagcataatgttgaggcaattttgagtttgagaaacgatttaaattataatttttcctaagtgactagagcgtgacttaatattaaaatttttggttggtttttcctcttaatatcgtaatgtgtattagttcacagatgaatttggcttaattgctgtttgttagatacaccaagacccaattcaaattatgttttcattgatgaccgtcttg

SEQ ID NO: 1148 - DNA, 2968 bp, Eucalyptus grandis
ctaccaccgacttcatttctctgccctcgcgccgtacctgctgcgaagcggcacaacgcatccaccgcggtggccgaccacgaagcaacaacctcctcctcctcgcccccggagggcggcgttgcgacccgaagtgcgatccggcggggttcggcggcggcgaaattcccgtccagaggttataaaagatggttcaatacaatttcaagaagatcacggtggtgcctagtgcgactgatttcatcaatatcatcctttctcgcacccagcggcagacgcctactgttgtccacaaggggtatgctatatcgcggctccgtcagttttacatgcgtaaggtgaagtacactcaacagaattttcacgacaagctctcgaccatcattgaggagttccctcggctggatgacatccatcctttctatggcgatcttcttcacgtgctttacaacaaggatcattacaagctcgctctgggggcaatcaatactgcaaggaatcaaattggaaaggttgctaaagactatgtgaagctactgaagtatggagactcgctctatcgctgcaagtctctgaaggttgctgctcttggacgaatgtgcaccctggttaagaagcttagtggcagtttggcttacttggaacagattaggcaacacatggccaggctaccttcaattgacccgaatactcgcacgctcttgatttgtgggtaccctaatgttggcaagagctctttcatgaacaaaattacaagggctgatgttgatgtgcagccatatgctttcacaacaaaatcactctttgttggtcatactgactataaatatctcagatatcaagtcattgacactcctgggattctggaccgtccctttgaagaccgtaacataattgagatgtgcagcataactgctttggcccatctacgttccgctgtcttgtttttcttggatatatcggggtcttgtggttacagcattgcgcagcaagcagctctttttcatagcatcaaatctctgtttatgaacaagcccttgatgatagtctgcaacaagactgatctgcaaccactggagggtctctcagaaggggacatgaaattggttatggagatgaaagctgaagctatgaaaacggtaataggtcaaggaggtgaagccacagatgacgagggagtgttgctgactatgagtactttgacagaggacggagtaatggctgtaaagaatgcagcttgcgggaggttgttgaatcagagagtggaaataaagatgaaatcaaagaagataaatgattgtttgaacagatttcatgttgcaataccaaagccacgtgaccaaaaagaacgaccggcatgcatacctcaggcagtattggaggctagagctcagcaagcagcagaaaaggagaagaggaaaactgaaagggatttggaggatgagaatggtggtgcaggtgtatactctgctagtttgaagaagaactacatcttagctaatgaagagtggaaagaagacatattgccagaaattcttgatgggcataatgtggctgactttatagatcctgatattctaatgaggcttgaagagctggaaagagaggaaggaatgcgccaggttgaggatgatgaagattttgagatggatgggaaagacttgacaccagaagagcaagaagcattggctgcgatcagaaagaagaaaagcatgctcatacagcagcacagggtgaagaaaagcacagcagagagtaggccaactgtcccaagaaagtttgacaagagccgtgaattcacaaccaaaaggatgggcaggcagctatcatctttgggactggaccccagcttggcaattgagcgggcccgcagcagatcaaggggccggaaaagggagaggtcacctgagaggggtgatgctatggatgtggatacagatgagtccaataagaagttgcgaacaaggtctagatcccggtctaggtcaatgtccagaccacctactgaatttgttcctggagcaggtttcaaggactccgaacaaaaggtcaaagctataaaacttgcaaagaaatctgtcaaaaagagaaacaagaatgctcgtcggggagaggcagacagggttattcctaccctcaaaccgaagcacttattctctggcaagcgctcaattggaaaaaccgacaggcgataaatctcagggaggttctcattttcatctcctgcaaagttttgatcagcatctgttgtcagttgctttcttgttcctgccggtgtgaggtttgtgccctatgagttgcagatcgacatcttagacgtggttccaaagggtccttagcaggaacggatgtttatgccgttgcttctattgtaggttatcttgattccaaatttgttttctatgtttgtccaagagttctgaaccttgttatacattattatgttcccttgctttgctttatgaggaaacctgaggaaaatttgagcactctgcgcgtgatcttttctacaaagtgcaattggcaccattttgctttatcggaaaaatgcagggtcatctactaacccttgctgtcactgttattgtgtcaactctctatgttgagcagaagcgcgatctctcatcgtccatgaagtgtcaatttgatgatgttggcagggattatttgagaaagtgtaatgctcttcattgatttcaaaagacccatcaagcttccgacttcttgtgggctggaaaataacgagcgtcatggaatttggatggagggacatagacaccatgtctagattgtagccctcaagaatcacgaggacttcactttccatattttacattctgctttgcgatctaccaattatttctatttacctcctcaaacattaacttggagccaattgcgctttgtaatattgtgaaattcaacatgggactttttaaattttaacgctcgacccccgcgaactctg

SEQ ID NO: 1149 - DNA, 3029 bp, Mimulus guttatus
aaatctgggtgaacttggaatgatcagtttgtttcgtgcatgttcatcaatatcatcaaaggctactagccttcttcttacgaaaagcccgtctagcaaacattttttccaaagttcggctgttagaacagtaaacttggaattgttgtcagcaaaacttcagttccagtgctattcatcgaaaagttctcgtaaggggaaaaccgttcttgaaccaataatgaaagaagacaaggaatcgtttttcgttgtgcgcaagggtgatcttgttggtgtttacaaaagcttaagtgattgtcaagctcaagtcggaacctcgatatgcgatccacctgtcagtgtgtacaaaggtaactccatgccaaaggacacagaaaagtatctaatctcttgtgggcttaagaatgctctttactccattagagcttctgatcttaccgaagaactttttggcactctcgtctcctgccctttacagtttctgatgcatcacaatctgatatgttgtttgaaaatatgaagctcgaatgggggactgacagtaaaaaaaacgggcggagatatactcttgaagattctctctctctctctcattccgcctccaccgttttagcggaaggcattgagcttcgtctttcgttccgccgtcgccgtctgattaccggtcgaagttcttcagctaattcgttgttgaagaaaaagtattaagacatggtgcagtacaatttcaagaagattaccgttgttccaacgggaaaggattttatagacataattctgtctcgtacgcaaaggcgtacgcccacccaagtccacaagggatatgccatttcacgtcttcgccagttctacatgcgtaaagtgaaattcacgcagacgaattttcacgaaaagctttccaccataatcgaagagttccccaggcttggtgacatccatcctttctacggcgatcttctccatgtgctctacaacaaagaccattacaaactcgccctcggccaaatcaacaccgcaagaaacctgattggcaagattgcaaaagactacgtcaaattgttgaagtatggagattctctttaccgatgcaagtcgctgaaggttgctgctctcggtcgtatgtgtactgtgataaaaagagtcagccctagtttggcttatcttgaacagatccgacagcatatggcaaggctaccttcgatcgatccgaacactcggactatcttgatctgtgggtacccgaatgttggcaagagctcattcatcaacaaaattacgagggctgatgtcgatgtgcaaccgtatgctttcaccacaaaatctttgtttgtcggtcataccgattacaagtatctgaggtatcaagtgattgatactcctgggattttggataggccgtttgaggatcgtaatattattgagatgtgcagtattacagctttagcccatttgagagctgctgtactgtttttccttgatatttccggttcttgcggatatacgattgcacagcaggcggctctattccatagcatcaagtcgctgtttatgaataaaccccttaccattgtttgcaacaagactgacttgcagccgttggatgggatatctgaagaggacaagaaactagtcatggagatgaaatccgaagcaatgaaaacggtgataggtcagggtggtgaaccgactgacgataacggcgtactcttgacaatgagcactttgacagaggatggtgtaattgctgtaaaaaacgcagcttgcgagcgattattggaccagagggtggaactgaaaatgaagtccaagaagttgaacgactgcctgaaccgcttccatgttgccatgccgaagccacgcgatcacaaggaaaggccaccgtgtatacctcaggccgtcttggaagccaaagccaagaaagcagaggaaactgcagagaaggagaagaagaaactggagagagatatcgaaaacgagaatggtggtgctggtgtgtattccgcaagcttgaagaagcactacatgctagcaaacgacgaatggaaagaggataacatgcccgagattcttgatgggcataatgtgtacgacttcatcgaccccgatattttgatgaggctcgaggagttggagagagaagaaggcactctccaaggtcttgaggaagacgatgatttcgaaatggatggagctgagttaacacccgacgaacaagctgcacttgcagagattaggaagaagaagagtctacttatccagcagcatcggattaaaaagagcacagctgagagcaggccgattgtgcctaggaaattcgataaggatgggaaatttacgtcggagagaatggggagacagctgtcatctcttggacttgatccgtcaaaggctattgaccgtgctagaagtaaatccaggggtcgtaagagggagagatctgttagtcaagttgactcgatggatgttgatggtgataattcgaataagaagatgaggctgaggtccagatcggcgtctaggtcttcgaggccacctggcgaacttgttcctggtgaagggttaagagacactgcgcagaagaagaaggctattaaattggcgcagggctctagcaagaacaggaataaggatgctcgtaaaggagaggccgatagagttattcctactctcagacctaagcatttgttctctggcaagcgctctaaaggaaagactgacaggcgttagtggaattctcgagaggaaatcgatattttacaatatacaacagcctatggagggtcgtatactggaagctgtaacggatgggttgtggaacttttgtgttttatttgataatttattggttagatcgttttatttttttacgttaaatagaattttgccccttgagacggtttattgtttttattgtactgaaattttgagactttgttttgtcggaatcgtgatgattaggacgtttgttataatgaagctgttgcagaagcaaaatgtgtgagctcagtgagcttgtctggatgtttgtt

SEQ ID NO: 1150 - DNA, 2349 bp, Ricinus communis
agacagggccgctaaagagccccaaacatccagagattcaggtttcaagaggataatataaaagatggttcagtataattttaagaagatcactgtggtccctagtgggaaggacttcgttgatatcatcctttctcggacccaaagacaaacaccaactgttgtccacaagggatatgccatttctcgtctgcgtcaattttacatgcgtaaagtcaagtatacccagcagaattttcatgaaaagctctctacgattattgatgagttccctcgcctggatgatattcatccgttttatggcgacctccttcatgttctttacaataaagaccattacaagcttgcccttggccaaattaacactgccaggaatcttattagcaagatagccaaggattatgtgaaattgttgaagtacggtgattcgctgtataggtgcaaatccctgaaggtagctgctcttggtcgcatgtgtactgtgattaagaggattggccctagtttagcttatcttgagcaaattagacagcatatggcaaggctaccttcgattgatccgaatactcgtaccatcttgatttgtgggtatcctaatgtaggcaagagctctttcattaacaaaatcactagggctgatgtggacgttcagccttatgcttttaccactaagtcactctttgtaggtcatactgactacaaatacctgaggtaccaagtgattgatacgccagggattttggatcgaccatttgaagatcgtaatatcattgagatgtgcagtattacagctctcgcccatctacgagctgctgtattgttcttcttggatatctctgggtcatgtggctacagcattgcacaacaagctgctctgtttcatagtatcaagtctctttttatgaacaagcccttgattattgtctgcaacaagacagatttgcagccattggaagggatatctgaggaagacagggaattggtcatggagatgaaagcagaagctctgaaaactgtgattggtcagggaggtgaagctacaggtgatgagggtgttcttttgaaaatgagcactttgacggaggaaggggtgattgctgtgaagaatgcagcttgtgagaggttactggatcagcgagtggaattgaagatgaaatctaaaaagataaatgactgcttgaataggttccatgttgcaataccaaagccacgtgaccagaaagaaaggccaccttgtatacctcaagcagttttggaagctaaagcaaagcaagcagccgaggcagctgagaaggagaagagaaaaaccgaaaaggatctggagaacgaaaatggtggtgcaggtgtatactctgccagtttgaggaagaagtatatcttagccaatgatgaatggaaagaagatgtcttgccagaaattcttgatggccacaatgtttatgacttcattgatcctgatgtcttagaaagacttgaggagttagaaagagaagagggtattcggctagcagaggaggaagatgaggattttgagatggatggtgaggaattgactccagaagagcaagaagctttggcggcgatcaggaaaaagaaaaccttactcattcaagagcataggatgaagaagagcactgcagagagtcggcccactgtacctagaaaattcgacaaggacaggaggtttacaacagatagaatgggtagagaccttaaatctgtggggctggatccctctttggcaattaatcgtgtccgcagcaggtcagtatcgaggggccgcaaaagagagaggtctcttgccagggaagataaagatggtggtgatgcaatggatatggatgttgaccaaccaaataagaagctaagactagctatatctcggtcaaggtcgaaatcacggcctcctactgaggttgtacctggagagggtttcaaggattcagctcagaaaattaaaggaattaagcttcataagaaatctgctaaaaagaggaataaggatgctcgccggggagaagcagatagagttattcctactgagagacctaagcatttgtatactggaaaacgtggcattggaaaaaccgatagacgttgatcacttaagagaaaggcggtcttatggagggtatactgaaccatggactgactttgctgcttatatgtcatttaatgttcaacgtactgctttgattgtggcagtgaatgaagtcttttattttaatccttaaagcaaattttgaatgagatgtttttatttcatatattgtgacgtttggttctgaacggtacttttacatcggctgctgctcttttattatttaaacgtgagaaaattttggagta

SEQ ID NO: 1151 - DNA, 2192 bp, Citrus clementina
taaaaaatggtgcaatataactttaagaagattaccgtggtacccaatgggaaagacattgtcgacattattctatcccgtactcagcggcaaacaccaactgttgttcacaaagggtattccattactcgtctccgtcagttttacatgcgtaaggtgaaatacactcaacagaatttttttgagaagctatctacaatcatagatgagtttcctcgcctagatgatatccatcctttttatggagatcttttgcatgtcctttacaataaggatcattataaacttgcacttggccaaataaatactgcaaggaaccttattagcaagattgctaaagactatgtgaagctgttgaagtatggtgattcgttgtatcgttgcaagtcgcttaaggttgctgctcttggccgtatgtgtacagtggtgaagagaataggccctagtttggcttatttagaacagatcagacaacacatggcaaggttgccttcaattgacccaaacactcgtacaatcttgatttgtgggtaccctaatgttggcaagagctcatttatgaacaagatcacaagggctgatgttgatgtacagccttatgcttttactacaaagtcactctttgtaggtcatacagattataagtacctgaggtatcaagtgattgatactccagggatcttagatcggccttttgaggatcgtaacattattgaaatgtgcagtataacggcgctggcacatctacggtctgccgtattgttcttcttagacatatctgggtcttgtggttacagtattgctcaacaggcagctcttttccacagcattaagtctctgtttatgaataagcccttgattattgtctgcaacaagactgatttgcagtcgctggatgggatttcggaggaagacaagaaattggtcatggagatgaaagctgaagcaatgaagactgtgatgggtcagggaggtgaagttggtgatgatgagggagtgctattgacaatgagcactttgaatgaagagggggtagctgctgtgaagaatgcagcttgtgagaggttattgaatcaaagggtagaattaaagatgaaaaccaaaaagataaatgactgcttgaatcgctttcatgttgcaataccaaagccgcgtgaccagaaggaaagaccaccttgtatccctcaggcagttttggaagctaaagctaagcaagcagctgagaaggagaggaggaaaactgagaaagacttggaggatgagaatggtggagctggtgtatattctgctagtttgaagaagaattatatcttggctaatgaagaatggaaagacgatgtaatgcccgaaattcttgatggtcacaatgtgtatgactttgttgatcctgatatcttattgaggcttgaagagctggaacgagaagaaggtcttagggaggaagaggaggaagacgatgattttgaaatggatggcaaggagctgacgccagaagagaaagaagcgttggcagagatcaggaaaaagaaaagcttgctcatccaacagcacaggatcaagaaaagcactgcagaaagtcggccctctgtaccaagaaagttcgataaagacaagaagtttacaactaagagaatgggtaggcagctatcctctttgggattggatccctctatggctatcgatcgtgcccgaagcaagtctaggggtcgcaaaagggagaggtctgttgacaggggagacaaggataatggtgatgctatggatatggacatggaccaacctaacaagaagttgaggttgaggtcaatgtcccgacctcggtcaaggtcaaggtcacggcctccaagtgaagttgcccctggtgaaggcttcaaggattctgctcaaaaggttaaggcgattaaactcggcaaaaaatctgttaagaagaggaacaaggatgctcgtcgtggagaagctgatagagttattcctacactgaagccaaagcatttattctctggaaaacgttccattggaaaaactgacagacgttgaaatgtttaagagaagaatgttctatgtattgcatcgcgggattgaaacttttgagcaatcaatatggcttcccttattatggagaatggtttctgtgttgcagtggtgcacatacaatggaattgtacttgccattgactgaactgtctagagat

SEQ ID NO: 1152 - DNA, 2522 bp, Aristolochia fimbriata
cgtctctcttttgcatcgagcgcaggaaggtcaagaccgttgtgtctggccggcgaatgtgttctgatatctactggcgagactcgttatcttgttgtccgaatcggtttctcaacttcgcaagagaatttggtgcagttatttttatataagtattgctagttaagcccattcaaaatggtgcaatacaatttcaagaagatcactgtggttccttctggcaaggacttcattgatattatcctttctcgcacacagcgtcagaccccaactgttgttcacaaaggctactcaatttcccgccttcgccagttctacatgagaaaggtcaaatacactcaacagaatttccatgaaaaactttcgttaattattgatgaattccctcgattggacgatatccacccgttttatggtgacctcctgcatgttctctacaataaagaccattacaagcttgccctcggtcagatcaacactgctaaaaacataattggtaaaatagccaaggattatgtgaggctcttaaagtatggggattctttgtacagatgcaagtgcctcaaagttgctgcacttggccgtatgtgcacggtagtaaagcgcattggccccagtttagcatatctagagcagattaggcagcacatggctaggctgccttcaatagacccaaacacaaggactgtcttgatatgtggctatccaaatgttggtaagagctctttcatcaacaagatcaccagggctgatgtggatgttcaaccgtatgctttcactacaaaatcactttttgtgggtcatactgattacaaatatttaaggtaccaagtgatagacacacctggaattttggatcggccctttgaggacagaaacataatagaaatgtgcagcatcacagcgttggctcatctcagagctgcagtattgttctttctagatgtctctggatcttgcggctacagtattgctcagcaggcagctctctttcacagtattaaatcactttttatgaataaaccactgataatagtttgtaacaagatagatttgcagcccttggatagtctttctgaggaagacctgaaattagtttcagagatgaaggctgaagctgcaaagactctgattggtcaagggggtgaggttgatgaggctggggttctgttgtccatgagcaccttgactgatgaaggtgtgattgctgtgaaaaatgcggcatgtgagaggttgttgaatcaaagggttgacataaagatgaaatcgaagaagatcaatgactgtttaaaccggttccatgttgcaattccaaaacctcgagatggcaaagaacgacctctatgcattcctcaggctgtccttgatgccagagaaaagaagattgagaaggagaagaggaagctggaaagggatttggaagaggagaatggtggggctggcgtttactctgccagtctcaggaaacactatatcttggcagatgatggatggaaggaggatattatgccagaaattttagacggacacaatgtttatgactttgtcgatcctgatatactgcagaggcttgaggagctggagagagaagaggggcttcgtcaggtagaggagaatgaggacgaagattttgagatggatgggaaattactcactccagaagagctggaagcactggctgagattaggaagaagaagagtttgctcattcaagaacacagaatcaagaaaagcaccgctgaaagcaggccaattatacctagaaaatttgataaagaccgaaaattcacacacgcgagaatgggtaggcaactctcgtcgttggggttggatcctactgctgctatcaatcgcgcccggagccggtctgtttcgaggggtaggaagagggagagatctcctgttagaaatgatgcagctgatgctatggatattgattccgaacggtcgaacaagaagaagaagatgcggtcatcatcgctttctatggcacggtcaaggtcacgatctcggcctcctggcgaagttgtaccaggggagggattcaaggattcggcccaaaagattaaggctgttaagctgggtaaggaatcggtcatgaaaagaaacaaggatgctaggaagggagaggctgatagagtcattcctaacctgaaaccaaagcatctattctcaggcaaaaggtcaattgggaaaaccagtcgccgttgatgttatatgttctatgtggatcggcgttgatgttatttgttcttgcatttgcagttttgctggtatcaaattttggttgaagtctttgtcgttttactgaaaaatttgtctttgaaatatatcaatttgtctttgtcgtttctatttactggctgatctctgcctgatactagtgactggctgaatgtagttggttttctgtcactccttgatatgcaaccatgcaactactagtaaaattgtgcttctcagagtgaccatggaatagcttcggctctttgaccatgttgcaggcttccctcaatttgtag

SEQ ID NO: 1153 - DNA, 2365 bp, Manihot esculenta
agccttctctcctttccttaaaccctagacagggccgctgctgagcccagcaccacactacgtcacaagaaagaataaactaaataagatggttcagtataattttaagaagatcactgtggtcccaagtgggaaggacttcattgacattatcctctctcgaacacaaaggcaaacaccgacggttgtccacaagggatatgccatttctcgtctgcgtcagttttacatgcgcaaagtcaagtacacccagcaaaattttagtgagaagttgtctacaattattgaggagtttccccgactggatgatatccatccattttatggtgacctccttcatgtcctttacaataaagaccattacaagcttgcccttggccaagtaaacactgccaagaatctcattagcaggatatcaaaggattatgtgaaattgttgaagtatggtgactcactatatcggtgcaaatctctgaaagttgctgctcttggtcgcatgtgtactgtgattaagaggattggccctagtttggcttatctggagcaaataagacaacacatggcaaggttaccttcaattgatcccaatactcgaactatcttgatttgtgggtatcctaatgtaggcaagagttctttcattaacaagattactagggctgatgtggatgtccagccatatgccttcaccactaagtcactttttgtgggtcatacagactacaagtacttaaggtaccaagtcattgatacaccagggattctggaccgaccttttgaagatcgtaatatcattgagatgtgtagtatcacagctctggcacatctacgagctgcggtgctgttcttcttggacatctcagggtcctgtggttatagcattgctcaacaagctgctttattccatagtatcaagtcactctttatgaacaaacctttgataattgtctgcaacaagactgatttgcagccgcttgaagggatatcagaggaagacatgaaattaatcatggagatgaaagcagaagctttaaaaactgtgattggtcaaggaggtgaacctacaaatgatgagggtgttcttttgacaatgagcacattgactgaggagggggttattgctgtgaagaatgcagcttgtgagaggttactggatcagcgagtggaattaaagatgaagtcaaaaaagataaatgactgcttgaatcggttccatgttgcaataccaaagccacgtgaccagaaagaaaggccaccttgtatacctcaggcagttttggaagctaaggcaaagcaggctgcgcaggcagcagagaaggagaagagaaaaaccgaaaaggatttggaagacgaaaatggtggtgcaggtgtatactctgcaagtttgaggaagaattacatcttagccaatgaagaatggaaagaagacatattgcccgaaattctggatggtcacaatgtttatgacttcattgatcctgatatcttacagagacttgaggagttagaaacggaagaaggtattcggcaagcagaggaggaaaatgaggatttctcaatggatggtgaggaattaaccccagaagagcaagcagctttggctgagatcaggagaaagaaaagcttgctcattcaagagcataggatgaagaagagcactgcagaaagtcggtctattgtacctagaaaatttgacaaggacaggaagttcacaacagagagaatgggcagacagctttcggctttggggttggatccttctcatgcaattaatcgcgcccgtagcaggtcactctctaggaggggccgcaagagagagaggtcacttgacagaggggataatgatgctggtgatgccatggacatggacgttgaccaacaaaataagaagctgcgaatgagatccagatctcggtcaagatcgaaatcacggcctccaagtgaagttgtccctggagagggcttcaaggactctactcagaaggtgaaagccctcaagcttgctaagaaatctgttaaaaagaggaataaggatgctcgtcgtggagaggcagatagagttattcctagtcttaaacctaagcacctgttttctgggaagcgttccattggaaaaacccaaagacgctgatcattcaaggggaaggcctgattacctttgcgttatactggactatggattgacacatggattgtattttctgtacacatgccttatcatttattcaatttacagcggtgtttgtactgtggcagtgaatgagttgtttgtttaatctttgtcttctaattcgattttgaatgagattttaatttttatatatttttatcacttttgaatttggaaaattaatgttctaagctc

SEQ ID NO: 1154 - DNA, 2187 bp, Manihot esculenta
ataatctacaagatggttcagtataattttaagaagatcactgtggtcccaagtgggaaggacttcattgacattatcctctctcgaacacaaaggcaaacaccaacagttgttcacaagggatatgccatttctcgtctgcgtcaattttacatgcgcaaagtcaagtatacccagcagaattttgaagagaagttatctacaattattgaggagtttccacggttggatgacatccacccattctatagcgacctccttcatgtcctctacaacaaagaccattacaagcttgcccttggtcaagtaaacactgccaagaatctcattagcaagatagccaaggattatgtgaaattgttgaagtatggtgactcactttatcgttgcaaatctcttaaagttgctgctcttggtcgcatgtgtactgtgattaagaggattggccctagtttagcttatctggagcaaataagacagcatatggcaaggctaccttcaatcgatcctaatactcgaactatcttgatttgcgggtatcctaatgtaggcaagagttctttcattaacaagatcactagggctgatgtggatgtccagccttatgctttcactactaagtcactctttgtgggtcatacagattacaagtacttgaggtaccaagtcattgatacaccagggattctggaccgaccttttgaagatcgtaatatcattgagatgtgcagtatcacagctctggcacatctacgagctgctgtacttttcttcttggacatctcaggatcatgtggctatagcattgcccaacaagctgctttattccatagtatcaagtctctctttatgaacaagcctttgatcattgtctgcaacaagactgatttgcagccccttgaagggatatctgaggaagacaagaaattagtcatggagatgaaagcagaagctatgaaaactgtgattgggcaaggaggtgaacctacaaatgatgagggtgtgcttttgacaatgagcactttgactgaggagggtgtgattgccgtgaagaatgctgcttgtgagagattacttgatcagcgagtggaattgaaaatgaaatctaagaagataaatgactgcttgaatcggttccatgttgcaatgccaaagccacgtgaccagaaagaaagaccaccttgtatacctcaggcagttttggaagctaaagcaaaacaagcagcacaggcagcagaaaaggagaagaggaagactgaaaaggacttggaagatgaaaatggtggtgcaggtgtatactctgcaagtttgaagaagaattacatcttagccaatgatgaatggaaagaagatgtattgccagaaattctggatggtcacaatgtttatgacttcattgatcctgatatcttacagagacttgaggagttagaacaagaagaaggtatccgacaagcagaggaggaaaatgaggattttgagatggatggtgaggaattgacaccagaagagcaagcagctttggctgagatcaggaaaaagaaaagcttactcattcaagagcataggatgaagaagagcactgcagagagtcggcccactgtaccaagaaaatttgacaaggaccggaagtttacaacagggagaatgggcagacagctttcagctttagggctggatccctctcaggcaattaatcgtgtccggggcaggtcactctctaggagaggccgcaaaagagagaggtcagttgataaaggagagaacgatgctggtgatgctatggatatggatgttgaccaacaaaataagaagctgcgaatgaagtccagatcacgatcaaggtcgaagtcacggcctccaagtgaggttgcccctggagagggatttaaggactctgctcagaaggtgaaagccctcaagattgctaagaaatctgttaaaaagaggaacaaggatgctcgtcgtggagaggcggatagggttattcctactctcaaacctaagcacttgttttctggcaaacgttccattggaaaaacccaaagacgctgatcattcaagttggctatgcttgctatcggctcttcatgtgaccggacgacccataattgttccggcagttgcaagtgcattagtcgtttcctctctatcggagaaagtggcttaaatttttttttttctttt

SEQ ID NO: 1155 - DNA, 2535 bp, Solanum lycopersicum
agtctcaaccgtatagtgcaaattgagattataaaagatggtgcagtacaattttaagaagattacagtggttcctaatgggaaggactttgttgatatcattctgtctcgcacacaacgtcaaactcctactgttgtgcacaaaggatatgctatctctcgtatacgtcaattttacatgcgcaaagtgaaatatacgcagcagaatttctatgacaagctctccaccattattgatgagttccctaggcttgatgacatccatcctttctatggggaccttcttcatgttctctacaacaaagaccattacaagcttgcccttggccaaattaatactgctagaaatttgatttctaaagtagctaaagattatgtgaaattgttgaaatatggtgactcactctaccggtgcaagttcctgaaagttgcggctcttggacgtatgtgcactgttataaagcgcattggcccaagtttagcttatttggagcagattaggcagcacatggcaagacttccctcgattgatcccaatactcgaaccatcttgatttgtggatatccaaatgttggaaagagttcattcattaacaagattactagagcagatgtggatgtgcagccttatgccttcactaccaagtccttgtttgtcggccatactgactacaaatatttgaggtatcaagtgatcgacactccagggatcttggataggccatttgaagatcgtaatatcatagaaatgtgcagtattacagctcttgcacatctgagggccgctgtgttattttttcttgatatttctgggtcttgtggctatagcattgcgcaacaggctgctcttttccacagcatcaaatcactttttatgaacaaaccgttgatgatcgtatgcaacaaaacggacttgcagccgttagatgggatttctgaggaagataagaagttagtcacagagatgaaagacgaagctatgaagacagtgataggtcaaggtggcgaggcaacagatgaagcaggtgtgcttttaactatgagcactttgactgaagatggtgtaatttcagtaaagaatgcagcttgtgagaggttattgaatcaaagggtggagttgaaaatgaagtcgaaaaagttgaatgactgcttgaaccgtttccatgttgctatgccaaaaccacgtgaccagaaagagaggccaccatgcatacccgaggcagtgttggaagccagagcgaagcaggccgaggcagatgctgagaaacagaaaaagaagcttgagagagatctggagaatgagaatggaggtgctggtgtttattccgcgagcttgaggaagcactatctattagcaaatgaagagtggaaggaagatataatgcctgaaattttagatgggcacaatgtctatgactttgttgaccctgatatcttacaaaggcttgaagaattagagagagaagaaggtcttcgtcaggaagaagaaggagatgatgattttgagatggacggtgcagagcttacccctgaagaaaaagcagcattagctgaaatccggaaaaagaaaagtttgctcattcaacaacatagaatgaagaagagcaccgcagagagccgacccactgtacctagaaagtttgataaagacaaggagtttacttcaaaaagaatgggaagacaattatctgctttgggattggatccaactctagctatcaatcgagcccgaagtaaatcaaggggtcgtaagcgagagagatcagttgaatgtggagatgacattggtaatgatgcaatggatgtagacgagattactcctagcaagaagcaacgtagatctagatcactttccatgtcaagatcaaggtcaatgtcacgacctcgaagtgaatttgttccaggggagggcttcaaggacaaaccccagaaggaaaaggctataaagatgtttaagaattctgctaataagagaaacaaggatgctcgacggggagagtctgatagagtcattcctactctgaaaccaaaacatctcttctctggtaagcgatcaagtggcaaaactgacaggcggtagtcaccagatgtgtggtcatgaaatttgctgatgcatgaagatgctttttgtttcaaaattttgggtggtggatggaagcacatacaaaaaaagaacctttgttggaatgccaattcacctcagcttattttgggctctctgttgtgcaattttggaacttaatttttattttaccttaacataagatatacgcaacatgtcaagactcaaccttttgttatggcaacacaagactacagatttttaagtatttaaatttgagtttgagatgcagctctgttttgctgccttgttaactagttgttcatataatattatacttttgttatgttttaatcattgaattctttatacaatggaacactacaaaggcaatagtctttattaataaccataactaaatcgatacttactagttactacacccttttgtctcacgtgaggtagattgactc

SEQ ID NO: 1156 - DNA, 2377 bp, Solanum lycopersicum
atggtgcagtacaattttaagaagattacagtggttcctaatgggaaggactttgttgatatcattctgtctcgcacacaacgtcaaactcctactgttgtgcacaaaggatatgctatctctcgtatacgtcaattttacatgcgcaaagtgaaatatacgcagcagaatttctatgacaagctctccaccattattgatgagttccctaggcttgatgacatccatcctttctatggggaccttcttcatgttctctacaacaaagaccattacaagcttgcccttggccaaattaatactgctagaaatttgatttctaaagtagctaaagattatgtgaaattgttgaaatatggtgactcactctaccggtgcaagttcctgaaagttgcggctcttggacgtatgtgcactgttataaagcgcattggcccaagtttagcttatttggagcagattaggcagcacatggcaagacttccctcgattgatcccaatactcgaaccatcttgatttgtggatatccaaatgttggaaagagttcattcattaacaagattactagagcagatgtggatgtgcagccttatgccttcactaccaagtccttgtttgtcggccatactgactacaaatatttgaggtatcaagtgatcgacactccagggatcttggataggccatttgaagatcgtaatatcatagaaatgtgcagtattacagctcttgcacatctgagggccgctgtgttattttttcttgatatttctgggtcttgtggctatagcattgcgcaacaggctgctcttttccacagcatcaaatcactttttatgaacaaaccgttgatgatcgtatgcaacaaaacggacttgcagccgttagatgggatttctgaggaagataagaagttagtcacagagatgaaagacgaagctatgaagacagtgataggtcaaggtggcgaggcaacagatgaagcaggtgtgcttttaactatgagcactttgactgaagatggtgtaatttcagtaaagaatgcagcttgtgagaggttattgaatcaaagggtggagttgaaaatgaagtcgaaaaagttgaatgactgcttgaaccgtttccatgttgctatgccaaaaccacgtgaccagaaagagaggccaccatgcatacccgaggcagtgttggaagccagagcgaagcaggccgaggcagatgctgagaaacagaaaaagaagcttgagagagatctggagaatgagaatggaggtgctggtgtttattccgcgagcttgaggaagcactatctattagcaaatgaagagtggaaggaagatataatgcctgaaattttagatgggcacaatgtctatgactttgttgaccctgatatcttacaaaggcttgaagaattagagagagaagaaggtcttcgtcaggaagaagaaggagatgatgattttgagatggacggtgcagagcttacccctgaagaaaaagcagcattagctgaaatccggaaaaagaaaagtttgctcattcaacaacatagaatgaagaagagcaccgcagagagccgacccactgtacctagaaagtttgataaagacaaggagtttacttcaaaaagaatgggaagacaattatctgctttgggattggatccaactctagctatcaatcgagcccgaagtaaatcaaggggtcgtaagcgagagagatcagttgaatgtggagatgacattggtaatgatgcaatggatgtagacgagattactcctagcaagaagcaacgtagatctagatcactttccatgtcaagatcaaggtcaatgtcacgacctcgaagtgaatttgttccaggggagggcttcaaggacaaaccccagaaggaaaaggctataaagatgtttaagaattctgctaataagagaaacaaggatgctcgacggggagagtctgatagagtcattcctactctgaaaccaaaacatctcttctctggtaagcgatcaagtggcaaaactgacaggcggtagtcaccagatgtgtggtcatgaaatttgctgatgcatgaagatgctttttgtttcaaaattttgggtggtggatggaagcacatacaaaaaaagaacctttgttggaatgccaattcacctcagcttattttgggctctctgttgtgcaattttggaacttaatttttattttaccttaacataagatatacgcaacatgtcaagactcaaccttttgttatggcaacacaagactacagatttttaagtatttaaatttgagtttgagatgcagctctgttttgctgccttgttaactagttgttcatataatattatacttttgttatgtttt

SEQ ID NO: 1157 - DNA, 2670 bp, Populus trichocarpa
ttctttcttaaaccctagagagagagggcctcctgcttgcggcgctcccttcttcttcctctcttgctcccggcaagaatagaaagagtacaaagatggtgcagtataattttaagaagattacagtggtccctaaagggaaggattttattgatatcatcctttctcggactcaaaggcaaacaccgactgttgtccataagggttatgctatttctcggctccggcagttttacatgcggaaggtgaagtatactcagtcgaatttccatgagaagctttcgacaatcattgatgagttccctcgtcttgatggtatccacccgttttatggcgacctccttcatgtgctatacaataaggatcattacaagcttgcccttggtcagattaatactgccaggaatcttattagcaagattgctaaagattatgtcaagttgttgaagtatggtgattcgttgtatcggtgcaagtctttgaaggttgctgcgcttggccgaatgtgcactgttattaagaggattggcccgagtttagcttacttggagcaaatcagacagcatatggcaaggctaccttcaatagatccaaatacccggacagtcttgatttgtgggtatcctaacgttgggaagagctctttcatcaacaagatcaccagggcagatgtggatgttcaaccttatgcattcactaccaagtcactctttgtaggtcacacagattacaagtatctgaggtaccaagtgatagatacaccggggattttggatcggccttttgaggatcgtaacattattgagatgtgcagcatcacagctctggcacatcttcgagctgctgtgttattcttcttggatgtctctgggtcatgtggctatagcattgctcaacaggctgctttatttcatagcattaagtctttgtttatgaacaaaccgttgaccatcgtctgcaacaagactgacctgcaaccacttgacgggatttctgaggaagacatgaagttggtcatggagatgaaatcagaagctatgaagactctagttgctcaaggaggtgaagctaccaatgacgctgatgttcttctgaccatgagtaccttgactgaggatggggtgattgctgtgaagaatgctgcttgcgagagattgttgaatcagcgagtggaattgaagatgaaatccaaaaaaataaatgactgcttgaatcggttccatgttgcaatgccaaagccacgtgatcaaagggaaaggccaccttgtatacctcaagcagttttggaagctaaagcgaaggaggcagcagagaaggagaaaagaaaaacagaaaaggatttggaggatgagaatggtggtgctggtgtatactctgccagtttgaagaagaattacatcttagccaatgatgaatggaaagaagatgtactcccagaaattcttgatggtcacaatgtgtatgacttcattgatcctgatattttgcaaaggcttgaagagttggaaagtgaagaaggtatccgacaggcagaggagggagatgaagattttgagctggatggtgaggaattaaccccggaagagaaagaagcattgtctgagatcaggaaaaagaaaagcttgctcattcaagagcatagaatgaagaaaagcactgcagagagccggcccactgtacctagaaaatttgacaaggacaggaagtttacgacaaaaaggatggggaggcagctgtcagctatgggagtggatccttcgaaagcaattactcgtcttcgtgagaggtcactctcgaggaagggccgcaaaagagagagatctacatctcgctctaggtcgaggtcacggcctccaggtgaggttgttccaggagagggcttcaaggactcggttcaaaaaaacaaggcccttaagcttttcaagaactctgctaaaaagaggaacaaggatgctagacgtggagaggcagatagagttattcctacactcaaaccaaagcatttgttttctgggaaacgttctattggaaaaactgaaaggcgttaaatactcaagggattgttggttgatttttgctactgagtatactgaaccatgtggcgtgcttcagtgcttgctgttcaaggcaattttgagagagatttaattatacgtttgctgctaggttctgaacctcactggataatgtattttcttcgattgcttttctataatttgtatacagaggatatttgagatttgttcgggtgagctccgttgctgctaggttctgctcctctctctgtgaattttgccagcttcttcaatttcactgcttaccttttgctcttgcccactgttcacatggagatatgttcgtctttatatatttaattttgtcgcaagtgccttttcatttcatgtgggcttttacttgattaggattggagtttaccatttcgagtttggccattttttaccatttcttcctttgttttcttcatcgtgaaatcgataaaagtgcctccacataccacagcggttgcaggtttgttttgccaatttacccgagttgcttggttatgtcattccttgtgggattcttaaagtttattgccccaaattaaactccctggagttgagacaagatgtatagagaagacagcgcatctctaatttaggatgttct

SEQ ID NO: 1158 - DNA, 2575 bp, Euonymus alatus
atcgcaattctcttaaaccctagtcggctactagggtcgccgacggagtccaagggtcacggttgatatataaggatggtgcaatataattttaagaagattactgttgtccctaatgggaaggacttcattgatatcatcctttctcgcacacagaggcagacaccgactgtagtccacaaaggatatgccatttcccgactccgtcagttttacatgcgtaaagtcaaatatacccaaacgaattttcacgagaagctttctactatcattgatgaattccctcgcctagatgatatccacccattctatggtgatcttcttcatgttctttacaacaaagaccattacaagcttgcacttggccaagtaaacactgcaaggaatcttatcagcaagattgctaaagactatgtaagaatgttgaaatatggagattcgttataccgatgcaagtgtctgaaggttgctgctcttgggcgaatgtgcactgtgataaagaggatcgggcccagtttggcctatttagagcagatcaggcaacacatggcaaggctgccttcaatcgatccaaatactcgaaccatcctaatatgtgggtatccaaatgttggaaagagttcattcatcaacatgatcacaagggcagatgtagatgtccagccgtatgctttcaccacaaagtcgctatttgtaggtcatacagactataagtatcttagataccaggtgatcgatactcccgggattcttgatcggccatttgaggatcgtaatattatagagatgtgcagcattacagctctggctcatctgcgagctgctgtgttgttcttcttggacatctcagggtcttgtggctacagcattgcccagcaggctgctctttttgacagcatcaagtctctttttatgaacaaaccgttgataattgtctgcaacaagactgatttgcagcctctggaagggatttcagaggaagacatgaagttggtcatggagatgaaggctgaagccatgaagactctagtaggtcaaggaggtgagtccacagatggtgagggtgtgctgctgaccatgagcactttgacggaggagggggtaatgtctgtaaagaacgccgcttgtgagagattattgaatcagagagtggaattgaagatgaaatccaaaaagatgaatgactgtttaaatagatttcacgttgccataccaaagccacgtgatcagaaggaaaggccaccttgcatacctcaggctgttttggaagctaaagccaagcaagcagcagagaaggagaagaggaaaactgaaagggatctggaggatgagaatggtggcgcgggtgtatatgctgctaatttgaggaaaaattacattttagcggatgatgagtggaaagaagacatcctgccagaaattcttgatggtcacaatgtgtatgactttgtggatcctgatatcttacagaggcttgaggagttggaacaagaagaaggtattcggcaggcagaggatgatgatgatgattttgagattgatggcaaggagttgaccccagaagagcaagcagcactggctgagatcaggaaaaagaaaagcttgctcattcaacagcataggataaggaaaagcactgcagagagtcggcccactgtaccaagaaaatttgacaaggataggaaatacacgtcagagagaatgggcagacaactatctgctttggggcttgatccctctcgggcaattagtcgttcccgcagcaggggccgcaaaagggagagatctcttggcggggaaggcaacaatggtgttgatgcaatggatgtggaccagccaaacaagaagctgcgtactaggtctaggtctatgtcagtgtctaggtccacgtcacggcctccaggtgaggttgtaccaggagaaggattcaaggattctgctcagaagttgaaggctatcaaaattgccaagaaatctgtcaggaagaggaacaaggaagctcgtcgtggagaggctgacagagttattcctacacttaaaccaaagcatttgttctctgggaaacgctccagtggaaaaactgatagacgctagatatgtaaggaatggtgggctttcttgcagatgtattcgaatacctggaattgtgttcactgtttacaaagtatgtttttgttgcaattatcaagagacttggtttttttcggcttctaataatgttcttggaaagcagaaacttttgaagacattctctgggaatttttattgtcagtgtttttttttgaatggctttatgatgttttaagttgtatcttcaagactatttagagcatgtacccaattggaaaagtgaaaattttgagagtgtgtcactggagttgctattagtgcaagttcttattgattccgtactaggtttgatagattggattttgtggtaagccaatccatcattccattctgtttctctctgtcatagcgtggaaatgttgatttatattggggtggcagaacactgtacgaaagttatatgtctgaaatttagagggaataaagttttgattttgttcgatct

SEQ ID NO: 1159 - DNA, 2285 bp, Vinca minor
caaactcacataccgatctcaaactcaagtgaagtcatcaaaatggtgcaatacaactttaaaaagattactgttgtcccaagtgggaaggactttgttgatatcatcctctctcgtacacaacgccaaactcctactgtcgttcacaagggttatgccatctctcggattcgccagttctatatgcgcaaagtaaaatacacacagacaaactatcatgacaagctttccaccattgttgatgagttccctcggcttgatgatatccatcctttctacggggaccttctccatgtcctttataacaaggaccattacaagcttgcacttggacagattaatactgcgaggaacttaatcagtaaaattgcaaaggattatgtgaagttgttgaagtatggggactcgctgtaccggtgcaaggcgttgaaggttgctgctcttggtcggatgtgtacggtgatcaagcggattgggcccagtctggcttatcttgagcagatcaggcaacacatggcaaggcttccttcgatagatccaaacaccaggaccctcttgatttgcgggtacccaaatgttggcaagagttcgttcatcaacaaaatcacaagggctgatgtggatgtgcagccatatgccttcactacaaagtctctgtttgttggtcatacagactataagtacttgagatatcaagtgattgacactccagggattttggatagaccctttgaagacaggaatattattgaaatgtgcagtattacagcccttgctcacctgagagcagctgtattatttttcctcgacatttcagggtcttgtggctatagcattgcacaacaggctgctctctttcacagcataaagtcactgttcatgaacaagcctttagttatagtctgcaacaagactgacttgcagccactagaagggatatcagaggaagatatgaagctggttatggagatgaaagcagaagctatgaagactgtgattggtcaaggaggtgaggcaacagatgaggaaggtgtcctgctcactatgagtactttgactgaagaaggtgttatttcagttaaaaatgcagcttgtgaaaggttattgaatcagcgggtagaactgaaaatgaagtcaaaaaaattgaatgactgcttgaatcgcttccatgttgcactgccaaagcctcgggaccagaaagaaaggcctgcatgcataccccaggctgttcttgaagttatagctaagaaggctaagcaagctgcagagaaagagaaaaggaagcttgagaaggatctggaagatgaaaatggaggtgctggtgtatactctgctagcttgagaaagcattacattctagctaatgaagagtggaaggaagatatcatgcctgaaattcttgatgggcataacgtgtatgattttgttgatcctgatatcttgcaaagactggaagagttggagcgagaagagggtcttcgtcaggagcaagagggtgatgatgattttgagatggatggcactgacttgacacccgaagaacaagaagcgcttgctcagatcaggaaaaagaaaagcttactcattcaacagcataggatgaagaagagcactgccgagagtcgatctattgttccgaggaaatttgacaaagacagggaattcacttcaggaagaatgggaaggcagttgcaaggtttgggactcgatcctactttggcaatgaatagagcgcgcagcaaatctaggggacgtaagagggaaagatcacctgaaagaggagaaaacgctggtggtgatgccatggatgtcgacaatgaccaacctagcaagaagctgcgcttgaggtcgagatcgatgtcgagacatccacatgaagtggtcccaggagagggttttaaggactctgttcagaaggttaaggcactgaagctggctaagagctctgtgaagaagaggaataagaatgctcgtcggggagaagcagatagagtaattcctacattgaaaccgagcacttattctctggcaaacgatccaacggaaaacccagaggcgctaagaagatgaagggattgtctcctggacatttctgggttctgtactattctcgcctgctggagattttatacctggaaaaatttgcgtccatcttgcaacccgagttggcagaggttcattttgaccattttgcaatggggagaggcattgtgaccattttgctgcggcaattttgaacccttttttggtcttgttatttaaattctataagtagatttgagtta

SEQ ID NO: 1160 - DNA, 1204 bp, Pseudoroegneria spicata
aagaatccaatccaatccaattcatcatctcttgccacccttctccagtgagctgctgcaaaagtgtgtctttctctctggctccgtgtccgtgcagtagatgagcatggcggcgactgcggcggcggcgtcctcctccgtcctcacccctcgcacccgccaccacgccactcccagctcccgcgccctccgctccggcttcctcggccgcgccctcaccctggccgccgccaccgaccgcccctcccgcggcgccgtctccgtctccgtgcgcgcggcctgggacgggcccctctcctcggcgcgcctcatcatgcagggccgcaacgtcaagctgacggagaagctcaaggagcacatcgaggacaaggtggggcgggcggtgtccaaccacgcgcacctggtgcgggaggtggacgtgcgcctctccgcgcgcggcggcgacctcagcaagggccccaagctctcccgctgcgaggtcacgctcttcaccaagcgccacggcgtcgtgcgcgccgaggaggaggaggagtcctcctacgcctccatcgacgccgccgccgccgtcgtcaagcgcaagctgcgcaagatcaaggagaaggagaccgacgtgcgacacctcaagggcaccaaggagtggcaggccgccgatgctgatgggattggcttctccgacgtcgaggaggagtcggagctggaggaggacgacgagctcgtcgaggtcatcggcgccgaggacgaggagaccgtgctcaccaaggttgtgcgcaccaaggtgtttgagatggcgccgctgacggtggacgaggcgctggagcagctcgagaacgtcgaccacgacttctacgccttcaggaacgagcagacaggggaggtgaacatcctgtacaagaggaaagagggagggttcgggctcatcatccccaagctggacggacacgtcgacaaggccaccgtcaatgccaaggagcaccccgtcaccggctgaccacgccgtcgtctcctctccatgacaccaaatcactcgctagctgtagctgcattagttggtctgttttccggatggtggtgggtgtctgtcaagcaagtgtcaacaactgctggtgtttcatcagatcaggcagtccctcccttgtgcaaattaacaaacgctttctgagctgtgttaacttatgatgatcccacacacaccagttggttggta

SEQ ID NO: 1161 - DNA, 1120 bp, Triticum aestivum
gtccaatccatcttctctttgccactcttctccgccggagctgctgccaaagtctctgtctttctctgtgtccgtccagtagatgagcatggcggcgacggcggccacggccacggcctggccctccacctcctcctccgtcctcgcccctcgcacccgccaccacgccacccgcagcccccgcgccctccgctccggcttccttggccgcgccctcaccctcgccgcccccacagaccgcccctcccccgtctccgtctccgtgcgcgcggcctgggacggccccctctcctcggcgcgcctcatcatgcagggccgcaacgtcaagctgacggagaagctcaaggagcacatcgaggacaaggtggggcgcgcggtgcacaaccacgcgcacctggtgcgggaggtggacgtgcgcctctccgcccgcggcggcgacctcagcaagggccccaagctctcccgctgcgaggtcacgctcttcacgcgccgccacggcgtcgtgcgcgcagaggaggaggaggagtcatcctacgcctccatcgacgccgccgccgccgtcgtcaagcgcaagctgaggaagatcaaggagaaggagaccgacgtgcgccacctcaagggcaccaaggagtggcaggcctccgggctgtccgacgtggaagacgagtcggaggcagaggagctggaggatgacgacgatgacgagctcgtggaggtcatcggcgccgaggacgaggagaccgtgctcaccaaggttgtgcgcaccaaggtgttcgagatggcgccgctgacggtggatgaggcgctggagcagctggagaacgtcgaccacgacttctacgccttcaggaacgagcagacaggggaggtgaacatcctgtacaagaggaaggagggagggttcgggctcatcatccccaagcaggacggccatgtcgacaaggccaccgtcaacgccaaggagaaggagcaccccgtcgccggctgacgtctcctctccatgacaccaagtggatcactagctgtagctgcattagtcggtctgttttttccctgatgataataatggtggtgggtgtcttatgaagcaagtgtcaacaagtgctggtgtcttacgcac

SEQ ID NO: 1162 - DNA, 1288 bp, Triticum aestivum
ccacgcgtccgcccacgcgtccgcttctcttctcctcttgttgctgcagtagatgagcatgtcggcgacggccgccacggccacggcctggccctccacctcctcctccgtcctcgcccctcgcacccgccaccacgccgctcccagcccccgcgccctccgctccggcttcctcggccgcgccctcacgctggccgccgccaccgaccgcccctcctccgcccccgccgccgtctccgtctcggtgcgcgcggcctgggacgggccgctctcctcggcgcgcctcatcatgcagggccgcaacgtcaagctgacggagaagctcaaggagcacatcgaggacaaggtggggcgggcggtgcacaaccacgcgcacctggtgcgggaggtggacgtgcgcctctccgcccgcggcggcgacctcagcaagggccccaagctctcccgctgcgaggtcacgctcttcaccaggcgccacggcgtcgtccgcgccgaggaggaggaggagtcatcctacgcctccatcgacgccgccgccgccgtcgtcaagcgcaagctgcgcaagatcaaggagaaggagaccgacgtgcgccacctcaagggcaccaaggagtggcagtcctctgggctgtccggtgtcgaagatgaatccgaggcagaggaggaggaggaggaggacgagctcgtcgaggtcatcggcgccgaggacgaggagaccgtgctcaccaaggttgtgcgcaccaaggtgtttgagatggcgccgctgacggtggacgaggcgctggagcagctcgagaacgtcgaccacgacttctacgccttcaggaacgagcagacaggggaggtgaacatcctgtacaagaggaaggagggagggttcgggctcatcatccccaagcaggacggccatgtcgacaaggccactgtcaatgccaaggagcaccccgtcgtcggctgacctcctcgtcgtctcctctccatgacaccaagtcactcactagctgtaggtgcattagttgttctgttttttccctgatggtggtggtgggtgtctgtctgtcaagcaagtgtcaacaactgctgatgtttcatgagatcagacagtcccttgtgcaaattaacagacgctttctgagctgtgttaactcatgatgatcccacacacccagttggtaagttgtttaagaagtgatttaagtaatctgtaatattgggatacatgtttgagctgagaatctctttattaaacttcactgaaagaaagaccagactctgaacaaaaaaaaaa

SEQ ID NO: 1163 - DNA, 1263 bp, Triticum aestivum
tctcttctcctcttgttgctgcagtagatgagcatgtcggcgacggccgccacggccacggcctggccctccacctcctcctccgtcctcgcccctcgcacccgccaccacgccgctcccagcccccgcgccctccgctccggcttcctcggccgcgccctcacgctggccgccgccaccgaccgcccctcctccgcccccgccgccgtctccgtctcggtgcgcgcggcctgggacgggccgctctcctcggcgcgcctcatcatgcagggccgcaacgtcaagctgacggagaagctcaaggagcacatcgaggacaaggtggggcgggcggtgcacaaccacgcgcacctggtgcgggaggtggacgtgcgcctctccgcccgcggcggcgacctcagcaagggccccaagctctcccgctgcgaggtcacgctcttcaccaggcgccacggcgtcgtccgcgccgaggaggaggaggagtcatcctacgcctccatcgacgccgccgccgccgtcgtcaagcgcaagctgcgcaagatcaaggagaaggagaccgacgtgcgccacctcaagggcaccaaggagtggcagtcctctgggctgtccggtgtcgaagatgaatccgaggcagaggaggaggaggaggaggacgagctcgtcgaggtcatcggcgccgaggacgaggagaccgtgctcaccaaggttgtgcgcaccaaggtgtttgagatggcgccgctgacggtggacgaggcgctggagcagctcgagaacgtcgaccacgacttctacgccttcaggaacgagcagacaggggaggtgaacatcctgtacaagaggaaggagggagggttcgggctcatcatccccaagcaggacggccatgtcgacaaggccactgtcaatgccaaggagcaccccgtcgtcggctgacctcctcgtcgtctcctctccatgacaccaagtcactcactagctgtaggtgcattagttgttctgttttttccctgatggtggtggtgggtgtctgtctgtcaagcaagtgtcaacaactgctgatgtttcatgagatcagacagtcccttgtgcaaattaacagacgctttctgagctgtgttaactcatgatgatcccacacacccagttggtaagttgtttaagaagtgatttaagtaatctgtaatattgggatacatgtttgagctgagaatctctttattaaacttcactgaaagaaagaccagactctgaacaaaaaaaaaa

SEQ ID NO: 1164 - DNA, 1178 bp, Triticum aestivum
gtccaatccatcttctctttgccactcttctccgctggagctgctgctgccaaagtttgtgtctttctctctgtccgtccagtagatgagcatggcggcgacggcggccacggccacggcgtggccctccacctcctcctctgtcctcgccccccgcacccgccaccacgtcactcccagcccccgcgccctccgctccggcttcctcggccgcgccctcaccctggccgccgccaccgaccgcccctcctccgtctccatctccgtgcgcgcggcctgggacgggccgctctcctcggcgcgcctcatcatgcagggccgcaacgtcaagctgacggagaagctcaaggagcacatcgaggacaaggtggggcgcgcggtgcacaaccacgcgcacctggtgcgggaggtggacgtgcgcctctccgcccgcggcggcgacctcagcaagggccccaagctctcccgctgcgaggtcacgctcttcaccaggcgccacggcgtcgtgcgcgccgaggaggaggaggagtcatcctacgcctccatcgacgccgccgccgccgtcgtcaagcgcaagctgcgcaagatcaaggagaaggagacggacgtgcgccacctcaagggcaccaaggagtggcagtcctccgggctgtccgatgtcgaagatgaatcggaggcagaggaggaggaggaggacgacgagctggtcgaggtcatcggcgccgaggacgaggagagcgtgctcaccaaggttgtgcgcaccaaggtgttcgagatggcgccgctgacggtggacgaggcgctggagcagctcgagaacgtcgaccatgacttctacgccttcaggaacgagcagacaggggaggtgaacatcctgtacaagaggaatgagggagggtttgggctcatcatccccaagcaggacggccacgtcgacaaggccaccgtcaatgccaaggagaaggagcaccccgtcgccggctgaccatggcaccaagtcactcactagctgtagctgcattagtcggtctgttttttccctgatgatggtggtgggtgtggtgtttcatcagatcagaccagacagtccctcccttctcccttgtgcaaattaacagacgctttctgagctgtgttaaaaaaaaaaaaaaaagggcggccgctctcgcgtgaccctg

SEQ ID NO: 1165 - DNA, 1170 bp, Triticum aestivum
cgacccacgcgtccaatccagtccaatccatcttctctttgccactcttctccgctggagctgctgctgccaaagtttgtgtctttctctctgtccgtccagtagatgagcatggcggcgacggcggccacggccacggcgtggccctccacctcctcctctgtcctcgccccccgcacccgccaccacgtcactcccagcccccgcgccctccgctccggcttcctcggccgcgccctcaccctggccgccgccaccgaccgcccctcctccgtctccatctccgtgcgcgcggcctgggacgggccgctctcctcggcgcgcctcatcatgcagggccgcaacgtcaagctgacggagaagctcaaggagcacatcgaggacaaggtggggcgcgcggtgcacaaccacgcgcacctggtgcgggaggtggacgtgcgcctctccgcccgcggcggcgacctcagcaagggccccaagctctcccgctgcgaggtcacgctcttcaccaggcgccacggcgtcgtgcgcgccgaggaggaggaggagtcatcctacgcctccatcgacgccgccgccgccgtcgtcaagcgcaagctgcgcaagatcaaggagaaggagacggacgtgcgccacctcaagggcaccaaggagtggcagtcctccgggctgtccgatgtcgaagatgaatcggaggcagaggaggaggaggaggacgacgagctggtcgaggtcatcggcgccgaggacgaggagagcgtgctcaccaaggttgtgcgcaccaaggtgttcgagatggcgccgctgacggtggacgaggcgctggagcagctcgagaacgtcgaccatgacttctacgccttcaggaacgagcagacaggggaggtgaacatcctgtacaagaggaatgagggagggtttgggctcatcatccccaagcaggacggccacgtcgacaaggccaccgtcaatgccaaggagaaggagcaccccgtcgccggctgaccatggcaccaagtcactcactagctgtagctgcattagtcggtctgttttttccctgatgatggtggtgggtgtggtgtttcatcagatcagaccagacagtccctcccttctcccttgtgcaaattaacagacgctttctgagctgtgttaactcatgatgat

SEQ ID NO: 1166 - DNA, 1228 bp, Avena sativa
aagattcagagaatccgcccatccaatccaatccaatccatcttcgccgcttcccagtagctgaatcaagctcgagtttttttttcagatgagcatcgcggcaacggcagctgcggcggcggcgtggccgtcgacctcctcctccgtcctcgctccacactcccaccatgccactcccaggacctgctgccacctccgctccggcttcctcggccgcgccctcgccgtggccccgcacccggtggccgccgtctccgcctccgcgtccgtgcgcgcggcctgggacgggcccctctcgtcggcgcgcctcatcatgcagggcaggaacgtcaagctgacggagaagctgaaggagcacatcgaggacaaggtggggcgcgcggttgtgaagcacagccacctggtccgggaggtggacgtgcgcctctcggcccgcggcggggacctgggcaggggccccaaggcgtcccgctgcgagatcacgctcttcaccaggcgccacggcgtggtgcgcgccgaggaggaggaggagtccagctacgccagcatcgacgtcgccgcagggatcatcaagcgcaagctcaggaagatcaaggagaaggagaccgacgtcaggcacctgatgaaagggaccaaagagtggatcgatgctggggatgctttggtgtcggagtcggatgtggaggtggacgaggaggaggaggacgatgagctcgtggaggtcatcggcgccgaggacgaggagaccgtgctcaccaaggttgtgcgcaccaaggtgtttgagatggcgccgctgacggtggacgaggccctggagcagctggagaacgtcgaccacgacttctacgcattcaggaacgagcagacaggtgaggtgaacatcctgtacaagaggaaagagggagggttcgggctcatcgtcccgaagcaggacggccacgtcgacaaggagaccgtcgccaagcaggacaacggcaaggagcaatccgtcgccggctagactgctcctcatcttctcagcgtcactagcagtagctttgttctagtttgtctgtttttctttcggatggatggatggatggatggatggatggatgtctgtcgactgacgaatgttggtttcatcatgtccccaaacgagaccgagccccgtgcccgtgtgtgcaaatttaacacttgtctgttatgagcccgcccgaaccacttgctaatctcctgttccgtccgt

SEQ ID NO: 1167 - DNA, 1017 bp, Hordeum vulgare
ggtgtgcagacgtcgcatgctcatgtgccatggcggcgcgggattcataaagcggccgcccgggcaggtacgcggggattcattcattctctcacagcaatcgatccatctaaactagcaaagcaaatggcctcaggagtgtttggtacccccatttcggagaagacggtgatagccactggtgagtataaggaacccattactcaaaaggatgttgcagactatgccatgaagatgatcaacgccggtggtaaggatattaacgcactaaccttcgtcgacaatctcaaagagcggtacggtaacggaatagctgtaaaatgcctcatctacaatgccactggtgccactttgagcttggctaagtacaacgattggcacggccatatctatgatacaccctacccatcagatattcagaatgggcaatggggtgcattcctccacgtccacccaagtggtgctgcggttggttcagctggtgccgttgtgtatcgtaccaagatcccctccagcagcaggtcctgcgattggttgttctcctggaccgccccctacattggtgacaacggggtgtacaccgaaatccgtgaggaaggacactacccaagtgtgggaagctggggttatatctatggtgtgaagcttgcaaattcaaatctcaactctactgatgaaaactatggatatgtttccaagactaatatcggtgaaggctctaccatgaacgcccgtggagttttccagtatccctactagatctcgttatcaacatcaaaggcttgtgtggcgaagacgttgcggtgtatttcctaagatccggtgttcaaactatggatatgtttcgtctactatctttgtggtgcatttccttagatcgggtgcttatgaataatcaaggaagaagacaataaatgagatatcatgtgtaattttatattatttacaagtcgtttgtgccaagctatccctcttttgtacccactactgttatccctaataaatatcaaatttatg

SEQ ID NO: 1168 - DNA, 931 bp, Triticum aestivum
tggagcagtacatacacaacaaagcaaggcataatggcctcaggagtgtttggtacccccatttcggagaagacggtgctagccactggagagtataaggaaccaattactcaaaaggatgttgcagactataccatgaagatgatcaacgccggtggtaaggatattaacgcacaaaccttcgtcgacaacctcaaggagaggtacggtaacggaatatctgtaaaatgcctcatctacaatgccaccggtgccactttgaacttggctaactacaaagactggcacggccatatctacgatacaccctacccatcagatattcagaatgggcaatggggggcatttctccacgtccacccaagtggcgctgcggttggttcagctggtgccgttgtgtatcgtaccaaggtcccatccagcagcagctcctgcgattggttgttctcctggaccgccccctacattggtgccaatgggatctacaccgaaatccgtgaggaagggcactacccaagtgtgggaagctgggattatatctatgacgtgaagctggaaaatgcaaatctcaactctactgacaaaaactatggatatgtttccaagactaacatcggtgaaggctctaccatgaacgctcgtggagttttccagtttccctactagatctctttgccagcatcgaggggttattgcggtcttcaaagtcttttgtgacgaggacgtttggggctgttatcttcctttactgtctttgtggtgcatttcctaatatccggtgttcatgaataatcaaggaagaagaaaataaaagagatgtaatgtgcaattttatattatatatcagtgtgaaaccaatccttttctaatggagtaccatatagatgggtgctggattctcacccacaagtttataccacgttgaagttct

SEQ ID NO: 1169 - DNA, 974 bp, Triticum aestivum
  misc_feature (21)..(21): n is a, c, g, or t
attcattcattctctcacagncatcgatccatctaaactaggtggagcagtacatacacaacaaagcaaggcataatggcctcaggagtgtttggtacccccatttcggagaagacggtgctagccactggagagtataaggaaccaattactcaaaaggatgttgcagactataccatgaagatgatcaacgccggtggtaaggatattaacgcacaaaccttcgtcgacaacctcaaggagaggtacggtaacggaatatctgtaaaatgcctcatctacaatgccaccggtgccactttgaacttggctaactacaaagactggcacggccatatctacgatacaccctacccatcagatattcagaatgggcaatggggggcatttctccacgtccacccaagtggcgctgcggttggttcagctggtgccgttgtgtatcgtaccaaggtcccatccagcagcagctcctgcgattggttgttctcctggaccgccccctacattggtgccaatgggatctacaccgaaatccgtgaggaagggcactacccaagtgtgggaagctgggattatatctatgacgtgaagctggaaaatgcaaatctcaactctactgacaaaaactatggatatgtttccaagactaacatcggtgaaggctctaccatgaacgctcgtggagttttccagtttccctactagatctctttgccagcatcgaggggttattgcggtcttcaaagtcttttgtgacgaggacgtttggggctgttatcttcctttactgtctttgtggtgcatttcctaatatccggtgttcatgaataatcaaggaagaagaaaataaaagagatgtaatgtgcaattttatattatatatcagtgtgaaaccaatccttttctaatggagtaccatatagatgggtgctggattctcacccacaagtttataccacgttgaagttcta

SEQ ID NO: 1170 - DNA, 934 bp, Pseudoroegneria spicata
cattcattctcgcagcgatcgatctaaactagctggagtagtatatacgaagcaaagcaacccaatggcctctggagtgtttggtacccccatttcagagcagacggtgatagccactggagagtatccggaacccattagccaaaaggatgttgcagactatgccatgaagatgatcaacgccggtggtaaggatgttaacgcacaacagttcgtcgacaacctcaaggacaggtacggtaatggaatatctgtaaaatgcctcatctacaatgccaccggtaccactctgaacttctccacctacaagaattggcacggccatatctatgatacaccctacccatcagatattcaaaatgggcaatggggggcatttctccacgtccacccaagtggtgctgcggttggttcagctggtgccgctgtgtatcgtaccaaggtcccctccagcagcagctcctgcgattggttgttctcttggaccatcccctacattggtgacaacggggtgcacaccgaaatccgtgaggaagggcacttccctaagcactgggattatatctacaatgtgaagctagcaaaatcaaatctcagctctactgataaaggctatggatatgtttccaaacttgacatcgctgaaggcactaccgttaatgcgcgtgcggttttccagcttccctactagatctcggtgctagcagcgagtgactattgcggccttcaaagccttgtgtggcgacagcgtttgcaggtgttcttctctttgctgtctttgtggtgcatttttcaagatttggtggttagcgaataatcgaaggaagaagacgaccaaagagatgtacggtgttaaaaaaattataggtcgttttgtatcaagttgtccttttgtaccgtctgttgttttccttaataaatatcagatataaga

SEQ ID NO: 1171 - DNA, 613 bp, Secale cereale
ccacgcgtccgctcatcaacatctccgacgccaaagctcagcttcttctccttgaaatcttttcgggttcacagatttggaggatgtcttgcaactgtggatcaggttgcagctgcggctcagactgcaagtgcgggaagatgtaccccgatctgacggagcagggcagcgccgccgcccaggtcgctgccgtggtcgtcctcggcctggcgcctgagaacaaggcggggcagttcgaggtggccgccggccagtccggcgagggctgcagctgcggcgacaactgcaagtgcaacccctgcaactgctaagccgcatgcgatcgtggctgtgtcacgtacgtactaggtgtgatggtgcgagagtatacgtgaataacgagcgtctgatctgatggagtcgagcaaggcccatgctctggtttgcgtgtgcgtgtgcgtgtgcgtgtgcttgctcgctctcccatgctctgcgcttggtgtccttgtgtgtatgtgtgtgtgcatgtgtccctgtaattgcttcatctatctccactgtggatggagtgatgaatatgtaagaatgaaagatttacctaattaactactcctaaatcgctacttcagttaaa

SEQ ID NO: 1172 - DNA, 583 bp, Triticum aestivum
gtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagttaaaaaaaaaa

SEQ ID NO: 1173 - DNA, 608 bp, Triticum aestivum
ttgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggttaaccaaagggggggcccggtaccaattcccccaa

SEQ ID NO: 1174 - DNA, 561 bp, Triticum aestivum
catcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcctaaatcgctacttcggttaa

SEQ ID NO: 1175 - DNA, 562 bp, Setaria italica
catcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcatgtgcgtgtggtttacttcgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcctaaatcgcta

SEQ ID NO: 1176 - DNA, 504 bp, Setaria italica
catccctgataccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgccgcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacttgaataacgagcgtctgatctgatggagtcgagcaagggtgcgtgtctgcccttggtgtccttgtgtgtatgtgtgtgcacgtgtccctgtaattgcttcatctatctccactatggatggagtgatgaatatgtaagaatgaaagatttacctaattaactagtcctaaatcgc

SEQ ID NO: 1177 - DNA, 564 bp, Triticum aestivum
attcaattcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaacta

SEQ ID NO: 1178 - DNA, 603 bp, Triticum aestivum
aattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggttaaagcagaaaaatacaacaaaa

SEQ ID NO: 1179 - DNA, 539 bp, Triticum aestivum
cctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 1180 - DNA, 519 bp, Avena sativa
tgctcatcaccatctccgacaccaaagcttatcttcttctccttgaaatcttttcgggttcaccagatttggagaggatgtcttgcaactgcggatccggttgcagctgcggctcagactgcaagtgcgggaagatgtaccctgatctgaccgagcagggcagcgccacctcccaggtcgccgccgtggtcgtcctcggagtggcgcctgagaacaaggccgggcagtttgaggtggccgccggccagtccggcgagggctgcagctgcggcgacaactgcaagtgcaacccttgcaactgttaaagctgctacgtacgtgtgatggtgtgagagtatacgtgaataacgagcgtctgatctgatggagtcgagcaagggtgtgcgtgtgcgtgtggtttacttgctcgctctcgcatgctctgcccttggtgtccttgtgtgtatgtgtgcgtgtgtgtctatgtaattgctccacctatcttcattatgatggggtgatgaatatataagaatatat

SEQ ID NO: 1181 - DNA, 548 bp, Pseudoroegneria spicata
  misc_feature (461)..(461): n is a, c, g, or t
atcatcatcatctccgacaccaaagctcatcttcttctccctgaaatctttttgggctcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccggccagtccggtgagggctgcagctgcggcgacaactgcaagtgcaacccctgcaactgttaagctgcatgcactcgtacgtacgtgtgatggtgtgagagtatacgtgaataacgagcgtctgatctgatggagtcgagcaagggtgcgtgtgcctgtggtgtggtttgcttgctcgctctcccatgctctgcccttggtgtccttgtgtgtatgtgtgtgtncgcgtgtgtccctgtaattgcttcatctatctccactatggatggagtgatgaatatataagaatgaaagatttacctaattaacca

SEQ ID NO: 1182 - DNA, 558 bp, Leymus cinereus x Leymus triticoides
  misc_feature (50)..(50): n is a, c, g, or t
  misc_feature (52)..(52): n is a, c, g, or t
  misc_feature (212)..(212): n is a, c, g, or t
  misc_feature (302)..(302): n is a, c, g, or t
  misc_feature (311)..(311): n is a, c, g, or t
  misc_feature (435)..(435): n is a, c, g, or t
  misc_feature (443)..(444): n is a, c, g, or t
  misc_feature (456)..(456): n is a, c, g, or t
  misc_feature (462)..(462): n is a, c, g, or t
  misc_feature (464)..(464): n is a, c, g, or t
  misc_feature (475)..(475): n is a, c, g, or t
gcacgaggccgataccaaagctcatcttcttctccttgaaatctttttgngntcacagatttggaggatgtcttgcaactgtggatcaggttgcagctgcggctcagactgcaagtgcgggaagatgtaccctgatctgacagagcagggcagcgccgccgcccaggtcgccgccgtggtcgtcctcggcgtggcgcctgagaacaaggcgnggcagttcgaggtggccgccggccagtccggcgagggctgcagctgcggcgacaactgcaagtgcaacccctgcaactgttaagctgcangcaatcgtngttggttgtgtcacgtacgtacgtgtgatggtgcgagagtatacgtgaataacgagcgtctgatctgatggagtcgagcaagggtgcgtgtgcatgtggtgtggttttacttgctcgctctccnatgctctnnccttggtgtccntgtgtntntgtgtgtgcangtgtgtccctgtaattgcttcatctatctccactatggatggagtgatgaatatataagaatgaaaggtttacctaattaact

SEQ ID NO: 1183 - DNA, 851 bp, Triticum aestivum
tgggagcaagagagattaggcaactttcgaagctccttgacgaggaccccgcggtcatggagcggaggacaaacctcgccaagaggctggagctataccggagcgcccaagcagagatcgacgcagttgcatggtcaaaataattttttgtcgacttatcgttccgtagtgtgtgttcacctttactccttgtttggtgacatgtctccccttattctgagggtcatatatagctgattctttcttccaaacctcgtgccgaattcggcacgaggatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcctaaatcgctacttcggttaa

SEQ ID NO: 1184 - DNA, 581 bp, Triticum aestivum
gaattcggcacgagggcatcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcgtacgtagtacgtgtgatggtgtgagagtatacgtgaataacgagcgtctgatctgatggagtcgagcaagtgtgcgtgtgtgtgtggtttacttgctcgctctccgtctatgctctgcccttgctgtccctgtgtgtatgtgtatgcatgtgtccctgtaattgcttcatctatctccactatggatggagtggtgaatatgtaagaatgaaagatttacctaattaactactcctaaatcgctccttcagtt

SEQ ID NO: 1185 - DNA, 475 bp, Triticum aestivum
  misc_feature (288)..(288): n is a, c, g, or t
  misc_feature (424)..(424): n is a, c, g, or t
  misc_feature (428)..(428): n is a, c, g, or t
  misc_feature (472)..(473): n is a, c, g, or t
  misc_feature (475)..(475): n is a, c, g, or t
aatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaaccctgcaactgttaactgcatgcaccctacgtacgtgtgttgggtgtnaagagtatacgttgaataacagcgtctgatttgatggagtccacaaggtgcgttgcgtgtgcgtgtggttgcttgctcgtctccaatctctgccatgttccttgtgttagtgtgtgtcatttccctgtattcttanctancccaactatgatggagtgatatatttagaatgaaaatacctaannan

SEQ ID NO: 1186 - DNA, 674 bp, Triticum aestivum
attcgtctataaatagtggcgccggtgtgaggctatccattcaattcaattgtgcgcatcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcgtacgtagtacgtgtgatggtgtgagagtatacgtgaataacgagcgtctgatctgatggagtcgagcaagtgtgcgtgtgtgtgtggtttacttgctcgctctccgtctatgctctgcccttgctgtccctgtgtgtatgtgtatgcatgtgtccctgtaattgcttcatctatctccactatggatggagtggtgaatatgtaagaatgaaagatttacctaattaactactcctaaatcgctccttcaaaaaaaaaaaaaaaactcgacctcggccgcgaccacgctaatcacttagtgaattc

SEQ ID NO: 1187 - DNA, 358 bp, Triticum aestivum
cgataccaaagctcatcttcttctccttgaaatctttttgggttcacaaatttggaggatgtcttgcaactgtggatccggttgcagctgcggctcaaactgcaagtgcgggaagatgtaccctgatctgacggagcaaggcagcgccgccgccgaggtcgccgccgtggtcgtcctcggcgtggcgcctgagaacaatgcgggacaattcaaggtggccgccgggcaatccggcgagggctgcagctgcggcgacaactgcaagtgcaacccctgcaactgttaagctgcatgcactcgtacgtacgtacgtgtgatggtgtgagagtatacgtgaataacgagcgtctgatctgat

SEQ ID NO: 1188 - DNA, 320 bp, Triticum aestivum
gctatccattcaattcaattgtgcgcatcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacattcgaggtggccgccgggcattccggcgaaggctgcaactgccgcgacaactgcaaatgcaacccctgcaactgtt

SEQ ID NO: 1189 - DNA, 438 bp, Triticum aestivum
  misc_feature (214)..(214): n is a, c, g, or t
  misc_feature (329)..(329): n is a, c, g, or t
  misc_feature (352)..(352): n is a, c, g, or t
  misc_feature (410)..(410): n is a, c, g, or t
  misc_feature (425)..(425): n is a, c, g, or t
gatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcaaggcagcgccgccgccgaggtcgccgccgtggtcgtcctcggcgtggcgcctgagaacaaggcgggacanttcgaggtggccgccgggcaatccggcgaaggctgcaactgccgcgacaactgcaagtgcaaaccctgcaactgttaagctgcatgcactcctacgtaatacgttttatggtgtngaaaatatacgtgaataacgacntctgatctgatggatcccacaagttgctgtgtgtgtggttacttgctcctctcctccnatctctcccttgctnccctggtgtaagt

SEQ ID NO: 1190 - DNA, 534 bp, Triticum aestivum
  misc_feature (60)..(60): n is a, c, g, or t
  misc_feature (94)..(94): n is a, c, g, or t
  misc_feature (194)..(194): n is a, c, g, or t
  misc_feature (209)..(209): n is a, c, g, or t
  misc_feature (233)..(233): n is a, c, g, or t
  misc_feature (295)..(295): n is a, c, g, or t
  misc_feature (414)..(414): n is a, c, g, or t
  misc_feature (431)..(431): n is a, c, g, or t
  misc_feature (440)..(440): n is a, c, g, or t
  misc_feature (445)..(445): n is a, c, g, or t
  misc_feature (466)..(466): n is a, c, g, or t
  misc_feature (480)..(480): n is a, c, g, or t
  misc_feature (495)..(495): n is a, c, g, or t
ccaaagccatcctccttctccttgaaatcttttggggttcacagatttggagggatgtcntgcaactgtggatccggttgcagctgcggctcanactgcaagtgcgggaagatgtacctgatctgacagagcaaggcagcgccgccgcccaagtcgccgccgtggtcgtgctcggcgtggctcctgagaacaangcggggcagttcgangtggccgccgggcaatccggcganggctgcagctgcggcgacaactgcaagtgcaacccctgcaactgttaagctgcatgcactcntacgtacgtacgtgtgatggtgtgagagtatacttgaataacgagcgtctgatctgatggagtcaacaagggtgcgtgtgctgtgattgcttgctcgctctccgcctatgctctgccanggtgtccttgtgtgtangtgttgcgnagtcncctgtaaatgctcaactatcnccacaatggatggngtgatgaatattaanaatgaaagattacctaattactatcctaaaaaaaaaaaa

SEQ ID NO: 1191 - DNA, 543 bp, Triticum aestivum
  misc_feature (69)..(69): n is a, c, g, or t
  misc_feature (100)..(100): n is a, c, g, or t
  misc_feature (107)..(107): n is a, c, g, or t
  misc_feature (159)..(159): n is a, c, g, or t
  misc_feature (249)..(249): n is a, c, g, or t
  misc_feature (327)..(327): n is a, c, g, or t
  misc_feature (376)..(376): n is a, c, g, or t
  misc_feature (399)..(399): n is a, c, g, or t
  misc_feature (416)..(416): n is a, c, g, or t
  misc_feature (510)..(510): n is a, c, g, or t
  misc_feature (536)..(536): n is a, c, g, or t
  misc_feature (542)..(542): n is a, c, g, or t
ctcgtgccgaattcggcacgagataacaaagctcatcttcttctccttgaaatctttttgggtccacanatttggaggatgtcttgcaactgcggatcangctgcanctgcggctcaaactgcaagtgcgggaagatgtaccctgatctgacggagcanggcagcgccgccgccgaggtcgccgccgtggtcgtcctcggcgtggcgcctgagaacaaggcgggacagttcgaggtggccgccgggcantccggcgagggctgcagctgcggcgacaactgcaagtgcaacccctgcaactgttaagctgcatgcactcgtacgtantacgtgtgatggtgtgaagaagtatacgtgaataaccaacgtcctgatntgatggagtccaacaaatgtgcngtgtgtgtgtgggttanttgctcgctctcccgtctaatgctctggccccttgctgtccctgtgtgtaaggtgtaatgcaatggtgtccccggtaaattgcttcaatccaancccccaaccaatgggatgggggtggnggaatnt

SEQ ID NO: 1192 - DNA, 296 bp, Triticum aestivum
cgataccaaagctcatcttcttctccttgaaatctttttgggttcacagatttggaggatgtcttgcaactgtggatccggttgcagctgcggctcagactgcaagtgcgggaagatgtaccctgatctgacggagcaaggcagcgccgccgcccaggtcgccgccgtggtcgtcctcggcgtggcgcctgagaacaaggcggggcaattcgaggtggccgccgggcagtccggcgagggctgcagctgcggcgacaactgcaagtgcaaccctgcaactgttaagctgcatgcac

SEQ ID NO: 1193 - DNA, 547 bp, Pseudoroegneria spicata
  misc_feature (7)..(7): n is a, c, g, or t
  misc_feature (9)..(9): n is a, c, g, or t
  misc_feature (48)..(49): n is a, c, g, or t
  misc_feature (493)..(493): n is a, c, g, or t
  misc_feature (527)..(530): n is a, c, g, or t
ccctccntnaatcctttttgagttcacatatttggaggatgtcttgcnnctgtggatcaggttgcagctgtggctcagactgcaagtgcgggatgatgtaccctgatctggcagagcagggcagtaccaccgcccaggtcgccgccgtggtcgtcctcggcgtggcgcctgagaacaaggccgggcagttcgagatgaccgccgacgagtccggtgagggctgcagctgtggcgccaactgcaactgcaacccctgcaactgttaaggtgcactcggggttgtgtcacgtacgtacgtgtgatggtatgagagtatacgtgaataacgagcatctgatctgattgagtcgagcaagctagggtgcttgtgcatgtggtgtggtttacttgctcgctctcctatgctgtgctcttggtgtccttgtgtgtatgtgtgtgcatgtgtccctgtaattgcttcatctatctccactatgcatggatggggtgagangaatatataagaatgaaagttttacctaatcaannnnaaaaggaaaaaatcggt

SEQ ID NO: 1194 - DNA, 579 bp, Hordeum vulgare
ctctacgataccaaagctcatcttcttctccttgaaagctttgcgggttcaccaggatctgaaggatgtcttgcaactgaggatccggctgcagctgcggctcaaactgcaagtgcgggaagatgtaccctgatctgaccgaccagggcagcgccaccgcccaggtcgacgccgaggtcgacctcggaatggcgcctgacaacaaggccgggcaattcgaggtggccgccggccagtccggcgagggctgcacttgcggcgacaactgcaagtgcaaccggtgaacctgtaaaagctgctacgtaaggggaatggtgtgagagtatacgtgaataacgagcgcgtgatgatctgatggacccggacaagggcgcgtgtgcgttctcttgcccatttggtgagataaacatgctggctccccgcatgtgggcccccttccgtgtgaaccacctggataaggtcacccaacagcgattgcgccaaatcacgggcctcaaagggactgagtgaatcttaataatggtcagcggttccccagactcccataaattttggggaggcaaaacagagtgacccccg

SEQ ID NO: 1195 - DNA, 936 bp, Festuca arundinacea
acagaagaagcaaccagaaagatgagattatgatttgttgccttgctgaactactattagccattgtatttgatcttgtcttgttgtctttgagcctagttttaccagttactgcagtaacacaagatcatgacttgaagtcacctccccaaggatcattaaaattatctaatggtgagaacttgtcgctgtcgaaagacagttgagacttgagaaaatggacaaattcgggaggccggcgtacgtatagcatcgtggcacgcaacaatatcttagctagagtgccctcctcctatacgctaacctggctataaatagtggtgcagatatggggtgctctccattcaattcaccatcttctctgatcccaaaagctttcttcttcgccttaatctcatccttcaccacttagatatttggaagatgtcttgcagctgtggatcaagctgcaactgcggctcaaactgcaagtgcggaaagatgtaccctgacctggacgagcaggccagcatcaccacccagacccaggccgtggtcgtcctcggcgtggctcctgggaacaaggccgggcagttcgagatggccgccggcgagtctggcgagggctgcagctgcggcgccaactgcaagtgcaacccctgcaactgctaagcttcacgcgctgcgatgcaacgcacttgtgtgatggtgtgagagtacatgtacgtaaataacaagaagcatctgacggagtcgagcaagtatgtgcgcggtgtgtgtgtctactagctcgctctgctctgatctgctctttgtgtcgtccttccttgtgtttatgtgtgtgcttgtgtctctgtaattgcttcatctatctccgaccatggagtatggagtgatgaattaatatacagtacaagaaagtcaagtttgcctaatcaattgagcgaaatttctact

SEQ ID NO: 1196 - DNA, 555 bp, Festuca arundinacea
  misc_feature (551)..(552): n is a, c, g, or t
tcttctctgatcccaaaagctttcttcttctccttaatctcatccttcaccacttagatatttggaagatgtcttgcagctgtggatcaagctgcaactgcggctcaaactgcaagtgcggaaagatgtaccctgacctggacgaacaggtcagcatcaccacccagacccaggccgtggtcgtcctcggcgtggctcctgggaacaaggccgggcagttcgagacggccgccggcgagtctggcgagggctgcagctgcggcgccaactgcaagtgcaacccctgcaactgctaagcttcacgcgctgcgatgcaacgcacttatgtgatggtgtgagagtacatgtacgtaaataacaagcatctgacggagtagagcaagtacgtgtgcggtgtgtgtctactagctcgctctgctctgatctgctctttgtgtcgtccttccttgtgtctgtgtgtgcttgtgtctctgtaattgcttatctatctccgaccatggagtatggagtgatgaattaatatacagtacaagaaagtcaagtttgcctannaaa

SEQ ID NO: 1197 - DNA, 719 bp, Triticum aestivum
  misc_feature (208)..(208): n is a, c, g, or t
ctcatcatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggaacatggcagtgccgccgcccatgtcgacgccgtggacgacctcggcgtggcacctganaacatggcatgtcaattccaggtggacgccggccagtacggcgagggctgcagctgccgcgacaactgcaagtgcaacccctgcaactgttaagctgcatgctctcgtaccgtcgtacgtacgtgtgatggcgtgacagtatacgtgaataacgaacgcctgatctgatggagtctagcaaaggtgcgtgtgcatgtacgtgtggtttacttagctcgatatccgcctatgctctgaccttggagaccttgtgtgtatgtgtgtgcatgtgtacctgtaattgcttcatctatctccactatagatggagtgatgcatatgtaacaatgaatgatttccctaaagcgcatggagcaaaaatttgctcttccgtagagggcggcctgttctacagtttcccttggggggcccaacttacccgtacccaccgttttttggaaaaaagggggcccttatagggattccctattttcaaaaaaagcacgggcccttttttttacacgcgcgctgg

SEQ ID NO: 1198 - DNA, 1193 bp, Triticum aestivum
atcctgcgacccacgcgtccgccatccccccagtttcccctgtccacgagccgaaaccccagccaccatctggttctcatctttctgttccactgaaattcccggggaacaaacactcacttccaaggataaatcctcaaggttgatttacacgctagtggctgtgccgcgacgtgcggcgagagacatgtctgtgcagtgcaccgcaaactcactccgggctcttgctgccctcccggcgccatccccctcccgccgcctggcgagaaatgaattccttatgccatgccgcccgagtcgcaccggtgcgctggtccgagctgcggattcttcgcctcctgccgcacccgcgtcatcgtccggagcagccgacgacaaggccgtcatccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgctttcgctctaagagagaagtgtgctacccctatcctcaagcaggtcaggagtgatgttacacgttatagatatggtgatgagcagcatctcgatgaagcactaaagcggatctttcaatatggtttgggtggcggcattccaagacgtagtgcacctatattacaaaagattcaagaagtaactgatgatgggaaatactgtttagtactggaattcgaagccaaatcgttggagctatcagattttgagaagaggcaggcaaaattcacctcctttttcggtcctggaattaaggctgaaattggaaaaggtggtgacgacctatatgaagtgcgtcttatctcggagaccacagaggaagagtgacagcgtttgcaatcctattatctgctaatatacaacaaaatgatatttatttcttttccccactaatttgcatatataacgttattattgtaatatactcagtatataattttgcttttgagctttgtatgtagttccaaatctagcatcgtatgttccatgcaaagcatacaaaaaaggctattgtaataaagatgtaaattgacttgattggcca

SEQ ID NO: 1199 - DNA, 1229 bp, Triticum aestivum
ctctcccagtttcccctgtccacgagccgaaaccccagccaccatctcgttctcatctttctgttccactgaaattcccggggaacaaacactcacttccaaggataaatcctcaaggttgatttacacgctagtggctgtgccgcgacgtgcggcgagagacatgtctgtgcagtgcaccgcaaactcactccgggctcttgctgccctcccggcgccatccccctcccgccgcctggcgagaaatgaattccttatgccatgccgcccgagtcgcaccggtgcgctggtccgagctgcggattcttcgcctcctgccgcacccgcgtcatcgtccggagcagccgacgacaaggccgtcatccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgctttcgctctaagagagaagtgtgctacccctatcctcaagcaggtcaggagtgatgttacacgttatagatatggtgatgagcagcatctcgatgaagcgctaaagcggatctttcaatatggtttgggtggcggcattccaagacgtagtgcacctatattacaaaagattcaagaagtaactgatgatgggaaatactgtttagtactggaattcgaagccaaatcgttggagctatcagattttgagaagaggcaggcaaaattcacctcctttttcggtcctggaattaaggctgaaattggaaaaggtggtgacgacctatatgaagtgcgtcttatctcggagaccacagaggaagagtgacagcgtttgcaatcctattatctgctaatatacaacaaaatgatatttatttcttttccccactaatttgcatatataacgttattattgtaatatactcagtatataattttgcttttgagctttgtatgtagttccaaatctagcatcgtatgttccatgcaaagcatacaaaaaaggctattgtaataaagatgtaaattgacttgattggccagcattgggcatagtagtagttgcaatattttcttttgggaacttttgaagaaaaaaaaaa

SEQ ID NO: 1200 - DNA, 1093 bp, Leymus cinereus x Leymus triticoides
  misc_feature (6)..(6): n is a, c, g, or t
  misc_feature (98)..(98): n is a, c, g, or t
  misc_feature (109)..(109): n is a, c, g, or t
  misc_feature (119)..(119): n is a, c, g, or t
  misc_feature (203)..(203): n is a, c, g, or t
  misc_feature (210)..(210): n is a, c, g, or t
  misc_feature (222)..(222): n is a, c, g, or t
  misc_feature (250)..(250): n is a, c, g, or t
  misc_feature (253)..(253): n is a, c, g, or t
  misc_feature (302)..(302): n is a, c, g, or t
ctgaanttctctgggaacaaacactcacttcccaaggagaaatcctcaagattgatttacacgctagtggctgtgccgcgacgtgctgtggagggagngagacatgtcngtgcagtgcnccgcaaactcactccgggctcttgctgcgctcccggcgccatcctcctcccgccgcctggcgagaaatgcattccttatgccangccgtcngagtcgcaccgntgcgctggtccgagctgcggattcttcnccncctgccgcacccgcgtcatcgtccggagcagccgacgacaaggccgtcntccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgctttcgctctaagagagaagtgtgctacccctatcctcaagcaggtcaggagtgatgttacacgttatagatatggtgatgagcagcacctcgatgaagcgctaaagcggatctttcaatatggtttgggtggcggcattccaagacgtagtgcacctatattacaaaagattcaagaagtaactgatgatgggaaatactgtttagtactggaattcgaagccaaatcgttggagctatcagattttgagaagaggcaggcaaaattcacctcctttttcggtcctggaattaaggctaaaattggaaaaggtggtgactatctatatgaagtgcgtcttatctcggagaccaccgaggaagagtgacagcgtttgcaatcctattctctgctaatatacaacaaaatgatctttatttctttttcccactaatttgcatatataatgttattgttgtaaaaatatatatttaattttgcttctgagctttgtatgtatccaaatctagcatcgtatgcttcatgcacacaaaaaaggctattgtaataaagatgtaaattgacttga

SEQ ID NO: 1201 - DNA, 1152 bp, Pseudoroegneria spicata
  misc_feature (590)..(590): n is a, c, g, or t
  misc_feature (642)..(642): n is a, c, g, or t
  misc_feature (1133)..(1133): n is a, c, g, or t
gtttcccctctccacgcgccaaaaccccagccaccatctccttctcatctctctgttccactgaaattccctgggaacaaacactcacttcccaaggataaatcctcaagattgatttacacgctagtggctgtgccgcgacgtgcggcggagggagagagaaatgtctgtgcagtgcaccgcgaactcactccgggctcttgctgcgctcccggcgccatcctcctcccgccgcctggcgagaaatgcattccttatgccatgccgcccgagtcgcaccggtgcgctggtccgagctgcggattcttcccctcctgccgcacccgcgtcatcgtccggagcagccgacgacaaggccgtcatccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgctttcnctctaagagaaaagtgtgctacccctatcctcaagcaggtcaggagtgatgntacacgttatagatatggtgatgagcagcatctcgatgaagcgctaaagcggatctttcaatatggtttgggtggcggcattccaagacgtagtgcacctatattacaaaagattcatgaagtaacaaatgatgggaaatactgtttagtactggaattcgaagccaaatcgttggagctatcagattttgagaagaggcaggcaaaattcacctcctttttcggtcctggaattaaggctgaaattggaaaaagtggtgacgatctatatgaagtgcgtcttatctcggagaccaccgaggaagagtgacagcgtttgcaatcctattctctgctaatatacaacaaaatgatctttatttcttttccccactaatttgcatatataatgttattattgtaaaaatatatatttaattttgtttctgagctttgtatgtagttccaaacctagcatcgtatgcttcatgcacaaaaaaggctattgtaanaaagatgttaattgactta

SEQ ID NO: 1202 - DNA, 1059 bp, Brachypodium distachyon
acatgtctatgcagtccgcggcgcacgcagtccgggcgctcgccgcgctcccggcgccgtcgtcctcctcccgccgtcgagcgggccatgcgccgtcccttctgccttgccggcccagtcgagctgttgcaccggtccgagccgcagattcttcaccccctgccgcgcccgcgtcgccgtcgccgtccggagcagccggcgggaaggccgtcgtccccgacgacgagttcaccctcgccaaggtgtcatttggtgtgattggcctagggataggcggctccctcttgtcgtatggatttggggcttatttcaatattctccccggttcggagtggtctgctctcatgctaacctacggatttcctctcacaatcatcggcatggccttgaagtatgctgaactgaaaccagtgccctgcataacctattctgatgctttcgctttaagagataagtgcgctacccctatcctcaagcaggttaggaatgatgtaacacgttatagatatggtgatgagcagcacctggatgaagcgctaaagcgaatttttcaatatggtttgggtggtggcattccaagacgtagtgcacctatattacaaaagattcaagaagaagtaactgaggaaggaaagtactgtttagtacttgaattcgaagccaaagcgttggagctatctgattttgagaagagacaggcaaaattcacctccttttttggtcctgggattaaggcagaaattggcaaaggtggcgatgatctgtatgaagtgcgtcttatctcagagactacttagaaaacacacagtgacgagttatgcagttcccttctctgctaatatacagcaaaatgttcatcattttcctttttccactaatcttcataaaatattgtcaatcttttccccttccctgtgttttggcttctgagcttgtgtctactggatgcagttccattgttccaaacctagcatcatatgcttcatgcacatacacacagaagaaggctgttgtaatatagatgtaaatttggcttggttgaaaacttggtccatatag

SEQ ID NO: 1203 - DNA, 1097 bp, Triticum aestivum
ctctcccagtttcccctgtccacgagccgaaaccccagccaccatctcgttctcatctctctgttccactgaaattcccggggaacaaacactcacttcccaaggataaatccttgggattgatttacacgctagtggctgtgccgcgacgtgcggcgagagacatgtctgtgcagtgcaccgcaaacttactccgggctcttgctgccctcccggcgccattcccctctcgccgcttggcgagaaatgaattccttgtaccatgccgcccgagtcgcaccggtgcgctggtccgagctgcggattcttcgcctcctgccgcacccgcgtcatcgtccggagcagccgacgacaaggccgtcatccccgacgatgagttcaccctcgccaaggtgtcttttggtgtgattggactagggataggtggctccctcttgtcgtatggatttggggcgtatttcaatcttctccctggttcggagtggtctgctctgatgctaacctatggatttcctctcacaatcataggcatggccttaaagtatgctgaactgaaaccagtgccctgcataacctactctgatgctttcgctctaagagagaagtgtgctacccctatcctcaagcaggtcaggagtgatgttacacgttatagatatggtgatgagcagcatctcgatgaagctctaaagcggatctttcaatatggtttgggtggcggcattccaagacgtagtgcacctatattacaaaagattcaagaagtaactgatgatgggaaatactgtttagtactggaattcgaagccaaatcgttggagctatcagattttgagaagaggcaggcatcaacggcattgttgaagaaaatggataatgtgtggaccgaagatgttgaaaccttcggcttggtccttcgtagctttcactcttttccttcttcacctttgtcgcactccttgtaaatgaagctcacacataattcttattttgaatatttactttgggaacccacgccatatttctcttttcaagttcttgtgcattaagcttccgcaactccttcttttgccaatacgataagtcgagtgggcatc

SEQ ID NO: 1204 - DNA, 1339 bp, Avena sativa
accccagccagccaccatcttctttctccctgttccaccaaaatccccaacgaggaaagcactcatttcccaaggaaaaaaaatccacaagctagtggtagtgctccgacgtgcggcagagcctgaaaggcgagatgtctgtgcagtgctcggcacacgcagtccgggcgcttgccgcgttccaggcgcccctctccccccgccgccgggtgagccatgcgccatccattgtgccttgccggcccggtcgcgaggttacgccggtccgagctgcggattcttcgccgcctgccgcgcccgcgtcgtcgtccggagcagccggcgacaaggccctcgtacccgacgacgatgggttcaccctcgccaaggtttcttttggtgtgattggactaggggttggtggctccctcttgacgtatggatttggggcgtatttcaatcttctcccaggttcagagtggtctgctctcatgctaacctacggctttcctctcacaatcataggcatggccttaaagtatgctgaactgaaaccagtgccctgcataacctatgctgatgctttcgctctaagagaacagtgtgctacccctatcctcaagcaggtcaggagtgatgttacacgttatagatatggtgacgagcagcatcttgatgaagcgctgaagcggatctttcaatatggtttgggtggtggcattccaagacgcagtgcacctatattacaaaaaattcgagaagaagtaactgatgaagggaaatactgtttagtacttgaatttgaagccaaatcgttggagctatcagattttgagaaaagacaggcaaaattcacctccttttttggtcctggaattaaggcagaaattggaaaaggtggtgatgatctgtatgaagtgcgtcttatctcagagactacatagaaaatccagagacttcttaggaaacacatagcgtggggcttgtcccgaggccccgtgcaggcagcccaacacacggcaacacccgaaacttgcatcagatgggcttggttcgggttgacgcggggaaccaatcgtgctgccctgcagtggaagcttatgcagttccattctctgctaatataaaacaaaaaaatcttaatttccttgttccactaacttgcatgtatgattcttttgcgggaatgtatatatgatgtaaaaagaacttctccttaatttggtatcgagctttgtttggatgtagttccaaacctagcatcgtatgcttcttgcacacgcgtggagaaaaaagagaggctattttaatacatatgtaaatttgttttactttgtgcacataatatagtaagtattaa

SEQ ID NO: 1205 - DNA, 1059 bp, Festuca arundinacea
ggcacgaggcttcttgctccctgttccaccaaaaatccccccgaggaaaccactcactgcccaagaaaagaaatccacaagctagtggtagtacgcagacgtgaaggacgacatgtctgtgcagtgcgcggcgcacgcagtccgggcgcttgccgcgttccaggcggccccctcctcccgccgccgggtgagccatgcatccgttgtgccctgccggccgaggcgcgcggttgcgccggtccgagctgcggattcttcgccgcctgccgcacctgcgccgtcgtcgtcgtcgtcgtccggagtagccagcgacaaggccatcgtacccgacgacgacgggttcaccctcgccaaggtttctttcggcgtgattggactaggggttggtggctccctcctgtcatatggatttggggcgtatttcaatcttctccccggttcagagtggtctgctctgatgctaacctacgggtttcctctcacaatcataggcatggccttaaagtatgctgaactgaaaccagtgccctgcataacctatgctgatgctttcgctctaagagaacagtgtgctacccctatcctcaagcaggtcaggagtgatgttacacgttatagatatggtgatgagcagcaccttgacgaagcgctaaagcggatatttcaatatggtttgggtggtggcattccaagacgtagtgcacctatattacaaaaaattcaagaagaagtaaccgatgatgggaaatactgtttagtacttgaattcgaagccaaatcattggagctgtctgattttgagaaaagacaggcaaaattcacctccttttttggtcctggaattaaggcagaaattggacaaggtggtgatgatctgtatcaagtgcgtcttatctcggagactacttaggtaattcagaggttacttaggaaacacatagcgtggggcctggcctgaggtgtcgtgcaggcagccaaacacccgaaacttgcatctgatgggcttggttcaggctggcgcaggcaaccagtcgtgcccgtagtggctgcttatgcagt

SEQ ID NO: 1206 - DNA, 1319 bp, Hordeum vulgare
ttccagatcaacaccaacagagatcgcttcccacccaccaagacctcccattagcttttcgaccagtttattacttcttcaacagccaagaaccatgagctctcggatggccggagccacgcttctgcgccacctgggcccccgcctcttcgccgccgccgagccggcctccgggctcgccgcgagcgcaaggggcgtcatgcccgccgccacgaggatcttcccggcgcggatggccagcacggccgccgccccgcatgccaaacaagaagaagccactgagaagccccagggcgcgacgacgccggagcaggcggtgagctactggggcatcgagccgcggaagctcgtcaaggacgacggcacggagtggccgtggttctgcttcaggccgtgggacacgtaccggccggacacgtccatcgacgtggccaagcaccacgagcccagggcgctgccggacaaggtggcgtacctcatcgtgcggacgctgcgcgcgggcagtgacctcttcttccagcgccggcacgccagccacgcgctgctgctggagacggtggcggccgtgccgcccatggtcggcggcgtgctgctgcacctgcgctcgctccgccgcttcgagcacagcggcggctggatccgcgcgctcatggaggaggccgagaacgagcgcatgcacctcatgaccttcatggaggtgacgcagcccctgtggtgggagcgcgccctcgtgctcgccacccagggcgtcttcttcaacgcctacttcgtcggctacctcgtctcccccaagttcgcgcaccgattcgtcggctacctcgaggaggaggccgtccactcctacacagagtacctcaaggacctcgaggccggcttgatcgagaacacgccggccccggccatcgccatcgactactggcgcctccccgccgacgccaggctcaaggacgtggtcaccgccgtgcgcgccgacgaggcgcatcaccgcgacgccaaccactacgcatccgacatccattaccagggaatgacgctgaatcagacgcctgcgccgctcgggtaccactaatcaatggttcgatcgatatgctttctcggtggttcaacggaccatagatcgatgcctgctatgtccaccgctgttacgtactaccactgtcgccgatgtttgtcctgttaatttgggatccaagtatgtcgaactatgtctatgagttcttttgtgtcacatttgtacccaaagatatatgtttgtgtaagcaggtaatgcttgtaaatatgatttgattactctcttaaaaaatatatttaatattatt

SEQ ID NO: 1207 - DNA, 1439 bp, Triticum aestivum
gacccacgcttccgcgagtggagcacgaggacactgacatgggactgcccgagtagaaattcagtcggttcacgagatgggacaccaacagaaatcacttcccagccaccaagacttcccattcgatccgatcaccacaaaaacctcaagcttttctaccagatttttagtcgttcaacaccaccatgagctctcggatggccggagccacgctgctgcgccacctgggcccccgcctcttcgccgccgccgagccggcgtccgggctcgccgcgagcgcgaggggcatcatgcccgccgccgcgaggatcttccccgcgcggatggccagcacagaggctgccggcccgcgtgccaaacaagaagaagccactgaaaagccccagggcgcaacaacgccggagcagaacaagaaggccgtggtgagctactggggcatcgagccgcggaagctcgtcaaggacgacggcacggagtggccgtggttctccttcaggccgtgggacacgtaccggccggacacgtccatcgacgtggccaagcaccacgagcccagggcggtggcggacaaggtggcgtacctcatcgtgcggacgctgcgcaagggaagcgacctcttcttccagcgccggcatgcgagccacgccttgctgctggagacggtggccgcggtgccgcccatggtgggcggcgtgctgctgcacctgcgctcgctccgccgcttcgagcacagcggcggctggatccgcgcgctcatggaggaggccgagaacgagcgcatgcacctcatgaccttcatggaggtgacgcagccgctgtggtgggagcgcgcgctcgtgctcgccactcagggcgtcttcttcaacgcctacttcgtcggctacctcgtctcccccaagttcgcgcaccgcttcgttggctacctcgaggaggaggccgtccactcctacaccgaatacctcaaggacctcgaggctggcttgatcgagaacacgcccgcgccggccatcgccatcgactactggcgcctccccgccgacgccaggctcaaggacgtcgtcaccgccgtgcgcgccgacgaggcgcatcaccgcgacgccaaccactacgcatcggacatccattaccagggaatgacgctgaatcagacgcctgcgccgctcgggtaccactgatcagctcaatggaccatagatcgatgcctgctcagtccataccgttggtgcgtactacactactactaccactgtcgccgatgttaatttgggatggattgttgcgcgcgtagtatgtttggtgtaaacgtctttcggagatgctcataggggatagggtgtgcgtgtgtacgtttatagaggtgagcgtatgcgcgtgtacatgagtgcttgtgtctgtactgatgttcaaaaagatatgtttatttgtatccaaaaaaaaaa

SEQ ID NO: 1208 - DNA, 1337 bp, Triticum aestivum
  misc_feature (607)..(607): n is a, c, g, or t
  misc_feature (824)..(824): n is a, c, g, or t
  misc_feature (853)..(853): n is a, c, g, or t
  misc_feature (892)..(892): n is a, c, g, or t
  misc_feature (1191)..(1191): n is a, c, g, or t
  misc_feature (1194)..(1194): n is a, c, g, or t
  misc_feature (1198)..(1198): n is a, c, g, or t
  misc_feature (1213)..(1213): n is a, c, g, or t
  misc_feature (1216)..(1216): n is a, c, g, or t
  misc_feature (1221)..(1221): n is a, c, g, or t
  misc_feature (1233)..(1233): n is a, c, g, or t
  misc_feature (1266)..(1266): n is a, c, g, or t
  misc_feature (1268)..(1268): n is a, c, g, or t
  misc_feature (1276)..(1276): n is a, c, g, or t
gtcggttcacaagatcaacaccaacagaaatcacttcccagccaccaagacttcccattcgatccgatcaccacaaaaacctcaagcttttctaccagatttttagtcgttcaacaccaccatgagctctcggatggccggagccacgctgctgcgccacctgggcccccgcctcttcgccgccgccgagccggcgtccgggctcgccgcgagcgcgaggggcatcatgcccgccgccgcgaggatcttccccgcgcggatggccagcacagaggctgccggcccgcgtgccaaacaagaagaagccactgaaaagccccagggcgcaacaacgccggagcagaacaagaaggccgtggtgagctactggggcatcgagccgcggaagctcgtcaaggacgacggcacggagtggccgtggttctccttcaggccgtgggacacgtaccggccggacacgtccatcgacgtggccaagcaccacgagcccagggcggtggcggacaaggtggcgtacctcatcgtgcggacgctgcgcaagggaagcgacctcttcttccagcgccggcatgcgagccacgccttgctgctggagacggtggccgcngtgccgcccatggtgggcggcgtgctgctgcacctgcgctcgctccgccgcttcgagcacagcggcggctggatccgcgcgctcatggaggaggccgagaacgagcgcatgcacctcatgaccttcatggaggtgacgcagccgctgtggtgggagcgcgcgctcgtgctcgccactcagggcgtcttcttcaacgcctacttcgtcggctacctcntctcccccaagttcgcgcaccgcttcgtnggctacctcgaggaggaggccgtccactcctacaccgantacctcaaggacctcgaggccggcttgatcgagaacacgcccgcgccggccatcgccatcgactactggcgcctccccgccgacgccaggctcaaggacgtcgtcaccgccgtgcgcgccgacgaggcgcatcaccgcgacgccaaccactacgcatcggacatccattaccagggaatgacgctgaatcagacgcctgcgccgctcgggtaccactgatcagctcaatggaccatagatcgatgcctgctcagtccaccgctggtgcgtactactaccactgtcgccgatgattgttncgngtgnagtctgttccgtgtnaanatgtntgtgtatgattnttttgtgtcactttgtacccaaagatatgtttncntaagccgntaatcctgtaaaatatgattttttaacatcagtacagacgcaagcgctcaaaaaaaaaaaa

SEQ ID NO: 1209 - DNA, 1308 bp, Triticum aestivum
acaccaacagtaaacagaaatcatttcctagcccgccaacaaaaacagacttcccattcgatccgctcacaagcttttcgatcgctttagttgttcaacaatcaacagccaacaccatgagctcccggatggccggagccacgcttctgcgccacctgggcccccgcctcttcgccgccgccgagccagcctccgggctcgccgcgagcgcgaggggcatcatgcccgccgccgcgaggatcttccccgcgcggatggccagcaccgaggccgccgccccgcatgccaaacaagaagatgatgccgcgagcccccaggcggccgcgactccagagcagcagaacaagaagcccgtggtgagctactggggcatcgagcctcggaagctcgtcaaggatgacggcacggagtggccatggttctgcttcaggccgtgggacacgtaccggccggacacgtccatcgaagtggccaagcaccacgagcccaaggccctggcggacaaggtggcctacttcgtggttcggtcgctgcgcgtgccccgggacctcttcttccagcgccggcacgccagccatgctctgctactggaaacggtggcggcggtgcctcccatggtgggcggcgtgctgctgcacctgcgctcgctccgccgcttcgagcacagcggcggctggatccgggcgctcatggaggaggccgagaacgagcgcatgcacctcatgaccttcatggaggtgacgcagccgcggtggtgggagcgcgcgctcgtgctcgccgcgcagggcgtcttcttcaacgcctacttcgtcggctacctcatctcccccaagttcgcgcaccgcttcgtcgggtacctcgaggaggaggccgtggagtcctacactgagtacctcaaggacctcgaagccggcttgatcgagaacacgcccgccccggccatcgccatcgactactggcgcctccccgccgacgccaggctcaaggacgtcgtcaccgccgtgcgcgccgacgaggcgcatcaccgcgacgccaaccactacgcatcggacatccattaccagggaatgacgctgaatcagacgcctgcgccgctcgggtaccactgatcagctcaatggaccatagatcgatgcctgctcagtccatcgttggtgcgtactactaccactgtcgccgatgtttgtcctgttaattgggattgattgttgcgcgtgcagtctgtttggtgtaaacgatgtatgtgtatgaattcttttgtgtcactttgtacccaaacatatgtttacgtaagccgatattgcttag

SEQ ID NO: 1210 - DNA, 1276 bp, Brachypodium distachyon
gctttccgatcaccaccaccatgagctctcgaatggccggagccacgcttctgcgccacctgggcccccgcctgttcgccgccgcggagccggcgtccgggctcgccgcgaggagcatcatggcgcccgcggccgccaggattctccccgcccggatggccagcacagcctccgccgccccggatgccaaagaaggcgccagcgccgccgcaaagacggattccgccgcgaccccggagcagagcaagaccaagtccgtggtcagctactggggcatcgagtcacggaagctcgtcaagccggacggcaccgagtggccgtggttctgcttcacgccatgggacacgtacagggcggacacgtcgatcgacatggagaagcaccacaagcccaagtcggtcccggacaaggtggcctactacgccgtgaggtcgctccgggtgcccatggacctcttcttccagcgccggcacgcgagccacgcgctgctgctagaaacagtagccgcggttcctcccatggtgggcggcatgcttctccacttacgctcgctccggcgcttcgagcacagcggcggctggatccgggcgctcatggaagaagccgagaacgagcggatgcacctcatgaccttcctggaggtgacgcagcccaactggtgggagcgagcgctcgtgatggccgcgcagggggtcttcgtcaacgcctacttcgtcggctacctggtttcccccaagttcgcgcacaggttcgtgggctaccttgaagaagaggccgtgcactcgtataccgaatacctcaaggatttggaagcagggaagatcgagaacactcctgcgccggccattgctatcgactactggcgcctgccggccgacgccacgctcaaggacgtcgtcaccgtcatccgcgccgacgaggcgcatcaccgcgacgccaatcattatgcctcggatatccattaccagggattgacgctcaaggagacgcctgccccgattgggtaccactaaatctcaatggacgtcgatgcctgctcggttcaccactgttaccgccgccgccgccgccgccaattttattccccgatttgggacaaattgttttcgcttgcattatgttcatgtaaatgaatcgcgtctcttgcggtcttgccaccggtttcggagatcctctgacgctggtgacatgtcccctatgtagactgtaacgttgtaaatatgataagattatgtgccgttaagaattcttttaataggcgtttaaatttttcatc

SEQ ID NO: 1211 - DNA, 2091 bp, Triticum aestivum
gaggctgctcactccactgtccaccccccaccggcccatccatcatcgtcgtcatccgccggagatgctcggccgactggccgcgcggcggccccgcctaggcagcgcccgcgccgccgctgcctaccgctcctcggcggcggcagcctcctcctcggtcctgcccgacgcgctcgaccggagctccgacgcctacgcccgcaacgccgccgccgtcggcggcctcctctccgacctgcgctcccgcgtctcccaggtgctgggcggcggaggagcgggggcggtgaagcggaacgaggggcgggggaagctgctccccagggaccgcatcgaccgcctgctcgacccgggggcctccttcctcgagctctctcagcttgcaggatctgatgtttacgaggaagcattaccatcagcgggaataattactggcatagggcctgttcatggacgactatgtatgtttgtggccaatgacccaactacaaaggggggtacatactatcctatcactgtcaaaaagcatctgcgggcgcaggaaatagcttctgaatgtaaattgccctgcatatatcttgttgacagtggaggtgctaatctccccaagcaggcagaagttttccccgaccgtgataattttggtcgaatattctacaatcaagctaagatgtccgcagatggtattcctcagattgctgtagttttaggttcttgtactgctggcggggcttatattcctgcaatggctgatgaaagtataatagttaagggaaatggaacaatatttctagctggtccaccccttgtaaaggctgctacaggggaggagatatctgctgaggaccttggtggagcatcagtgcattgtaaaatatcaggagtctctgatcattttgcacaagatgaacaccatggtcttgcactgggaaggaacgttgtgaagaacctccatttggccgctaaagaaacaagtagacacaattctgcttgtgattaccaagaaccattgtatgatgtacaggaacttcgctcaattgcaccagctgatacgaagcaatcttttgacattcgctcaataatagctcgtatagtcgatggaagtgaatttgatgaattcaaaaaattgtatggaacaacactagtgactggttttgcaaggatatgcgggcagccagttgggattattggaaacaatggcattttatttaccgagtcggcactaaagggtacccacttcattgagttgtgtgctcaacgcaatattcctttgatattccttcaaaatatttctgggttcatggttgggtcgaaatctgaagcaagtggaattgcgaaagctggagcaaaaatggttatggcagtttcctgttcaaaggttcctaaaattaccataattgtcggtggaagtttcggtgctgggaattatggaatgtgtggacgtgcatacagcccgaattttttgttcatgtggccaactgctaggatatctgttatgggtggcattcaggcagctggtgttctcgcccaaatagagaagaacaacaggaaaaggcaaggagtggagtggaccaaggatgacgaagaagccttcaaagccaaagtcgtcgaggcttatgacaaagaaggaagcccgtactactcgaccgctaggctttgggacgacgggatcatagatcccgccgataccagacgggtcctaagcctttgcctctctgcttcggccaagccggttccagaagacacgaaatatggcgtgtttcgaatgtaattatgtaaatcgtgtatagtacacatgtcacagccctgtaaaataaaacttgctttaatgcttccaatatgaattgaaatgaggtgcttattcaaggcctgtttctagggggaaattttgttagccctgctgtattgattttgtccatgtgcttttctagtgcttggaaggggctgaaaggcgtcttgctcgagaacgaacttcacattgtgttgtgtgaaaagaaaccagcgcgtgtagatgctggttaccatgtgcactattcccgggcgggggtgctcggtctgttgtacttttatactcttaattgttttgaatggatg

SEQ ID NO: 1212 - DNA, 2092 bp, Oryza sativa
cccacccaaagcaagtccgtccgtacactcctctactccgacgagccccgcccccgccgccgtaggaggagtgactccgacatgctccgccggttcgccgcgcggcgtctccggccgccggcgaccgcggggtacccctcgtcggccgctgcggcggccgcggcgtacgcccacgggggcggcgcctcggtgctccccgacggcctcgaccgggcctccgacgcgcacgcccgcaacgccgccgcggtgggcggcctcctctccgacctccgcgcccgcgtctcccaggtgctggccgggggaggcgcggaggcggtgaggcggaacaaggcgcgggggaagctgctcccgcgggagcgcatcgaccgcctgctcgaccccggcgcctccttcctcgagctctcccagcttgcaggatctggtgtttatgaggaagcattaccatcagggggcataataactggcataggacctgtccatggacgattatgtatgtttgtggccaatgatccaactacaaaagggggcacatactatcctatcactgtcaaaaagcatctgcgggcacaggaaatagcttctgaatgtaaactgccttgcatatatcttgttgacagtggaggtgctaatctccccaggcaggctgaagttttccctgaccgtgataattttggtcgaatattctacaatcaagctaagatgtcatcggatagcattcctcagattgcattagttctaggctcttgtaccgctggtggtgcttatattccggcaatggctgatgagagtgtaatagtaaagggaaatggaacaatatttctagctggtccaccacttgtaaaggctgctacaggagaagagatatctgctgaggaccttggtggagcatcagtgcattgtaagatatcaggagtctctgatcactttgcacaagatgagcttcatgggctaacattgggaagaaacattgtgaagaacctccacttggcagctaaagttccaaatgtacaaaattctgcttgcgattaccaagagccattgtatgatgtacaggaacttcgctcaattgccccggctgatatgaagcagtcttttgacattcgccaagtaatagctcgcatagttgatggaagtgaatttgatgaattcaaaaaattgtatggaacaacactggtgactggttttgcaaggatttgtggacagccagttggaattattggaaacaatggcattttgtttacagaatcagccctaaagggttcccacttcatagaattgtgtgcccagcgcaatattcctttgatattccttcaaaatattactggattcatggttgggtcaaaatctgaagcaagtggaattgcaaaagcgggagcaaaaatggttatggcagtttcctgttccaaggtaccgaaaattaccataattgttggtggaagttttggtgctggaaactatggaatgtgtggacgtgcatacagtccaaattttttgtttatgtggccaactgctaggatatctgtcatgggtggcatccaggcagctggtgtccttgctcaaatagagaagaacaacagaaaaagacaaggagtggagtggaccaaagatgaggaagaagccttcaaagcaaaagttgtggaggcttatgacaaagaaggaagcccatactactccaccgctagactttgggacgatgggattatagatcctgcggacaccagacgggttttaagcctctgcttatctgctgcggcaaagccggttccagaagacacaaaatatggagtatttcgaatgtaaatcatgcattataattgtgtacaaatccctgtatactgtatagtaaaatccgctttcatgcgcattgaaataaggcaaaataaaatgccattccaaggcttatttcgcaagtataatttcgccctgatgtgtataacaaagttatgtttaccagtgttttagtggcgaataaactgtttaagttgttactgtagctaaaatacattgatagactattgttctgagtccacaatccgtcaatgtatattttttctcttaaagcttacaaaatgagcatactaatgtttgctct

SEQ ID NO: 1213 - DNA, 1835 bp, Brachypodium distachyon
atgctcggccgattcgtctcacggcggctccgtccaagcagcaacactgctcccgcggtcaccgctgccgcctatcactcctcggcggccgtccgcgcacacggaggaggcagctcctcctcctcctcctcctcggtcctccccgactctctcgaccggagctccgacgcctacgcccgcaacgccgccgccgtcggcggcctcctatccgaactgcgctcccgcgtctcccaggtgctgggcgggggaggcgcggaggccgtacggaggaacacagcgcgggggaagctgctccctagggagcgtatcgatcgcctgctcgaccctggcggctccttcctcgagctctctcagcttgcaggctctgatgtttatgaggaagcattaccatcagggggtataataactggcataggacctgtccatggacgattatgtatgtttgtggccaatgatccaactacaaagggcggtacatactatcctatcactgtcaagaaacatctgcgggcacaggaaatagctgctgaatgtaaattgccttgcatatatcttgttgacagtggaggtgctaatcttcccaagcaggctgaagttttcccggatcgtgataattttggtagaatattctacaaccaagctaagatgtctgcagatggtatccctcagattgcattagtgttaggctcttgtactgctggcggggcttatattcctgcaatggctgatgaaagtataatagttaagggaaatggaacaatatttctagctggtccaccccttgtgaaggctgctacaggagaagagatatctgctgaggaccttggtggagcatcagtgcattgtaaaatatcaggagtctctgatcattttgctcaagatgagcttcatggaatcgcactggggagaaacattgtgaagaacctccacttggctgctaaagtaacaaatgtacaaaattctgcttgtgattatgaagaaccattgtacgacgttcaggaacttcgctcaattgcaccagctgacatgaaacaatcttttgatattcgctcggtaatagctcttatagttgatgggagcgaatttgatgaattcaagaaattgtatggaacgacactagtgactggttttgcaaggatatgtgggcagccagttggaattataggaaacaatggcattttatttaccgagtcagcgctaaagggtgcccacttcattgagttgtgtgcccaacgcaatattccgttggtattccttcaaaatattactggattcatggttgggtcgaaatctgaggcaagtggaattgcgaaagctggagcaaaaatggttatggcagtttcctgttccaaggttcctaaaattaccataattgtcggtggaagttttggtgctggaaattatggaatgtgtggacgtgcatacagcccaaattttttgtttatgtggccaactgctaggatatctgttatgggtggcatccaggcagctggggttcttgctcaaatagaaaagaacaacaggaaaaggcaaggagtggagtggaccaaggatgaggaagaagccttcagagccaaagttgtggaggcttatgacaaagaaggaagcccgtattactctaccgccaggctttgggacgatgggatcatagatcccgcagataccagacgggttttaagcctctgcctttctgcttcggccaagccagttccagaagatacgaagtatggtgtatttcgaatgtaaatcaaataatgtacacatccttgtgtagtaaaaccttgtttattgagtccaagatgcagtgaaataaaatgcgtattcaaggcttgaac

SEQ ID NO: 1214 - DNA, 1921 bp, Panicum virgatum
agcgcgagcgagcgagcgatccgagccacggcgacatcgagcgatcctctcccacggaaccgcggacccatctccgagacagcggaggcatgctcgcccggctcgccgcggggcggcggcacctgcacctgcacccgcgcgccgccccggcgtacagttcgtcagcggcggcggcggcccgcgggggcgcctccgtgctcccggacacgctcgaccggggctccgacgcctacgcgcgcaacgccgccgccgtcgccgcgctgctcgccgacctgcgcgcccgcgtctcccaggtgctgcgcgggggtggcccggaggcggtgcggcggaacgcgtcgcgggggaagctgctcccgcgggaccgcatcgaccgcctgctcgaccccggcgcgtccttcctcgagctctcgcagcttgcaggttcggatgtttatgaagaagcattaccatcagcgggtataataactggcataggacctgttcatggacgattatgtatgtttgtggccaatgacccaaccacaaaagggggcacatactatcctcttactgtaaaaaagcatctgcgggcacaggaaattgcttctgaatgcaaattgccttgcatatatctcgttgacagtggaggtgctaatctccccaggcaggctgaagttttccctgaccgtgataattttggtcgaatattctacaatcaagctaagatgtcttcaaatggtatccctcagattgccttagttttaggatcttgcaccgctggcggggcttatattcctgcaatggcggatgagagtgtgatagttaagggaaatggaactatttttttctagctggccccccacttgtaaaggctgttacaggagaggagatatctgctgaggaccttggtggagcatcagtacattgtaaggtatccggagtctcggatcattttgcacaagatgaacttcatgggcttgaaatggggcgaaacattgtgaagaacctgcacttagctgctaaggggacaaatattcaaagttctgcttgtgattaccaagaaccattgtatgatgtagaggaacttcgctcaattgcaccagctgatttgaagcagtcctttgacatccgttcagtaatagcccgtattgttgatggtagtgaatttgatgagttcaaaaaattgtatggaacaacactggtgactggttttgcaaggatatgcgggcaaccagttggaataattggaaataatggtatcctgtttactgagtcggcattaaagggttcccacttcattgaactgtgcactcagcgccatattcctttgatattccttcaaaatattactgggttcatggttgggtcgaagtctgaagctagtggaattgcgaaagctggagcaaagatggtcatggcagtttcctgcgccaaggttcctaaaattacaataattgttggtggaagttttggtgctgggaactatggaatgtgtggccgtgcttatagcccaaactttttgtttctttggccaactgctaggatatctgttatgggtggcatccaggcagccggtgtccttgctcaaatagaaaagaacaataaaaagagacaaggagtggagtggaccaaggacgaggaagaagccttcaaagcaaaggtcgcggaggcttacgacaaagaaggaagcccctactacgctactgctaggctatgggacgatggtgtcatcgaccctgctgataccaggcggattctgagcctctgcctctctgctgcggccaagccggttcccgaagacacgaaatatggtgtattccggatgtaaatactgtatgtgaatatgcatccgtgtataaataaaatggcttccgtgcgcccaatgtgtattggacttttgcctctggaaataaaatctttaatcctcgttatatgtttaaaa

SEQ ID NO: 1215 - DNA, 1833 bp, Pennisetum glaucum
gggtgcggctcccgcctccgcgtccgtgctcccggacacgctcgaccggggctccgacgcctacgcgcgcaacgccgcggccgtcggcgggctgcttgccgacctgcgcgcccgcgtctcccaggtgctgcgcgggggtggcccggaggcggtgaagcggaacgcggcgcgggggaagctgctcccgcgggaccgcatcgaccggctgctcgaccccggcgcgtccttcctcgagctctcgcagcttgcaggatcagatgtttatgaagaagcattaccatcagcgggtataataaccggcataggacctgttcacggacgattatgtatgtttgtggccaatgacccgaccaccaaagggggcacatactatcctctcactgtcaaaaagcatctgcgggcacaggaaattgcttctgaatgcaaattgccctgcatatatcttgttgacagtggaggtgctaatctccccaggcaggctgaagtgttccctgaccgtgataattttggtcgaatattctacaaccaagctaagatgtcggcagatggtatccctcagattgccttagttttaggttcttgtaccgctggtggggcttatattcctgcaatggcggatgagagtgtgatagttaagggaaatgggactatatttctagccggtccgccacttgtaaaggctgctacaggagaggagatatctgctgaggaccttggtggagcatcagtacattgtaaggtatccggagtctcagatcattttgcacaagatgaacttcatggccttgcactgggccgaaacattgtgaagaaccttcacttagctgctaaaggaacacatattcaaagttctgcttgtgattaccaagaaccattgtatgatatcgaggaacttcgctcaattgcaccatctgatttgaagcagtcctttgacattcgttcagtaattgcccgtattgtcgatggaagtgaatttgatgagttcaaaaaattgtatggaacaacattggtgactggttttgcaaggatatgcgggcagccagttggaattattggaaacaatggcattttgtttaccgaatcagcgttgaagggctcccacttcattgaattgtgcacacagcgccatattcctttgatattccttcaaaacattacaggattcatggtcgggtcaaaatctgaagctagtggaattgcgaaagctggagcaaagatggtcatggcagtttcctgcgccaaggttcctaaaatcacaataattgttggtggaagttttggtgctgggaattatggaatgtgtggacgcgcatatagcccaaactttttgtttctttggccaactgctaggatatctgttatgggtggcatccaggcggctggtgtcctcgctcagatagaaaagaacaacaaaaagagacaaggagtggagtggaccaaggacgaggaagaagccttcaaagcaaaggtagcggaggcttacgacagagaagcaagcccgtactacgccactgctaggctatgggacgatggggtcatcgaccctgctgacaccaggcgtgttctgagcctctgcctgtctgctgcggcgaagccggttttggaagacacgaagtacggtgtgttccggatgtagatagtgcatatgaatacacatccgtgtataataaaacggctttccatgcgccctatgtgcattggacttctgccatctgggaataaaatttctcaccctggttttacgtcatctttgtttctaatataagtggcacgggacagggaatggtttcgccgggagagagaatgtaattgatgtctcacggaatttaaaaa

SEQ ID NO: 1216 - DNA, 1771 bp, Setaria italica
cgcggcgcccgcctccgcgtccgtgctcccggacacgctcgaccggggctccgacgcctacgcgcgcaacaccgccgccgtcggcgggctgctcgccgacctgcgcgcccgcatctcccaggtgatgcgcgggggaggcgcggaggcggtgaagcggaacgcggcgcgggggaagctgctcccgcgggaccgcatcgaccgcctgctcgaccccggagcgtccttcctcgagctctcgcagcttgcaggctcagatgtttatgaagaagcattaccatcagccggtataataactggcataggacctgttcacggacgattatgtatgtttgtggccaatgacccaaccacaaaagggggcacatactatcctcttactgtcaaaaagcatctgcgggcacaggaaattgcttctgagtgtaaattgccttgcatatatctcgttgacagtggaggtgctaatctccccaggcaggctgaagttttccctgaccgtgataattttggtcgaatattctacaatcaagctaagatgtcgtcggatggtatccctcagattgccttagttttaggttcttgcaccgctggtggggcttatattcctgcaatggcggatgagagtgtaatagttaagggaaatgggactatatttctagccggcccgccacttgtaaaggctgctacaggagaggagatatctgctgaggaccttggtggagcatcagtacattgtaaggtatccggagtctcagaccattttgcacaagatgaacttcatgggcttgcactggggcgaaacattgtgaagaaccttcacttagctgctaaaggaacaaatattcaaagttctgcttgtgattaccaagaaccattgtatgatatcgaggaacttcgctcaattgcaccttctgatttgaagcagtcctttgacattcgttcagtaatagcccgtattgtcgatggaagtgaatttgatgagttcaaaaaattgtatggaacaacattagtgactggttttgcaaggatatgcgggcaaccagttggaatcattggaaacaatggcattttgtttaccgagtcagcattaaagggctcccacttcattgaattgtgcacacagcgccatattcctttgatattccttcaaaacattactggattcatggtcgggtcgaagtctgaagctagtggaattgcgaaagctggagcaaagatggtcatggcagtttcctgcgccaaggttcctaaaattacaataattgttggtggaagttttggtgctgggaattatggaatgtgcggacgcgcatatagcccaaactttttgtttctttggccaactgctaggatatctgttatgggtggcatccaggcggctggtgtcctctctcaaatagaaaagaacaacaaaaagagacaaggagtggagtggaccaaggacgaggaagaagccttcaaagcaaaggtagcggaggcttacgacagagaagcgagcccgtactacgccactgctaggctatgggacgatgggatcatcgaccctgctgacaccaggcgtgttctgagcctctgcctctctgctgcggcgaagccggttccagaagacacaaagtacggtgtattccggatgtaaatggtgtatatgaatacacatccgtgtataataaaacggctttccatgcgcacaatgtgcattggacttctgccctctgggaataaattttctcaccctggttttacgtcatcttttttggtttatttctaatataag

SEQ ID NO: 1217 - DNA, 1737 bp, Saccharum officinarum
ggtccacggggtcgcgccggcgcccgcctccgcctccgtgctcccggacaccctcgacaggggctccgacgcctacaagcgcaacgccgccgccgtcggcgggctgctcaccgacctgcgcgcccgcgtctcccaggtgctgcgcgggggaggcgccgaggcggtgaggcggaacgcggcgcggaggaagctgctcccgcgggaccgcatcgacagactgctcgaccccggcgcgtccttcctcgagctctcgcagctcgcaggctcagatgtttatgatgaagcattaccatcagcaggtataataactggcataggacctgtccatggacgattatgtatgtttgtggccaatgacccgaccactaagggtggcacatactatcctcttactgtcaaaaagcatctgcgggcacaggaaatagcttccgagtgcaaacttccttgcatctatctcgttgacagcggaggtgctaatctccccaggcaggctgatgttttccctgaccgtgataattttggccgaattttctacaatcaagctaagatgtcttcagatggtatccctcagattgcattagtcttaggatcttgcactgctggtggggcttatattcctgcaatggcagatgagagtgtaatagttaagggaaatggaactatatttctagcaggtccgccacttgtaaaggctgctacaggagaggagatatctgctgaggaccttggtggagcatcagtacattgcaaggtatcaggagtctcggatcattttgcacaagatgaacttcatgggcttgagttggggcgaaacattgtgaagaacctgcacttagctgctaaaggaacaaatattcaaagttctacttgtggttaccaagagccattgtatgatgtagaggaacttcgctcaattgcaccagctgatttgaaacagtcctttgacattcgttcagtaatagctcgtattgttgatggaagtgaatttgatgagttcaaaaaattgtatgaaacaacaatagtgacgggttttgcaaggatatgcggacaaccagttggaattattggaaacaatggcattttgtttactgagtcggcgctaaagggttcccacttcattgaattgtgcgctcagcgtcatattcctttgattttccttcaaaacattactgggttcatggtcgggtcgaagtctgaagctagtggaattgccaaagctggagcaaagatggtcatggcagtttcctgtgctaaggttcctaaaatcacaataattgttggtggaagttttggtgctgggaattatggaatgtgcggacgtgcatatagcccaaactttttatttctttggccaactgctaggatatctgttatgggtggcatccaggcagctggtgtcctcgctcaaatagaaaagaacaacaaaaagagacaaggagtggagtggagcaaggacgaagaagaagccttcaaagcaaaagtcgtggaggcctacgacagagaaggaagcccgtactactccactgctagactatgggacgacggggtcatcgaccctgctgacaccaggcgggttctcagcctctgcctctctgcttcggccaagccggttccagaagatacaaaatacggtgttttccggatgtaaataaacgttatgtatgaataacacaaccgtgtttaataaaaatgcttccatgcgctcgacgtgggtgcgctggactttgccttgtgcgc

SEQ ID NO: 1218 - DNA, 2106 bp, Sorghum bicolor
ggccgtggcgcagcaggctgcacactccagcccagcagcagcactgcagcagtagcgccaccaaaactcccacgaagccggggaaccccacccacgaccacgagcctagtctactatgctcagccgactcgccgcggcgcggcggcagcagctgctgctacccgcgcgcggcgccccggccgtcgcgttcgcgtaccgctcctcctcgacagcggcggccgcggtccacggggccgcggcgcccgcgcccgcctccgcctccgtgctcccggacacgctcgacaggggctccgacgcctaccagcgcaacgccgccgccgtcggcgggctgctctccgacctgcgcgcccgcgtctcccaggtgctgcgcggtggaggcgtcgaggcggtgaggcggaacgcggcgcgggggaagctgctcccgcgggaccgcatcgaccggctgctcgaccccggcgcgtccttcctcgagctctcgcagcttgcaggctcagatgtttatggtgaagcattaccatccgcaggtataataactggcataggacctgttcatggacgattatgtatgtttgtggccaatgacccgaccactaagggtggcacatactatcctcttactgtcaaaaagcatctgcgggcacaggaaatagcttccgagtgcaaactgccttgcatctatctcgttgacagcggaggtgctaatctccccaggcaggctgatgttttccctgaccgtgaaaattttggccgaatattctacaatcaagctaagatgtcttcagacggtatccctcagattgcattagtcttaggatcttgcactgctggtggggcttatattcctgcaatggcggatgagagtgttatagttaagggaaatggaactatatttctagcgggtccgccacttgtaaaggctgctacaggagaggagatatctgctgaggaccttggtggagcatcagtacattgcaaggtatcaggagtctcagatcattttgcacaagatgaacttcatgggcttgagttggggcgaaacattgtgaagaacctgcacttagctgctaaaggaacaaatattcaaagttctgcttgtggttaccaagagccattgtacgatgtagaggaacttcgctcaattgcaccagctgatctgaaacagtcctttgacattcgttcagtaatagcccgtattgttgatggaagtgaatttgatgagttcaaaaaattgtatggaacaacactagtgactggttttgcaaggatatgcgggcaaccagttggaattattggaaacaatggcattttgtttactgagtcagcgctaaagggctcccacttcattgaattgtgtgctcagcggcatattcctttgattttccttcaaaacattactgggttcatggtcgggtcgaagtctgaagctagtggaattgccaaagctggagcaaagatggtcatggcagtttcctgtgctaaggttcctaaaattacaataattgttggtggaagttttggtgctgggaactatggaatgtgcgggcgtgcatatagcccaaactttttatttctttggccaactgctaggatatctgttatgggtggcatccaggcagctggtgtcctcgctcaaattgaaaagaacaacaaaaagagacaaggagtggagtggagcaaggacgaggaagaagccttcaaggcaaaagtggtggaggcttacgacagagaaggaagcccgtactattccactgctagactatgggacgacggggtcatcgaccctgctgacaccaggcgggttctcagcctctgcctctctgcttccgccaagccggttccggaagatacaaaatacggtgtattccggatgtaaataaacgtgtatgaataacgcaaccgtattttaataaaaacggcttccatgcgcccaatgtgcgcgctggactttgccttctgcacaaataaaatttcgcccgggttttctgtcgtcgaaatgtgtggcacgggacagacaggcaccgtttacctaatattttgactgatggtacaaaagtgttcttcatttattttttattattatactacatgaatggaaagtgttcttca

SEQ ID NO: 1219 - DNA, 2129 bp, Zea mays
cccagcgcggcgtctagtcatcagatcattatccgcaccgacttgcgtgcacgagcttcgcggcgagggcagcaccggggctgggaatgggaagacactgcagcccagctccagcagcactacagcagtagcgccaccgaacctgaaaactccgaccccccacgaaatcgcggaacctacccacgagccgagccatgctcagccgactcgccgcggcgaggcgacagctactgctatccccggccgtcgcgtaccgctcctcctcggcagcggcgacggcgtcggcggtccacgagagagcagcgcccgcctcggcctccgtgctcccggacaccctcgaaaggggctccgacgcgtaccagcgcaacacggccgccgtcggcgggttgctctccgacctgcgcgcccgcgtctcccaggtgctgcgcgggggaggcgccgaggcggtgaggcggaacgcggcgcgggggaagctgctcccgcgggaccgcatcgaccgactgctcgaccccggcgcgtccttcctcgagctctcgcagcttgcaggctcagatgtttatgatgaagcattaccatcagcaggtataataactggcataggacctgttcatggacggttatgtatgtttgtggccaatgacccaaccactaagggtggcacatactatcctcttactgtcaagaagcatctgcgagcacaggaaatagcttcggagtgcaaactgccttgcatatatctcgttgacagcggaggtgctaatctccccaggcaggctgacgttttccctgaccgtgataattttggccggatattctacaatcaagctaagatgtcttcagatggtatccctcagattgcagtagtcttgggttcttgcactgctggtggggcatatattcctgcaatggcggatgagagtgtaatagttaagggaaatgggactatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaattgtatggaacaacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttaagagtgttgttcatttcatatattactatctgatgaatgggaagtgttcttcatttgatagtaggtatataactgtgcattgct

SEQ ID NO: 1220 - DNA, 1532 bp, Triticum aestivum
ccgcatcgaccgcctgctcgaccccggggcctccttcctcgagctctctcagcttgcaggatctgatgtttatgaggaagcattaccatcagggggaataattactggcattggacctgttcatggacgactatgtatgtttgtggccaatgacccaactacgaaggggggtacatactatcctatcaccgtcaaaaagcatctgcgggcgcaggaaatagcttctgaatgtaaattgccctgcatatatcttgttgacagtggaggcgctaatctccccaagcaggcagaggttttccccgaccgtgataattttggtcgaatattctacaaccaagctaagatgtctgcagatggtattcctcagattgcagtagttttaggttcttgtaccgctggcggggcttatatccctgcaatggctgatgaaagtataatagttaagggaaatggaacgatatttctagctggtccaccccttgtaaaggctgctacaggggaggagatatctgctgaggaccttggtggagcatcagtgcattgtaaagtatcaggagtctctgatcattttgcacaagatgaacgtcatggtcttgcgctgggaaggaacattgtgaagaacctccatttggccgctaaagaaacaagtatacacaattctgcttgtgattaccaagaaccattgtatgatgtacaggaacttcgctcaattgcaccagctgatacgaagcaatcttttgatattcgctcaataatagctcgtatagtcgatggaagtgaatttgatgaattcaaaaaattgtacggaacaacactagtgaccggttttgcaaggatatgcgggcagccagttggaattattggaaacaatggcattttatttaccgagtcggcactaaagggtacccacttcattgagttgtgtgctcaacgcaatattcctctgatattccttcaaaatatttctggattcatggttggttcgaaatctgaagcaagtggaattgcgaaagctggagcaaaaatggttatggcagtttcctgttcaaaggttcctaaaattaccataattgtcggtggaagttttggtgctgggaattatggaatgtgtggacgtgcatacagcccgaattttttgttcatgtggccaactgctaggatatctgttatgggtggcattcaggcagctggtgttctcgcccaaatagagaagaacaacaggaaaaggcaaggagtggagtggaccaaagatgacgaagaagccttcaaagccaaagtcgtcgaggcctatgacaaggaaggaagcccgtattactcgaccgctaggctttgggacgacgggatcatagatcccgcagataccaggcgggttctaagcctttgcctttctgcttcggccaagccggttccagaagacacgaaatatggcgtgttccgaatgtaaatccatgtgtatgtatagtgcacatccctgtaaaataaaactctgcttcgatgcttccaatatatggattgaaatgaggcgcttattc

SEQ ID NO: 1221 - DNA, 1551 bp, Triticum aestivum
ctctctcagcttgcaggatctgatgtttacgaggaagcattaccatcagcgggaataattactggcatagggcctgttcatggacgactatgtatgtttgtggccaatgacccaactacaaaggggggtacatactatcctatcactgtcaaaaagcatctgcgggcgcaggaaatagcttctgaatgtaaattgccctgcatatatcttgttgacagtggaggtgctaatctccccaagcaggcagaagttttccccgaccgtgataattttggtcgaatattctacaatcaagctaagatgtccgcagatggtattcctcagattgctgtagttttaggttcttgtactgctggcggggcttatattcctgcaatggctgatgaaagtataatagttaagggaaatggaacaatatttctagctggtccaccccttgtaaaggctgctacaggggaggagatatctgctgaggaccttggtggagcatcagtgcattgtaaaatatcaggagtctctgatcattttgcacaagatgaacaccatggtcttgcactgggaaggaacgttgtgaagaacctccatttggccgctaaagaaacaagtagacacaattctgcttgtgattaccaagaaccattgtatgatgtacaggaacttcgctcaattgcaccagctgatacgaagcaatcttttgacattcgctcaataatagctcgtatagtcgatggaagtgaatttgatgaattcaaaaaattgtatggaacaacactagtgactggttttgcaaggatatgcgggcagccagttggaattattggaaacaatggcattttatttaccgagtcggcactaaagggtacccacttcattgagttgtgtgctcaacgcaatattcctttgatattccttcaaaatatttctggattcatggttgggtcgaaatctgaagcaagtggaattgcgaaagctggggcaaaaatggttatggcagtttcctgttcaaaggttcctaaaattaccataattgtcggtggaagttttggtgctgggaattatggaatgtgtggacgtgcatacagcccgaattttttgttcatgtggccaactgctaggatatctgttatgggtggcattcaggcagctggtgttctcgcccaaatagagaagaacaacaggaaaaggcaaggagtggagtggaccaaggatgatgaagaggccttcaaagccaaagtcgtcgaggcatatgacaaggaaggaagcccgtattactcgaccgctaggctttgggacgacgggatcatagatcccgcggataccagacgggttctaagcctttgcctctctgcttccgccaagccggttccagaagacacgaaatatggcgtgtttcgaatgtaattattatgtaaatcatgtatagtacacatgtcacagacctgtaaaataaaacctgctttactgcttccaatataaattgaaatgaggtgcttattcaaggcttgtttctctggggaaattttgctagcctcgtgccgaattcggcaccag

SEQ ID NO: 1222 - DNA, 1733 bp, Triticum aestivum
ccaacttgttgtggactatgagctgctgatgatacttttcgcgataaagcttgcaggatctgatgtttatgaggaagcattaccgtcagggggaataattactggcataggacctgttcatggacgactatgcatgttcgtggcaaatgacccaactacaaaggggggtacatactatccaatcactgtcaaaaagcgtctgcgggcgcaggaaatagcttctgaatgtaaattgccctgcatatatcttgttgacagtggaggcgctaatctccccaagcaggcagaggttttccccgaccgtgataattttggtcgaatattctacaaccaagctaagatgtctgcagatggtattcctcagattgcagtagttttaggttcttgtaccgctggcggggcttatatccctgcaatggctgatgaaagtataatagttaagggaaatggaacgatatttctagctggtccaccccttgtaaaggctgctacaggggaggagatatctgctgaggaccttggtggagcatcagtgcattgtaaagtatcaggagtctctgatcattttgcacaagatgaacgtcatggtcttgcgctgggaaggaacattgtgaagaacctccatttggccgctaaagaaacaagtatacacaattctgcttgtgattaccaagaaccattgtatgatgtacaggaacttcgctcaattgcaccagctgatacgaagcaatcttttgatattcgctcaataatagctcgtatagtcgatggaagtgaatttgatgaattcaaaaaattgtacggaacaacactagtgaccggttttgcaaggatatgcgggcagccagttggaattattggaaacaatggcattttatttaccgagtcggcactaaagggtacccacttcattgagttgtgtgctcaacgcaatattcctctgatattccttcaaaatatttctggattcatggttggttcgaaatctgaagcaagtggaattgcgaaagctggagcaaaaatggttatggcagtttcctgttcaaaggttcctaaaattaccataattgtcggtggaagttttggtgctgggaattatggaatgtgtggacgtgcatacagcccgaattttttgttcatgtggccaactgctaggatatctgttatgggtggcattcaggcagctggtgttctcgcccaaatagagaagaacaacaggaaaaggcaaggagtggagtggaccaaagatgacgaagaagccttcaaagccaaagtcgtcgaggcctatgacaaggaaggaagcccgtattactcgaccgctaggctttgggacgacgggatcatagatcccgcagataccaggcgggttctaagcctttgcctttctgcttcggccaagccggttccagaagacacgaaatatggcgtgttccgaatgtaaatcatgcatgtatagtgcacatccctgtaaaataaaactctgcttcgatgcttccaatatatggattgaaatgaggcgcttattcaaagcttgtttctctggggaaactttgctagccctgatgtattgattttgtccatgttcttttctagtgcttggaaggggctaaaaggcgacttgatcgaaaacgaactttacattgtgctgtgtcaaaagaaaccagcgcgtgcagatgttggttaccatgtgtgcactagaaaatttatttgcaacataaatagattttggtgtt

SEQ ID NO: 1223 - DNA, 2089 bp, Triticum aestivum
cccccacaaatgaagcggctttcttaaactcgagggaagagaagcgccgccgccgccgcggggggagatggcccccgccgcagccgccgcgccggcgccggccgccaccgcctgctcctcgtcggcgagctccgcgcgcccgccctccaccgcctcctcctcctcccagtcgccgcccaggcgcacggtcccggcgctcctcctcttcacctccctcgccgccctcctcatcctctcctccggcgaggcccacgacgccgacgccgacgccgcgtccggccgccccctcaaagatgtcagcttggaaaatccggaggtgacttttgctccctcatccatgggtggaatcttttgtgagcgaatccgcatttctggaatgccaaggtggcagtttcaaagctacgcaaatcaaatacatgttagaatgaatgtttctcattcaatgccagaaaagttccattggaaaatacagatttgctttcatgggaatgcttctacgggtctgtgccaatgtgagatgggtgaatggcaagttctgcaaggtggcatgtggaacgcagtgaagtctccatatgtcagcagatatgttgatgtgaaactgactgataagaaatctactgtcttcagcctttccattcaggaagagcttcagaagtggcgtttagcttgccttggtattggatttgtcctgttattcctgtcacccatcgttagtaaatgggcacctttttactatagcagctctatggcacttggaatcctgcttgtggtgctgattgtccttttccaggggatgaaactgctaccaatgggcaaaaaaggtttattttaccttacaatttatggatctgtgttgggtgttggctcctacgctgcacactacttctcctcaatggttgcctctattctggaaaactttggcttgagtgaggagatgcacaaccctgtgtcaatctttctgctggtagcagttgtcttgactggagctggttttggctattggatggtgaggagatttatcatttcaaaagatggcagtgttgatgccgggatagcacagtttgtgaagtgggctatgcgtgttgtttcaatgttctttgttatgcagagcacactggaccctattctagcatcggctgctctagctgctagctggtggatttgctctgtactgacagcaaagaaagttcacaagccaacagcaccgaagcgaaaacaatcaaatgttccttctcatcgaaggtttactcaagtatcacccaacacccgccaggtccagttctcaagtccatcatcaggggcgggtactggaagagccacaacaacacagtatggttggaacaatttagccaatggaggtctggtccccaaagcagtcagaaagagggtagcacccaatcaagatgaagactactactccaccttccacaacatcgaaccacggaaatactcaaagagagaatgggaggagttcaccgaggaatcgaccagaaacgcactgatggaacacacagccaccccagagttcgcccaatgggctgctgacaatgctcaccggttgcgggtggagcgggacgacgtgtccgaggacgagtcgatcgagagctactctagctcttccgaagaagccgagaaaggcggaaaagcttctcgtctgttgagcaggtttatgtgatatcgtcaccggctaaaactgtagggagctcgacgtgctgcttttgcggacgatgtgtataaggtaggattggaaacttggtagcggtagggggtggaagttcatcgtttccacatggttcgccattgcagcagaatgcttggtgactgtaggcggtagttggttggttaaccatcatccatctcaattcaactaatgttaggtttagctggcagtctgccatccatggatctttagattttagtcgatgcatcaggggatgtggaccggtgtcggttccgcgccattcgatggattagggacagtcgatcctgttgggatcttgccattgtcttgttgaacatctcctgtttcattctcaggtgtgtgagagtagcatttcaaggatctttatctcttgttagctgggcatgt

SEQ ID NO: 1224 - DNA, 2094 bp, Triticum aestivum
  misc_feature (261)..(261): n is a, c, g, or t
  misc_feature (263)..(264): n is a, c, g, or t
  misc_feature (304)..(304): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (340)..(340): n is a, c, g, or t
  misc_feature (385)..(385): n is a, c, g, or t
  misc_feature (428)..(428): n is a, c, g, or t
  misc_feature (460)..(460): n is a, c, g, or t
  misc_feature (509)..(509): n is a, c, g, or t
  misc_feature (528)..(528): n is a, c, g, or t
  misc_feature (540)..(540): n is a, c, g, or t
  misc_feature (562)..(562): n is a, c, g, or t
  misc_feature (565)..(565): n is a, c, g, or t
  misc_feature (582)..(582): n is a, c, g, or t
  misc_feature (641)..(641): n is a, c, g, or t
  misc_feature (1093)..(1093): n is a, c, g, or t
  misc_feature (1226)..(1226): n is a, c, g, or t
  misc_feature (1244)..(1244): n is a, c, g, or t
  misc_feature (1272)..(1272): n is a, c, g, or t
gcacgaggcttccccccacaaatgaagcggctttcttaaactcgtgggaagagaagcgccgccgtcgccgcggggggagatggcccccgccgcagccgccgcgccggcgccggccgccaccgcctgctcctcgtcggccagctccgcgcgccctccctccaccgcctcctcctcctcccagtcgccgcccaggcgcacggtcccggcgctcctcctcttcacctccctcgccgccctcctcatcctctcctccggcgaggncnncgacgccgacgccgcgtccggccgccccctcaaagatgtnagnttngaaaatccngaggtgacttttgctccctcntccatgggtggaatcttttgtgagcgaatccgcatttctggaatnccaaggtggcagtttcaaagctacgcaaatcaaatacatgttngaatgaatgtttctcattcaatgccagaaaanttccattggaaaatacagatttgctttcatgggaatgcttctacgggtntgtgccaatgtgagatggntgaatggcaagntctgcaaggtggcatgtggaangcngtgaagtctccatatgncagcagatatgttgatgtgaaactgactgataagaaatctactgtcttcagcctttccntcaggaagagcttcagaagtggcgtttagcttgccttggtattggatttgtcctgttattcctgtcacccatcgttagtaaatgggcacctttttactatagcagctctatggcacttggaatcctgcttgtggtgctgattgtccttttccaggggatgaaactgctaccaatgggcaaaaaaggtttattttaccttacaatttatggatctgtgttgggtgttggctcctacgctgcacactacttctcctcaatggttgcctctattctggaaaactttggcttgagtgaggagatgcacaaccctgtgtcaatctttctgctggtagcagttgtcttgactggagctggttttggctattggatggtgaggagatttatcatttcaaaagatggcagtgttgatgccgggatagcacagtttgtgaagtgggctatgcgtgttgttncaatgttctttgttatgcagagcacactggaccctattctagcatcggctgctctagctgctagctggtggatttgctctgtactgacagcaaagaaagttcacaagccaacagcaccgaagcgaaaacaatnaaatgttccttctcatcnaaggtttactcaagtatcacccaacacncgccaggtccagttctcaagtccatcatcaggggcgggtactggaagagccacaacaacacagtatggttggaacaatttagccaatggaggtctggtccccaaagcagtcagaaagagggtagcacccaatcaagatgaagactactattccaccttccacaacatcgaaccaaggaaatactcaaagagagaatgggaggagttcaccgaggaatcgaccagaaacgctctgatggaacacacagcgaccccagagttcgcccaatgggctgctgacaatgctcaccggttgcgggtggagcgggacgacgtgtccgaggacgagtcgatcgagagctactctagctcttccgaagaagccgagaaaggcggaaaagcttctcgtctgttgagcaggtttatgtgatatcgtcaccggctaaaactgtagggagctcgacgtgctgcttttgcggacgatgtgtataaggtaggattggaaacttggtagcggtagggggtggaagttcatcgtttccacatggttcgccattgcagcagaatgcttggtgactgtaggcggtagttggttggttaaccatcatccatctcaattcaactaatgttaggtttagctggcagtctgccatccatggatctttagatttttagtcgatgcatcaggggatgtggaccggtgtcggttctgcaaccattcgatggattagggacagtcgatcctgttggggtcttgtcattgtcttgttgaacatctcctgtttcattctcaggtgtgtgagagtagcatttcaaggatctttatctcttgttagctgggcat

SEQ ID NO: 1225 - DNA, 1372 bp, Hordeum vulgare
ggagaacaaacaagtctctgcacggctgcaccggagcaggaaccgagagagagagagaagctctgcccctgagctcctccgccggcatggagatccttcaacaaggcactatgtcgatgttccctgggatggatcttacgaaaatggatcctccaactcttaccctccttggagcagcttgttgtgtaatgttgtctatgcatttcacaatacagctggtatcacagcatcttttttattggaaaaatcccaaagagcagaaggctatactcattatagtgctgatgcctccattgtatgctatgacttcctttgctggtcttctggatattaagggaagcaaaacgttttttacatgcttggagtctgttaaagaatgttatgaagcactggttattgctaagtttctggcattgatgtacagctacttaaatatatctatcagtaaaaacatcgtacctgatgaaatcaaagggagggtgcttcatcattctttccctgtttctcttttcctgccccgtaatgttcggttggagcacaagacactaaagcttctgaagtactggacctggcaatttgttgttgttaggcctgtatgctccattctgattatcgcacttcagcttattgggctgtaccccagctgggtcagttggacgttcacaattatactgaacttgtcagtctccatggcactgtatgccttggtcattttctatcacttgtttgccaaggagctggcacctcacaagcctcttgcaaagttcttgtgcatcaaagggattgtcttcttctctttctggcagggctgtgccttggatgttttggctgctgtagggtttattcaatctcaccatttctggctggacgtggagcacatccaggaggcaatccagaatgtcttgattatcctggaaatggtcatcttctcagttctccagcaatacgcatatcacgttgctccgtacagtggcgctgacaaggcaaaattcgagaagaagaatgaatgatccgccaagcaacataagcagcttgttcttgtatggttttgtgtgtttgtgctgggaacacggattcaacatgctataggacatgcatttccttttgggcatgtgtagagtgagtcgttatacgttgaacaatagaataccgagatgtccaggattcaggaacatgcaggaatggcactgttatttgcgctgtgaaactatgtaatgcaccaataaggagaattttggggttttcccgctccaagatggagtcctgaataaatgtggtttcctgctgaagaacatggcagttattggcgaccccataacaagcttaaattatgcgtgggggggatcttaatatttatatcagaaccccgagg

SEQ ID NO: 1226 - DNA, 1494 bp, Triticum aestivum
aaaaaaacctgctcccacgcgggtcgcgaggagatcaaacaagtctctgcaccggagcaggaaccgagagagagagagagagagagagagtccactgcccgtcttcccctgagctccttcgccggcgaacgcccaaaactccgcatggagatcctccaacaaggcactatgtcgatgttcccggggatggatcttacgaaaatggatcctccaactcttaccctccttggagcagcttgttgtgtaatgttgtctatgcatttcacagtacagctggtatcacagcatcttttctattggaaaaatcccaaagagcagaaggctatactcattatagtgctgatgcctccattgtatgctataacttcctttgctggtcttctggatattaagggaagcaaaacattttttacatgcttggagtctgttaaagaatgctatgaagcactggttattgctaagtttctggcattgatgtacagctacttaaatatatctatcagtaaaaacattgtacctgatgaaatcaaagggagggtgcttcatcattctttccctgtttctcttttcctgccccgtaatgttcggttggagcacaagacacttaagcttctgaagtactggacctggcaatttgttgttgttaggccagtatgctccattctgattattgcacttcagcttcttgggttgtaccccagctgggtcagctggaccttcacaattatacttaacttttcagtctccatggcattatatgccttggtcatattctatcacttgtttgctaaggagctggcacctcacaagcctcttgctaagttcttgtgcatcaaagggatagtcttcttctctttctggcagggctgtgcgttggatgttttggctggtgtaggggttattcaatctcaccatttctggctggacgtggagcacatccaggaggcaatccagaatgtgttgattatcctggaaatggtcattttctcagttctccagcagtacgcgtatcacgttgctccgtacagtggcgctgacaaggcaaaattcgagaagaagaatgaatgatccgccaagcaacataagcagcttgttcttgtatggttttgtgtgtatgtgctgggaatatgttatagacatgggtacttccttatgggcacgtgtagagtgagccgttatactttgaacattagaaaaacgagatgatcaggaacatagaggaatgacactgttatctgcgctgtgaaactatgtaatgcccgaataaggagaattttggggttttttccgctccaaagtggagtcctgaataaatgttggtttcgtgttgaaatcatggtgtgtccatgttgtttgctgaacttaacgcagcactacataaggtgtttttttttcaggagtgtggacttttggtgaccgagctccaaggagcttggtgctttaaattttaaaaagttgagaaggcatttagaaatacatattgtctttcttttg

SEQ ID NO: 1227 - DNA, 1298 bp, Triticum aestivum
gagagagagagagagagagagtccactgcccgtcttcccctgagctccttcgccggcgaacgcccaaagccccgcatggagatcctccaacaaggcactatgtcgatgttcccggggatggatcttacgaaaatggatcctccaactcttaccctccttggagcagcttgttgtgtaatgttgtctatgcatttcacagtacagctggtatcacagcatcttttctattggaaaaatcccaaagagcagaaggctatactcattatagtgctgatgcctccattgtatgctataacttcctttgctggtcttctggatattaagggaagcaaaacattttttacatgcttggagtctgttaaagaatgctatgaagcactggttattgctaagtttctggcattgatgtacagctacttaaatatatctatcagtaaaaacattgtacctgatgaaatcaaagggagggtgcttcatcattctttccctgtttctcttttcctgccccgtaatgttcggttggagcacaagacacttaagcttctgaagtactggacctggcaatttgttgttgttaggccagtatgctccattctgattattgcacttcagcttcttgggttgtaccccagctgggtcagctggaccttcacaattatacttaacttttcagtctccatggcattatatgccttggtcatattctatcacttgtttgctaaggagctggcacctcacaagcctcttgctaagttcttgtgcatcaaagggatagtcttcttctctttctggcagggctgtgcgttggatgttttggctggtgtaggggttattcaatctcaccatttctggctggacgtggagcacatccaggaggcaatccagaatgtcttgattatcctggaaatggtcattttctcagttctccagcagtacgcgtatcacgttgctccgtacagtggcgctgacaaggtaaaattcgagaagaagaatgaatgatccaccaagcaacataagcagcttgttcttgtaaggttttgtgtgtatgtgctgggaatatgttatagacatgggtacttccttatgggcgcgtgtagagtgagccgttatactttgaacattagaaaaacgagatgatcaggaacatagaggaatgacactgttatctgcgctgtgaaactatgtaatgcccgaataaggagaattgggatttttcccgctccaaaatggagccctgaataaattttggtttcgtgttgaaatcatggtgtgtccatgttgtttgatgaaaaaaaaaa

SEQ ID NO: 1228 - DNA, 1190 bp, Triticum aestivum
aggcaccatgtcgatgttcccagggatggatcttactaaaatggatgctccaactcttaccctccttggagcagcttgttgtgtaatgttatctatgcattcacagtgcagctggatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaagtttctggcattgatgtacagctacttaaatatatctattagcaaaaatattgtacctgatgaaatcaaagggagggtgcttcatcattctttccctgtttctcttttcctgccccgcaatgttcggctggagcacaagacattaaagcttctgaagtactggacctggcaatttgttgttgttaggcctgtatgctccattctgattattgcacttcagcttcttgggctgtaccccagctgggtcagctggacgttcacaattatactgaacttttcagtctccatggcattatatgccttggtcatattctatcacttgtttgctaaggagttggcacctcacaagcctcttgcgaagttcttgtgcatcaaagggattgtcttcttctctttctggcagggctgtgcactggatattttggctgctgtaggggtgattcagtctcaccatttctggctggacgtggagcacatccaggaggcaatccagaatatcttgattatcctggaaatggtcatcttctcagtcctccagcaatatgcgtaccacgtcgctccgtacagcggcgctgacaaggcgaaatccgtgaagaagaacgaatgatccagggcttcgtgccaagcaacgtcttccgctggctcttgtatgattttgtgtgtatgtgctgggagtattgattcaaagatgttataggacgtgtatttccttgtggacacgtgtagagtcgtcgttataccttgaacattagaaaaacgagatgatcaggaacaagatataggaatgctactgttgttaccgtgctgtgagactatgtaatgcccgaataaggagaattttgggggtttcctgccccgaattgcgcccagaataaatggtggtttactgtcg

SEQ ID NO: 1229 - DNA, 1367 bp, Brachypodium distachyon
ggagctccagcggtctacgcacgcacgccaggagatcaaacaagtccaccacagctccacccgcgagctcttcgcttctccgccggcggagccaacaccacacggagattccaaggctccacgactaggcgcctgctccccgctcttctccgccggcgagccaactccccacgaagagcccccaaccaggcacaatgtcgctgttcccaggaatggatcttactaaaatggatcctccaactcttaccctccttggagcagcttgctgtgtgatgttatctatgcatttcacagtacaattggtatcacaacatcttttctattggaaaaatcccaaggagcagaaggctatactcattatagtgttaatgcctccactgtatgctataacttcctttgttggccttctcgatattaagggaagcaaaacattttttacgtgcttggaatctgttaaagaatgctatgaggcactggtcattgccaagtttctggcattgatgtacagctacttgaatatatctatcagtaaaaacatcgtacctgatgaaatcaaagggagggtgcttcatcattctttccctgtttctcttttcctgccccgcaatgttcggttagagcacaagactctaaagcttttgaagtactggacctggcaatttgttgttgttaggccagtatgttccattctgatgattacacttcagctttttgggctgtacccaagctgggtcagctggacgttcacaattatactgaatttttcagtctccatggcattatatgccttggtcatcttctatcacttgtttgctaaggagctggcacctcacaagcctcttgctaagttcctatgcatcaaagggattgtcttcttctctttctggcagggctgtgctctggatgttttagctgctgtaggtatcattcagtcccaccatttctggctggacgtggagcacatacaggaggcgatccagaacgtcctggtgatccttgaaatggtcatcttctcggtcctccagcaatacgcttaccacgttgcaccgtacagtggcgccgacagggcgaagtttgagaagaagaacgaatgatccacgctttgccaccgagcagcatcctccagctaccctgtgtatgactctatgttttgttgcctgtatgcgccgggaatatgaactcaggatgttgcagaacactggcatttctttttgtagagcatgtcgttatgccatgaacatcattagaacaagtaaaacgagatggtcaggaacaaactggaatgctatcgccggtactgcaccgtgtaactatgcaatgcctgaataaggagatatttttttgtgcgttccctacttctaattatc

SEQ ID NO: 1230 - DNA, 1280 bp, Leymus cinereus x Leymus triticoides
  misc_feature (508)..(508): n is a, c, g, or t
  misc_feature (533)..(533): n is a, c, g, or t
  misc_feature (535)..(535): n is a, c, g, or t
  misc_feature (725)..(725): n is a, c, g, or t
  misc_feature (803)..(803): n is a, c, g, or t
  misc_feature (806)..(806): n is a, c, g, or t
ctggccaaatttgcagatctctcggcggctccgcaacgagcgaccggcgctagctggcccccttccctcccgcgtggcgacggaagctgtaggcaccatgtcgatgttcccagggatggatcttaccaaaatggatcctccaactcttaccctccttggagcagcttgttgtgtaatgttatctatgcatttcacagtgcagttggtatcacaacatcttttctattggaaaaatcccaaagagcagaaggctatactcattattgtgctaatgcctccactgtatgctataagttcctttgttggtcttctggatattaagggaagcaaaacgttttttacatgcttggagtctgttaaagaatgctatgaggcactggttattgctaagtttttggcattgatgtacggctacttgaatatatctattagcaaaaacattgtacctgatgaaatcaaagggagggtgcttcatcattctttccctgtttctcttttcctgccccgnaatgttcggttggagcacaagacantnaagcttctgaagtactggacctggcaatttgttgttgttaggcctgtatgctccattctgattattacacttcagcttcttgggctgtaccccagctgggtcagctggacgttcacaattatactgaacttttcagtctccatggcattatatgccttggtcatattctatcacttgtttgctaaggagntggcacctcacaagcctcttgctaagttcttgtgcatcaaagggattgtcttcttctctttctggcagggctgtgcgntgnatgttttggctggtgtaggggttattcagtctcaccatttctggctggacgtggagcacatccaggaggcaatccagaatgtcttgattatcctggaaatggtcattttctcagtcctccagcaatatgcgtatcacgttgctccgtacagcggcgctgacaaggcaaaattcgagaagaagaatgaatgatccaggtctcacgccaagcaacatatgcagcctgttcttgtatgcttttgtgtgtatgtgctgggaatatggattcaggatgttataggacatgtccgtttcctcatgggcacgtgtagagtgagtcgttataccttgaacgttaggaaaacgagatgataaggaacatataggaatggcactgttatttgcgctgtaaaattatgtaatgcccgaataaggagaatttggggttttcccgctccaaattgagtcctgaataaatgttagtttcgtgctgaaa

SEQ ID NO: 1231 - DNA, 1325 bp, Triticum aestivum
caagaaacgcaacatcaaagagttaagaccgcggcggcttcacaggaagctacgtatcgtcagacagacagcgcccaaatttgcagatctctcggcggctccgcaacgagcaaccggcgctagctgcccccccttccctcccgcgtgccgacggaagctgcaggcaccatgtcgatgttcccagggatggatcttactaaaatggatgctccaactcttaccctccttggagcagcttgttgtgtaatgttatctatgcatttcacagtgcagttggtatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaagtttctggcattgatgtacagctacttaaatatatctattagcaaaaacattgtacctgatgaaatcaaagggagggtgcttcatcattctttccctgtttctcttttcctgccccgcaatgttcggttggagcacaagacattaaagcttctgaagtactggacctggcaatttgttgttgttaggcctgtatgctccattctgattattgcacttcagcttcttgggctgtaccccagctgggtcagctggacgttcacaattatactgaacttttcagtctccatggcattatatgccttggtcatattctatcacttgtttgctaaggagttggcacctcacaagcctcttgctaagtttttgtgcatcaaagggattgtcttcttctctttctggcagggctgtgcactggatattttggctgctgtaggggtgattcagtctcaccatttctggctggacgtggagcacatccaggaggcaatccagaatatcttgattatcctggaaatggtcgtcttctcagtcctccagcaatatgcataccacgtcgctccgtacagcggcgctgacaaggcgaaattcgagaagaaaaatgaatgatcccttccctgcggagcaacacccgcggctagttcatgtatggttttgtgtgtatgtgctgggagtattgattcaaagatgttataggacatgtgtatttccttgtggacacgtgtagagtgggttgtcgttataccttgaacattagaaaaccagatgatcaggaacaacatataggaatgctactgttgttatcgtgctgtgagactgtaaatgcctgaataaggagaatttggggggtttcccactccgaattg

SEQ ID NO: 1232 - DNA, 1246 bp, Triticum aestivum
agacagacagcgcccaaatttgcagatctctcggcggctccgcagcgagcaaccccccttccctcccgcgtgccgacggaagctgcagcctgcaggcaccatgtcgatgttcccagggatggatcttactaaaatggatgctccaacgcttaccctccttggagcagcttgttgtgttatgttatctatgcatttcacagtacagttggtatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaaatttctggcattgatgtacagctacttaaatatatctattagcaaaaacattgtacctgatgaaatcaaagggagggtgcttcatcattctttccctgtctctcttttcctgccccgcaatgttcggttggagcacaagacattaaagcttctgaagtactggacctggcaatttgttgttgtcaggcctgtgtgctccattctgattattacacttcagcttcttgggctgtaccccagctgggtcagctggacgttcacaattatactgaacttttcagtctccatggcattatatgccttggtcatattctatcacttgtttgctaaggagttggcacctcacaagcctcttgctaagtttttgtgcatcaaagggattgtcttcttctctttctggcagggctgtgcactggatattttggctgctgtaggggtgattcagtctcaccatttctggctggacgtggagcacatccaggaggcaatccagaatatcttgattatcctggaaatggtcgtcttctcagtcctccagcaatatgcataccacgtcgctccgtacagcggcgctgacaaggcgaaattcgagaagaaaaatgaatgatcccttccctgcggagcaacacccgcggctagttcatgtatggttttgtgtgtatgtgctgggagtattgattcaaagatgttataggacatgtgtatttccttgtggacacgtgtagagtgggttgtcgttataccttgaacattagaaaaccagatgatcaggaacaacatataggaatgctactgttgttatcgtgctgtgagactgtaaatgcctgaataaggagaatttggggggtttccc

SEQ ID NO: 1233 - DNA, 1151 bp, Triticum aestivum
gcccaaatttgcagatctctcggcggctccgcagcgagcaaccccccttccctcccgcgtgccgacggaagctgcagcctgcaggcaccatgtcgatgttcccagggatggatcttactaaaatggatgctccaacgcttaccctccttggagcagcttgttgtgttatgttatctatgcatttcacagtacagttggtatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaaatttctggcattgatgtacagctacttaaatatatctattagcaaaaacattgtacctgatgaaatcaaagggagggtgcttcatcattctttccctgtctctcttttcctgccccgcaatgttcggttggagcacaagacattaaagcttctgaagtactggacctggcaatttgttgttgtcaggcctgtgtgctccattctgattattacacttcagcttcttgggctgtaccccagctgggtcagctggacgttcacaattatactgaacttttcagtctccatggcattatatgccttggtcatattctatcacttgtttgccaaggagttggcacctcacaagcctcttgctaagttcttgtgcatcaaagggattgtcttcttctctttctggcagggctgtgcgctggatgttctggctgctgtaggggtgattcagtctcaccatttctggctggatgtggagcacatccaggaggcaatccagaatatcttgattatcctggaaatggtcatcttctcagttctccagcaatatgcgtaccacgtcgctccgtacagtggcgctgacaaggcgaaatccgtgaagaagaacgaatgatccagggcttcgtgccaagcgacatccgcagctagttcatgtatggttttgtgtgtatgtgggagtattgattcaaagatgttatagggcatgtgtatttccttgtggacacgtgtagagtgggtcgtcgttataccttgaacattagaaaaacagagatga

SEQ ID NO: 1234 - DNA, 1375 bp, Hordeum vulgare
gtaaatatcgagagttgagacttaagaccgtggccggctgatactcgtcagtcgtcacacagcgcatgagagagactcgccaaatttgctgcagatctctcgtcggctcagcaaccagcaaccggcgttagctggccctcttccttccctcccgcatggcgactgaagccgtaggcaccatgtccatgttcccagggatggaccttaccaaaatggaccctccaacacttaccctccttggagcagcctgttgtgtaatgttatcgatgcatttcacagtgcagttggtatcacaacatcttttctattggaaaaatcccaaagagcagaaggctatactcatcattgtgctaatggctccactctatgctataacttcctttgttggccttctggatattaagggaagcaaaacgttttttacatgcttggagtctgttaaaggatgctatgaggcactggttattgctaagtttctggcattgatgtacagctacttgaatatatctattagcaaaaacattgtacctgatgaaatcaaagggagggctcttcatcattctttccctgtctctcttttcctgccccgcaatgttcggttggagcacaagacactaaagcttctgaagtactggacctggcaatttgttgttgttaggcctgtatgctccattctgattatcgcacttcagcttattgggctgtaccccagctgggtcagttggacgttcacaattatactgaacttgtcagtctccatggcactgtatgccttggtcattttctatcacttgtttgccaaggagttggcacctcacaagcctcttgcgaagttcttgtgcatcaaagggattgtcttcttctctttctggcagggctgtgcgctggatgttttggctgctgtaggggtgattcagtctcaccatttctggctggacgtggagcacatccaggaggcaatccagaatgtcttgattatcctggaaatggtcatcttctcggtactccagcagtatgcgtaccatgtcgctccgtacagcggcgctgacaaggcgaaatctgtgaagaagaacgaatgatccagggcttcgtgccaagcgacatctgcagctggttcttgtatggttttgtgtgtatgtgctgggagtattgattcaagatgttataggacatgtgcatttccttgtggacacgtgtagagtgagtcgtcgttataccttgaacactagagaaacgacatgatcaggatcaacacataggaaagctgttgttgttaccgtgctgtgagattgtgtaatgcctgaataaggggaattctgggggttccccgccctgaatttcgtccggaataaatggcggtttcgtgtcgcccaaa

SEQ ID NO: 1235 - DNA, 1386 bp, Avena sativa
gccgcgaggggatcaaacaaagtccactgtccccgatctctcagccggcgaaggttccaaccacgcacggagattccaagtcccggactaggcaccatgtcgatgttcccgggaatggatcttagtaaaatggatcctccaactcttacactccttggagcagcttgttgtgtaatgctgtctatgcatttcacagtacagttggtgtcgcagcatcttttctactggaaaaattccaaggagcagaaggctatactcattatagtgctgatgcctccattgtatgctataacttcctttgttggtcttctagatataaagggaagcgaagctttttttacatgcttggaatctgttaaagaatgctatgaggcactggtgattgctaagtttctggcattgatgtacagctacttaaatatatccataagtaaaaacattgtacctgatgaaatcaaagggagggtgcttcatcactctttccctatgtctcttttcctgccccgcaatgttcggttggagcacaagacactaaagcttctgaagtactggacctggcaatttgttgtcgttaggcctgtatgctccattctgattattgcacttcagcttcttgggatgtaccccagctgggtcagctggacgttcacaattatactgaacttttcagtctccatggcattatacgccttggtcatattctatcacttgtttgctaaggagctggcacctcacaagcctctttctaagttcttgtgcatcaaagggattgtcttcttctccttctggcagggctgtgcactagaaattttgacggctgtaggggttattcgatctcaccacttctggctggacgtggagcacatccaggaggcaatccagaacgtcctgattatcctggaaatggtcgtcttctcggtcctccagcaatacgcttaccacgtcgctccttacagcggtgccgacagggcgaaattcgagaagaagaatgagtgatccatgtttctcacggagcagctagttcatgtactgtactagtatttttttgtttgtttgagccgggaacatggtttcaatctgttgtactccgtagaacactggcatttccttgcggacacgcgtagagtgggtgtggttataccttgaacattaggaaacaacgagatggtgtagaacatatacgaacgggtaccgtatggtgcggaattatggaatgcctgaataaagaacatttggagggtttcccacttcaaatcgccctaagctgaataaattaaacgggtaccgggtgcggaattatggaatgcctgaataaagaacatctggagtgtttcccacttcaaatcgccttaataagcagaataaattctggttttgtcttttgcc

SEQ ID NO: 1236 - DNA, 1307 bp, Oryza sativa
gcgggtcgcgaggaactctctctctctctctgtgcacaccccgggaggaggaaccgagggaggaggacaagtcagagcaaggggcctcgacggcggcgaagccctccaactcacaggcgccatgtcgatgtcactgttccctgggatggatcttacgaaaatggatgctcctactcttaccctccttggagcagcctgctgtgtaatgctatcgatgcattttacagtacagttggtgtcgcagcatcttttctattggaagaatcccaaggagcagaaggctatacttattatcgttctcatggctcccttatatgctataaattcctttgttggtcttctggatatcaagggaagcaaaacatttttcactttcttggatgctgtcaaagaatgctacgaggcactggctattgctaagtttatggcactgatgtacagctatttgaatatatctattagtaagaacatagttcctgatgagatcaaagggagggtgcttcatcattccttccctgtttcccttttcctgccccgcaatgttcgattggagcataaaacactgaagcttctgaagtactggacctggcaatttgttgttgttaggcccatatgcgccattctaatgattactcttcagcttcttggtctgtaccccagttgggtcagctggacattcacaatcatactgaacttttcagtctccatggcattatacgcactggttattttctaccacttgtttgcaaaagagctggcacctcacaaacctcttgcaaaattcttatgcatcaaagggattgtcttcttctctttctggcagggttttgcattagaggttttagctgccgtagggatcattcagtcccaccatttctggttggacgtggagcacatccaggaggcaatccagaatgtcttggtgatcatcgaaatggtcttcttctccgttctccaacaatatgcttaccatgttgctccatacagcggggctgacagggcgaaattcgagaagaagaatgaatgatccaggttttgtactgagtaataccctccagctcttgtatgatatctctctgtatggactcacagtgttataaactcagtgtttcttatgcacacgagtagagtaagtacattacaatcattagaaagctagaggtgcctgaataagtggtggtttcgtcttgttgtacacaatatcatgttggactgaggatcttgtgtgtacactgtacagtgcagcctttggaggcaagcaaatccattatcaataaagctatgtacttccaagtgccaatcaccaa

SEQ ID NO: 1237 - DNA, 1482 bp, Pennisetum glaucum
cagccacgcgcatcacgcgagggcgaggccccggcttcctgtagtctcgtctttatactaccgccggccgcgcgggcggaaggaaccgagtgctcctcctgggcgtcaggcgaggcgagctcatccgacggcgggcagcggcggcgactccaacgaccccgtcccgcgcaggctgcgctgctcctccagccaggcaccatgtcactcatgtctccgttcccggggatggatctaagtaaaatggatgccccaactctgaccctccttggggcagctggttgtgtgatgctgtctatgcattttactgtgcaattggtgtcacaacatcttttctattggaaaaaccccaaggagcagaaagctatacttatcattgtgctaatggctccattatatgctatcacttcctttgtgggtcttcttgatatccagggaagcaagacttttttcacattcttggaagctgttaaagaatgctatgaggcactggtcattgctaagtttatggcactgatgtacagttacttgaatatatccatcagcaaaaacatagtccctgatgaaatcaaagggagggaacttcatcattccttccctgtttctcttttcctgcctcgtactgtccgattggagcacaagacactgaagcttctgaagtactggacctggcaatttgttgttattaggccagtatgctccgttctgattattgccctccagcttcttgggctgtacccaagctgggtcagctggacgtttacaatcatactgaacttttcagtctccatggcattatatgccttggttcttttctaccacttgtttgctaaagagctggcacctcacaagccacttgcaaagttcctatgcatcaaagggattgtctttttctctttctggcagggtcttgcgctcaaagttttaactgaagtaggcgtgatccagtcccaccatttctggctggacgtggaacatatccaggaggcgatccagaacgtgcttgtgatcctcgagatggtcgtgttctccgtcatccagcaatacgcataccacgtcgccccctacagcggcgccgacaaggccaagttcgagaagaagaatgaataagtcaggtcccaaaagagtgagtgaacataccatgcagctgtttttctctgtcggaatgaaggcatagtattttacctacggacagacgtttttgagtaagtctgattagcataaatattttggtagctcgtggaagtcaggacgaggcacagccgcacaggcaacgctctcaccacgctgctgtaaaatggcaccatgcctgtactgcttgtttgtactgaataattgcctgttgagcgctaggtatctctgaggccatgttgcaaggactgttcatctttgtagtacagtctctattggggaatccttttatcaaataaagctacagtccttcagaggcagccatgaactctgattgcgaggactgaaccctga

SEQ ID NO: 1238 - DNA, 1272 bp, Setaria italica
gactccaacgaccccgcgcgcaggctgcgctgctccggacaggcaccatgtcactcatgtctccgttcccggggatggatctaagtaaaatggatgccccaactctgaccctccttggggcagctggtggtgtgatgctgtctatgcatttcactgtgcaattggtgtcacaacatcttttctattggaaaaaccccaaggagcagaaagctatacttattattgtgctaatggctccattatatgctatctcttcctttgtgggtcttcttgatattcagggaagcaagacttttttcacattcttggatgctgttaaagaatgctatgaggcactggtcattgctaagtttatggcattgatgtacagctacttgaatatatccatcagcaaaaacatagtccctgatgaaatcaaagggagggttcttcatcattccttccctgtttctcttttcctgcctcgcactgtccgattggagcacaagacactgaagcttctgaagtactggacctggcaattcgttgttattaggccagtatgctccattctgattattaccctccagcttcttgggctgtacccaagctgggtcagctggacgtttacaattatactgaacttttcagtctccatggcattatatgccttggttcttttctaccacttgtttgctaaagagctggcacctcacaagccgcttgcaaagttcttatgcatcaaagggattgtcttcttctctttctggcagggtattgcgctcaatgttttaactgaagtaggcgtgatccagtcccaccatttctggctggacgtggagcatatccaggaggcgatccagaacgtgctggtgatccttgagatggtcgtgttctccgtcatccagcaatacgcataccacgtcgccccctacagcggcgccgacagggcgaagttcgagaagaagaacgaatgagctgagccgaggtcccaaaagagtgaaaaatatcgcgctgctctgtttttctaggattctgtcggaacgaaggactagtatttccctacggacagacgttcagcgagcatatttgatagctcgtggaagtctgggatgatcaggcacaggcacgaacgctctctcgctgctgtaaaattgcactacgcatgtactgaatagttgcctgctccgtctcgttgaacgctaggtatctctgaggccatgtagcaaggacttgttcatctttgtagtacactctattggggaatcctttaccaataaagctacagtcctt

SEQ ID NO: 1239 - DNA, 1470 bp, Zea mays
actgcaattagtactgactctgccaagtcgccacgtgactaacccgcgaggtcgacgcggattttcttctttataccgcgggtaggcggactgggcggctgacggagccgcggagggaaccgagtggccccggcgacgcgaggccgaggcgagctaatctgacggtggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatccagggtagcaagacatttttcacattcttagatgctgttaaagaatgctatgaggcactggtgattgctaagtttatggcattgatgtacagctacttgaatatatctatcagcaagaacatagtccctgatgaaatcaaagggagggtgcttcatcattccttccctgtttctcttttcctgccccgcaatgtccgattggagcacaaaacattgaagcttctgaagtattggacctggcaatttgttattgttaggccagtatgttccattctgattattgcactccagcttcttgggctgtaccccagctgggtcagctggacgtttagtattatactgaacttttcagtctccatggccttatatgcattggttctcttctaccacttgtttgctaaagagctggcacctcacaagcctcttgcaaagttcttgtgcatcaaagggattgtcttcttctctttctggcagggttttgcgctcgatgttttaacccaagcaggcgtgatcaaatcccaccatttctggctggacgtggagcacatccaggaggcgatccagaacgtcctggtgatccttgagatggtggtgttctccgtcatccagcagtacgcataccacgtcgccccctacagcggcgctgacagggccaagtttgagaagaagaacgaatgaaccaggtttccaaaaagaatgaaagaaggaaaaaaactctctgctttctggtcgctcggagatggagcaccagtatttcctcacggatggacgacatacacaagttcatcgagtctcgcgagtagcgtatttggtagcgagttgtcgcgctgtaaaattacactgtccttgcgcgctgaataattttgctggctttgtcgttttggttttttgaacgttgtcgccgaggctatatagccaggactgttcgtcttgtacgagcgcgcgctctctctctctctctctctctgcggacttggcgaatccttttatgaataaaagctactgtcctgttctac

SEQ ID NO: 1240 - DNA, 1416 bp, Saccharum officinarum
cgcggattttcttcgtctttataccgcgggcaggcggactggcggagggaaccgagcggccccggcgtcgcgaggcgagctaatctgacggcggcagcgacgactccaacgacctcgcgcgcggaggctgcactgctccagccaaggcaccatgtcactcatgtctccatttcccgggatggatctaagtaaaatggatcccgcaactctgaccctccttggggcagctggttgtgtaatgctgactatgcatttcactgtgcaattggtgtcacaacatctcttctattggaaaaaccccaaggagcagaaagctatacttattattgtgctaatggctccactatatgctatctcttccttcgtgggtcttcttgatatccagggtagcaagacatttttcacattcttggatgctgttaaagaatgctatgaggcactggtgattgctaagtttatggcattgatgtacagctacttgaatatatccatcagcaagaacatagtccctgatgaaatcaaagggagggagcttcatcattccttccctgtttctcttttcctgccccgcaatgtccgattggagcacaagacattaaagcttctgaagtattggacctggcaatttgttgttgttaggccagtatgttccattctgattattgcacttcagcttcttgggctgtaccccagctgggtcagctggacgtttagtattatactgaacttttcagtctccatggccttatatgctttggttcttttctaccacttgtttgctaaagagctggcacctcacaagcctcttgcaaagttcttgtgcatcaaagggattgtcttcttctctttctggcagggttttgcgctcgatattttaactgaagcaggtgtgatcaaatcccaccatttctggctggacgtggagcacatccaggaggcgatccagaacgtcctgattatccttgagatggttgtgttcgccgtcatccagcaatacgcataccatgtcgccccctacagcggcgctgacagggcgaagttcgagaagaagaacgaatgaaccaagttggtccaaaaggagtgaaaaaaaaatcgtgctggtcctctccgctttgtgttctgttggaaatggagcaccagtatttccttacggatggacagacacgagtccattgagtctcgcgagtactgtagtatatttggtagctagttatcgtgctgtaaaattagtacactgtgcttgcacactgaataattttgctagtttttgtcgttttgaacgttgtcgctgaggctatgtagccatggctgttcatcttgtacgtacgctgtacgctctctggggactgggggaatccttttatgaataaagctacagtcctgttctacggaggccgcactggactgattccgatg

SEQ ID NO: 1241 - DNA, 1383 bp, Panicum virgatum
tgctgacttgccagatcgccacgtgagagtcacaccgccgtgaggccgtctcgtcctcgtctttaaccggcgcgggcggaaggaaccgagtggccccggcgtcgcgaggcgagcttgacggcggcactgctccagccaggcaccatgtcactcatgtctccattcccggggatggatctaagtaaaatggatgccccaactctgaccctccttggggcagctggttgtgtaatgctgactatgcatttcactgtgcaattggtgtcacagcatcttttctattggaaaaaccccaaggagcagaaagctatacttattattgtgctaatggctccattatatgctatctcttcgtttgtgggtcttcttgatatccagggaagcaagacatttttcacattcttggatgctgttaaagaatgctatgaggcactggtcattgctaagtttatggcattgatgtacagctacttgaatatatccatcagcaaaaacatagttcctgatgaaatcaaagggagggttcttcatcattctttccctgtttctcttttcctgccccacactgtccgattggagcacaagacactgaagcttctgaagtactggacctggcaatttgttgttattaggccagtatgctccattctgattattgccctacagcttcttgggatgtacccaagttgggtcagctggacgtttacaattatactgaacatttcggtctccatggcattatatgccctggttcttttctaccacttgtttgctaaagagctggcacctcacaagcctcttgcaaagttcttgtgcatcaaagggattgtctttttctctttctggcagggtcttgcgctcgatgttttgactgaagtaggcgtgatccaatcccaccatttctggctagacgtggagcacatccaggaggcgatccagaatgtcctggtgatcctcgagatggtcgtgttctccgtcatccagcaatacgcgtaccatgtcgccccctacagcggcgccgacagggcgaagttcgagaagaagaacgaatgagccaaaggtcccaaaagagtaagaataccgcactgctctgttttttctagtattcagttggactggaggactagtatttccttgcagcagagggacagacgatccgatgagcatatttgatagctattagaagtcaggatcatcaagcacagacacgaacttgaccactgctgtaaaattgcactattattgtacggcttgtaccgaataattgctggttgtgtcgttgaacgctgtctctgaggccatgtagcaaggacccctcatctttgtacgtacgctctgctattggggaatcctttatcaataaagctacagtactacagaggc

SEQ ID NO: 1242 - DNA, 1389 bp, Panicum virgatum
ctcgtcctcgtctttataccggcgcgggcggaaggaacacgagtggccccggcgtcgcgaggcgagctcatccgacggcggcagcggcgactccaacgacccccgcgcggaggctgcgctgctccagccaggcaccatgtcactcatgtctccattcccggggatggatctaagtaaaatggatgccccaactcttaccctccttggggcagctggttgtgtaatgctgactatgcatttcactgtgcaattggtgtcacaacatcttttctattggaaaaaccctaaggagcagaaagctatacttattatcgtgctaatggccccattatatgctatctcttcctttgtgggtcttcttgatatccagggaagcaagacatttttcacattcttggatgctgttaaagaatgctacgaggcactggtcattgctaagtttatggcattgatgtacagctacttgaatatatccatcagcaaaaacatagttcctgatgaaatcaaagggagagttcttcatcattccttccctgtttctcttttcctgccccacactgtccgattggagcacaagacactgaagcttctgaagtactggacctggcaatttgttgttattaggccagtatgctccattctgattattgccctccagcttcttgggatgtacccaagttgggtcagctggacgtttacaattatactgaacatttcagtctccatggcattatatgccctggttcttttctaccacttgtttgctaaagagctagcacctcacaagcctcttgcaaagttcttgtgcatcaaagggattgtcttcttctctttctggcagggttttgcgctcgatgttttgaccgaagtaggcgtgatccaatcccaccatttctggctggacgtggagcacatccaggaggctatccagaacgtcctggtgatcctcgagatggtcgtgttctccgtcatccagcaatacgcgtaccacgtcgccccttacagcggcgccgatagggcgaagtttgagaagaagaacgaatgagccaaaggtcccaagagagtaaaaatactgcgccgctctgttttctagtattctgttgggccggagtagtagtatttccttgcggacagacgggcagacgatctgatgagcatatttgatacgtagctagtagaagtcaggatcatcaggcacagacacgaacgtgaccactgctgtaaaattgcactacgcttgtacggcttgtaccgaataattgctggttctatctcgttgaacgctgcctctgaggccatgtagcaaggactgctcatcttttgtacgtacgctctgttattggtgaatcctttatcaataaaaagctacagtcccacagaggcaccctg

SEQ ID NO: 1243 - DNA, 1156 bp, Triticum aestivum
aggcaccatgtcgatgttcccagggatggatcttactaaaatggatgctccaactcttaccctcttggagcagcttgttgtgtaatgttatctatgcatttcacagtacagttggtatcacaacatcttttctactggaaaaatgccaaagagcagaaggccatactcattattgtgctaatgcctccactgtatgccataacttccttcgttggtcttctggatattaagggaagcaaaacgttttttacatgcttggagtctgttaaagaatgctatgaggcactggttattgctaagtttctggcattgatgtacagctacttaaatatatctattagcaaaaacattgtacctgatgaaatcaaagggagggtgcttcatcattctttccctgtttctcttttcctgccccgcaatgttcggttggagcacaagacattaaagcttctgaagtactggacctggcaatttgttgttgttaggcctgtatgctccattctgattattgcacttcagcttcttgggctgtaccccagctgggtcagctggacgttcacaattatactgaacttttcagtctccatggcattatatgccttggtcatattctatcacttgtttgctaaggagttggcacctcacaagcctcttgcgaagttcttgtgcatcaaagggattgtcttcttctctttctggcagggctgtgcactggatgttttggctgctgtaggggtgattcagtctcaccatttctggctggacgtggagcacatccaggaggcaatccagaatatcttgattatcctggaaatggtcgtcttctcagtcctccagcaatatgcataccacgtcgctccgtacagtggcgctgacaaggcgaaatccgtgaagaagaacgaatgatccagggcttcgtgccaagcaacacccgcggctagttcatgtatggttttgtgtgtatgtgctgggagtattgattcaaagatgttataggacatgtgtatttccttgtggacacgtgtagagtgggtcgtcgttataccttgaacattagaaaaacagagatgaggagcaacatacaggaatgctactgttgttaccgtgctgtgatacggtaccatgtaatgcctgaataaggagaattttgggggtt

SEQ ID NO: 1244 - DNA, 1307 bp, Sorghum bicolor
cccgcgaggtcgacgcggatttttcttcgtctttataccgcgggcaggcggactggcggagggaaccgagtcgccaccggcgtcgcgaggccgaggcgagctaatctgacggcggcagcgacgacgaccccaacgacctcgcgcgcggaggctgcactgctccagccaaggcaccatgtcactcatttctccattcccggcggtggatataagtaaaatggatcccccgactctgaccctccttggggcagctggttgtgtaatgctgactttgcatttcactgtgcaattggtgtcacaacatctcttctattggaaaaatcccaaggagcagaaagctatacttattattgtgctaatggctccactatatgctatctcttcctttgtgggtcttcttgatatccagggtagcaagacatttttcacattcttggatgctgttaaagaatgctatgaggcactggtgattgctaagtttatggcattgatgtacagctacttgaatatatccatcagcaagaacatagtccctgatgaaatcaaagggagggagcttcatcattccttccctgtttctcttttcctgccaagcaaggtcagattggagcacaagacattaaagcttctgaagtattggacctggcaatttgttattgttaggccagtatgttccattctgattattgcactacagcttcttgggctgtaccccagttgggtcagctggacgtttagtattatactgaacttttcagtctccatggccttatatgccttggttcttttctaccacttgtttgctaaagagctggcacctcacaagcctcttgcaaagttcttgtgcatcaaagggattgtcttcttctctttctggcagggttttgcgctcgatattctaactgaagcaggtgtgatcaaatcccaccatttctggctggacgtggagcacatccaggaggcgatccagaacgtcctgattatccttgagatggtcgtgttcgccgtcatccagcaatatgcataccatgttgccccctacagcggcgctgacagggcaaagttcgagaagaagaacgaatgaaccaagtttccaaaatgagtgaaaaaaaaaaaccttgctctccgctttgtggtctgatggaaatggagcaccggtatttcccttacggatggtcagacacgagttcatcgagtctcgcgagtactgtagtatatttggtagctaggtatcgtgctgtaaaagtacaatgtgcttgcacactgaataattttgctagttttgtcgttttgaacgttgtcgctgc

SEQ ID NO: 1245 - DNA, 1890 bp, Triticum aestivum
gcggggacccccggcacaacaagaggccgcacaaaaccctcctctctgattctccaaagcggcggcgcggtgggcatggatggtgccggtatggcgacactgccggaggccaacacgtcgcccgcgcccaacggcggcggctgcggcgggatcagggttgagaattgctacgtcttcaagagcaggctgcaggagtacgcgcagaaagccggcctcatgacgccagagtaccaaaccctcaaggaggggccttcccatgagccaatcttcaagtcctccgtcgtgataaacaacaccaagtatgactctttgcctgggttcttcagccggaaggctgcagagcagtcggctgccgaagtcgcgctcatggaaatcggcaagtctgtggtgttaccaaccaatgcaaccatccccgcagtccaagaaactggtctgtgcaagaatcttcttcaggagtatgctcagaagatgaattatgctattccatcttatatttgcaacaaacaaggtccatacatatgcaccgtagagattggtggaatacaatacattggtgctacagcacggacaaagaaagaggcagagataaaagctgcccgaactgctcttcttgcaatccaagttgcaggccaatcagagggttgtgcaaatggtaccacaaaatatattgttgtgcctggcaaaaggcaaggtaaggagatcgagaaaaagcctgttgaaactccaaaatcacttaagaccaagaaaggtggtttcaagaagcaacggaacaagaataaattcatcaagaagaatggccaagaagttaacgaggaaaaggatgagactggagtgcctggagatgctcatcattcagatgtccctatgaagccagctgtaacaacagaagatccagtgaccaacactgtaatgatccagcctgatgaagcttggccattcgaacatgaaccaaccggtgacactgcaatgctgcaacctattgaagacgcttggccatccaaacatgaaccgaccggtgagactgcaatgctgcaacctgatggcgaagctacaaaagtggaacaggagcaactcagtgacacagcaatgctgcaacctgatgatgaaggtggaagagtagaacatgagccactcagcaacgctccaatggtgctacgtaatgaggaagctagaaatgtaaagcaggaagcactcatcagcactgcaatgccacaacctcacatggaagatagaagagtgggagcagagccacctagagatgctgcaatggtgcaacctaatgatgaagctagatgcataaagcaggagctactaattgacgctgcaatgcctctccccaatgaggaggccggagcagctgcaaatcctgtgccattgagtgactccataacagcgcaacctaatgcagtgactacaaatataaatgaggagtcactgaggaatgcagcatcagtgcaacataatgaagaagctaggaccgtaaaccaggagccacccagcagtgcttcactacagcagccaaaggaacccagagtcgagaacggtgaatttgtttctgaaaacaaggaccaaactctgggagatgcatctcgtgaggcaaataggtccaacgaagatgtgccagaaaagtgctcagataattcatctgcttttacaagtgtggaatgatatgtgctgtttgaatcaaatgcaatggccttccagttttacatcttgatttgcaaactagtaaaacctgaatagctggcttcgcattttagaaatataattgcataacagatggacgtacgtggaccaaccaaggtcggttggtggtccatgttggccattagttattaggaaatttgcatgatgatgtatctcatgttgcttatctgatcaatgaactat

SEQ ID NO: 1246 - DNA, 2052 bp, Triticum aestivum
gcggggacccccggcacaacaagaggccgcacaaaaccctcctctctgattctccaaagcggcggcgcggtgggcatggatggtgccggtatggcgacactgccggaggccaacacgtcgcccgcgcccaacggcggcggctgcggcgggatcagggttgagaattgctacgtcttcaagagcaggctgcaggagtacgcgcagaaagccggcctcatgacgccagagtaccaaaccctcaaggaggggccttcccatgagccaatcttcaagtcctccgtcgtgataaacaacaccaagtatgactctttgcctgggttcttcagccggaaggctgcagagcagtcggctgccgaagtcgcgctcatggaaatcggcaagtctgtggtgttaccaaccaatgcaaccatccccgcagtccaagaaactggtctgtgcaagaatcttcttcaggagtatgctcagaagatgaattatgctattccatcttatatttgcaacaaacaaggtccatacatatgcaccgtagagattggtggaatacaatacattggtgctacagcacggacaaagaaagaggcagagataaaagctgcccgaactgctcttcttgcaatccaagttgcaggccaatcagagggttgtgcaaatggtaccacaaaatatattgttgtgcctggcaaaaggcaaggtaaggagatcgagaaaaagcctgttgaaactccaaaatcacttaagaccaagaaaggtggtttcaagaagcaacggaacaagaataaattcatcaagaagaatggccaagaagttaacgaggaaaaggatgagactggagtgcctggagatgctcatcattcagatgtccctatgaagccagctgtaacaacagaagatccagtgaccaacactgtaatgatccagcctgatgaagcttggccattcgaacatgaaccaaccggtgacactgcaatgctgcaacctattgaagacgcttggccatccaaacatgaaccgaccggtgagactgcaatgctgcaacctgatggcgaagctacaaaagtggaacaggagcaactcagtgacacagcaatgctgcaacctgatgatgaaggtggaagagtagaacatgagccactcagcaacgctccaatggtgctacgtaatgaggaagctagaaatgtaaagcaggaagcactcatcagcactgcaatgccacaacctcacatggaagatagaagagtgggagcagagccacctagagatgctgcaatggtgcaacctaatgatgaagctagatgcataaagcaggagctactaattgacgctgcaatgcctctccccaatgaggaggccggagcagctgcaaatcctgtgccattgagtgactccataacagcgcaacctaatgcagtgactacaaatataaatgaggagtcactgaggaatgcagcatcagtgcaacataatgaagaagctaggaccgtaaaccaggagccacccagcagtgcttcactacagcagccaaaggaacccagagtcgagaacggtgaatttgtttctgaaaacaaggaccaaactctgggagatgcatctcgtgaggcaaataggtccaacgaagatgtgccagaaaagtgctcagataattcatctgcttttacaagtgtggaatgatatgtgctgtttgaatcaaatgcaatggccttccagttttacatcttgatttgcaaactagtaaaacctgaatagctggcttcgcattttagaaatataattgcataacagatggacgtacgtggaccaaccaaggtcggttggtggtccatgttggccattagttattaggaaatttgcatgatgatgtatctcatgttgcttatctgatcaatgaactattattaattaatagtcggtgtttttttttgaattaatagtcggtgtttgttattagcacatgttattccttcaattggagcgttgtccatcaaatggccgaaataaatagcagcatgccgacttattttcaggtgtattgtttctaaattttgtaaccaaata

SEQ ID NO: 1247 - DNA, 1182 bp, Triticum aestivum
ccccatcgtcggtttctttggctcaattatccccttcttccttgtgcttcttcattcacctgcgactgcgagtgagtgcgagtgcggggtgggtcaaagcaagtgcgtgggattggaggagaaggagatggagctggtgtcctcctcccgctccaccctatcctcttgcagccgactggttgctccctccaggtccagttccacgacggcatccgcagctgctaggcgccacgggaagaggctattatgtgtcttgggtggagacaggaatggtgagctcaagatcgggaagcgggcggctcttgctctgctcctggctacgcccacgctctcactgcccttctccgcccacgccaagaccaagaccataaatccttatgacgaaagacgcttgcttcagcagaacaagaagatccaggaagccaaccgtgcacctgatgatttcccaaacttcatcagagaaggttttcaggtcaaagtagtgacacccgacaactacataactcgggactccggattaatatatgaggacgtcaaagttggtacaggcgattgcccaaaggatggtcagcaggttatatttcactatgtgggctacaacgaatcaggacgaaggatagatagcacctacatccagggttcgcctgccaaaattcgactaggcaacaaatcattagttccaggttttgaagaggggattcgggacatgaagccaggggggaagagaagactaattatacctcctgagcttggtcctcctgttgggccatcgacgttctttagcgcgaaacagtttgaagtattcgacgtcgagctactctcagtgcaggactgccagcggaggacaatagctttctactctgatgttgtctgcacttgatcatctggtctgttagtcccgaccggtgcagcattctcctcctacaaccctgtaggaaaaaattgttagctattgtttttcgagaaaacgcaggggacccatgcgtctcattccattgaaaagagagagtttgtaatttacaatcctcctaggaggtggtttcagacatcaagtagatgctagtgcacatcccatgtgggggcagcacaactctaagcccagcagcgccagcagtagtccagagcctggcttcggctttgatcctactcactaaggtgggcttgatcctactcactaaggtg

SEQ ID NO: 1248 - DNA, 1249 bp, Triticum aestivum
  misc_feature (143)..(143): n is a, c, g, or t
  misc_feature (1242)..(1242): n is a, c, g, or t
tcaatgggcgattgggccaaatttgaaggttccggccgcaaggccccgggttgaccgcccgggcaggtttcctcccttcctgggcttctcaatcacctgcgactgcgagtgagtgcgagtgcgagtgcggggtgggtcaaagnctcaaagcaagtgcgtgggattggaggagaaggagatggagctggtgtcctcctcccgctccaccctatcctcttgcagccgactggttgctccctccaggtccagttccacgacggcatccgcagccgctaggcgccacgggaagaggctattatgtgtcttgggtggagacaggaatggtaagctcaagatcgggaagcgggcggctcttgctctgctcctggctacgcccacgctctcactgcccttctccgcccacgccaagaccaagaccataaatccttatgacgaaagacgcttgcttcagcagaacaagaagatccaggaagccaaccgtgcacctgatgatttcccaaacttcatcagagaaggttttcaggtcaaagtagtgacacccgacaactacataactcgggactccggattaatatatgaggacgtcaaagttggtacaggcgattgcccaaaggatggtcagcaggttatatttcactatgtgggctacaacgaatcaggacgaaggatagatagcacctacatccagggttcgcctgccaaaattcgactaggcaacaaatcattagttccaggttttgaagaggggattcgggacatgaagccaggggggaagagaagactaattatacctcctgagcttggtcctcctgttgggccatcgacgttctttagcgcgaaacagtttgaagtattcgacgtcgagctactctcagtgcaggactgccagcggaggacaatagctttctactctgatgttgtctgcacttgatcatctggtctgttagtcccgaccggtgcagcattctcctcctacaaccctgtaggaaaatattgttagctattgtttttcgtgaaaacgcaggggacccatgcgtttcatgccattgaaaagagagagtttgtaatttacaatcctcctaggaggtggtttcagacatcaagtagatgctagtgcacatcccatgtgggggcagcacaactctaagcccagcagcgccagcagtagtccagagcctggcttcggctttgatcctactcactaaggtgggcttgatcctactcactaaggtggaacggagngttgcgc

SEQ ID NO: 1249 - DNA, 1205 bp, Brachypodium distachyon
tttggcactttggcttatccccttcgggcttcagccttcccctgagaactgggagaagaggtgaagtggcagaggggagccggagccgccattaggaggagaaggagatggagctattgtcttcttcccgctccatgctatcctcttgcaaccgattggttgcgccgtccaggacggcatcctcagctgctaagcgcgaccgcaagagcggattagtatgtgtgttgggtggcgagcgagggagtgaggggaagatcgggaagaggtcagctcttgctctagtgctggctataccggccctgtcagtgccgttatcggcccatgggaagaccaaaagcatgaccccttacgatgaaaggcggctgcttcagcagaacaagaagattcaggaagccaaccgtgcacctgatgatttcccaaacttcatcagagaaggttttcaggttaaagtagtgacacctgacaactacgtaacacgggactctggattaatatatgaggacgtcaaaattggcacaggtgactgcccaaaggatggtcagcaggttacatttcactatattggctacaatgaatcaggacgcaggatagatagcacctacattcagggttcgcctgccaaaattcgtttaggcaacaaatcattagttccaggttttgaagaggggattcgggacatgaaaccaggtggcaagagaagacttattatacctccagaacttgggcctcctgttgggccttcgacgttcttcagcgcgaagcagttcgaagtattcgatgtagagctcctctccgtgaaggactgcgagcggaggaccattggcttctactctgatgttgtctgcagttgatcatctcaagagtaccaacaggtagcaaaatacagcactctcctgcaactctgtagggaaaaaaaattaccagctgtacatgccaactacaaaaaggaaaggaaaataaataatgtaaaaggcacaaagagagaggtgttgtatgtgaatagccaaatatttgcattgccatgaacatcctgttgttgagcccacatgtacctttcttgtttgatttgtaagtttcaagtaaccagaactactggatagagatagcatataccgagacttgtagatagaaaacaaattgcagatgtgttccaaactaccacagttatgtctgatccttcgtgaataactatttctaagtcgacg

SEQ ID NO: 1250 - DNA, 1063 bp, Triticum aestivum
ctcaattatccccttcttccttgtgcttcttcattcacctgcgactgcgagtgagtgcgagtgcggggtgggtcaaagcaagtgcgtgggattggaggagaaggagatggagctggtgtcctcctcccgctccaccctatcctcttgcagccgactggttgctccctccaggtccagttccacgacggcatccgcagctgctaggcgccacgggaagaggctattatgtgtcttgggtggagacaggaatggtgagctcaagatcgggaagcgggcggctcttgctctgctcctggctacgcccacgctctcactgcccttctccgcccacgccaagaccaagaccataaatccttatgacgaaagacgcttgcttcagcagaacaagaagatccaggaagccaaccgtgcacctgatgatttcccaaactttatcagagaaggttttcaggtcaaagtagtgacacccgataactatataactcgggactctggattaatatatgaggacgtcaaagttggtacgggcgattgcccaaaggatggtcagcaggttatatttcactatgtgggctacaacgaatcaggacgaaggatagataacacctacatccagggttcgcctgccaaaattcggctaggcaacaaatcattagttccaggttttgaagaggggattcgggacatgaagccaggggggaagagaagactaattatacctcctgagcttggtcctcctgttgggccatcgacgttctttagcgcgaaacagtttgaagtattcgacgtcgagctactctcggtgcaggactgccagcggaggacaatagctttctactctgatgttgtctgcacttgatcatctggtctgttagtcccgaccggtgcagcattctcctcctacaaccctgtaggaaaaaattgttagctattgttgtacatggcaacataaaaaatcgtagaaggaaaagagagggagctgttgtatctgtgtagccaaatgcttgattataccattgtcatgaatcctatgatgcgggggcacactggtacctttctccac

SEQ ID NO: 1251 - DNA, 451 bp, Gossypium hirsutum
  misc_feature (451)..(451): n is a, c, g, or t
gcaccagcggaaccctcgctctctcctcctccttccttctcccgagcaagaacgtggctgcacatccacgcagagcactgcctcatggcctgcgccttcttcttcgacgcggagccgctgggcgagcccggggtgcgcatgcacgggccggagctggagctgcacgcctgcgcgctctgcaccaagccgctgcagagcaacagcgacatcttcatgtacaagggggacacccccttctgcagcgaggactgccgctacgagcagatgcacttcgacgccgccatggccaggcagcaggccagcgccaggcggaagcagcagcagcagcagcaggcacaggcgccgctcggcgtgcccggagcgccggcgcccgtgtccgccaaggccgacgtgtccgtggcgagctaatcgggccgcgccgcgccgcgtcggggttagctagtaggaactn

SEQ ID NO: 1252 - DNA, 557 bp, Triticum aestivum
ccacgcgtccgttcttcttcttcttctcccgagcaagaaggaggctctgctccgcgcaagcaagctctgcctcatggcctgcgccttcttcttcgacgcggagccgctgggcgagcccgggctgcgcctgcacgggccggagctggagctggacgcctgcgcgctctgcaccaagccgctgcagagcaacagcgacatcttcatgtacaagggggacacccccttctgcagcgaggactgccgctacgagcagatgcactttgacgccgccatggccaggcagcaggccagcgccaggcggaagcagcagcagcagcaggcccaggcgcagcccagcgtgccggcgccggcgcccgtgtccgccaaggccgacgtgtccgtggcgagctagttgcgccgcgccgcatcgggttagctggtaggaactatgtaccctttttgccttgggttgaaggaggaggaggatgcgggattcttgaccaaaaacaaaacaccacacaaacaacccaacccaacaaccccacccaaccccccccccccctccccaaataacacaa

SEQ ID NO: 1253 - DNA, 734 bp, Pseudoroegneria spicata
  misc_feature (18)..(18): n is a, c, g, or t
  misc_feature (65)..(65): n is a, c, g, or t
  misc_feature (553)..(553): n is a, c, g, or t
  misc_feature (624)..(624): n is a, c, g, or t
  misc_feature (661)..(661): n is a, c, g, or t
aacccgctcaccctcgcnctctcgtccttcttcatcttctcccgagcaaggagtagtctgcgtcngcacagccctgctccgcgcaagcaagctctgcatcatggcctgcgccttcttcttcgacgcggagccgctcggcgagcccgggctgcgcctgcacgggccggagctggagctggacgcctgcgcgctctgcaccaagccgctgcaggccaacagcgacatcttcatgtacaagggggacacccccttctgcagcgaggactgccggtacgagcagatgcacttcgacgccgccatggcgaggcagcaggccagcgccaggcggaagcagcagcagcaggcccaggcgcagctcagcgtgccggcgccggcgcccgtgtccgccaaggccgacgtgtccgtggcgagttagtcgagccgcgccgcatcgggttagctagtaggaactatgtaccctttttgccttgggttgaagaaggaagatgcgggattcttggaaggccagtgtttttgccctggcatccggtgccatcgatcttttgatctgcanacactgggcaatcggagcaggatcaccgcgggcttttgattggcccccttttggggtttgggtttgggtangagaggagagagcaggtgtgcaagagcaccgtcgctntgtaattatgcaaggcaatccatgtaaagtatttctccaaattttgaaggaaatccgttcatgtttactctca

SEQ ID NO: 1254 - DNA, 780 bp, Triticum aestivum
cgcacacccacgcgtctctcgagttcctcttcttcttccccccgagcaaggaggaggctgcatccgcacagccctgcgtcatggccgcctgcgccttcttcttcgacgcggagccgctgggcgagcccgggctgcagctgcacgggccggagctggagctggacgcctgcgcgctctgcaccaagccgctgcagggcaacagcgacatcttcatgtataagggggacacccccttctgcagcgaggactgccgctacgagcagatgcacttcgacgccgccatggccaggcagcaggccagcgccaggcggaagcagcagcagcagcaggcccaggcgcagcccagcgtgccggcgccggcgcccgtctccgccaaggccgacgtctccgtggcgagctagtcgagccgcgccgcatcgggctggctagctagtaggaactatgtaccctttttgccttgggttgaaggaggaggacgcggggttctttggacggccagtgttcttgcctggcatccggtgccgatcgatcaatctattgatctgcacaggactatcagtccaggatcaccgcgggcttttgattggcccccttttggggtttgggtttggctatgctatgagaggagagagcgggtgtgcaagagcaccgtcgctgtgtaattattcaaggcaagcgatgtaaagtatttctccaaatttcgaaggaaatatgatcatgtttattattcatttgaatgagcatattgtttcgaacctaaaaaaaagtcgacgcggccgc

SEQ ID NO: 1255 - DNA, 581 bp, Triticum aestivum
tcttcttcttctcccgagcaagaaggaggctctgctccgcgcaagcaagcgagctctgcctcatggcctgcgccttcttcttcgacgcggagccgctgggcgagccggggctgcgcctgcacgggccggagctggagctggacgcctgcgcgctctgcaccaagccgctgcagggcaacagcgacatcttcatgtacaagggggacacccccttctgcagcgaggactgccgctacgagcagatgcacttcgacgccgccatggccaggcagcaggccagcgcccggcggaagcagcagcagcagcaggcccaggcgcagctcagcgtgccgggagcaccggcgccggcaccggcaccggtgtccaacaaggccgatgtgtccgtggcgagttagttgcgccgcaccacaccgggttagctagtaggaactatgtaccctttttgccttgggttgaagaaggaggatgcggggttcttggacggccagtgttcttgccctggcatccggtgccgatcgatcaatctattgatctgcaaacactgggcaatcggagcaggatcaccgcgggcttttgattgg

SEQ ID NO: 1256 - DNA, 797 bp, Triticum aestivum
tcgacccacgcgtccgcgacccacgcgtccccgcacaccctcgctctctcgttctctcttcttcttctcccgagcaagaaggaggctctgctccgcgcaagcaagcgagctctgcctcatggcctgcgccttcttcttcgacgcggagccgctgggcgagccggggctgcgcctgcacgggccggagctggagctggacgcctgcgcgctctgcaccaagccgctgcagggcaacagcgacatcttcatgtacaagggggacacccccttctgcagcgaggactgccgctacgagcagatgcacttcgacgccgccatggccaggcagcaggccagcgcccggcggaagcagcagcagcagcaggcccaggcgcagctcagcgtgccgggagcaccggcgccggcaccggcaccggtgtccaacaaggccgatgtgtccgtggcgagttagttgcgccgcaccacaccgggttagctagtaggaactatgtaccctttttgccttgggttgaagaaggaggatgcggggttcttggacggccagtgttcttgccctggcatccggtgccgatcgatcaatctattgatctgcaaacactgggcaatcggagcaggatcaccgcgggcttttgattggcccccttttggggtttgggtttgggtttgggtatgagaggagagagcgggtgtgcaagaacaccgtcgctgtgtaattacgcaaggcaatcgatgtaaagtatttctccaaattttgaaggaaatatgatcatgtttattattcatttcgaaaaaaaaaa

SEQ ID NO: 1257 - DNA, 715 bp, Triticum aestivum
cgagttcctcttcttcttccccccgagcaaggaggaggctgcatccgcacagccctgcgtcatggccgcctgcgccttcttcttcgacgcggagccgctgggcgagcccgggctgcagctgcacgggccggagctggagctggacgcctgcgcgctctgcaccaagccgctgcagggcaacagcgacatcttcatgtataagggggacacccccttctgcagcgaggactgccgctacgagcagatgcacttcgacgccgccatggccaggcagcaggccagcgccaggcggaagcagcagcagcagcaggcccaggcgcagcccagcgtgccggcgccggcgcccgtgtccgccaaggccgacgtctccgtggcgagctagtcgagccgcgccgcatcgggctggctagctagtaggaactatgtaccctttttgccttgggttgaaggaggaggacgcggggttctttggacggccagtgttcttgcctggcatccggtgccgatcgatcaatctattgatctgcacaggactatcagtccaggatcaccgcgggcttttgattggcccccttttggggtttgggtttggctatgagaggagagagcgggtgtgcaagagcaccgtcgctgtgtaattattcaaggcaagcgatgtaaagtatttctccaaatttcgaaggaaatatgatcatgtttattattcaaaaaaaaa

SEQ ID NO: 1258 - DNA, 591 bp, Secale cereale
ccacgcgtccgcgcacaccctcgctctctcctccttctcccgagcaagaaagaggctgcatccgcgcaaggaagctctgcctcatggcctgcgccttcttcttcgacgcggagccgctgggcgagcccgggctgcgcctgcacgggccggagctggagctggacgcctgcgcgctctgcaccaagccgctgcagagcaacagcgacatcttcatgtacaagggggacacccccttctgcagcgaggactgccgctacgagcagatgcacttcgacgccgccatggcgaggcagcaggccagcgccaggcggaagcagcagcagcagcagcaggcccaggcacaagtcagcgtgcccggcgcgccggcgcccgtgtccgccaagccgatgtgtccgtggcgagctagttgagccgcgccacatctatttagctaggaactaagtacccttttgccttgggttgaagaaggaagatgcgggattcctggactggacggccagtgttcttgcactggcatgcggtgccgatcgatctgttgatctgcacgccacgcactgggcaatcggaccaggatcaccgcgggctttttga

SEQ ID NO: 1259 - DNA, 442 bp, Triticum aestivum
  misc_feature (291)..(291): n is a, c, g, or t
  misc_feature (329)..(329): n is a, c, g, or t
  misc_feature (339)..(339): n is a, c, g, or t
  misc_feature (341)..(341): n is a, c, g, or t
  misc_feature (415)..(415): n is a, c, g, or t
cctcgctctctccttcttcttcttcttcttctcccgagcaagaaggaggctctgctccgcgcaagcaagctctgcctcatggcctgcgccttcttcttcgacgcggagccgctgggcgagcccgggctgcgcctgcacgggccggagctggagctggacgcctgcgcgctctgcaccaagccgctgcagagcaacagcgacatcttcatgtacaagggggacacccccttctgcagcgaggactgccgctacgagcagatgcactttgacgccgccatggcaaggcagcangccagcgccaggcggaagcagcagcagcagcaggccangcgcagccancntccggcgccggcgccgtgtccgcaaaggcgactgtcgtgggaactattgcgcgcgccgcatcggttactggtangaactattacctttttccctggtagag

SEQ ID NO: 1260 - DNA, 1840 bp, Triticum aestivum
aaaaagcaggtgggcaccggtcccgaattcccgtggatatcgtcgacccacgcgtccggagctgagcattgcatttggtgatagactggcgcttgctcaccctgccatgacgtccaaggtagccaacagctccggcagcgacaatgcggatgccaagctatcgccgtcggggctccccgtccgggaggtcccgggcggctacggcgttcccttcttgtcgccgctgcgcgaccgccttgactactactacttccagggcgcggaggagtacttccgctcccgcatcgcccggaacggcggcgccaccgtgctgcgcgtcaacatgccccccgggccgttcatcaccgccgactcccgcgtcgttgccttcctcgacgcgcgcagcttcagcgtgctcctcgacgacgccaaggtcgacaagaccgacacactcgacgggaccttcatgccctccctcgcgctcttcggcggctaccgcccgctcgccttcctcgacgctgccgacccccgccatgccgcgctaaagcgcgtcatgatcagcctcgccgccgcgcggatgcaccacgtcgcgccggtcttccgcatcgccttcggcgccgtgttcgacgccgccgacgccggcctcggcgacggccccgttcagttcaacaagctcaacgagcaccacatgttcgacttcacctgctccgcgctgttcggcggcacgccgccgagcaaggccatgggcgacggcgccgtgaccaaggccatcaagtggctcggcgtgcagctgcacccgctcgcgagtaagatcatcaagccgtggctgctcgaggatctccttctccacaccttccgcctgccgccgttgctggttcgccgtgactacgccgacctgacagcgtacttcgccgaagctgccgccggcttcctcaacgacgctgacaaggcgcagtccggcatctcacgcgacgagctcctccacaacctagtcttcaccgccatcttcaacgcctacggaggcttcaagatcttcctgccgcacgtcatcaagtggctagcccgcgccggcccggctctgcacgccaggctcgccagcgaggtccgcgccgccgtgcccaacggcagcgacatcaccgtgtccgccgtcgacaagatgccgctggtgaagtcggtggtgtgggaggcgctgcgcatgaacccgccggtggagtttcagtacggccgcgcgcgccaggacctggtggtcgagagccacgacgccgcctaccaggtgcgcaagggcgagatgctcttcgggtaccagcctctggcgacccgcgacgagcgcgtattcaagcaggccggcgagttcgtccctgaccggttcgtgggcggcgaagggcggctgctcgggaacgtggtttggtcgaacgggccggagaacagcgagccggcggaggggaacaagcagtgccccgggaaggacatggtggtggcggtcgggaggctgatggtggcggagctgttccggcggtacgacacattcaccgccgacgtgaaggagatgccgctggagccggtggtgacgttcacttcgctgaccagggccaaggcggagtgacctatagcagagcagtactgtcctactatagtgcagccggtgccaagtggcggcagcgctgccccaatccacaataattgctagtgctactggccggatgtctgttgcatctctggtcaaatctgcatgatttggcttttagtttggaattgcatgtgatgtgcgtgtgttggcgattatgtaaagttctttgggggtgtgatcgtttgaactgtctaccaataaaaaagctctatttacattcaaaaaaaaaaaaaa

SEQ ID NO: 1261 - DNA, 1859 bp, Triticum aestivum
  misc_feature (1205)..(1205): n is a, c, g, or t
tcgacccacgcgtccgacagcctagagctgagcattgcatttggtgatagactggcgcttgctcaccctgccatgacgtccaaggtagccaacagctccggcagcgacaatgcggatgccaagctatcgccgtcggggctccccgtccgggaggtcccgggcggctacggcgttcccttcttgtcgccgctgcgcgaccgccttgactactactacttccagggcgcggaggagtacttccgctcccgcatcgcccggaacggcggcgccaccgtgctgcgcgtcaacatgccccccgggccgttcatcaccgccgactcccgcgtcgttgccttcctcgacgcgcgcagcttcagcgtgctcctcgacgacgccaaggtcgacaagaccgacacactcgacgggaccttcatgccctccctcgcgctcttcggcggctaccgcccgctcgccttcctcgacgctgccgacccccgccatgccgcgctaaagcgcgtcatgatcagcctcgccgccgcgcggatgcaccacgtcgcgccggtcttccgcatcgccttcggcgccgtgttcgacgccgccgacgccggcctcggcgacggccccgttcagttcaacaagctcaacgagcaccacatgttcgacttcacctgctccgcgctgttcggcggcacgccgccgagcaaggccatgggcgacggcgccgtgaccaaggccatcaagtggctcggcgtgcagctgcacccgctcgcgagtaagatcatcaagccgtggctgctcgaggatctccttctccacaccttccgcctgccgccgttgctggttcgccgtgactacgccgacctgacagcgtacttcgccgaagctgccgccggcttcctcaacgacgctgacaaggcgcagtccggcatctcacgcgacgagctcctccacaacctagtcttcaccgccatcttcaacgcctacggaggcttcaagatcttcctgccgcacgtcatcaagtggctagcccgcgccggcccggctctgcacgccaggctcgccagcgaggtccgcgccgccgtgcccaacggcagcgacatcaccgtgtccgccgtcgacaagatgccgctggtgaagtcggtggtgtgggaggcgctgcgcatgaacccgccggtggagtttcagtacggccgcgcgcgccaggacctggtggtcgagagccacgncgccgcctaccaggtgcgcaagggcgagatgctcttcgggtaccagcctctggcgacccgcgacgagcgcgtattcaagcaggccggcgagttcgtccctgaccggttcgtgggcggcgaagggcggctgctcgggaacgtggtttggtcgaacgggccggagaacagcgagccggcggaggggaacaagcagtgccccgggaaggacatggtggtggcggtcgggaggctgatggtggcggagctgttccggcggtacgacacattcaccgccgacgtgaaggagatgccgctggagccggtggtgacgttcacttcgctgaccagggccaaggcggagtgacctatagcagagcagtactgtcctactatagtgcagccggtgccaagtggcggcagcgctgccccaatccacaataattgctagtgctactggccggatgtctgttgcatctctggtcaaatctgcatgatttggcttttagtttggaattgcatgtgatgtgcgtgtgttggcgattatgtaaagttctttgggggtgtgatcgtttgaactgtctaccaataaaaaagctctatttacattccaaaaaaaaaaaaaaaaaaaaagggggccgctcttaaatttcccccagggggcccaatttagccgtc

SEQ ID NO: 1262 - DNA, 1168 bp, Triticum aestivum
cgcaagaagcagagtagggcaaggaggcggagcagagcagagcagaggggaggagatggcggcaccgcgcccgcagccgctgctgctgctcctcgtctcgctgctcgccgcctccgcgccccgccgcgccgacgcgtggggcaaggagggccacatcatggtctgcaagatcgccgagaagtacctgtcggaggaggcggcggcggcggtgcaggacctgctgccggagtcggcgggcggggagctgtcgacgatgtgcccgtgggcagacaccatgcgcttccgctaccactgggccagcccgctccactacgccaacacccccaacgtctgcaacttcaacttctcccgggattgccacaactcacgcggggagcaggggatgtgcgtcgtcggggccatcaacaactacacggaccagctctacacctacggggactcccccaagagctcgtacaacctgacggagagcctgatgttcctggcgcacttcgtgggcgacgtgcaccagccgctgcacgtcggctacgaggaggacgagggcggcaacaccatcatggtgcgctggtaccgcaggaaggccaacctccaccacgtgtgggatgtcagcatcatcgacacggtgatgaaagacttctacaacaagagcatggacaccatggtggatgcactccagacgaacctcactgagggatggtccgacgatgtcggtcactgggaaaactgcgccaacaagaaggcgacctgcgcaaacgactacgcgattgagagcataaatctgtcgtgcaactacgcctacaaagatgtggtgcagaacatcaccctaggagatgattattacttcacccggtacccggttgtggagaagagactagcacaggccggcgtaaggctggccttgatactcaaccggatattcgacaagaagaaagcagataccacgccgttatacatacagtaaaatagctatacttgtacacatatagataatacgggctggaaggtattgtagctgccgctgacacgccagtatgatcaattaccacttctataggtttacacagtctgtaataagaatcacgcaaccttggcagagcattcagaaattcagttgttgtaaagttgtagtataaaccctctatttgtctactatgtgcttgaacaataa

SEQ ID NO: 1263 - DNA, 1251 bp, Leymus cinereus x Leymus triticoides
  misc_feature (73)..(73): n is a, c, g, or t
  misc_feature (80)..(80): n is a, c, g, or t
  misc_feature (355)..(355): n is a, c, g, or t
  misc_feature (457)..(457): n is a, c, g, or t
  misc_feature (482)..(482): n is a, c, g, or t
gcacgaggccagctcccctgctcccgtcgtccgccaaagccgcaagaagcagaggaggtaaggaggcggagcngagcagngccagaggggagatggcggcaccgcgcccgcagccgctgctgctcctgctccttgtcttgttgctcgccgcctccgcgccccgccgcgccgacgcctggggcaaggagggccacatcatggtctgcaagatcgccgagaagtacctgtcggaggacgcggcggcggcggtgcaggacctgctgccggagtcggcaggcggggagctgtcgacgatgtgcccgtgggctgacacgatgcgcttccggtaccactggtccagcccgctccactacgncaacacccccaacgtctgcaacttcaagttctcccgggattgccacaactctcgcgggcagcaggggatgtgcgtcgtcggggccatcaacaactacacggnccagctctacacctacggggactcnaagagttcatataacctgacggagagcctgatgttcctggcgcacttcgtgggcgacgtgcaccagccgctgcacgtcggctacgaggaggacgagggcggcaacaccatcatggtacactggtaccgcaggaaggccaacctccaccacgtgtgggatgtcagcatcatcgacacggtgatgaaggacttctacaacaagagcctcgacaccatggtgaatgcactccagatgaacctcactgagggatggtctgatgatgtcggtcactgggaaaactgcgccaacaaaaaggcaacctgcgcaaatgactacgcgatcgagagcatacatctgtcatgcaactacgcctacaaagatgtggtgcagaacattactctaggagatgattattatttcacccggtacccggttgtggagaagagattggcacaggccggcgtcagactggcgctgatactcaaccggatattcgacaagaagaaagcagatgctatgccgttatacgtacagtaaaagagctatactttgtgtatatatatatataagtatatatacacggacgggctggaagatattgtagctgccgctgccacgccagtttgatcaattaccacttataaaaataggtttacgcgttctgtaataagaatcacacaaccttggcacagcattcagaaattcaattcttgtaaagatgtaatatagaccctctatactgtatttgcttgaacaataatagccaatccacaagtgaagttcaaagtga

SEQ ID NO: 1264 - DNA, 1238 bp, Pseudoroegneria spicata
  misc_feature (163)..(163): n is a, c, g, or t
  misc_feature (302)..(302): n is a, c, g, or t
  misc_feature (414)..(414): n is a, c, g, or t
  misc_feature (434)..(434): n is a, c, g, or t
  misc_feature (440)..(440): n is a, c, g, or t
  misc_feature (629)..(629): n is a, c, g, or t
  misc_feature (635)..(635): n is a, c, g, or t
  misc_feature (638)..(638): n is a, c, g, or t
  misc_feature (707)..(707): n is a, c, g, or t
  misc_feature (718)..(718): n is a, c, g, or t
  misc_feature (740)..(740): n is a, c, g, or t
  misc_feature (860)..(860): n is a, c, g, or t
  misc_feature (866)..(866): n is a, c, g, or t
  misc_feature (887)..(887): n is a, c, g, or t
  misc_feature (896)..(896): n is a, c, g, or t
  misc_feature (912)..(912): n is a, c, g, or t
  misc_feature (914)..(914): n is a, c, g, or t
  misc_feature (917)..(917): n is a, c, g, or t
  misc_feature (932)..(932): n is a, c, g, or t
  misc_feature (938)..(938): n is a, c, g, or t
  misc_feature (968)..(969): n is a, c, g, or t
  misc_feature (978)..(978): n is a, c, g, or t
  misc_feature (983)..(983): n is a, c, g, or t
  misc_feature (992)..(992): n is a, c, g, or t
  misc_feature (998)..(998): n is a, c, g, or t
  misc_feature (1001)..(1001): n is a, c, g, or t
  misc_feature (1004)..(1004): n is a, c, g, or t
  misc_feature (1019)..(1019): n is a, c, g, or t
  misc_feature (1052)..(1052): n is a, c, g, or t
  misc_feature (1058)..(1058): n is a, c, g, or t
  misc_feature (1068)..(1068): n is a, c, g, or t
  misc_feature (1086)..(1086): n is a, c, g, or t
  misc_feature (1093)..(1093): n is a, c, g, or t
  misc_feature (1104)..(1104): n is a, c, g, or t
  misc_feature (1107)..(1107): n is a, c, g, or t
  misc_feature (1120)..(1120): n is a, c, g, or t
  misc_feature (1123)..(1123): n is a, c, g, or t
  misc_feature (1125)..(1125): n is a, c, g, or t
  misc_feature (1154)..(1154): n is a, c, g, or t
gcagaggcacccagctcccctgctcccgtcgtccgccaaagccgcaagaagcagaggagggcaaggggagcagagcagagggagaggggaagatggcggcaccgtgcccgcagccgctgctgctcctgctcctcatctcgctgctggccgcctccgcgccccnccgcgccgaagcctggggcaaggagggccacatcatggtctgcaagatcgccgagaagtacctgtcggaggacgcggcggcggcggtgcaggacctgctgccggagtcggcgggcggggagctgtcgacgatgtgcccntgggcggacaccatgcgcttccggtaccactgggccagcccgctccactacgccaacacccccaacgtctgcaacttcaagttctcccgggactgccacaactctcgcgggnagcaggggatgtgcgtcgtnggggcnatcaacaactacacggaccagctctacacctacggggactcatccaagagctcatacaacctgacggagagcctgatgttcctggcgcacttcgtgggcgacgtgcaccagccgctgcacgtcggctacgaggaggacgagggcggcaacaccatcatggtgcactggtaccgcaggaaggccaacctncaccangtntgggatgtcagcatcatcgacacggtgatgaaggacttctacaacaagagcctcgacaccatggtggangccctccagangaacctcactgagggatggtcngacgatgtcggtcactgggagaactgcgccaacaaaaaggcgacctgcgcaaacgactacgcgatcgagagcataaatctgtcgtgcaactacgcctacaaagatgttgtgcagaacatnactctnggagatgattattacttcacncggtacccngttgtggagaagagantngcncaggccggcgtcagnctggcnctgatactcaaccggatatttgacaagaannaagcagatnctatnccgttatangtacantanaanagctatacttgtagnaaaaagtatatatatacgggctggaaggtattntagctnccgctgccangccagtttgatcaattancacttcnataggtttacncantctgtaataagantcncncaaccttggcacagcattcagaaattcanttgttgtaaagttgtagtataaaccctctattagtctatttgcttgaacaataaacaaatccacaagtgatattttaaaaaaaa

SEQ ID NO: 1265 - DNA, 1073 bp, Triticum aestivum
ccgctgctgctcctgctcctcgtcgcgctgctggctgcctccgcgccccgccgtgccgacgcctggggcaaggagggccacatcatggtctgcaagatcgccgagaggtacctgtcggaggaggcggcggcggcggtgcaagacctgctgccggagtcggcgggcggggagctgtcgacgatgtgcccgtgggctgacaccatgcgcttccgctaccactgggccagcccgctacactacgccaacacgcccaacgtctgcaacttcaagttctcacgggattgccacaactctcgcgggcagcaggggatgtgcgtcgtcggggccatcaacaactacacggaccagctctacacctacggggattcccccaagagctcgtacaacctgacggagagcctgatgttcctggcgcacttcgtgggcgacgtgcaccagccgctgcacgtcggctacgaggaggacgagggcggcaacaccatcatggtgcactggtaccgcaggaaggccaacctgcatcatgtgtgggatgtcagcatcatcgacacggtcatgaaggacttctacaacaagagcctcgacaccatggtggacgccctccagacgaacctcacggagggatggtccgacgatgtcggtcactgggagaactgtgccaacaaagaggcgacctgcgcaaacgactacgcgatcgagagcataaatcttgcatgcaactatgcctacaaagatgtggtgcagaacatcaccctaggagatgattattacttcacccggtacccggttgtggagaagaggctagcacaggccggcgtcagactggcgctgatactcaaccgtatattcgacaagaagaaagaagcagatgctatgccgttatacatacagtaaagtagctatactacttgtacaaatatagagtagatatacgggctggaaggtattgtagctgccgctgacacgccagtttcgatcacttaccgcttcaataggtttacgcgttctgtaataagagtcacgcaaccttggcacagcattcagaaattcaattgttgtaaagttgtagtctattt

SEQ ID NO: 1266 - DNA, 1172 bp, Triticum aestivum
gagcagagcagagcggtaggtgagatggcggcaccgcgctcgcagccgctgctgctcctgctcctcgtcgcgctgctggccgcctccaccgacgcctggggcaaggagggccacatcatggtctgcaagatcgccgagaggtacctgtcggaggaggcggcggcggcggtgcaggacctgctgccggagtcggccggcggggagctgtcgacgatgtgcccgtgggcggacaccatgcgcttccgctaccactgggcgagcccgctccactacgccaacacgcccaatgtctgcaacttcaagttctcacgggactgccacaactctcgcgggcagcgggggatgtgcgtcgtcggggccatcaacaactacacggaccagctctacacctacggggactcccccaagagctcatataacctgacggagagcctgatgttcctggcgcacttcgtgggcgacgtgcaccagccgctgcacgtcggctacgaggaggacgagggcggcaacactatcatggtgcgctggtaccgcaggaaggccaacctccaccacgtgtgggacgtgagcatcatcgacacggtgatgaaggacttctacaacaagagcctcgacaccatggtggccgccctccagacgaacctcaccgagggatggtccgacgatgtcggtcactgggagaactgcgccaacaaaaaggcgacctgcgcaaacgactacgcgatcgagagcatacacctgtcgtgcaactacgcctacaaggatgtggtgcagaacattaccctaggagatgattattacttcacccgctacccggtcgtggagaagagactagcacaggccggcgtcaggctggcgctcatactcaaccgtatattcgacaagaagaaagcagacaccatgccgttatacgtacagtaaaagagctatatacttgtgcataaagtgtatacatacgggctgcaaggtctataattgtagctgccgttgccacgccagtttttcatcaattaccgcttcaataagtttgccattctgtaataagagtcacaaagccttggcacagcattcagaaattcaattcttgtaaagttgtaatactccctccgttcctcaatataaggtgtattatttttccaaaagtcaaacttctctaagtctgaccaagttta

SEQ ID NO: 1267 - DNA, 1213 bp, Triticum aestivum
  misc_feature (1191)..(1191): n is a, c, g, or t
gaaaaagccgcaagcagcagagtaggcggagcagagcagagcggtaggtgagatggcggcaccgcgctcgcagccgctgctgctcctgctcctcgtcgcgctgctggccgcctccaccgacgcctggggcaaggagggccacatcatggtctgcaagatcgccgagaggtacctgtcggaggaggcggcggcggcggtgcaggacctgctgccggagtcggccggcggggagctgtcgacgatgtgcccgtgggcggacaccatgcgcttccgctaccactgggcgagcccgctccactacgccaacacgcccaatgtctgcaacttcaagttctcacgggactgccacaactctcgcgggcagcgggggatgtgcgtcgtcggggccatcaacaactacacggaccagctctacacctacggggactcccccaagagctcatataacctgacggagagcctgatgttcctggcgcacttcgtgggcgacgtgcaccagccgctgcacgtcggctacgaggaggacgagggcggcaacactatcatggtgcgctggtaccgcaggaaggccaacctccaccacgtgtgggacgtgagcatcatcgacacggtgatgaaggacttctacaacaagagcctcgacaccatggtggccgccctccagacgaacctcaccgagggatggtccgacgatgtcggtcactgggagaactgcgccaacaaaaaggcgacctgcgcaaacgactacgcgatcgagagcatacacctgtcgtgcaactacgcctacaaggatgtggtgcagaacattaccctaggagatgattattacttcacccgctacccggtcgtggagaagagactagcacaggccggcgtcaggctggcgctcatactcaaccgtatattcgacaagaagaaagcagacaccatgccgttatacgtacagtaaaagagctatatacttgtgcataaagtgtatacatacgggctgcaaggtctataattgtagctgccgttgccacgccagtttttcatcaattaccgcttcaataagtttgccattctgtaataagagtcacaaagccttggcacagcattcagaaattcaattcttgtaaagttgtaatactccctccgttcctcaatataaggtgtattatttttccaaaaagtcaaacttctctaagtttnaccaagtttatagataaaaata

SEQ ID NO: 1268 - DNA, 1194 bp, Triticum aestivum
gaaaaaaagaaagaggcagaggacccagctccccttcccccttcctccgccaaagccgcaagaagcagaggagggcaaggaggcggagcagagcagagcagagggacaggggagatggcggcaccgcgcccgcatccgctgctgctcctgctcctcgtcgcgctgctggccgcctccgccgacgcctggggcaaggagggccacatcatggtctgcaagatcgctgagaggtacctgacggaggaggcggcggcggcggtgcaggacctgctgccggagtcggccggcggggagctgtcgacgatgtgcccctgggcggacaccatgcgcttccgctaccactgggccagcccgctccactacgccaacacccccaacatctgcagcttcaacttctcccgggattgccacaactctcgcggggagcaggggatgtgcgtcgtcggggccatcaacaactacacggaccagctctacacctacggggactcccccaagagttcgtcgtacaacctgacggagagcctgatgttcctggcgcatttcgtgggcgacgtccaccagccgctgcacgtgggctacgaggaggacgagggcggcaacaccatcacggtgcactggtaccgcaggaaggccaacctccaccacgtgtgggatgttagcatcatcgacacggtgatgaaggacttctacaacaagagcctcgacaccatggtggccgccctccagatgaacctcaccgagggatggtctgacgatgtcgctcactgggagaattgcgccaacaagaaggcgacctgcgcaaacgactacgcgatcgagagcataagtctgtcgtgcaactacgcctacaaagatgtggtgcagaacatcaccctaggagatgattattacttcacccgctacccggttgtggagaagagattggcgcaggccggcgtcagactggcgctgatactcaaccgtatatttgacaagaaagaagctgatactatgccgttatacgtgcagtagaatagctatacttgtacaaaaggtgtatatgtacgggctggacaaaaatcggtattgtagctgccactgccacgccgtttgatcaatttccacttcaataggtttaccattatgtaatataaagagtcacgcaaccttggcacggctttcagaaattcattagttgtaaagttgcaatac

SEQ ID NO: 1269 - DNA, 1246 bp, Triticum aestivum
cccgagaattacataaaggcagcccaagcccgcagagcagaggcacccagctcctcccctgctcccgtcgtccgccaaagaagcaagcagcagagcagagggagatggcggcacctctcctgctcctcgtcgcgctgctggccgcctccgcaccccgccgcgccgacggctggggcaaggagggccacatcatggtctgcaagatcgccgagaagtacctgtcggaggaggcggcggcggcggtgcaggagctgctgccggagtcggccggcggagagctgtcgacgatgtgcccgtgggcggacaccatgcgcttccggtaccactgggccagcccgctccactacgccaacacgcccaacgtctgcaacttcaagtcctcacgggactgccacaactctcgcgggcaacaggggatgtgcgtcgtcggggccatcaacaactacacggaccagctctacacctacggggattctcccaagagttcatacaacctgacggagagcctgatgttcctggcgcacttcgtgggcgacgtgcaccagccgctgcacgtcggctacgaggaggacgagggcggcaacaccatcatggtgcgctggtaccgcaggaaggccaacctccaccacgtgtgggacgttagcatcatcgacacggtgatgaaggacttctacaacaagagcctggacaccatggtgggcgccctccagacgaacctcacggaaggatggtccgacgatgtcggccactgggagaactgcgccaacaaaagggcgacctgcgcaaatgactacgcgatcgagagcatacacttgtcctgcaactacgcctacaaggatgtggtgcagaacattaccctcggagatgattattacttcacccgctacccggtcgtggagaagagactagcacaggccggcgtcagactcgcgctgatactcaaccgtatatttgacaagaagaaagcagataccatgccgttatacgtacagtaaaagagctatactttgtacatgaagtgtatacatacggggctgcaaggtattgtagctgccgttgccacgccagtttctcataaattaccgcttcaataagtttgccattctgtaataagagtcacaaagccttggcacagcactcagaaattcaattgttgtgaagttgtaatataattcaaccgtctataatagactatttgcttgaacaataatagccaatccacaagtgaagttcagagccacgtttt

SEQ ID NO: 1270 - DNA, 1053 bp, Triticum aestivum
ctcctgctcctcgtcgcgctgctggccgcctccgcaccccgccgcgccgacggctggggcaaggagggccacatcatggtctgcaagatcgccgagaagtacctgtcggaggaggcggcggcggcggtgcaggagctgctgccggagtcggccggcggagagctgtcgacgatgtgcccgtgggcggacaccatgcgcttccggtaccactgggccagcccgctccactacgccaacacgcccaacgtctgcaacttcaagtcctcacgggactgccacaactctcgcgggcaacaggggatgtgcgtcgtcggggccatcaacaactacacggaccagctctacacctacggggattctcccaagagttcatacaacctgacggagagcctgatgttcctggcgcacttcgtgggcgacgtgcaccagccgctgcacgtcggctacgaggaggacgagggcggcaacaccatcatggtgcgctggtaccgcaggaaggccaacctccaccacgtgtgggacgttagcatcatcgacacggtgatgaaggacttctacaacaagagcctggacaccatggtgggcgccctccagacgaacctcacggaaggatggtccgacgatgtcggccactgggagaactgcgccaacaaaagggcgacctgcgcaaatgactacgcgatcgagagcatacacttgtcctgcaactacgcctacaaggatgtggtgcagaacattaccctcggagatgattattacttcacccgctacccggtcgtggagaagagactagcacaggccggcgtcagactcgcgctgatactcaaccgtatattcgacaagaagaaagcagataccatgccgttatacgtacagtaaaagagctatactttgtacatgaagtgtatacatacggggctgcaaggtattgtagctgccgttgccacgccagtttctcataaattaccgcttcaataagtttgccattctgtaataagagtcacaaagccttggcacagcactcagaaattcaattgttgtgaagttgtaata

SEQ ID NO: 1271 - DNA, 862 bp, Triticum aestivum
ctcctgctcctcgtcgcgctgctggccgcctccgcaccccgccgcgccgacggctggggcaaggagggccacatcatggtctgcaagatcgccgagaagtacctgtcggaggaggcggcggcggcggtgcaggagctgctgccggagtcggccggcggagagctgtcgacgatgtgcccgtgggcggacaccatgcgcttgcgggaccactgggccagcccgctccactacgccaacacgcccaacgtctgcaacttcaagtcctcacgggactgccacaactctcgcgggcaacaggggatgtgcgtcgtcggggccatcaacaactacacggaccagctctacacctacggggactcccccaagagctcgtacaacctgacggagagcctgatgttcctggcgcacttcgtgggggacgtgcaccagccgctgcacgtcggctacgaggaggacgagggcggcaacaccatcatggtgcactggtaccgcaggaaggccaacctccaccacgtgtgggacgttagcatcatcgacacggtgatgaaggacttctacaacaagagcctggacaccatggtgggcgccctccagacgaacctcacggatggtccgacgatgtcggccactgggagaactgcgccaacaaacgggccacctgcgcaaacgactacgcgatcgagagcatacacttgtcgtgcaactacgcatacaaggatgtggtgcagaacattaccctaggagatgattattacttcacccgctacccggtcgtggagaagagactagcacaggccagcgtcaggctggcgctgatactcaaccgtatattcgacaagaagaaagcagataccatgccgtt

SEQ ID NO: 1272 - DNA, 1067 bp, Triticum aestivum
ccgacgcgtggggcaaggagggccacatcatggtctgcaagatcgccgagaagtacctgtcggaggaggcggcggcggcggtgcaggagggggtgccggagtcggcgggcggggagctgtcgacgatgtgcccgggggcagacaccatgcgcttccgctaccactgggccagcccgctccactacgccaacacccccaacgtctgcaacttcaacttctcccgggattgccacaactcacgcggggagcaggggatgtgcgtcgtcggggccatcaacaactacacggaccagctctacacctacggggactcatcaaagagctcgtacaacctgacggagagcctgatgttcctggcgcacttcgtgggcgacgtgcaccagccgctgcacgtcggctacgaggaggacgagggcggcaacaccatcatggtgcactggtaccgcaggaaggccaacctgcatcatgtgtgggatgtcagcatcatcgacacggtcatgaaggacttctacaacaagagcctcgacaccatggtggacgccctccagacgaacctcacggagggacggtccgacgatgtcggtcactggaagaactgtgccaacaaagaggcgacctgcgcaaacgactacgcgatcgagagcataaatcttgcatgcaactatgcctacaaagatgtggtgcagaacatcaccctaggagatgattattacttcacccggtacccggttgtggagaagaggctagcacaggccggcgtcagactggcgctgatactcaaccgtatattcgacaagaagaaagaagcagatgctatgccgttatacatacagtaaagtagctatactacttgtacaaatatagagtagatatacgggctggaaggtattgtagctgccgctgacacgccagttcgatcacttaccgcttcaataggtttacgcgttctgtaataagagtcacgcaaccttggcacagcattcagaaattcaattgttgtaaagttgtagtctatttgcttgaacgataaacaaatccacaagtgcagttgaaagcgaaaaaaaaaa

SEQ ID NO: 1273 - DNA, 1159 bp, Brachypodium distachyon
gtcagaaactcagaagcagcagcagcaggagcagagcagagggagaagccgggaagatggcagcaccgcgagcgcgcctgccgctgctgctgctcctcgtccctctgctggacgccggccgcgccgccgcgtggggcaaggagggccacatcatggtctgcaagatcgccgagaagtacctgtcggcgtcggcggcggcggcggtgcaggagctgctgccggaggcggcgggcggggagctgtcgaccatgtgcccgtgggcggaccagatgcggttccgctaccactgggccagcccgctccactacgccaacacccccaacgtctgcaacttcaagttctcccgggattgccacaactctcgtgggcagcaagggatgtgcgtcgtgggagccatcaacaactacacggaccagctctacagctacggagaccccaagagttcatataacctgacggagagcctgatgttcctggcccacttcgtcggcgacgtgcaccagccgctgcacgtcgcctttgagaaagacgaaggcgggaacactatcatggtgcactggtaccggaggaaagccaacctgcaccatgtgtgggatgtcagcatcatagacacggtgatgaagaacttctataacaggagcctggacaccatggtggatgctctcaaggggaacctgacaaatgggtggtccgacgatgttagtcactgggaaaattgcgagaacaaaagggcaacctgcgcaaatgactatgcaattgagagcatacatttgtcatgcaattatgcctacaaagatgtggagcaaaatgttactctaggagatgattattatttctcccggtacccggttgtggagaagcgattagcgcaggccggcatcagattggcattgatactcaacaggatatttgacaaggacaaagcagatgttataccattacatgtacagtaaaagctataactacagcacaaaaaatacagggtggaaagcattatagctgccgcattgtttgatcaatttgtcacttcaataagtttgcacattctgtaataagaaacacatcagctatgtaattatttgtacagttgtaaaccctctatttgttcgaacaatacacaatccagaagtgcagtacaaagcaatgattcattttctct

SEQ ID NO: 1274 - DNA, 1383 bp, Triticum aestivum
ccacgcgtccgggcgcgtgcccccacgcgtggcagcagcaccacctacaccaccgcgggcgcatgtgggccgcctccccggccttccgcaggcagctcgtcctgctccgctctctcgcgcccaccacctgcgcagacggcggccgcgcctcctcgagctctcttcgtccccacgcgatgtctgcggcggccgggccggtgtacgaggcggacgcggaggcggtggtccggcgaatcacgccgccgctcgaccgcgcaaggcacaagggtcaggcagggaagatagcaataattggtggatgtcgcgagtacactggtgctccttattttgccgctatctctgcattgaaagttggtgcagatctctcacatgttttctgcacaaaagatgctgcaacagtaatcaagagctatagccctgagttgattgtgcatccaatattagaggagtcctacagcgtaagggatgatgaaagagaatctgtttcttctagcattctcactgaagttataaagtggatggagcgctttgattgcattgttgttggccccggccttggaagggactcatttcttatggattgtgtcagtaatatcatgaggcatgcacgacaggctaatatcccaactgttgttgatggggatggccttttccttataaccaataacattggtcttgttgaagacaactctcttgccatcttaacgccaaatgtatacgagtacaagcgtcttgtccagaaggttcttaactgtgaagtaaatgaggaaaatgcttctgagcaactgactgcactttgccaaaaaattggtggtgtaaccatcatgaggaaaggaaaagcagatgtaattagtgatggtaaaaaagtcacacaagtgagtacctttggttctccaaggcgatgtggtggtcaaggcgacattctctctggaagcgtggcagtattttcatcatgggcacggcactttctcttgtcaaatgagcaacctaaagagactagtgtgaatcctatggttcttgggtgcatagctggctctctattgctcagaaaagctgcggcgcttgcatttgagaagaacaagagatcaactgtcactactgacatcattgagttcttgggccaaagcttggaagatatctgccctgctgggtggtagtttcttgtgggtttcttaacataatactggaactgcgcctaggcattctacaataataatagcgatcctgttatcaggatgtatcatcaccgtctttatgtatatataactctagatgaggatgctacaatgcttggatgctatgatatgttatgtatcgccgctgtctagaaatcctcagtgaattgaagtttagtagtagaagcagtcgcggcaggcgtgacgc

SEQ ID NO: 1275 - DNA, 1346 bp, Triticum aestivum
gcgcgtgcccccacgcgtggcagcagcaccacctacaccaccgcgggcgcatgtgggccgcctccccggccttccgcaggcagctcttcctgctccgctctctcgcgcccacctgcgcagacggcggtcgcgcctcctcgagctctcttcggccccacttgatgtatgcggcggccgggccggtgtacgaggcggacgcggaggcggtggtccggcgaatcacgccgccgctcgaccgcgcaaggcacaagggtcaggcagggaagatagcaataattggtggatgtcgcgagtacactggtgctccttattttgccgctatctctgcgttgagagttggcgcagacctctcacatgttttctgcacaaaagatgctgcaacagtaatcaagagctatagcccggagttgattgtgcatccaatattagaggagtcctacagcgtaagggatgatgaaagagaatctgtttcttctagcattctcgctgaagttataaagtggatggagcgctttgattgcattgttgttggccccggccttggaagggactcatttcttatggattgtgtcggtaatatcatgaggcatgcacgacaggctaatatcccaactgttgttgatggggatggccttttccttataaccaataacattggtcttgttgaagataactctcttgccatcttaacgccaaatgtatacgagtacaagcgtcttgtccagaaggttcttaactgtgaagtaaatgaggaaaatgcttctgagcaactgactgcactttgccaaaaaattggtggtgtaactatcatgaggaaaggaaaagcagatctaattagtgatggtaaaaaagtcacacaagtgagtacctttggttctccaaggcgatgtggtggtcaaggcgacattctctctggaagcgtggcagtattttcatcatgggcacggcactttctcttgtcaaatgagcaacctaaagagaccagtgtgaatcctatggttcttgggtgcatagctggctctctattgctcagaaaagctgcagcgcttgcatttgagaagaacaagagatcaaccgtcactactgacatcattgagttcttgggccaaagcttggaagatatctgccctgctgggcggtagtttcttgtgggtttcttaccataatactggaactgcgcctcggcattctacaataatagtgatcctgttatcaggatgtatcgtcaccgtgtttatgtacatatttctctagtaagaagaggatgctacaatgcttggatgctatgatctgttatgtatcacccaccgctgtctagaaatcctcagtgaattgaagtttagtag

SEQ ID NO: 1276 - DNA, 1172 bp, Triticum aestivum
tctctcgcgcccacctgcgcagacggcggccgtgcctcctcgagctctcttcgtccccacgcgatgtctgcggcggccgggccggtgtacgaggcggacgcggaggcggtggtccggcgaatcacgccgccgctcgaccgcgcaaggcacaagggtcaggcagggaagatagcaataattggtggatgtcgcgagtacactggtgctccttactttgccgctatctctgcattgaaagttggtgcagatctctcacatgttttctgcacaaaagatgctgcaacagtaatcaagagctatagccctgagttgattgtgcatccaatattagaggagtcctacagcgtaagggatgatgaaagagaatctgtttcttctagcattctcactgaagttataaagtgggtggagcgctttgattgcattgttgttggccccggccttggaagggactcatttcttatggattgtgtcagtaatataatgaggcatgcacgacaggctaatatcccaattgtcgttgatggggatggccttttccttataaccaataacattggtcttgttgaagacaactctcttgccatcttaacgccaaatgtatacgagtacaagcgtcttgtccagaagattcttaactgtgaagtaaatgaggaaaatgcttctgagcaactgactgcactttgccaaaaaattggtggtgtaaccatcatgaagaaaggaaaagcagatgtaattagtgatggtaaaaaagtcacacaagtgagtacctttggttctccgaggcgatgtggtggtcaaggcgacattctctctggaagcgtggcagtattttcatcatgggcacggcactttctcttgtcaaatgagcaacctaaagagactagtgtgaatcctatggttcttgggtgcatagctggctctctattgctcagaaaagctgcggcgcttgcatttgaaaagaacaagagatcaactgtcactactgacatcattgagttcttgggccaaagcttggaagatatctgccctgctgggcggtagtttcttgtgggtttcttaccataatactggaactgcgcctcggcattctacaataatagcaatcctgttatcaggatgtatcgtcaccgtgtttatgtacatatatctctagtaacaagaggatgcta

SEQ ID NO: 1277 - DNA, 1468 bp, Brachypodium distachyon
tgggcgcgtgcccccacgcgtggcggcacaatctgcaacaccgcggccgcatgtgggccgcctccccggccttccgcaggcagctattcctgctccgctctctcgcgccctcctgcacctgcgtaagcggcggccgcgcgtcctcgagctctctccgggtccacgcgatgcatgcggcggcagcgggggcggtgtacgaggcggacgcggagtcggtggtccggcggatcacgccgccgctcgaccgcgcccggcataaagggcaggcagggaagatagcagtaattggtggatgtcgcgagtacactggtgctccttattttgccgctatctctgccttaaaagttggtgcagatctctcacatgttttctgcacaaaagatgctgcaacagtaattaagagctatagccctgagttgattgtgcatccaatacttgaggagtcctacagtgtaagggatgatgaaagagaatctgtttcttctatcattctcactgaagttacgaagtggatggagcgcttcgattgcatagttgttggtcctggccttggaagggactcatttcttctgaattgtgtcagtaatatcatgagacatgcacggcaggctaatattccaactgttgttgacggggatggccttttccttgtaaccaataacattagtcttgttgaagataactctctcgccatcctaacaccaaatgtatacgagtacaagcgtcttgtccagaaggtgcttaactgtgatgtagatgaggaaaatgcttctgagcaactgactacactttgccaaaaaattggtggtgtaaccatcatgaagaaaggaaaagcagatgtaattagtgatggtaaacaagtcacacaagtgagtacatttggttccccaaggcgatgtggtggtcaaggcgacattctttccggaagcgtggcgctcttctcatcatgggcacgacactttctcttgtcaaatgaccaacctacagagaagagcgtgaacccgatgatccttgggtgcatagctggctctctattgctcaggaaagctgcagggcttgcttttgagaagaagaagagatcaaccgtaactacagacatcattgagttcttgggcaaaagcttggaagatatctgccctgctgagcagtagtgttgggtggatttgttccatcattgccgaactgtaccccagcagcctacaataatgttgatgctggcatttggatattaccatcatcgtgtacatattttgtagactaagaagagggtgctgggatgctttgatagactgtctgcttctttgtaagcgctgcattggacatggccttatgacttttcaagtatccttcccatgatagctaaaacatctatatcctttcttttgtttttgcgccccttaattgtttttaagagtgattcgttgttctctatttatatgctgtctattatgctcagaaatttggaagt

SEQ ID NO: 1278 - DNA, 1418 bp, Oryza sativa
actactttccggcggcgccgctctcctgtagaaaaaatgcgaaaccactgccctcacgcgtggcatcagcagcagcaccgcggccgcatgtgggccgcctcaccggccttccgcaggcgcctcttcctcctccgttccctttccccctccccctgcgccgccctccccggcaacgccgcctgctcctcctccccctcgccgtcgacctccattcgggtcaacgcgatgtcggcatcgggccccgtgtacgaggcggacgctgaggcggtggtccgccggatcaccccgccgctcgaccgcgcgcgccacaagggccaggcagggaaaattgctgtaattggtggatgtcgtgagtacactggtgctccctattttgcagcgatttctgccttgaaagttggtgcagatctctcacatgttttctgcacaagagatgctgcaacggtaataaagagttatagccctgagctgattgtacatccaatactagaggaatcttacagtgtaagcgatggtgagagagaatctgtttcttctagaattctcacagaagtagcaaagtggatggagcgctttgattgcatcgttgttggtcctggccttggaagggactcatttcttctggactgtgtaagtaatatcatgagacatgcacggcaggcaaatattccaacagtcgttgacggggatggccttttccttataaccaataaccttagtcttgttgagggtaacttgcttgccatcctaacaccaaatgtatacgagtacaaacgtcttgtccagaaggttcttaactgtgaagtaaatgaggaaaacgcttctgaacaacttactgcactatgccaaaaaatcggtggcataaccatcatgcggaaaggaaaagcagatataatcagtgatggcaaaactgtaacacaagtaagtacctttggttccccaaggagatgtggtggtcaaggtgacattctttcaggaagtgttgcagtatttgcatcatgggcacgtcactttctcctgacgaatgagtaccctacagagaagagcgtgaatccgatgatgcttgggtgcattgctggctctctactacttaggaaagctgcatcacatgcttttgagaagaacaagagatcaactgtcaccactgacatcattgagttactgggcaaaagcttggaagatatatgccctgctggtcattagtttagatctttaccatcattggtggtacggcgccttagcacctgtaataatggtaatccatatgttcggataccagtctctccctgcttaatgtacatgtttcttgactgaaaagatggtgttacaatgcttggttttgtttagcctccgttttgctcagaagaattctacagaatgaataatgaattgccccataaatggggctttgattttgg

SEQ ID NO: 1279 - DNA, 1464 bp, Panicum virgatum
agcatcatcccatgagccggcccacgggcgcgtggcgacaccagccgcagcaccgggggcgcatgtgggccgcctccccgttcttccgcaggcagctcgtcctgctccgctccctcctcccccagtctcctccaccctccgtcgccggctgccgcttcgcccacctgtcctccccctcgggtacctccggctccctccgggccgcccgcgccatggcggcggcgacggtgtacgaggcggacgcggaggccgtcgtccgccggatcacgccgccgctcgaccgcgccaggcacaagggtcaggcaggaaagatagcagtaattggtggatgtcgcgagtacacaggcgctccatattttgcggctatctctgccttgaaagttggtgcagatctttcacatgttttctgcacaaaagatgctgcaacagtaattaagagttatagccctgaactgattgtacatccgatactggaggaatcatacagtgtaagagatgatgaaagagcatctgtatcttctaaaattctcactgaagttgcaaagtggatggagcgttttgattgcattgtcgttggtcctggccttggaagggactcatttcttctggattgtgtgagtaatattatgaagcatgcaaggcaggctaatattcctactgttgttgatggggatggcctttttcttataaccaataaccttggtcttgttgagggcaaccctcttgccattttaacaccaaatgtatacgagtacaaacgtcttgttcagaaggtccttaactgtgatgtaaatgaggaaactgcttctgagcaactgatggaactttgccaaaaaattggtggtgtgacaataatgcagaaaggaaaggcagatgtcatttgtgacggtaaaacagtgacgcaagtgagtacttttggttccccaaggcgatgtggtggtcaaggggacatcctttctggaagtgtggcagtatttacatcttgggcacagcactttatcttgtcaaatgagcaacctacagagaagagagtcaatcctacgacacttgggtgcatagctggctctctactgctcagaaaagctgcatcgctggcttttgagaagaacaagcgttcaacagtcaccacagacatcatcgagttcttgggcaagagcttggaagatatctgccctgctgaacactagttcttgtcggttcatgtcatgcatgtacagctctagcccctctaataaggttcatccatgcgttttgatccctagatctccttttactctgtacacgtccaataggaatagggtgttaccatgctttgatccaatgtttattgtccactgttgagaagaactgcggtaaaatcatggaatatatgttttctgagaattgaaactgtggaaagactggtagaatgctaaacgcatgcttcccaagtaatgcgatagatctctagttgtcacccatggc

SEQ ID NO: 1280 - DNA, 1683 bp, Sorghum bicolor
cgattcccacggcaggaaagcctgatgagccggcccaccggcgcgtgccctcacgcgtggcgacaccagcagcagccgctccgggggcgcatgtgggccgcctccccggcattccgcaggcagctcgtcctgctccgctccctcctcccttccccgcctgccccctcctccgtcgccggctttcccccatcctgcccctcgtgctccagcttcctccgggtccggaccaaccacgcgatggcggcgtccgccgggacggtgtacgaggcggacgcggaggccgtcgtgcgccggatcacgccgccactcgaccgcgccaggcacaagggccaggcagggaagatagcagtaatcggaggatgtcgtgagtacactggtgctccttattttgccgctatctctgccttgaaagttggtgcagatctttcacatgttttctgcacaaaagatgctgctacagtaattaagagctatagccctgaactaattgtacatccaatattagaagaatcttacagtgtaagggatgatgaacgagcatctgtttcttctaagattcttactgaagttggaaaatggatggagcgctttgattgcattgttgttggtcctggccttggaagggactcatttcttctggattgtgtgagtaatatcatgaggcatgcacggcaggctaatattccaactgttgtggatggggatggcctgtttcttgtaaccaataaccttagtcttgttgaaggaaaccctcttgccattttaacaccaaatgtctatgagtacaagcgtcttgttcagaaggttcttaactgtgatgtagatgaggaaactgcttctgagcagctaatcacactttgccaaaaaattggtgatgtaacaataatgcagaaaggaaaagctgatgtcatcagtgatggtaaaacagttacgcaagtgagtacttttggttccccaagacgatgtggtggtcaaggtgacatcctttctggaagtgtggctgtatttgcatcgtgggcacgacactttgtcttgacaaatgaacaacctacagagaaaagagttaatcctatgacccttgggtgcatagctggctctcttctactcaggaaagctgcatcacatgcttttgagaagaacaagagatcaactgtcacctctgatatcattgagttcttgggcaaaagcttggaagatatctgccctgccgagcactagctcctgtgagtgattatagtcatgcacgtgcaaatctaataatgttatccaggcagtttgatgatcggatctctccctttgtatgtctgttgaatagggtgctaccatgcttagatccaatgttgttgagaagaactgtgcacaagaatcataggactgaaactgggtaaagactgactagaattcagaatgcatgtttctagtcgcgtagtgatgcagctgataaatatggtggtggcagcgttctttttgggaaatcatgcttttggattaagtaccaaattgtcagaggaaaactttggtttaaagtgctgtttccttggatcgataggatcaatgattgttcttattaacgactatcctatccggccatgttgacctcagttgtcctttgctcacaataacgcaccaactgccttcctcttgacaacactatcactatataaaacctttagattagtaccc

SEQ ID NO: 1281 - DNA, 1520 bp, Saccharum officinarum
cataggcgattccccacggcagggcagcctcatgagccgacccagggccgcgtgccctcacgcgtggcgacaccagcagcagccgcaccgggggcgcatgtgggccgcctccccggcattctgcaggcagctcgtcctgctccgctccctcctcccttctcctcctgcaccctcctccgtcgccggcttccccccatcctgcccctcgtgctccagcttcctccgggttcggaccaaccacgcgatggcggcgtccgccgggacggtgtacgaggcggacgcggaggccgtcgtgcgccggatcacgccgccgctcgaccgcgccaggcacaagggccaggcagggaaggtagcagtaatcggaggatgtcgtgagtacactggtgctccttattttgctgctatctctgccttgaaagttggtgcagatctttcacatgttttctgcacaaaagatgctgctacagtaattaagagctatagccctgaactgattgtacatccaatattagaggaatcttacagtgtaagggatgatgaacgagcatctgtttcttctaaaattcttactgaagttgcaaagtggatggagcgctttgattgcattgttgttggccctggccttggaagggactcatttcttctggattgtgtgagtaatatcatgaggcatgcacggcaggctaatattccaactgttgtggatggggatggcctgtttcttgtaaccaataaccttagtcttgttgaaggaaaccctcttgccattttaacaccaaatgtctatgagtacaaacgtcttgttctgaaggttcttaactgtgacgtagatgaggaaactgcttctgagcagctaatcacactttgccaaaaaattggtgatgtaacaataatgcagaaaggaaaggctgatgtcatcagtgatggtaaaacagttacgcaagtgagtacttttggttccccaagacgatgtggtggtcaaggtgacattctttctggaagtgtagcggtatttgcgtcgtgggcacggcactttgtcttgacaaatgaacaacctacagaaaaaagagttaatcctatgacccttgggtgcatagctggctctcttctactcaggaaagctgcatcacatgcttttgagaagaacaagagatcaactgtcacctctgatatcattgagttcttgggcaaaagcttggaagatatctgccctgccgagcactagctcctgtgagtaattatagtcatgcacgtgcaactctaataatgttatccaagcagtttgatggtcggagccctttgtatatgtctgttgaatagggtggtaccatgcttagatccaatgttgcccttagtgttgttgaaaagaactgtgcactagaatcataggactgaaactgggtaaagactgactagaattaagaacgcatgtttctagtcgcctaatgatgcagctgataaatatggtggtagcaggggtcttttgggaaaacatgcctttggatgaagacccaattgtc

SEQ ID NO: 1282 - DNA, 1440 bp, Pennisetum glaucum
ccacggcgccgcacaggcgttccatgagccggcccacggtcgcgtggcgacaccaccacccacagccgcaaccgcaccgggggcgcatgtgggccgcctcccaggccttccgcaggcagctggtcctgctccgctccctcctcccgccgcccccctccccctgctcccccgtcgctagctgcttcgccccgtcgccctccctctcgagttcgagcacctccagctccatccgggctagccacgcgatggaggcgacggtgtacgaggcggacgccgaggccgtcatccaccggatcacgccgccgctcgaccgggccaggcacaagggccaggcagggaagatagcagtaattggtggatgtcgcgaatacactggggctccatattttgcagctatctctgccttgaaagttggtgcagatctttcacatgttttctgcacaaaagatgctgcaaccgtaattaagagttatagtcctgagctgattgtgcatccaatattggaggaatcatatagtgtgagagaagatgaacgagcaccggtttcttctaaaattctcactgaagttgcaaagtggatggagcgctttgattgcattgtcgttggtcctgggcttggaagggactcatttcttctggattgtgtcagtaatattatgaagcatgcaaggcaggctaatattcctactgttgtggatggggatggactttttcttataaccaataaccttggtcttgttgaaggcaaccctcttgccattttaacaccaaatgtatatgagtacaaacgtcttgttcagaaggtgcttaactgtgatgtaaatgaggaaaatgctgctgagcaactgacaatgctttgccaaaagattggtggtgtgacgataatgcggaaaggaaaagcagatgtgattagtgatggtaaaacagtgtcacaagtgagtactttcggttccccaaggcgatgtggtggtcaaggggatatcctttctggaagtgttgcagtatttacatcatgggcacagcagtttatcttgtcaaatgaacaaccaactgggaagagagtcaatcccatgacccttgggtgcgttgctggctctctattgctaaggaaagccgcgtcacttgctttcgaggaaaacaagcgatcaaccgtcaccacagacatcatcgagttcttgggcaaaagcttggaagatatctgccctgctgagcactagttttggttggtactttatcatcatgcattcgtagctctaataatgtttatcaatgcatgtggtccttggacatccattttcgttgtacatttttgtccaatgggaatagggtgttacaatgtctgaatccactgttcacccagtgttgagaacttcagaaaaataaggaatttactttttcttggaagaaactggggaaagagggcgctgaacttgtgtggcc

SEQ ID NO: 1283 - DNA, 1621 bp, Zea mays
ggaacaactgaacggccggcagtggcagaggatgcggctgcgtccgacctccttgcttttcgagaatccactgccttcgattcctagtttcccacggcagggcagcctcatcggatcccatgagccggcccacgggcgcgtggcgactagggatggcaacgtgtacaataccagcagcaccgcgtgcgcatgtgggccgcctccccggcattcggcaggcagctcgtcctgctctactgcttccttccttctcctcctccactctcctctgtcaccggcttccccccatcctgcccctcgtgctccagctcctccgggtccgggccaaccacgcgatggcggcgtccgccgggacggtgtacgaggcggacgcggaggccgtcgtgcgccggatcacgccggcactcgaccgcgccagacacaagggccaggcagggaagatagcagtaatcggaggatgtcgtgagtacactggagctccttattttgccgctatctctgccttgaaagttggtgcagatctttcacatgttttctgcacgaaagatgctgctacagtaattaagagctatagccctgaactaattgtacatccaatattagaagaatcttacagtgtaagggttgatgaacgagcatctgtttcttctaagattcttacggaagttgcaaagtggatggagcgctttgattgcattgttgttggtcctggccttggaagggacccctttcttctggaatgtgtgagtaatatcatgaggcacgcacgacaggctaatattccaactgttgtggatggggatggcctatttcttgtaaacaataaccttaatcttgttgaaggaaaccctcttgccattttaacaccaaatgtctatgagtacaagcgtcttgttcagaaggttcttaactgtgacgtagatgaggaaagtgcttctgagcagctaatcgcactttgccaaaaaattggtgatgtaacaataatgcagaaaggaaaagctgatgtcatcagtgacggtaaaacagttacacaagtgagtacttttggttccccaagacggtgtggtggtcaaggtgacatcctttctggaagtgtggcagtatttgcatcatgggcacgacactttgtcttgacaaacgaagaacctacagagaaaagagttaatcctatgacccttgggtgcatagctgcctcccttctactccggaaagctgcgtcacatgcttttgagaagaacaagagatcgactgtcacctctgatatcattgagttcttgggcaaaagcttggaagatatctgccctgccgagcactagctcctgccagtaattgtagtcatgcacgcggaagcctaataatgtttatatgtctgttgaacagggtgttaccatgcctaattctaatgttgcccagtgatgttgagaactgtgcagtagaagcgtaagattgaaactggggaacgacgactagaattctgaacacatgtttctagtcgcctaggactatccgtcttcttctcgacaacactatcactatatataaacttgaccttaggattagtactgctattggtgctagtagtttatttgaattgaagtaatttgcgtaggttctgagcgag

SEQ ID NO: 1284 - DNA, 1631 bp, Leymus cinereus x Leymus triticoides
gatcgagagaagctcggatccccggaggagaggagaggagccccgagctctcggttgcgccgcggcgatgggtagcttgcgaggcggaagcggcggagagggaaggaacgaggacggagggaaagtcgggctaccggcgttggaggtggcgctcgcgttcccgcaggccacgccggcgtccctgttcccgcccgccgtgtcggactactaccagcttgatgatttgctgaccgatgaagaaaaggcacttaggaagaaagtccgtgctatttcagagaaagaaatcgcacccattatgaccgaatactgggagaaggcagaattcccatttcatgccattcccaaacttgcaactcttggcttagctggaagtacaacgaagggatatgggtgcccaggactctcgcttacagctagtgctgtttctatagcagaagttgcacgggttgatgcaagctgctccacatttattctagtgcactcctctttggcaatgtccacaattgctctttgtgggtcagaagctcaaaagcagaagtacttaccgtcgttagctcagtttaaaactgttggttgctgggctttaacagagccagattatggaagtgatgcaagctccttgaaaacttcagcaaccaaggtacctggcggttggcaattagatggccaaaagcgctggataggtaacagcacgtttgcagatgtgcttgtaattttagctaggaatgcagacacaaagcaactaaatggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctcgcaatgtcacgcattatggtggcatggcagccaattggcatatcaatgggcgtctacgacatgtgtcatcggtatttgaaagaaaggaagcagtttggagctcccctggcagcctttcagctcaaccaagaaaagcttgttcggatgcttggtaacatccaggccatgcttcttgtcggctggcgcttgtgcaagctctatgagtctggcaaaatgacaccaggccatgctagtttgggcaaggcatggacgtccagcaagtcaagggaggtagtttctctgggtcgagaactattgggcggcaatggaattttggctgattttctagtagcgaaggcgttctgcgatctggagccgatttactcatacgagggcacctatgacatcaacagccttgtgaccggaagagaaatcaccgggatcgcgagcttcaaacctgctgctgtagcaaaatctcggctttaattcttcttctgcctccagctatgatgaacaacaaagtatgacccccaccttgtattctggtgggtacgagtaagatcggaataagtgcaaccgaatgatcaaatataatttgtaaggcggaaggataaagtcggagctggatttgtatctatgtaatggtacagcatatggagtcacctctcatgaccagtgtttgtgccgtggggggtcgtaccagcttctacataatggaattgtgcagtttaggaga

SEQ ID NO: 1285 - DNA, 3398 bp, Triticum aestivum
gttttaaatccgattcggcccccgattcggcaacccagcccgacccacctgttctgttccccagtaacgagaagctaaataaatccataaatccctggcagagagagggagaggagccaggcgatcgatcccggtggcggcgagaggcgaggagaggcggccggcgaagcaatgccttactgcgaggtggaccggtaccaggccggcgacaagtgggagggcgtccgcctcttctaccgccgctacggccgcggcgccaccaaggtgctcctcgtcatcggtctggcggggacgcacgactcgtggggcccgcagataagggggctgaccgggtccatggagccggcggacggcggcgacgtgcccgagcccgccgcgaggacggacgaggaggccgccgcgccggcgacggcgacggcgccggaggaggaggacgtcggcgagggcatcgaggtctgctgcttcgacaaccgcggcgtcggccgcagcagcatccccccgcacaaatcctactactcgacggcgatcatggcgagggacgcgctggccttgatggaccatctggggtggaagaaagcccacgtcttcggccactccatgggcgcgatgatctcctgcaagctcgcagcgatggcgcctcaccggctgtcctcgctggcgttgctcaacgtcaccggcggcgggatggagtgtttccccaaggtagatgcacagatgctatctctcgcgttccggttcttaagggcgaggactccggagcaaagagctcttgtggacttggaaacccactatacgaaggaatacctcgatgaggaagttgaatcctgcacaaggagagcgatcctatataaggaatatgtgaaaggcatatcatcttcagggatgcaatctaattgcgggtttgaaggtcaaattaacgcgtgctggactcacaaagtgacaactaaagagctagatacaattcgtgctgccggttttctggtttcagttattcatggaagacatgatattattgcgcaagtatgtcatgcgaggcggcttgcacaaaggcttcttcctgttgctagaatggtagatcttcatggtgcacatctagtcagccatgaaagaccacaagaggtcaacaacgcgctgatggatctgataaaggccaccaagtcggcgacggcgccgcacgagtggtcgtcccagccagaaaacacatcaggcctggtagtgatggcgtttgagcacatgaggaacattgtaagagtaacgaagcccgtgagggtcgcggcgatcgagtcatcataaagaaacaaaagacatgtaaattatacccccgaagccggcgaggagatcatatttcatgtctcctccgtataccatccgcggagatgagacggatttagagtagcatctccgcaagaatcgaacctattttccctcctcccttgagaaaggccctctgctctcggcagaaacaacgtttcgagactgaagaacagaggagctgtacctgcgttgcgcacctgggcagaagcgtcacggggcgtggtgattgagatgtgctgccatacattgtattagctcggagagagcaaatggatcggatgtacctttgtgtgatgagtgtaattaagctgtgaccaatatgtacacggccgcatgttgcgttgcgtgggtgctgtcgccgttcttgtgtactccattgttgtgctgtgatcattcctttgaataaatccctcgtgccgaattcggcacgaggtctctgtcccccttcccaactactcctccacctcgatcgagagaagctcggatccccggaggagagcagaggagaggagcccactttagctctcggttgcgccgcggcgatggggagcctacgaggcggaagcggcggagagggaaggaacgaggacggagggaaagtagggctaccggcgttggaggtggcgctcgcgttcccgcaggccacgccagcgtccctgttcccgcccgccgtgtcggactactaccagcttgatgatttgctgaccaatgaagagaaggcgcttaggaagaaagtccgtgctatttcagagaaagaaatcgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattctagtgcactcctctttggcaatgtccacaattgctctttgtggatcagaggctcaaaagcagaagtacttaccatcgttagctcagtttaaaactgttggttgctgggctttaacagagccagattatggaagtgatgcaagctccttgaaaacttcagcaaccaaggtacctggcggttggcaattagatggccaaaagcgctggataggtaacagcacgtttgcagatgtgcttgtaattttggctaggaatgcagacacaaagcaactaaacggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggagctcccctggcagcctttcagcttaaccaagaaaagcttgttcggatgcttggtaacatccaggccatgcttcttgtcggctggcgcttgtgcaagctctatgagtcaggcaaaatgacaccaggccatgctagtttgggcaaggcatggacgtccagcaagtcaagggaggtagtttctctgggccgagagctattgggcggcaatggaattttggctgattttctagtagcaaaggcgttctgcgatctggagccgatttactcgtatgagggcacctatgacatcaacagccttgtgaccggaagagaaatcaccgggatcgcgagcttcaaacctgctgcagtagcgaaatctcggctgtaattcttcttctgcctccagctatgatgaacagcaaagtatgacccccaccttgtattctggtgggtacaagtaagatcggaataagtgcaaccgaatgatcaagtgtaatttgtaaagtggaagaacaaagtcggagctggatttgtatctatgtaatggtacagcatatggagtcacctctcatgaccagtgtttgtgctgtggggggtcgtaccagcttctacataa

SEQ ID NO: 1286 - DNA, 1637 bp, Triticum aestivum
gtctctgtcccccttcccaactactcctccacctcgatcgagagaagctcggatccccggaggagaggagaggagaggagcccactttagctctcggttgcgccgcggctatggggagcctgcgaggcggaagcggcggagaagggaggaacgaggacggagggaaagtagggctaccggcgttggaggtggcgctcgcgttcccgcaggccacgccggcgtccctgttcccgcccgccgtgtcggactactaccagcttgatgatttgctgaccggtgaagagaaggcgcttaggaagaaagtccgtgctatttcagagaaagaaattgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattctagtgcactcctctttggcaatgtccacaattgccctttgtggatcagaggctcaaaagcagaagtacctaccatcgttagctcagtttaaaactgttggttgctgggctttaacagagccagattatggaagtgatgcaagctccttgaaaacttcagcaatcaaggtacctggcggttggcaattagatggccaaaagcgctggataggtaacagcacgtttgcagatgtgcttgtaattttggctaggaatgcagacacaaagcaactaaacggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggagctcccctggcagcctttcagctcaaccaagaaaagcttgttcggatgcttggtaacatccaggccatgctccttgtcggctggcgcttgtgcaagctctatgagtcaggcaaaatgacaccaggccatgctagtttgggcaaggcatggacgtccagcaagtcaagggaggtagtttctctgggccgagagctattgggcggcaatggaattttggctgattttctagtagcaaaggcgttctgcgatctggaaccgatttactcatatgagggcacctacgacatcaacagccttgtgaccggaagagaaatcaccgggatcgcgagcttcaaacctgctgcggtagcgaaatctcggctgtaattcttcttctgcctccagctatgatgaacagcaaagtatgacccccaccttgtattctggtgggtacgagtaagatcggaataagtgcaaccgaatgatcaaatgtaatctgtaaagcgaaagaataaagtcggagctggatttgtatctatgtaatggtacagcatatggagtctaacctctcatgaccagtgtttgtgctgtggggggtcg

SEQ ID NO: 1287 - DNA, 1886 bp, Brachypodium distachyon
aaatcaaattagaaagctcctcttcctcggtcgaagaagctcggatccccggaggagctgtcagcgtgacctcggttgcctcggtgatggggagcttgcgaggcagcgccggcggagaggggaggaacgaggacggagggaaggtcgggctgccggcgttggaggtggcgctcgcgttcccgcaggccacgccggcgtccctgttcccgccctccgtatcggactactaccagtttgatgatttgctgagcgatgaagagaagacacttcggaagaaagtacgcgctatttcagagaaagaaatcgcgcccattatgacagaatactgggagaaggcagaatttccatttcatgccattcccaaacttgcaactcttggcttagctggaagtacgacgaagggatatgggtgcccaggactctcacttacagctagtgctatttctatagcagaagttgcacgggtcgatgcaagctgctccacatttattctagtgcactcctctttggcgatgtccacgatcgccctttgtggatcggaagctcaaaaacagaagtacttgccatcgatggctcagcttaaaactgttggctgctgggctttaacagagccagattatggaagtgatgcaagctccttgaaaacttcagcaaccaaggtacctggtggttggcttctagatggtcaaaagcgctggattggtaacagcacatttgcagatgtgctcataattttagctaggaatgcagacacaaagcaactaaatggattcattgtgaagaagggggctcctggtttgaaagccacaaaaatccaaaacaaaattggactcagaatggtacagaatggcgatattcttctgaataaagtatttgtcccagaagaagacagattaacaggcatcgattcatttcaagatataagcaaggtcctcgcgatgtcgcgtattatggtggcatggcaaccaattggcatagcaatgggcgtctacgacatgtgccatcggtatttgaaagaaaggaagcagtttggagctccactggcagcctttcagctcaaccaagaaaagcttgttcggatgcttggtaacatccaggccatggttcttattggttggcgcctgtgcaagctttatgagtcagacaaaatgacaccaggccatgctagtttaggcaaggcatggacatccaccaaggcaagggaggtagtttctttaggtcgcgagctgttgggcggaaatggaattttggctgattttctggtagcaaaggcattttgcgatctggagccgatttacacatacgagggcacttatgatatcaacagcctggtgactggaagagaaatcactgggattgctagcttcaaacccgctgcgttggcgaaatctcggctttaataattgttattctccagctacaatgaataagtacaaccccaccttgtattctggtgggtaatatgggaacaagtgcaatagaattcaaaaggatcatgtgaaattgcatgatgaatggtagcatgttgggattaaaaaaaagatcatgttaaattacacggtgaatggtaaatatgtaaggccgggcctggatttgtttgtggtaaatagtacagcccatggaggtgtttgttttgtgggatcgtaccagcgtatgcataacgtactggtacgatttaggagcattcctcttatggtatactgtgagatactacaaagagtggaaactcaaatgcacccagtagctcacacggtggaaatactatgttttgaatgtcaaattctgtaaaaagtgcagaaatttctctatgtacctgcaaatgtttatggcaaggtcagttccgtaccgttgtacaaaacttatcctcgatgtgcctgtaaatgttc

SEQ ID NO: 1288 - DNA, 1901 bp, Avena sativa
gagaaagcttttcatctctccgtgttggtccgtctcctacttctccactgctccctcccccacctccatcggaagaagcagctcggatcctcggacgagcagcccgtgagccctaggttgcgccgcggctatgggtagcttgggaggcggcggcagcggcggcggagagggaagtagccaggccggagggaaggtcggactaccggctttggaagtctcgctcgcgttcccgcaggccacgccggcgtccctgttccctccctccgtgtcggactactaccagcttgatgatttactgaccgatgaagagaaggcgcttaggaagaaagttcgtgctatttcggagaaagaaattgcacccattatgacagagttctgggagaaggcagaattcccatatcatgccattcccaaacttgcaacccttggcttagccggaagcacaacgaagggatacggatgcccaggactctcaattacagctagtgctatctctatagctgaagttgcacgggtcgatgcaagctgctccacatttattctagtgcactcctctttggcaatgtccacaattgccctttgtggatcagaggctcaaaagcagaagtacttaccatctttagctcagttaaaaactgttggttgctgggctttaacagagccagattacggaagtgacgcaagctctttgaaaacttcagcaacaaaggtacccggcggttggcatttagatggccaaaagcgctggataggtaacagcacatttgcagatgtgctcataattttagctaggaatgcagacacaaagcaactaaatggattcattgtgaagaagggagctcctggtttgaaagccacaaaaattcaaaacaaaattggacttagaatggttcagaatggcgatattctgatgaataaagtatttgtcccagaagaagacaggctaacaggcatagattcatttcaggatataagcaaggtcctcgcaatgtcacgtattatggtggcatggcagccaattggcatatcgatgggtgtctacgacatgtgccatcggtatttgcaagaacggaagcagtttggagctccactggcagcctttcagctcaaccaagaaaagcttgttcggatgcttggtaacatccaggccatgcttcttgtcggctggcgtctgtgcaagctctatgagtctggcaaaatgacaccaggtcatgctagtctaggcaaggcatggatatcgagcaagtcaagggaggtagtttctctaggtcgggagctattgggaggcaatggaatattggctgattttctggtagcaaaggcattctgtgatctagaaccaattttcacgtatgagggtacctacgacatcaacgccctggtgactggtagagaaatcaccgggatcgcgagcttcaaacctgcagcgctggcgaaagctcggctttaatacttcccttcaagctacgatgaacaacaaatgtaacccccacggccccaccttgtgttctggtggatatgagtaagatcggaataagtgcagataagattggagctggagctggatctgtatgtaatgggtacagcgcatagagtcacctctcatgaccagtgtttgtgttgttggatcgtatcagcttataaataatggactggtacaatttagtataattttcctgtgttgacttgcctatgtgacgactgcagatcatgtgccatttcgaccagtgtttgtgtggttggatcgtatcagcttataaataatggaccggtacaatttagtgtagttttcctgtgttggcttgcctatgaggcgactgcagatcatgtgccattttgaccagtgtttgtgttgttggatcgtatcatcttataaataatggacttgtacaatttagtat

SEQ ID NO: 1289 - DNA, 1758 bp, Setaria italica
tcgtttcgtatcgtgtcgtgccgctcttcctcttcctcttcctcctctttccacctactgctccgtcttgatcgggagctcgccggatccacgaggggaagttcgcggggccctcgagcgcggcgcggggcggcgatgggaagcttgggaggtagcggtggcgccggggccggcagcaaggtcgggctgccggcgctggacgtggcgctcgcgttccctcaggcaacgccggcgtcgctcttcccgcccgccgtgtcggactactatcagtttgatgatttgcttactgatgaagagaaggcactcaggaagaaggtccgaggtattatggaaaaggaaatcgcacccattatgactgaatattgggagaaggcagaattcccatttcatgccattcccaaccttgcatctcttggcttagctggaggtacaataaaggggtatggttgcccaggattgtcgcttacagctagcgctatttcgatagcagaagttgcacgggttgatgcgagttgctccacatttattttagtacactcctctttggctatgtccacgattgctctttgtggatctgaggctcaaaagcagaaatacttaccatctcttgcgcagttcaaaactgttggttgttgggcattgacagaaccagattatggaagtgatgcaagctccttaaggactgcagcaaccaaggttcctggtggttggcatttagatggccaaaagcgctggataggtaacagcacttttgcagatgtgctcatcattttagctaggaatgcagatacaaaccaactaaacggatttattgtgaagaaaggagctcccggtctaaaagccacaaaaattgaaaacaaaattggactcagaatggttcaaaatggagacataattctaaataaagtatttgtccctgaggaagacagattaacaggtatcaattcatttcaggatataaacaaggttctcgctatgtctcgcattatggtggcgtggcaaccgataggcatatcaatgggagtttttgacatctgccatcggtatttgaaagaaaggaaacaatttggagccccgctggcggcctttcagctcaaccaagagaagcttgtccgaatgcttggcaacattcaggccatgcttctcattggctggcgactatgcaagctgtacgagtcaggcaaaatgacgccaggccatgctagtttaggaaaggcgtggacgtctaggaaggccagggaggtagtttctcttggccgagagctattgggtggcaatggcattttggctgattttctggttgccaaggcattctgtgatttggagccaatattttcttacgagggcacctatgacattaacagcctggtgacgggcagagagattactgggatcgcgagcttcaaacctgctgtggtaacgaaatcacgcttgtgaagttctcttcttttcctcttacagaggaagctacagtgaacacaatagacatccgccttgtatattctcatgattgggaataagagcaacagaagattattattatttgcatcgtcagttttttcagatggtgtatgtggtcattttcgtgttgcaaaatgctcctagctcggaataatgcctaacattcctgcgtagatgctgctgctatatcacaggcagaaaatatgtaattacggattgaattcctgatctaacagaatatttttttaagaattttcatatagtggtttcgatactatagtataaggcagaaaattc

SEQ ID NO: 1290 - DNA, 1748 bp, Panicum virgatum
cgtttcgtatcgtgtcgtgccgctcttctcgtcttccctcctcctcctactcttcctccacctactgctccggcttgatcggggagctcgccggatccgctagggggaatttcgcggggccctcgagcgcggcgatgggcagcttgggaggtagcggcggcgccggggccggcggcaaggtcgggcttccggcgctggatgtggcgctcgcgttccctcaggccacgccggcgtcgctcttcccgcccgccgtgtcggactattaccagtttgatgatttgctgactgatgaagagaaggcactcaggaagaaggtccgaggcattatggaaaaggaaattgcgcccgttatgactgaatactgggagaaggcagaattcccatttcatgccattcccaaccttgcaactcttggcttagctggtggtacaataaaggggtatgggtgcccaggactgtcacttacagctagtgctatttgcatagcagaagttgcacgtgtcgatgcgagctgctccacatttattttagtacactcctctttggctatgtccacgattgccctttgtggttcggaggctcaaaagcagaaatacttgccttcacttgcccagttcaagactgttggttgttgggcattgacagagccagattatggaagtgatgcaagctccttaaggactgcagcaaccaaggtacctggtggttggcatttggatggccaaaagcgttggataggtaacagcacttttgcagatgtgctcatcattttagctaggaatgcagatacaaaccaactaaacggatttattgtgaagaaaggagctcccggtctaaaagccacaaaaattgaaaacaaaattggactcagaatggttcaaaatggagacataattcttaataaagtatttgtccctgaggaagacagattaacaggtatcaattcatttcaggatataaacaaggttctcgctatgtctcgcattatggtggcatggcaaccgataggcatatcaatgggagtttttgacatgtgccataggtacttgaaagaaaggaaacaatttggggccccactggcagcttttcagctcaaccaagagaagcttgtacgaatgcttggcaacattcaggccatgcttcttattggctggcgactatgcaagttgtatgagtcgggcaaaatgacgccaggccatgctagtttaggcaaggcatggacgtccaggaaggcgagggaggtagtttctcttggccgggagctattgggcggcaatggcattttggctgattttctggttgccaaggcattctgtgatttggagccgattttttcgtacgagggcacgtatgacattaacagcttggtgacgggcagagagatcaccgggatcgctagcttcaaacctgctgtgttaacgaaatcacgcttgtgaaattctcctagttttctcttacagaggaagccacagtgaacatgatagacacgcatcttgtataaattctcatgacgggaataagagcaactgaagattatatcgattgcactgttagtttttctgatggtgcctgtggtcatttttcgttttgcgaaatgttcctagctcgaaataatgccatttgttcctaccatagatgccactgccacaagacaggtagaaaacatgtcattatggatcgaattcctgatgtaacataattttttttaagaatcctcatcctagtggttctaatactgtattataaga

SEQ ID NO: 1291 - DNA, 1845 bp, Panicum virgatum
tgccgctcttctcgtcttccctcttactcttcctccacctactgctccgtcttgatcggggagctcgccggatccgcgagggggaagttcgcgggggcctcgagcgcggtgatgggcagcttgggaggtaacgatggcgccggggccggcggcaaggtcgggcttccggcgctggacgtggcgctcgcgttccctcaggccacgccggcgtcgctcttcccgcccgccgtgtcggactactaccagtttgatgatttgctgactgatgaagagaaggcactcaggaagaaggtccgaggcattatggaaaaggaaattgcgcccattatgactgaatactgggagaaggcagaattcccatttcatgccattcccaaccttgcaactcttggcttagctggtggtacaacaaaggggtatgggtgcccaggactgtcacttacagctagtgctgtttgcatagcagaagttgcacgtgtcgatgcgagctgctccacatttattttagtacactcctctttggctatgtccacgattgccctttgtggatccgaggctcaaaagcagaaatacttgccatcactttcccagttcaagactgttggttgttgggcattgacagagccagattatggaagtgatgccagctccttaaggacggcagcaaccaaggtacctggtggttggcatttggatggccaaaagcgttggataggtaacagcacttttgcagatgtgctcatcattttagctagaaatgcagatacaaaccaactaaacggatttattgtaaagaaaggagctccgggtctaaaagccacaaaaattgaaaacaaaattggactcagaatggttcaaaatggagacataattcttaataaagtatttgtccctgagcaagacagattaacaggtattaattcatttcaggatataaacaaggttctcgctatgtctcgcattatggtagcctggcaaccgataggcatatcaatgggagtttttgacatgtgccatcggtatttgaaagaaaggaaacaatttggagccccactggcagcttttcagctcaaccaagagaagcttgtacgtatgcttggcaacattcaggccatgcttctcattggctggcgactatgcaagctgtacgagtcaggcaaaatgacaccaggccatgctagtttaggcaaggcatggacgtccaggaaggcaagggaggtagtttctcttggccgagagctattgggcggcaatggcattttggctgattttctggttgccaaggcattctgtgatttggagccgattttttcatacgagggcacgtatgacattaacagcctggtgacgggcagagagatcaccgggatcgctagcttcaaacctgctgtgttaacaaaatcacgcttgtgaaattctccatgttttctcttacagaggaagccaccgtgaacacaatagatgcccaccttgtataaagtctcatgactgggaaaaggagccacggaagattatattaattgcactgtcagtttttctgatggtgcccgtggtcattttaatttcgtcttgcaaattttcctagctcgaaataatgccatctgttcctacatagatgccactgctacatatatatggctggtagaaaatatatcattatggattgagttcctgatgtaacacacatttgtttttaagaatcttcatcctagtggttctagtactgtattataagacaaaaagatgtagctatatgcttataatcagataaaacaaaaggattaaggtaaaactgtggggatcgctcggagacggagctagaaataatgtaagtggtgataactc

SEQ ID NO: 1292 - DNA, 1853 bp, Sorghum bicolor
ctcctctgatactccacctactactcctctgatcggggaggggaggagctcgccggagccggatccacgagggggaagttaacgccatcgagcgctgcgatgggcagcttgggaggtagcgccggtgctggggacggcggcaaggtcgggctgccggcgctggacgtggcgctcgcgttcccgcaggctacgccggcatcgctcttcccgcccgccgcctcggactactaccaatttgatgatttgctgactgaagaagagaaggcactcaggaagaaggtccggggtatcatggaaaaggaaatcccgcccattatgacggagtattgggagaaggctgaattcccattccatgccattcccagccttgccagtctcggcttagctggtggaacaataaaggggtatgggtgcccaggactctcgcttacagctagtgctatttcgatagcagaagttgcacgggtcgatgcgagctgctccacatttattctagtgcactcctcgttggctatgtccacgattgccctttgtggatctgaggctcaaaagcagaaatacttgccatctcttgccgagttcaaaactattggttgttgggctttgacagagccagattatggaagtgatgcaagctccctaaggactgcagcaaccaaggtacctggtggttggcagttagatggacaaaaacgctggataggtaacagcacttttgcagatgtcctcgtcattttggctaggaatgcagatacgaaccaactaaatggatttattgtaaagaaaggagctcccggtctaaaagcgacaaaaattcaaaacaaaattggactcagaatggttcaaaatggagacataattctaaataaagtatttgtccctgaggaagacagattaacaggcatcaattcatttcaggatataaacaaggtcctcgctatgtctcgaattatggtggcatggcaaccaataggcatatcaatgggagtttttgacatctgccatcggtatttgaaagaaaggaagcaatttggagctccactggcagcttttcagctgaatcaagaaaagcttgtccgaatgcttggcaacattcaggctatgcttctcgttggctggcgtctgtgcaagctctatgagtcaggcaaaatgacaccaggccgatctagtttaggcaaggcgtggacatcccagaaggctagggaggtagtttctcttggacgagagctactgggtggcaatggcattttggctgattttcttgttgccaaggcgttttgtgacctggagcccattttctcttacgagggcacctatgacattaacagcctggtaactggcagagagatcaccgggatcgcgagcttcaagcctgctatgtcagcaaaatcacgcctgtgaagttgtttttttatttccccgaggaagatgatagacaccaatcttgtatatattccgatgattgggaataactgaataagaacgatggggaaactgtatttgttacattttcacttttgtcagtctgtgataaacgactctccactggccgtgttcaaatgctgcaatcaccagcgattttacaaaggacatggcccttttttttattacgcaggagaggtgcgtttcattgtattattgtagagatgaaaatagggggtcaccagcaggatcctcactggctcttgaaagcacgcttctcggcatccgtagatatactattagcttctggattcatggatcatggatgtatacctacgagtttttcatcgtaatcgtattcttgtaacagtactatgatactacggcatgtttagttgacgaagtgaaaaattttatgacactgtagcatt

SEQ ID NO: 1293 - DNA, 1635 bp, Saccharum officinarum
cgtagtacgtttcgtttcggatcgtgccgctctgccgtcgcctcgtcgcctctccctccgcttactccacctactgctaacagctccgttgatcgggcggcgagctcgccggaagccggcgccggatccacgaggggaagttaagcgccatcgaacgctgcgagcgatgggcagcttaggagggagcgccggtgccgggggggacggcggcaaggtcgggctgccggcgctggacgtggcgctcgcgttcccgcaggctacgcctgcttcgctcttcccgcccgccgcctcagactactaccaatttgatgatttgctgactgatgaagagaaggcactcaggaagaaggtccagggtattatggaaaaggaaatcccgcccattatgactgagtactgggagaaggctgagttcccattccatgccattcccagccttgccagtctcggcttagctggtggtacaataaaggggtatgggtgcccaggactctctcttacagctagtgctatttcgatagcagaagttgcacgggtcgatgcgagctgctccacatttattctagtgcactcctcgttggctatgtccacgattgccctttgtggatctgaggctcaaaagcagaaatacttgccatctcttgccgagttcaaaactattggttgttgggcattgacagagccagattatggaagtgatgcaagctcccttaggactgcagcaaccaaggtacctggtggttggcagttagatggacaaaaacgctggataggtaacagcacttttgcagatgtcctcatcattttggctaggaatgcagatacgaaccaactaaatggatttattgtaaagaaaggagctcccggtctaaaagcgacaaaaattcaaaacaaaattggactcagaatggttcaaaatggagacataattctaaacaaagtatttgtccctgaggaagacagattaacaggcatcaattcatttcaggatataaacaaggtcctcgctatgtctcgaattatggtggcatggcaaccaataggcatatcaatgggagtttttgacatctgccatcggtatttgaaagaaagaaagcaatttggagctccactggcagcttttcagctcaatcaggaaaagcttgtccgaatgcttggcaacattcaggctatgcttctcgttggctggcgactgtgcaagctgtatgagtcaggcaaaatgacaccaggccgatctagtttaggcaaggcgtggacatccaagaaggccagggaggtggtttctcttggccgagagctactgggtggcaatggcattttggctgattttctcgtcgccaaggcattttgtgacctggagcccattttctcgtacgagggcacctatgacataaacagcctggtgactggcagagagatcaccgggatcgcgagcttcaagcctgctgtgtcagcaaaatcacgcctgtgaagttgttttgtgttatttccccgaggaagacgatagacatcaaccttgtacattctgatgattgagaataactgaataaaaacgatgggggaaacagtcttagttgcattgtcactttgtctatgtgataaacgactctccagtggcggccgtgttcatttttc

SEQ ID NO: 1294 - DNA, 1674 bp, Triticum aestivum
gtctctgtcccccttcccaactactcctccacctcgatcgagagaagctcggatccccggaggagagcagaggagaggagcccactttagctctcggttgcgccgcggcgatggggagcctacgaggcggaagcggcggagaagggaggaacgaggacggagggaaagtagggctaccggcgttggaggtggcgctcgcgttcccgcaggccacgccggcgtccctgttcccgcccgccgtgtcggactactaccagcttgatgatttgctgaccgatgaagagaaggcgcttaggaagaaagtccgtgctatttcagagaaagaaatcgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattctagtgcactcctctttggcaatgtccacaattgctctttgtggatcagaggctcaaaagcagaagtacttaccatcgttagctcagtttaaaactgttggttgctgggctttaacagagccagattatggaagtgatgcaagctccttgaaaacttcagcaatcaaggtacctggcggttggcaattagatggccaaaagcgctggataggtaacagcacgtttgcagatgtgcttgtaattttggctaggaatgcagacacaaagcaactaaacggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggagctcccctggcagcctttcagctcaaccaagaaaagcttgttcggatgcttggtaacatccaggccatgctccttgtcggctggcgcttgtgcaagctctatgagtcaggcaaaatgacaccaggccatgctagtttgggcaaggcatggacgtccagcaagtcaagggaggtagtttctctgggccgagagctattgggcggcaatggaattttggctgattttctagtagcaaaggcgttctgcgatctggaaccgatttactcatatgagggcacctatgacatcaacagccttgtgaccggaagagaaatcaccgggatcgcgagcttcaaacctgctgcggtagcgaaatctcggctgtaattcttcttctgcctccagctatgatgaacagcaaagtatgacccccaccttgtattctggtgggtacgagtaagatcggaataagtgcaaccgaatgatcaaatgtaatttgtaaagtggaagaacaaagtcggagctggatttgtatctatgtaatggtacagcatatggagtcacctctcatgaccagtgtttgtgctgtggggggtcgtaccagcttctacataatggaactgtgcagtttaggaga

SEQ ID NO: 1295 - DNA, 1657 bp, Brachypodium distachyon
actcactgtctaaaatgaactaggaaactccccctcttcctcgatcgaaggagctcggggtccccggaggagcggtcggcgagctagccctcggttgcctcggagatggggagcttgcgaggcagcgccgccggagaggggaggagcgaggatggagggaaggtcgggctgccggcgttggacgtggcgctcgcattcccgcaggccactccggcgtccctgctgttcccgcccgctgtatcagactactaccagattgatgatttgctgaccgatgaagagaaggcacttcggaagaaagtccgtgctatttcagagaaagaaatcgcgccaattatgacagaatactgggagaaggcagaatttccatttcatgccattccgaaacttgcaactcttggcttagttggaagtacaatgaagggatatgggtgcccaggactctcacttacagccagtgctgtttctatagcagaagtttcacgggtcgatgcaagctgctccgcatttattctagtgcactcctctttggcgatgtccacaatcgccctttgtggctcagaggctcaaaaacagaagtacttaccgtcgatggctcagcttaaaactgttggttgctgggctttaacagaaccagattacggaagcgatgcaagctccttgaaaacttcagcaaccaaggtacctggtggttggcatttagatggtcaaaagcgctggattggtaacagcacgtttgcagatgtgctcataattttagctaggaatgctgacacaaagcaactaaatggatttattgtgaagaaaggggctcctggtttgaaagccacaaaaatccaaaacaaaattggtctccgaatggtacagaatggcgatattcttctgaataaagtatttgtcccggacgaagacagattaacaggcatcgattcatttcaagatataaacaaggtccttgggatgtcacgtgttatggtgacatggcaaccaattggcgtagcaatgggggtctacgacatgtgccatcggtatttgggagaaaggaagcagtttggagctccactggcagcctttcagctcaaccaagaaaagcttgttcggatgcttggtgacatccaggccatggttcttgttggctggcgcctatgcaagctttacgagtcgggcaaaatgacaccaggccatgctagtttaggcaaggcatggacatccaccaaggcaagggaggtagcttccgtaggtcgcgagctattgggtggcaatggaattttggctgattttctggtagcaaaggccttctgcgatctggagccgattttcacgtacgagggcacctatgatattaacagcctggtgactggaagagaaatcactgggactgctagcttcaaacccgctgttttggtgaaatcccggctctaataattcttattgttatcccggtacagtgaacaacaaagcacatcctcaccatgtattctggtgggtaagatgggaataagtgcagtacagtgaaaaaagaacgtgtgaacttgcttgttcaatggtagcatgctggaccttgattcttagaaaatcatttgaaattgcatggtgagtggcgaatataaggttgggtctggatttttaattcattgaaatagttttaacggatttg

SEQ ID NO: 1296 - DNA, 1864 bp, Zea mays
cgtcttcgttttgtttcgtttcgtatcggatcgtgccgctcttcccttctcgtctagtcttgtctttctttcctcctctgttactccacctacagacctactactgccatcgggagggtaagctcttcggagccggagccgggtccacgttaacgccatcgagtgctgcgatgggcagcttaggagggagcgccggtgctggggacggcggcaaggtcgggctgccggcgcttgacgtgacgctcgcgttcccgcaggccacgcccgcatcgctcttcccgccagccgtttcggactactaccaatttgatgatttgctgactgatgaagagaaggcactcaggaagaaggtccgaggtatcatggaaaaggaaatcgcgcccattatgactgagtactgggagaaggctgaattcccattccatgccattcccagccttgccagtcttggtttagctggtggtacaataaaggggtatgggtgccctggactctcgcttacagctagtgctatttcgatagcagaggttgcacgggtcgatgcgagctgctccacatttattctagtgcactcctcgttggctatgtccactattgccctttgtggatctgaggctcaaaagcagaaatacttaccatctcttacccagttcaaaactattggttgctgggcattgacagagccagattatggaagtgatgcaagctccctaaggactgcagcaaccaaggtacctggtggttggcatttagatggacaaaaacgctggataggtaacagcacttttgcagatgtcctcatcattttggctaggaatgcagatacaaaccaactaaatggatttattgtaaagaaaggagctcctggtctaaaagccacaaaaattgaaaataaaattggactcagaatggttcaaaatggagacataattctaaataaagtatttgtccctgaggaagacagattaacaggcatcaattcatttcaggatataaacaaggtcctcgctatgtctcgaattatggtggcatggcaaccaataggcatatcaatgggagtttatgacatctgccatcggtatttgaaagaaagaaagcaatttggagctccactggcagcttttcagctcaatcaagaaaagcttgtccgcatgcttggcaacattcaggctatgcttctcgttggatggcgactgtgcaagctgtatgagtcaggcaaaatgacaccaggccggtctagtttaggcaaggcatggacgtccaagaaggccagggaggtggtttctcttgggcgagagctactgggtggcaatggcattttggttgattttcttgtcgccaaggcattttgtgacgtggaacccattttctcgtacgagggcacctatgacattaatagcctggtggctggcagagagatcaccgggatcgcgagcttcaagcctgctgtgtcagcaaaatcacgcctgtgaaagttgtttttttctttgttcccgaagacagtagaaatcaaccttatacattcagatgattgggaataagaacggtaggaaagctgtaaaactcgacgtgcttcctcgtatgtactgttctgtttcaaattattcgacgttttgtcggaacggaacggaagacctgtatggctgtatatgatactcatcctatatatcacgcagcttttgaagattttgtaaaaaagttattgttgggattttgattctaagaagccaacgataacatttcgatggtggtgttagctttctgaacccagaaagctataaaaatccacgaaaccagatttttcagttttcgatataaactcagcttttttgagcttctaacttttcggacgctaaacaaaaaa

SEQ ID NO: 1297 - DNA, 1636 bp, Pennisetum glaucum
gtgccgctcttcctcatcttactcttccacctactgctccgtgttgatcaggagctcgccggatcctcgaggggaagttcgcgggggacgtcgagcgcggcgatgggaagcttgggaggtggaggtggtgccggggccggcggcaaggtcgggcttccggcgctggacgtggcgctcgcgttccctcaggccacgcctgcgtcgcttttcccgcccgccgtgtcggactattatcagtttgatgatttgcttactgatgaggagaaggcactcaggaagaaggtccgaggtattatggaaaaggaaatcgcacccattacgactgaatactgggagaaggcagaattcccatttcatgccattcccaaccttgcatctcttggcttagctggaggcactataaaggggtatggctgcccaggactgtcgattacagctagtgctatttcgatagcagaagttgcacgggtcgatgcaagttgctccacatttattttagtacactcttctttggctatgtccacgatcgccctttgtggatctgaggctcaaaagcagaaatacttaccatctctttcgcagttcaaaactgttggttgttgggcattgacagaaccagattatggaagtgatgcaagctccttaagaactgcagcaaccaaggtacctggtggttggcatttagatggccaaaagcgctggataggtaacagcacttttgctgatgtgctcatcattttagctaggaatgcagatacaaaccaactaaacggatttattgtgaagaaaggagctcctggtctaaaagccacaaaaattgaaaacaaaattggactccgaatggttcaaaatggagacataattctaaataaagtatttgtctctgaggaagacagattaacaggcatcaattcatttcaggatataaacaaggttctcgctatgtctcgcattatggtggcatggcaaccaataggcatatcaatgggagtttttgacatctgccatcggtatttgaaagaaaggaaacaatttggagccccgttggcggcctttcaactcaaccaagagaagcttgtccgaatgcttggcaacattcaggccatgcttctcattggctggcgactatgcaaactgtacgagacaagcaaaatgacgccaggccatgctagtttaggaaaggcgtggacgtctaggaaggccagggaggtagtttctcttggccgagaactattgggtggcaatggcattttggctgattttctggttgccaaggcattctgtgatttggagccaatattttcatacgagggcacctatgacatcaacagcctggtgacgggcagagaaatcaccgggatcgcgagcttcaaacctgctgtgttaacgaaatcacgcctgtgaagatctcttcttttcctcttgcagaggaagctaaagttaacacaatagacatccaccttgtatattctcatgattgggaataagagcaacaggagattattattatttgcatcgtcagtttttcagatggtgtatggtcattttcttcatgcggaacgttcctagctcggaataatgccccatacattcctacgtagatgccacagctacatcacaagcagaaaatatgtta

SEQ ID NO: 1298 - DNA, 1570 bp, Oryza sativa
acgtgagaagagctcaaatcctccaaactttttttcctcctccatatccatcgatcgatctcgccatcgtcctcgagcgagcgggcggctgcggcgagctcgatccgatccccgccggcggagatggggagcttggcaggcggcggcggaggcggcaaggtggggctgccggcgttggacgtcgcgctcgcgttcccgcaggccacgacggcgtcccagttcccacccgccgtatcggattactaccagtttgatgatttgcttactgatgaagagaagacacttaggaagaaagtccgtggtattatggagagagaaattgcacccattatgacagagtactgggagaaagcagaatttcccttccatgccattcccaaacttgcaactcttggcttggcaggagggacaacaaagggatatggttgcccaggactctcacttacagctagtgctatttctgttgcagaagttgcacgggtggatgccagctgctccacatttattttagtacattcctctttggcaatgagcacaattgcactttgtggatcagaggctcaaaagcagaagtacttaccatcattaacgcagtttagaacaattggttgctgggcattgacagagccagattatggaagtgatgcaagttcattaaggactgcagcgaccaaggtgcctggcggttggcatttggatggccaaaagcgttggataggcaacggcacttttgcagatgtgctcatcatcttagctagaaattcagatacaaatcaactaaatggatttattgtcaagaaaggagctcctggtttgaaatgtacaaaaattgaaaataaaattggactcagaatggttcagaatgccgacattgttctgaataaagtatttgtccctgacgaagatagattaactggaatcaattcatttcaagacataaacaaggtccttgctatgtcgcgcattatggtggcatggcagccaattgggatatccatgggggtcttcgacatgtgtcatcggtatttgaaagaaagaaagcaatttggagttccgttggcagcttttcagctcaaccaagaaaagcttgttcgcatgctaggaaacatccaagccatgcttcttgtcggctggcgcctgtgcaagctgtatgaatcaggcaaaatgacaccaggccatgctagtttaggcaaggcatggacatccaagaaggctagggaggtggtttctcttggccgtgagctactgggtggaaacggaattttggctgactttctggtagcaaaggcgttctgtgatctggagccaatcttctcgtacgaaggcacctatgacatcaacagcttggtgaccggaagagagatcaccggaatcgccagcttcaaacctgctgcattgacaaaatctcgtctttaattttttttcctttcaaatgtatatagctgcaatagacaaaataatatacgtccaccctatattttgatgaaagcaaatgggcaataaaaggaatagaaaaaccatatttgttcttgaaaagaaaataaaagctctgatatgcttcgttttgcta

SEQ ID NO: 1299 - DNA, 1539 bp, Setaria italica
cggggctggcgccaaggtcgggctgccggcgctagacgtgacgctcgcgttcccccaggccacgccggcgtccctcttcccgcccgctgtgtcggactactaccagtttgatgatttgctgactgatgaagacaaggcactcaggaagaaggtccgaggtattatggaaaaggaaatcgcacccattatgcctgaatactgggagaaggcggaattcccatttcatgccattcctaaacttgcaactcttggcctagctggaggtacaacaaagggatatgggtgcccaggactatcacttacagctagtgctatttcaacagcagaagttgcacgggtcgatgcaagctgctccacgtttattctagtgcatgcctctcttgtaatgcccacgattgatctttgtgggtcagaggttcaaaagcagaagtacttaccatctcttgctgagtttaaaactctcggttgttgggcattgacagaaccagattatggaagtgatgcaagctccttaaggactgcagcaaccaaggtacctggtggttggcatttagatggtcaaaagcggtggataggtaacagcacttttgcagatatgctcatcattttagcgaggaatgcagatacaaaccaactaaatggatttattgtaaagaaaggagctcccggtctgaaagccacaaaaattgaaaacaaaattggactgagaatggtacaaaatggagacatagttctaaataaagtatttgtccctgaggaagacagattacctggcatcaattcatttaaggatataaacaaggtgtttgccatgtctcgcgttatggtggcatggcagccaataggcatatcaatgggagtttttgacatgtgccataggtatttgaaagaaaggaagcaatttggagctccgctggctgcttttcagctcaaccaagaaaagcttgttcgaatgctcggcaacattcaggccatggttctcgttggctggagactgtgcaagctctacgagtcaggcaaaatgacatcaggtcatagtagtttaggcaaggcatggacatccaggaaggccagggaggtagtttctcttggacgagagctattgggtggcaacggcattttggctgattttctagtcgcaaaggcgttctgtgatcttgagccgattttctcgtacgagggcacctatgacataaacagcctggtgaccggcagagagatcactggggtggcgagcttcaagcctgccatgttagcgaaatcacgcctctgaagttattttcccgtttcccttgagttgatgtgttaagtagtggctggaactgcaataggatggtttgtgtgcttgaatgcctgcaaactttggctgaatgcccaattggtgctgtaaacggtttgtgtcatttgtgtccgttgcgatgcccaatttgtgatttgtagccccaaagtgtaggaatacgagaagcaaaagagtgatgttgatatttaagtgtcagtttctcagctaacgttcattggagtagtcatttttaccttgcg

SEQ ID NO: 1300 - DNA, 1735 bp, Saccharum officinarum
tcctccggaactccaaaaccctcgcgcaggactccgctgacccttcctccacgccgctgggatggcggggaagcgagttacgggcggcgttgggcgggacgaggacggcgccaaggtcgggctcccgtcgttggacctctccctcgcgttcccgcaggccacgccggcctccattttcccgccgtccgcttcggattactaccagtttgatgatttgctgaccagtgaagagcgctctatcaggaagaaggtcaggagtattgtggagaaagaaattgcgcccattatggcagagtactgggaaaaggcagagtttccatttcatgccattcctaaacttgcaagccttggtgttgctggtggtacaataaagggttatgggtgcccaggactttcaattacagccagtgctgttactatggcagaaatggcacgggtagatgcaagctgctccacatttatactggtgcactcctctcttgcgatggtgacaatagctctttgtggatctgaggctcagaagcagaagtacttgccatcccttgctcaacttactactgttggctgttgggcattgacagagccaaattatggaagtgatgcaagctctttgagaactacagcaaccaaggcacctggtgggtggcacatagatggtcaaaaacgctggatcggtaacagtacgttcgccgatgtgctcgtggtattagctaggaatgcagatacacaacaactaaatgggtttattgtgaggaaaggagctcctggtctgaaagctacaaagattgagaacaaaattggtctcaggatggttcaaaacggtgatatagtatttaataaggtgtttgtccctgaggaagaccgattgccaggcatcacctcgtttcaggatatcagcaaggtccttgctatttcgcgcattatggtggcatggcaaccaattggcatttcgatgggggtcttcgatatgtgccaccggtacctgaaagagaggaaacagtttggagtccctctagcatccttccagctgaaccaagagaaacttgtccggatgctcggtaacgtccaatcgatgctccttgttggctggcgcatctgcaagctttacgagtcggggaaaatgacgccaggccacgctagcctagggaaggcttggaactccaggatggcccgcgaggtggtttcccttggccgagagctgctgggtgggaacggaattttggccgatttccttgtggcaaaggcgttctgcgacctggagccaatttactcgtacgaaggcacatacgacatcaacagcctggtgaccggcagagagatcaccgggatcgcgagcttcaagcccgccgcgctagccaaagcccggttgtaatgtactgtacaagaacaacgtaaaatacctttcagttgcagcagggatatgttgatgaaaggtaccctccctagtccgcatgttgcaaagcattggaagaagcgaataaatcagggatcaggtcgccgtcgtcacgttgcggtggctggctagaacaaaccgaggacgttcgttccttgaacgtgcctggaaactgccggtcaatgttggctgcttcatgatgtgtactattgtaccgagtgagtttgatgggaacaaattctatatatatgtatgtaaatttactactcctctgtggacggaggcacaagagacgcacaagatatttgtttcacacgataaactgaactaattcctgattcg

SEQ ID NO: 1301 - DNA, 1284 bp, Festuca arundinacea
  misc_feature (133)..(133): n is a, c, g, or t
  misc_feature (401)..(401): n is a, c, g, or t
  misc_feature (406)..(406): n is a, c, g, or t
  misc_feature (583)..(583): n is a, c, g, or t
  misc_feature (955)..(955): n is a, c, g, or t
  misc_feature (1278)..(1278): n is a, c, g, or t
ggcacgaggccttcttctccactactactactccacctcgatcggaagaagctgctcgggtccccggacgagcagcccgcgagccctcggttgcgccgcggatatggggagcttgcgaggcggcggcggtggngcagagggaaagagcgagggcggagggaaggtggggctaccggctctggaagtctcgctcgcgttcccgcaggccacgccggcgtccctgttccctcctgccgtgtcggactactaccagtttgatgatttactcaccgatgaagagaaggcgcttaggaagaaagtccgcgctatttcagagaaagaaatcgcacccattatgaccgaatactgggagaaggcagaattcccatttcatgccattcccaaacttgcaactcttggcntagcnggaagtaccactaagggatatggatgcccaggactctcaattacagctagtgctatttctatagcagaagtagcacgagtcgatgcaagttgctccacatttattctagtgcactcctctttggcaatgtccacaattgccctttgtggatcagaggctcaaaagcagaagtacttnccatcgttagctcaacttaaaactgttggttgctgggctttaacagagccagattacggtagtgatgctagcgccttgaaaacttcagcaaccaaggtacctggcggttggcaattagatggccaaaagcgctggataggtaacagcacgtttgcagatgtgctcgtaattttagctaggaatgcagacacaaagcaactaaatggattcattgtgaagaagggagctcctggtttgaaggccacgaaaattcaaaacaaaattggactcagaatggttcagaatggcgatattcttctgaataaagtatttgtcccagaagaagacagattaacaggcatcaattcatttcaggatataagcaaggtcctngcaatgtcacgtattatggtggcatggcagccaattggcatatcgatgggcgtctacgacatgtgccatcggtatttgcaagaaaggaagcagtttggcgctcccctggcagcctttcagctcaaccaagaaaagcttgttcggatgctcggtaacatccaagcaatggttcttgtcggctggcgcctgtgcaagctctatgagtctggcaaaatgacaccaggccatgctagtctaggcaaggcatggatatcgagcaagtcaagggaggtagtttctctaggtcgggagctattgggtggcaatggtatcttggctgattntctggt

SEQ ID NO: 1302 - DNA, 2001 bp, Oryza sativa
caagcgagagagtcggagatatcactactactactcctctttcccactcctctcgcttccttcctcctcctcccctgcttcgccgccgcgtgctcctccgccgccgccggagaagctccaagcctcctcctcctccgggccgccgggaatggcggggaagcaaggagatgggcgcgaggaggatggcgctaaggtcggcctcccggcgctggatatctcgctcgcgtttccgcaggccacgccggcatccatcttcccgccatcagcatcggactattatcagattgatgatttactcaccactgaagagcagtctatcaggaagaatgtcagggctataatggagaaagaaattgcacccattatggcaacgtactgggagaaagcagagttcccatttcatgccattcctaaactttcaagcctcggtgtagctggaggcacaataaagggatatgggtgcccaggactttcaataacagcaagtgctattactatggcagaaattgcacgggtagatgcaagctgctccacgttcattctagtacactcctcccttgcaatggtcacaatagctctttgtggatctgaggttcagaagcagaagtacttgccatcccttgctcaacttactgctgttggttgctgggcattgacagaaccaaatcatggaagcgatgcaagctctttgataactacagcaaccaaggtacctggtgggtggcacatagatggacaaaaacgctggattggtaacagtacttttgctgatgtgctcgtggtattagctaggaatgccaatacaaaacaactaaatggatttattgtgaggaagggtgctcctggcttgaaagctacaaagattgagaacaaaattggtctcagaatggttcagaacggtgatatagtttttaataaagtatttgtccctgaggaagatcgactgccaggtgtcaattcatttcaggatataagcaaggtccttgctatttcacgtgtcatggtggcatggcaaccgattggtatatcaatgggggtgtttgatgtctgccatcggtatctgaaagaaaggaaacagtttggagttcctctagtagcttttcagctgaaccaagaaaaacttgtgcgaatgcttggtaacatccaagcgatgcttcttgttggctggcgactatgcaagctttatgagtcagggaaaatgacaccagggcatgctagtttagggaagggttggacttccagaatggctcgtgaggtggtttctctcggtcgagaattgttgggtggaaatggaattttggctgattttctagttgcaaaggcattctgtgacctggagcctatatactcatacgaaggcacatacgacatcaacagcctggtgactggtagagaaataactgggatcgcaagcttcaaacctgccgcattagcaaaagctcggttataaccatcattttccgaagaggataaagctacagctcactgcaatttcttctcagattgctactacaggaagcaaataaaaatcaggtccccatgcaccgattattggccggctaatgcagcatgatgcagaccaaatagactccttggaaaattctctggtcaatcttggctggctagaaggctgtgccgtgcgagaggatatctaacgtatccgaatcacctcgttggaatcgtgtccggtggtggaggacagcatgaataaaagctccgtcctgtatgccaagtcttggcatttaactgttgtatacatttgtgaacgctgtaaaatctgaataaaggtcaagaacagtagtgtcgaattttacctctttcaaacctacactgcctgttcttgttttggtttgtttcaagcatgggtccagagaataattgtcctttctcgattgtttgccttactctgtcagtaaattttctgactttagacaggaaacttctgtatatctagcatgcgcactgctacacgtgcttaaaagattcaagacaacttttacg

SEQ ID NO: 1303 - DNA, 1850 bp, Sorghum bicolor
ccgccggcctctctcgcttcctcctccggaactcgaaaaccctcgcctcgtgcaggactccgctgacgcttcctccgcgccgctgggatggccgagaagcgagttacgggcggcgataggcgggaggaggaccgcgccaaggtcgggctcccggcgttggacctctcactcgcgttcccgcaggccacgccggcctccattttcccgccgtccgcttcggattactatcagtttgatgatttgctgaccagtgaagagcgctccatcaggaagaaggtcaggggtattgtggagaaagaaattgcgcccattatggcagcgtactgggaaaaggcagagtttccatttgatgccattcctaaacttgcaagccttggtgttgctggtggtacaataaagggttatgggtgcccaggactttcaattacagccagtgctgttactatggcagaaatggcacgggtagatgcaagctgttccacatttatactggtgcactcctctcttgcgatggtgacaatagccctttgtggatctgaggcacagaagcagaagtacttgccatcccttgctcaacttactaccgttggctgttgggcattgacagagccaaattatggaagtgatgcaagctctttgagaactacagcgagcaaggcacctggtgggtggcacatagatggtcaaaaacgctggatcggtaacagtacgttcgccgatgtgctcgtggtattagctaggaatgcagatacacaacaactaaatgggttcattgtgaggaaaggagctcctggtctgaaagctacaaagattgagaacaaaatcggtctcaggatggttcaaaacggtgatatagtatttaataaggtgtttgtccctgaggaagaccgattgccaggcatcacctcatttaaggatatcagcaaggtgcttgctatttcgcgcattatggtggcatggcaaccaatcggcatatcgatgggggtcttcgatatgtgccaccggtatctgaaagagaggaaacagtttggcgtccctctagcatccttccagctgaaccaagagaagcttgtccggatgctcggtaacatccaatcgatgctccttgttggctggcgcctctgcaagctttacgagtcggggaaaatgacgccaggccacgctagcctagggaaggcttggaactccaggatggcccgcgaggtggtttcccttggccgagagctgctgggtgggaacggaattttggctgatttccttgtggcaaaggcattctgtgacctggagccaatttactcgtacgaaggcacatacgacatcaacagcctggtgaccggcagagagatcaccgggatcgcgagcttcaagcccgccgccgcgctagccaaagcccggttgtaatgtactgtatactgtacaacgtaaaccacctttgcagttgcagcagggatattttgatgaaagttaccctcccccaatccgcatgttgcaaagtaaagcactggaagcgaatataaatcagggatgaggtcgccgtcgtcactgttgcggtggcggtagaacaaaccgaggacgttccctgaacgtgcctggaaaccgccggtcagtgttggctgcttcaagatgtactactattgtaccgagtgagtctgagtctggatgggaacaaattcctgtatatgtaaattttactcttctggtggaggcggcaaaagagcacagagatattttgtttcagcacgactgaagctaatcttgctgtattcgccgtttttgctacagatggaaggagagaggagaggagggggaacaccaggcaaaattggtgtgtttattgttgttgtgttggg

SEQ ID NO: 1304 - DNA, 1483 bp, Pennisetum glaucum
ggcggcggcggggatggcgccaaggtccggctgccggcgctggacgtggcgctcgcgttcccgcaggccacgccggcatccctcttcccgcccgctgtgtcagactactaccagtttgatgatttgctgactgatgaaaataaggcactcaggaagaaggtccgaggtattatggaagaggaaatcgcacccattatgactgaatactgggagaaggcggaattcccatttcattacattcctaaacttgcaactcttggcctagctggaggtacaacaaagggatacggatgcccaggactatcacttacagctattgctatttcaacagcagaagttgcacgggtcgatgcaagctgctccacatttattctagtgcatgcctctcttgtaatgcccacgattgatctttgtgggtcagaggctcaaaagcagaagtacctaccatctcttgctcagtttaaatctctcggttgttgggcgttgacagagccagataatggaagtgacgcaagcttcttaatgaccacagcaaccaaggtacctggtggttggcatttagatggtcaaaagcgttggataggtaacagcacttttgcagatatgttcatcattttagcgaggaatgcagatacaaaccaactaaatggatttattgtaaagaaaggagctcccggtctgaaagccacaaaaattgaaaacaatattggactcagaatggtacagaatggagacatagttctaaatgaagtatttgtccctgaggaagacagattacctggcatcaattcatttaaggatataaacaaggtgtttgccatatctcgtgttacagggacatggcagctaataggcatatcaatgggagtttttgacatgtgccataggtatttaaaagaaaggaagcagtttggagctccgctggctgcttttcagctcaaccaagaaaagcttgtccgaatgctcggcaacattcaggccatggttctcgttggctggcgactgtgcaagctctacgagtcaggcaaaatgacatcaggtcatagtagttcaggcaaggcatggatatccaggatggccagggaggtagtttctcttggacgagagctgttgggtggcaacgggattttgaccgattttctggtcgcaaaggcgttctgtgatcttgagcctattttctcgtacgagggcacctatgacataaacagcctggtgaccggcagagagatcactggggtggcgagcttcaagcctgccatgttagcgaaatcacgcctctgaagttattttcccgttcaccttgagttgacgtgtcgagtagtggctggaatcaaggagagatcctcgtcctggtctgtgtgcctgaataaatgcctgtaaactttggctgaatgcccaactgatgctgtaaacggtttgtgtgtttgtgcccgttgcatagcaatgaaatgagactggggtgcaaccccaaacgcaaagtatg

SEQ ID NO: 1305 - DNA, 2091 bp, Zea mays
cttccgtgtaatgccttccaaagaatttgtttcctccaattttctgacgccgtaatcctgccaaccaaagagcactgcagtgccgatttctataggaacaaaattcctattctttccctacaaacttcctacattcagggtcctcctcgtgtgcccatcccatattcaagattacgtccgctgactcctcaggcctcccactgcgtgtggggccgagccagcttgctccatcaagccgagagcagtctcccactcttctttctcacctcgcatcgcactgcctcaatctctcgtctctattgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggggtattatggaaaaagaaattgctcccattatgtcagcgtactgggaaaaggcagagtttccatttaatgccattcctaaacttgcaagccttggtgttgctggtggtacaataaagggttatgggtgcccaggactttccattactgccagtgctgttactatgtcagaaattgcacgggtagatgcaagctgttccacatttatactggtgcactcctctcttgcgatggtgacaatagctctttgtggatccgaggctcagaagcagaagtacttgccatcccttgctcaacttactactgttggctgttgggctttgacagagccaaactatggaagtgatgcgagctccttgagaactatagcgaccaaggcacctggtgggtggcacatagatggtcaaaaacgctggatcggtaacagtactttcgccgatgtgctcgtcgtgttagccaggaatgcagacacacaacagctaaatgggttcattgtgcggaaaggagctcctggcctgaaagctacaaagatcgagaacaaaattggcctcaggatggttcagaacggtgacatagttttgaacaaggtgttcgtccctgacgaagaccggttgccaggcatcaactcgtttcaggacatcagcaaggtgctcgccatttcacgcattatggtggcatggcaaccggttggcatatcaatgggggtcttcgacatgtgccaccggtatctgaaagaaaggaagcagttcggagtccctctggcggcgtttcagctgaaccaagagaagctcgcccggatgctcggtaacgtccagtcgatggtcctcgtcggctggcgtctctgcaagctctacgagtcggggaaaatgacgccgggccacgctagcctagggaaggcttggaactccaggacggcccgcgaggtggtctcccttggccgagagctgctgggtgggaacgggattttggccgacttccttgtagccaaggcgttctgcgacctggagcccatctactcgtacgagggcacgtacgacatcaacagcctggtgaccggcagggaggtcaccgggatcgcgagcttcaggcccgccgcgccagcgaaagcccggctgtgacgtgataacctgtgtccccgtgttgcagggaactggaggcgaataaatcatgatcaggtcgtcgtcgtcgtcgccatcgaacaaactgagcacgttcctggaacccgcccggtcaacgttggctgctcacatggtgtaccgtagccgagtgcggatgggaacggattcctagatatatgtagtactatacgaagatatctgttgcgggtggattactgtaaaccgggtctaatctctgttgcggtgtttgccgtctttggtcagaaggtaaggggggaacgccaggcagatctggtgggtttggttgttgttgttgtcgtgttgggtgggtagcatgcgagtgtggaggcctcgaccaatgaataaaacatggtgccgtttgggcggtagtacgtacaca

SEQ ID NO: 1306 - DNA, 1878 bp, Aristolochia fimbriata
gcgtaggcaaacctcttttaagcgtctgtcctttgacttctttcagcgaaacagaaaacttcagagttcgcctgatcgcgtgcagttaaacttggcggtggaagatttcattggattgtatctatcgattgatttgcgtgccactttctctatatacctcccataacctccgctcttcttatcccgtctgcctttcccgtctgctcttcccgtctaagcatcgagtatggctgctttttcgtcgtctttaatccaaggtgggaattctaaggaacaagctaactcatctgttggtcttccagcattggatgtctccaaagcatttccccaagcaacaccagcatccaattttcctccagctgtttcagattattaccagtttgatgatttgttaaccccagaggagcaggcccttagaaagaaggttcaagtgatcatggagaaagaaatagctcctatcatgactgagtattgggagaaggcagagtttccatttcatgttattccaaagcttgcatcattgagaattgctggtgggactattaaggggtatgggtgtcctgggctgtccattactggaagtgctataacagtggcagaagtggctagagttgatgcaagttgctctacttttattttggttcattcatccttagcaatgctaacaatagcactatgcggctctgaggagcaaaagcagaaatacctgccttcattggcaaactttgatactgtcgcttgttggggtttaactgaacctgattgtggaagtgatgctagctctttgaggacaacagcaacaaaggtagacggtggatggttacttgatggtcagaagcggtggatagggaacagcacatttgctgatgttttggtcatttttgctcggaacacgacaacgaatcagattaatggatttattgtgaaaaagggcgctcctggtttaaaggcaactaaaatgcaaaacaaaattggcttaaggatggtccaaaatggtgatattctcttacagaaaacttttgtcccggatgaggacagactacctggtgtcaattcttttcaggacacaagcaaggttcttgctgtatcgcgtgttatggttgcatggcagccaattggcatctccatgggtgtgtttgacatgtgtcacagatatttgagagagaggaaacaatttggggcacctttagctgcctttcagcttaaccaagaaaagcttgttcgaatgttgggcaatatccaggcgatggttctagtgggttggcgtttgtgcaagttgtatgaatctcaaaaaatgactgcaggccatgccagcatgggcaagtcatggattacattgaaggctagggaaacagtttctctagggcgagagttacttggtggcaatggaattttggctgactttcttgtggcaaaggctttctgtgatttggagccaatttacacatatgaaggcacttacgatataaactccatggtgacgggaagagagctaactggaattgcaagtttcaaacctgctgtcttggcaaaacagagtcgcctataatcgacactctcggatggactttcctgttgatcctgtgaaggcagcagcctgcagggaggcctctttaaactctcactcaaatagaataagccgcataccatgttacatcgaattttacaatggcaagctacaataatgtcaccaagttttagttttagcttgtataataaatttataacaatatatcagtattattaatgccatattgtcttctccagctccttgaatgttttgtttatcaagctgctgaatttgagagcaaatttccctactgcgcctctgcttaagttcagctaaaataatgaagaactatataaggaataactata

SEQ ID NO: 1307 - DNA, 2895 bp, Triticum aestivum
gtcgtcacttcaagcaggagcgcgagaacgtctggaaggacaaccccaggcgccctcccgcctccgccggcgaaggaggcgaggggaacggctggcagccgttcgccacggagaacctggccttcgaggcctactacaaggggcagcaaattgttcctgaggaagagtgggatgccttcatgagcatgctccggaagccattgccagccgcttttaggattaatgcgagctctcagttttgtcaagacatttgttcacaattagaaaatgacttcaggaagtcgttagagactgaggtcaatgatgaccatgaaaaagaggctattcggcctttggcttggtaccctggcaatcttgcatggcatttgaacttctctcggatgcaactgaggagaaaccaggcgcttgagagtttccatgaattcttgaagcaagagaatgaagttggtaatattaccaggcaagaggctgtcagcatggtcccacctttgtttctgaatgtgcaacctgaccatcatattcttgacatgtgtgccgctccagggtctaaaactttccagttacttgagatgatccaccagtcaacaaagcctggagtgcttccaactgccatggtggtagctaatgatgttgacgtgcaaagatgcaaccttcttattcatcagacgaagagaatgtgcacagccaacctgatagtgacaaatcatgaagcccaaaattttcctggctgtagtcttgcaaagttctgtccagaagcatacatagacgagtccaagccgcagaggttggaatttgatcgtattctgtgtgatgtgccatgtagtggggatggaactgcccgtaaggctcctgatatgtggagaacatggaatatcggcatgggaaatggacttcatcgtctccaagtggaaatagctatgcgtggcattgggttacttaaagtgggcggaaggatggtctactcaacatgctcaatgaatcctgttgaaaatgaagctgttgttggtgagattctgcggagatgtggggattctgttgaactccttgatgtttctaatgagctacctgaattgatccgccgtcctggacttaaaacctggaaggtacgggatagagcgtcttggttgggcagtcataatgatgtacttcactacaggaagaatgcaatattgccaagtatgttcccctcgggtaaaggtaccacggacagctgtacggcgggtggcagtgttgaggtcaacataaatgcagtcgatgcagatatgaatgagtcaggggatatggtagagggaaaagaagaaacgaagatagcaaccaatgacagcaataacggtgacaatggcaagactgaagagataaaacaagatgaatctgagtctgttaaagtttcaaggggctcaaatgaaaaaacagattcagcctccatcgttacagagcattcaaatttaccgctacatcgttgcatgcgaattattcctcatgaccaaaacagtggagcattttttatagcagtccttcagaaactctctccgctgaatgagagtctggtggtagaagtgatgaaaggtgagcgcagtacctcgaaagacaaggctttgaaatgttcgaatggtcagggatcagatacggtgccggctgaagaaatttcagttcagcagccaggggttgatgacacccatgttcttgttgagcaacaaaacagagacatggatactgaaatttcaaaagataaaagttctgaggaagctaaggtggttgctggtgaggtgcaaaatgatcaagcgacaaggagagataaaagaaagacccagaaccaaggcagatggagaggggttgatcctgtgatatttttcaaagacgaagcgacaatcagaagcatagtgtctttctacggcatcaaggattcatttacccttgaaggccatcttgtgactaggaatcctgatactaatcatgttaaaagaatatactacgtctcaaaatcagttaaagaagttttggacctcaatttgaaagttggtgagcggctgaaaatcacttcacttggcttaaagatatttgaaaggcagtcgtcaaaggagggttcaccatgcacatttaggttgtcatccgagggattgcctctgctgcttccttacatcaccaaacagattctatatgcatctgcaatagactttcagcacctcttacaatacagaatcattaaattccctgattttgtggatgtaaaattcggtgagcaagcttcagctttgctacaaggttgctgtgtcgtaatattacgcgaagggcatgaggatctagagtccataggcatggatccctctgcaatcgccgttgtttgttggaaaggaaagaccaatctgtgcgtcatggtcactcccatggatgggagggagctgcttgaaaggatctcatttcgtttcgggctcaaaatcccaaaacttgatgatgggaagcctgacctgaagtgtgatgatggatcagatgagcagcccgatggtggcgccgagacggttgatccagattgtgtgcctgagagtaaagcatcagaagacatggatatctcagacgtcaaggacacggagtagctcggtttgacgccaatgcaaggaggcatgttatatctcgttacgatgatgcagcagagaccgctacttggcttacgagttgatgattactctaatgggagtgttgttgccatcccttggttcttcatgtagggattctatcctattgatttgccatgaaaaccacaccgcatacatggtgctagactgctacccgctgcccccctgtaacgttctaccagtttgtttttggtgtgatgttggcacacaactgtcaaacggaacttcgaacatgagtgccgacaattctaatttgtttgagaca

SEQ ID NO: 1308 - DNA, 3073 bp, Brachypodium distachyon
ggatgggaggcggcaggaagcgcgggcggtcgcagcgccgacacttcaagcaggggcgcgagaacgtctggaaggacaacccccagcgccctcccgccggcggcggcggcggagaccaaggcgccgcagggagcggcgaggggcgcgagggaaacgactcctggcagccgttctccaccgagaacccggccttcgaggcctactacaaggagcagcaaattgttcctgaggaagagtggaatgacttcatgagcatgctccggaagccattgccagccgcttttaggattaatgcgagctgtcaattttatcaagacatttgttcacagttagaaaatgacttcaggaagtcgttggagacggaggttagtgatgagcatgaaaaagatgctattcgtcctttgccttggtatcctggcaatcttgcatggcatttgaacttttctcgaatgcagctgaggagaaaccaggcacttgagagttttcatgaattcttgaagcaagagaatgaagttggcaatataactaggcaagaggctgtcagcatggtcccacctttgtttctgaacgtgcaacccgaccatcatatccttgacatgtgtgccgctccagggtctaaaactttccagctacttgagatgatccaccagtcaacaaagcctggagtgcttccaaatgccatggtggtagctaatgatgtcgatgtgcaaagatgcaatcttcttattcatcagacaaagagaatgtgcacagccaacctgatagtgacaaatcatgaagcccagaactttcctggctgcagtcttacaaagttttgtcccgaaacatatttagacgagtccaaaccgcagaggttggaatttgatcgtgtactgtgtgatgtgccatgtagtggtgatgggactgtccgtaaggctcctgatatgtggagaaagtggaatgctggtatggggaatggacttcatcgtctccaagttgaaatagctatgcgtggtattgctttgcttaaagtgggcggaaggatggtgtactcaacgtgttcaatgaatcctgttgaaaatgaagctgttgttgctgagatcctgcggagatgcggagattctgttgaactccttgatgtttctaatgagcttcctgaattggttcgccgtcctggacttagcacctggaaggttggtatatgtgtctctttatcatgcatatttcttgtttatggtatctcattttgcccatcaggtgtacgagatagagggtcttggttgggcactcatgaagatgtccttcactacaggaagaacgcgatatcaccaagtatgtttccctcaggtaaaggtagcacggataaccgtaaggttggtggcagtggggagctcaacatggatgtggccgatgcagacatggactcaggggatatggtagagaggaaagaagaatcaagaatagcgatcaatggcagcaataatggtgaaaccaacattgaagagataaaccaagttgaatctgagtccggtgaagttccaagggactctgaaaaaaaatcagattctacctccatctgtacagagcattcaaatttgccactacatcgttgcatgagaattgttcctcatgaccaaaacagtggagcattttttattgcagtccttcagaaactctctgttctcaatgagaaccaggtggtagaagtgatgaaaggtgagcacagtatcttgaaagacagggctgtgaaacctgtggatagtccaggctcagataaggtgccgtctgaagaaatcccagttcaccagcaaggggttgagggcagccatgtttcgggtaaacaacaaaacggagacatggatgcaatttcaaaagataaggcctctgaggaaggtagtgtaatcgttaatgagacacaaaatgatgaagcagcaacaagagataagaggaagacacagaatcaaggaagatggagaggggttgatcctgtgatatttttcagagatgaagcgacaatcacaagcatagtatctttctatggtatcaaggattcatttacccttgagggtcatcttgtgactagaaaccctgatactaatcatgttaaaagaatatattatgtgtcaaaatcagttcaagatgttttggagctcaatgtaaaagttggcgagcggctaaagattacctcacttggcctaaagatatttgaaagacagtcgtcaaaggacggttcaccatgcacattcaggttatcatctgagggattgcctctgctgcttccctacatcaccaaacagattctatatgcatctgcattggactttcagcatcttttgcagtacagaatcattaagtttccagattttgtggatgcaaaattcggtgaggaagcttcagctttgctaccaggttgctgtgtcgtcgtattacgtgaagggcatcagcacatagattcaatagccacggatccctctgcaatcgctattgtttgctggaaaggaaagaccaatttgtgtgtcatggtttctcccctggatggaaaggagctgcttgaaagggtttcattgcgctttgggctcaaagtccctaaagccgatgatagaaaaactaagctgaaggttgatggatcagacgagcagcttgattgtggtgctgagacggtagatccagaatgtaagcctgaaagcaaagcatcagacatggacatctcagatgttaaggaggtcgagtagcttggctcacacccttctagatcgcagattatatctggacgatccagcagagtcccactacttcactacctgtacgagttgatgattattctagtgattggggttgccatttttacctgctggcatttctaccggatttacatgccattaaacctactccgcatacatggtgctagttgcccccctgtaacgtgtcagtttgcttttctttgagaagatgtgatgtggggcacaacagtgtcgcgatgaactctgaacgcaagagctattaatttcttagacatcttgaactgatgtgtagccgtaattttttgcgacatctagatctgaagttggacgagtacggctgacttttcgtgcgt

SEQ ID NO: 1309 - DNA, 1409 bp, Triticum aestivum
ccgtcccctgcctgccaaccccaaatctcccctccctctgccgctctcgaaattccccgagcatcgaccatgtcggcctactgcggaaagtacaaggatgagctcatcaagaacgctgcctacattggcacccctggcaagggtatccttgctgccgacgagtccaccggcaccattggtaagcgctttgccagcatcaatgttgagaatgttgaggacaaccgtcgcgccctccgtgagctcctcttctgcacccctggagccctccagtacctcagcggtgtgatcctcttcgaggagaccttgtaccagagcaccaagggtggcaagcccttcgtcgacatcctcaaggagggcaacgtcctccctggcatcaaggtggacaagggtaccgtcgagctcgctggaaccaacggtgagaccaccacccagggctttgatgaccttggcaagcgctgcgccaagtactatgaggctggtgcccgctttgccaagtggcgtgccgtcctgaagattggccctaccgagccatcacagctttccatcaaccagaatgctcagggtctggctcgttatgccatcatctgccaggagaatggtctggtgcccattgtagagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgatgccaagaaggtagcccctgaggtcattgctgagtacaccgtccgcaccctccagaggaccgtccctgctgctgtccctgccattgtcttcctctccggtggacagagcgaggaggaggcgaccctgaacctgaacgccatgaacaagctccagaccaagaagccctggaacctgtccttctccttcgggcgtgccctccagcagagcaccctcaaggcctgggctggtaaggcggagaacgaggagaaggccaggaaggcgttcctggtgaggtgcaaggccaactctgaggccaccctcggcacctacaagggcgatgccaccctcggcgagggggcctctgagagcctccacgtcaaggactacaagtactgatctgccttcggtgtggtggcccgtttgggtgtcctgcttaccagtattattgtttggttttcagagtcttgatatatccttcggatatcgaacctagtatggaacttgtgctctcaaaatagcgtaggtagtttcgtttttagagtcgaataccctgttactcgggtgctgcgtatcgtaaattggaggggtggcttttgttctatggtcgtgtaattttgctgcttacaatggtaaaacctgttatatgctgagtacatgtc

SEQ ID NO: 1310 - DNA, 1382 bp, Triticum aestivum
gcctgccagcccccaaatctcccctccctctgtcgctctcgaatcttccccgagcatcgaccatgtcggcctactgcggaaagtacaaggatgagctcatcaagaacgctgcctacattggcacccctggcaagggtatccttgctgccgacgagtccaccggcaccatcggcaagcgcttcgccagcatcaacgttgagaatgttgaggacaaccgtcgcgccctccgtgagctcctcttctgcacccctggagccctccagtacctcagcggcgtgatcctcttcgaggagaccctgtaccagagcaccaagggtggcaagcccttcgtcgacatcctcaaggagggcaacgtcctccctggcatcaaggtggacaagggtaccgtcgagctcgctggaaccaacggtgagaccactacccagggctttgatgaccttggcaagcgctgtgccaagtactatgaggctggtgcccgctttgccaagtggcgtgctgtcctcaagattggcctcaccgagccatcacagctttccatcgaccagaatgctcagggtctggctcgttatgccatcatctgccaggagaatgggctggtgcccattgttgagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgacgccaagaaggtagcccctgaggtgattgctgagtacaccgtccgcaccctccagaggaccgtccctgctgccgtccctgccattgtcttcctctccggtggacagagtgaggaggaggcgaccctgaacctgaacgccatgaacaagctccagaccaagaagccctggaacctgtccttctccttcgggcgtgctctccagcagagcaccctcaaggcctgggctggcaaggcggagaacgaggagaaggccaggaaggcgttcctggtgaggtgcaaggccaactccgaggccaccctcggcacctacaagggcgatgccacccttggcgagggcgcctccgagagcctccacgtcaaggactacaagtactgatctaccttcggtgctgtggcacgtttgggtgtcctgcttaccagtattatcgtttggttttcagggtcctgatatatccttcggatatcgaacctagcatggaactttaccttaggtagttttgtttttggagttgaatgaatatcctgtttttggagtcgaataccgtgtaaccctgagtgctgcgtatagtaagttggtggtaaaacctgttatatgctgagtacacatgctttgagtttt

SEQ ID NO: 1311 - DNA, 1426 bp, Leymus cinereus x Leymus triticoides
ccgttgctgtcgccctcccctgcctgccaaccccaaatctccctctgccaacctcaaatctccccccaagcatcgaccatgtcggcctactgcggaaagtacaaggatgagctcatcaagaacgctgcctacattggcacccctggcaagggtatcctggctgcagacgagtccaccggcaccatcggcaagcgcttcgccagcatcaatgttgagaacgtcgaggacaaccgtcgtgccctccgtgagctcctcttctgcacccctggtgccctccagtacctcagcggtgtgatcctcttcgaggagaccctgtaccagagcaccaagggtggcaagcccttcgtcgacatcctcaaggagggcaacgtcctccccggcatcaaggtggacaagggtaccgtcgagctcgctggtaccaacggtgagaccaccacccagggctttgatgaccttggcaagcgctgcgccaagtactacgaggctggtgcccgcttcgccaagtggcgtgcagtcctcaagatcggcgccaccgagccatcacagctctccatcgaccagaacgctcagggtcttgctcgttatgccatcatctgccaggagaacggtctggtgcccattgttgagcctgagatccttgttgatggacctcatgacattgatcgctgtgcttacgtgacggagatcgtccttgctgcctgctacaaggctctcaatgaccagcatgtcctccttgagggcaccctcctgaagcccaacatggttacccctggttccgacgccaagaaggtggcccctgaggtgattgctgagtacaccgtccgcaccctccagaggaccgtccctgctgccgtccctgccattgtcttcctctcgggtggacagagcgaggaggaggcgacccagaacctgaacgccatgaacaagctccagaccaagaagccctggaacctgtccttctccttcgggcgtgccctccagcagagcaccctcaaggcctggtccggcaaggcagagaacgaggagaaggccaggaaggcgtttctggtgaggtgcaaggccaactccgaggccaccctcggcacctacaagggcgacgccaccctcggcgagggcgcctctgagagcctccacgtcaaggactacaagtactgatctaccttcggtgctgtggcccgtttgggcgtcccgcttaccagtatcattgtttggttttcagagtctgatatatctgcggatatcgaacctcgtttttaataatatggaactatcataccgtagtagtttcgtttttggagtcgataccctgtaaatcgggtgctgcgtatcgtaaattggagcagctgttttttgttttatggtcctgtaatcttgtaattttgctgcttacaatggtaaagttctatctatctatctggttattgca

SEQ ID NO: 1312 - DNA, 1441 bp, Triticum aestivum
gcacgaggcccatcacctgcctgccaactagccccaaatctcccctccctcccccgctctcgaatccccccgagcatcgaccatgtcggcctactgcggaaagtacaaggatgagctcatcaagaacgctgcctacattggcacccccggcaagggtatccttgctgccgacgagtccaccggcaccatcggcaagcgctttgccagcatcaatgttgagaatgttgaggacaaccgccgtgccctccgtgagctcctcttctgcacccctggagccctccagtacctcagtggtgtgatcctctttgaggagacactgtaccagagcaccaagggtggcaagcccttcgttgacatcctcaaggagggcaacgtcctccctggcatcaaggtggacaagggtaccgtcgagctcgctggaaccaacggtgagaccaccacccagggctttgatgaccttggcaagcgctgtgccaagtactacgaggctggtgcccgctttgccaagtggcgtgccgtcctcaagattggccccaccgagccatcacagctttccatcgaccagaatgctcagggtctggctcgctatgccatcatctgccaggagaatgggctggtgcccattgttgagcctgagatccttgttgatggacctcatgacattgaccgctgtgcttacgtgactgagatggtccttgctgcgtgctacaaggccctcaacgaccagcatgtcctccttgagggcaccctcctgaagcccaacatggtcacccctggatccgacgccaagaaggtggcccctgaggtgattgctgagtacaccgtccgcaccctccagaggactgtccctgctgccgtcccagccattgtcttcctctctggtggacagagcgaggaggaggcgaccctgaacctgaacgccatgaacaagctcgagaccaagaagccatggaacctgtccttctccttcgggcgtgccctccagcagagcaccctcaaggcctgggctggcaaggtggagaacgaggagaaggccaggaaggcgttcctggtgaggtgcaaggccaactctgaggccaccctcggcacctacaagggcgatgccaccctcggcgagggggcctctgagagcctccacgtcaaggactacaagtactgatctgccttcggtgcggtggcctgtttgggtgtcctgcttaccagtattatcgtttggttttcagagtcttgatatatccttcggatatcgaacctagtatggaacttgtgctctcaaaatagcttaggtagtttcgtttttggagtcgaataccctgttactcgggtgctgcgtatcgtaaatcggagcggtggtttttgttctactatggtcgtgtaattttgctgcttatacaatgggtaaaacctgttatatgctgagtacatgtcttgagttgctcta

SEQ ID NO: 1313 - DNA, 1262 bp, Pseudoroegneria spicata
cccaaatctcccctccctttgcagctctcgaatctccccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaatgttgaggacaaccgtcgtgccctccgcgagctcctcttctgcacccctggtgccctccagtacctcagtggtgtgatcctcttcgaggagaccctctaccagagcaccaagggtggcaagcccttcgtcgacatcctcaaggcgggcaatgtcctccccggcatcaaggtggacaagggtaccatcgagctcgctggaaccaacggtgagaccaccacccagggctttgatgaccttggcaagcgctgcgccaagtactacgaggctggtgcccgctttgccaagtggcgtgcagtcctcaagatcggccccaccgagccatcgcagctctccatcgaccagaacgcccagggtcttgctcgttatgccatcatctgccaggagaacggtctggtgcccattgttgagcctgagatccttgttgatggacctcatgacattgaccgctgtgcttacgtgaccgagatcgtccttgctgcctgctacaaggccctcaacgaccagcatgtcctcctcgagggcaccctcctgaagcccaacatggtcacccctggttccgacgccaagaaggtggcccctgaggtcattgctgagtacaccgtccgcaccctccagaggaccgtccctgctgccgtccccgccattgtcttcctctccggtggacagagcgaggaggaggcgaccctgaacctgaacgccatgaacaagctccagaccaagaagccctggaacctgtccttctccttcgggcgtgccctccagcagagcaccctcaaggcctggtccggcaaggcggagaatgaggagaaggccaggacggcgttcctggtgaggtgcaaggccaactctgaggccaccctcggcacctacaagggcgacgccaccctcggcgagggcgcctccgagagcctccacgtcaaggactacaagtactgatctgtcttcggcgctgtggcccgtttgggcgtcccgcttaccagtatcattgtttggttttcagagtcctgatatatccccggatatcgaaccttgtttttaataatatgcaacttgtgttttcataaaaaaa

SEQ ID NO: 1314 - DNA, 1379 bp, Secale cereale
  misc_feature (137)..(137): n is a, c, g, or t
tgcctcccctgccaaccaaccccaaatctcctcccctttgcagctctcgaatctcccccgagcatcgaccatgtcggcctactgcggaaagtacaaggatgagctcatcaagaacgctgcctacattggcactcctngcaagggtatcctcgctgctgatgagtccaccggcaccattggcaagcgttttgccagcatcaatgttgagaacgttgaggacaaccgtcgtgccctccgtgagctcctcttctgcacccctggtgccctccagtacctcagcggtgtgatcctctttgaggagaccctgtaccagagcaccaagggtggcaagcccttcgtcgacatcctcaaggagggcaacgtcctccccggcattaaggttgacaagggtaccatcgagctcgctggaaccaacggtgagaccaccacccagggctttgatgaccttggcaagcgctgcgccaagtactacgaggctggtgcccgcttcgccaagtggcgtgcagtcctcaagatcggcgccaccgagccatcgcagctctccatcgaccagaacgcccagggtcttgctcgttatgccatcatctgccaggagaacggtctggtgcccattgttgagcctgagatccttgttgatggacctcatgacattgaccgctgtgcttacgtcaccgagatcgtccttgctgcctgctacaaggccctcaacgaccagcatgtcctccttgagggcaccctcctgaagcccaacatggtgacccctggttccgatgccaagaaggtggcccctgaggtcattgctgagtacaccgtccgcaccctccagaggaccgtccctgccgccgtccctgccattgtcttcctctctggtggacagagcgaggaggaggcgaccctgaacctgaacgccatgaacaagctccagaccaagaagccctggaacctgtccttctccttcgggcgtgccctccagcagagcaccctcaaggcctggtccggcaagacggagaatgaggagaaggccaggactgctttcctggtgaggtgcaaggccaactctgaggccaccctcggcacctacaagggcgacgccaccctcggcgagggcgcttccgagagcctccacgtcaaggactacaagtactgattaatctgccttcggtgctgtggcccgtttgggcgtcccgcttaccagtatcattgtttggttttcagagtcctgatatatccccggatatcgaacatcgtttttaataatatggaacttgtgttttcataataccgtagtagtttatttttggagttgaaataccatgtaaatcgggtgatgcatatagtaaattggagcaggtttttgttcaataatcatataattttca

SEQ ID NO: 1315 - DNA, 1433 bp, Triticum aestivum
ctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccccggcatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttcctggtgaggtgcaaggccaactccgaggccacccttggcacctacaagggcgacgccacccttggcgagggcgcctctgagagcctccacgtcaaggactacaagtactgatctatctgccttcggagctgtggcccgtttgggcgtcccgcttaccagtatcattgtttggttttctgagtcctgatatatccttggatatcgaacatcgtttttaataatatggaacttgtgttttcataataccgtagtagtttctttttggagttgaagtaccctggaaatcgggtgctgcgtatcgtatattggagcaggtttttgttccatggtcctgtaattttcctgctcatacaatgttcaaacctcatatgcgagtacacatgtgttccgtca

SEQ ID NO: 1316 - DNA, 1445 bp, Hordeum vulgare
caaatctccatttgcagccctcgaatctacccccctccccgagcatcgaccatgtcggcctactgcggaaagtacaaggatgagctcatcaagaacgctgcctacattggcacccctggaaagggtatccttgctgctgacgagtccaccggcaccatcggcaagcgcttcgccagcatcaatgttgagaacgtcgaggacaaccgccgtgccctccgtgagctcctcttctgcacccctggtgccctccagtacctcagcggtgtgatcctcttcgaggagaccctctaccagagcaccaagggtggcaagcccttcgtcgacatcctcaaggagggcaacgtcctccccggcatcaaggtggacaagggtaccatcgagctcgctggaaccaatggtgagaccaccacccagggctttgatgaccttggcaagcgctgcgccaagtactacgaggctggtgcccgcttcgccaagtggcgtgcggtcctcaagatcggtgccaccgagccatcgcagctctccatcgaccagaacgctcagggtctggctcgctatgccatcatctgccaggagaacggtctggtgcccatcgttgagcctgagatccttgttgatggacctcatgacattgaccgctgtgcctacgtcactgagatcgtccttgctgcctgctacaagccctcaacgaccagcatgtcctccttgagggcaccctcctgaagcccaacatggtcacccctggttctgatgccaagaaggtgacccctgaggtcattgctgagacaccgtccgcaccctccagaggaccgtccctgctgccgtccccgctatcgtcttcctctccggtggacagagcgaggaggaggcgactctgaacctgaatgccatgaacaagctccagaccaagaagccttggaacctgtccttctccttcgggcgtgccctccagcagagcaccctcaaggcctggtccggcaagactgagaacgaggagaaggccagggctgcgttcctggtgaggtgcaaggccaactctgaggccaccctcggcacttacaagggcgacgccacccttggcgagggcgcctccgagagccttcacgtcaaggactacaagtactgattgatctgcgttggggtgctgtggcccgtttgggcgtcccgcttaccagtatcattgtttggttttcagagtcctgagatatatcgtttttaataatgctgaacttgctttcataataccgtagtagtttctttttggagttgatgaataccctgtaaatcgggtgctgcgtatcgtaaattggagcagcaggtttttgttccatggtcctgtaattttcctgctcatacaatggtaaaacctgttatatgctgatttcgcatgtgttcaatcactttttctttttgtttgtcgctagtaaacattatttttgaaacac

SEQ ID NO: 1317 - DNA, 1461 bp, Triticum aestivum
tcggcacgaggcagcctccctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggcaagcgctgcgccaagtactatgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtggagcctgagatccttgttgatggacctcatgacattgaccgctgtgcttacgtcaccgagatcgtccttgctgcctgctataaggccctcaacgaccagcatgtcctcctcgagggcactctcctgaagcccaacatggtcacccctggttctgactccaagaaggtggcccctgaggtgattgctgagtacaccgtccgcaccctccagaggaccgtccctgctgccgtccccgccattgtcttcctctctggtggacagagcgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccagggcggcgttcctggtgaggtgcaaggccaactccgaggccaccctcggcacctacaagggcgacgccaccctcgctgagggcgcctccgagagcctccacgtcaaggactacaagtactgattgatctgccttcggtgctgtggcccgtttgggcgtcccgcttaccagtatcattgtcattgtttggtttcctgagtcctgatatatcctcggatatcgaacatcgtttttaataatatggaacttgtgttttcataataccgtagtagtttctttttggagttgaagtaccctgaaaatcgggtgctgcgtatcgtaaattggagcaggtttttgttccatggtcctgtaatttacctgctcatacaatgttaaaacctgtcatattctgagtacacatgtgttccgtca

SEQ ID NO: 1318 - DNA, 1440 bp, Triticum aestivum
ccttccctcccctgcctgccaacccccaatctcccgtcgcagccctcgaatctccccccgagcatcgaccatgtcggcctactgcggcaagtacaaggatgagctcatcaagaacgctgcctacattggcacccctggcaagggtatccttgctgctgatgagtccaccggcaccatcggcaagcgcttcgccagcatcaatgttgagaacgttgaggacaaccgtcgtgccctccgtgagctcctcttctgcacccctggtgccctccagtacctcagcggtgtgatcctgtttgaggagaccctgtaccagagcaccaagggtggcaagcccttcgtcgacatcctcaaggcgggcaatgtcctccccggcatcaaggtggacaagggcaccatcgagcttgctggaaccaacggtgagaccaccacccagggctttgatgaccttggcaagcgctgtgccaagtactacgaggctggtgcccgcttcgccaagtggcgtgcagtcctcaagatcggcgccaccgagccatcacagctctccatcgaccagaacgctcagggtctggctcgctatgccatcatctgccaggagaatggtctggttcccattgttgagccagagatccttgttgatggacctcatgacattgaccgctgtgcttacgtcaccgagatcgtccttgctgcctgctacaaggccctcaacgaccagcatgtcctcctcgagggcaccctcctgaagcccaacatggtcacccctggttccgactccaagaaggtggcccctgaggtgattgctgagtacaccgcccgcaccctccagaggaccgtccctgctgccgtccccgccattgtcttcctctctggtggacagagcgaggaggaggcgaccctgaacctgaacgccatgaacaagctccagaccaagaagccatggaacctgtccttctccttcgggcgtgccctccagcagagcaccctcaaggcctggtccggcaagacggagaatgaggagaaggccagggcggcgttcctggtgaggtgcaaggccaactctgaggccaccctcgggacctacaagggcgacgccacccttgccgagggcgcctcggagagcctccatgtcaaggactacaagtactgatctgccccccgctggatggtttgggcattcctgcttactacctccgtctgaaaataagtgtctgacacttatttttggacggagtagtatctgtttggtttcatagtcttgatatttttaaatatcaatccttgtttttaataatataagcttctacttatagttaatttttgacgttgaatcccctgtaatacatttgctgagcagaatgtttttgctctaagcggtattgtattttttctgcttacaatgaaatgaaatggtgaaccccccctttacgctgaaaaaaaaaa

SEQ ID NO: 1319 - DNA, 1423 bp, Triticum aestivum
cctccgtcccctgcctgccaaccccaaattccgctctcgaatctttcccgagcatcgaccatgtcggcctactgcggaaagtacaaggatgagctcatccagaacgctgcctacattggcacccctggcaagggtatcctcgctgctgatgagtccacaggcaccatcggcaagcgcttcgccagcatcaatgttgagaacgttgaggacaaccgtcgtgccctccgtgagctcctcttctgcacccctggtgccctccagtacctcagcggtgtgatcctctttgaggagactctgtaccagagcaccaagggtggcaagccctttgtcgacatcctcaaggcgggcaatgtcctccccggcatcaaggtggacaagggtaccattgagctcgctggaaccaacggtgagaccaccacccagggctttgatgaccttggcaagcgctgcgccaagtactacgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtcgagcccgagatccttgttgatggacctcatgacattgaccgctgtgcttatgtcaccgaggtcgtccttgctgcctgctacaaggccctcaacgaccagcatgtcctcctcgagggcaccctcctgaagcccaacatggtcacccctggttccgactccaagaaggtggcccctgaggtgattgctgagtacactgtccgcaccctccagaggaccgtccctgctgccgtccccgccattgtcttcctctctggtggacagagtgaggaggaggcgaccctgaacctgaacgccatgaacaagctccagaccaagaagccatggaacctgtccttctcctttgggcgtgccctccagcagagcaccctcaaggcctggtccggcaagacggagaacgaggagaaggccagggcggcgttcctggtgaggtgcaaggccaattccgaggccaccctcggcacctacaagggtgacgccaccctcgctgagggcgcctctgagagcctccacgtcaaggactacaagtactgatctatctgccttcggagctgtggcccgtttgggcgtcccgcttaccagtatcattgtttggttttctgagtcctgatatatcctcggatatcgaacatcgtttttaataatatggaacttgtgttttcatgatatcgtagtagtttctttttggagttgaagtaccctggaaatcgggtgctgcgtatcgtatattggagccaggtttttgttccatggtcctgtaatttacctgctcatacaatgttaaaacctgtcatatgctgagtacacatgtgttccggca

SEQ ID NO: 1320 - DNA, 1190 bp, Triticum aestivum
gccctcgaatcccccccgagcatcgaccatgtcggcctactgcggcaagtacaaggatgagctcatcaagaacgctgcctacatcggcacccctggcaagggtatcctcgctgctgatgagtccaccggcaccatcggcaagcgcttcgccagcatcaatgttgagaacgttgaggacaaccgtcgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccctggcatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtcctcaagatcggcgccaccgagccatcgcagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttcctggtgaggtgcaaggccaactccgaggccacccttggcacctacaagggcgacgccaacctcgctgaaggcgcctcccgagaacctccaacgtcaaaggactaaaagtactggattggatcctgccctccgttgctgttggcccctttgggcctcccgccttacaatcacaatggccatggttgggttcccgcat

SEQ ID NO: 1321 - DNA, 1052 bp, Triticum aestivum
gctctcgaatcttccccgagcatcgaccatgtcggcctactgcggaaagtacaaggatgagctcatcaagaacgctgcctacattggcacccctggcaagggtatccttgctgccgacgagtccaccggcaccatcggcaagcgcttcgccagcatcaatgttgagaatgttgaggacaaccgtcgcgccctccgtgagctcctcttctgcacccctggagccctccagtacctcagcggtgtgatcctcttcgaggagaccctgtaccagagcaccaagggtggcaagcccttcgtcgacatcctcaaggagggcaacgtcctccctggcatcaaggtggacaagggtaccgtcgagctcgctggaaccaacggtgagaccaccacccagggctttgatgaccttggcaagcgctgcgccaagtactatgaggctggtgcccgctttgccaagtggcgtgccgtcctcaagattggccccaccgagccatcacagctttccatcaaccagaatgctcagggtctggctcgttatgccatcatctgccaggagaatgggctggtgcccattgttgagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgacgccaagaaggtagcccctgaggtgattgctgagtacaccgtccgcaccctccagaggaccgtccctgctgccgtccctgccattgtcttcctctccggtggacagagcgaggaggaggcgaccctgaacctgaacgccatgaacaagctccagaccaagaagccctggaacctgtccttctccttcgggcgtgccctccagcagagcaccctcaaggcctgggctggcaaggcggagaacgaggagaaggccaggaaggcgttcctggtgaggtgcaaggccaactccgaggccaccctcggcacctacaagggcgatgcca

SEQ ID NO: 1322 - DNA, 1039 bp, Triticum aestivum
ccccgagcatcgaccatgtcggcctactgcggaaagtacaaggatgagctcatcaagaacgctgcctacattggcacccccggcaagggtatccttgctgccgacgagtccaccggcaccatcggcaagcgctttgccagcatcaatgttgagaatgttgaggacaaccgccgtgccctccgtgagctcctcttctgcacccctggagccctccagtacctcagtggtgtgatcctctttgaggagacactgtaccagagcaccaagggtggcaagcccttcgttgacatcctcaaggagggcaacgtcctccctggcatcaaggtggacaagggtaccgtcgagctcgctggaaacaacggtgagaccaccacccagggctttgatgaccttggcaagcgctgtgccaagtactacgaggctggtgcccgctttgccaagtggcgtgccgtcctcaagattggccccaccgagccatcacagctttccatcgaccagaatgctcagggtctggctcgctatgccatcatctgccaggagaatgggctggtgcccattgttgagcctgagatccttgttgatggacctcatgacattgaccgctgtgcttacgtgactgagatggtccttgctgcgtgctacaaggccctcaacgaccagcatgtcctccttgagggcaccctcctgaagcccaacatggtcacccctggatccgacgccaagaaggtggcccctgaggtgattgctgagtacaccgtccgcaccctccagaggactgtccctgctgccgtcccagccattgtcttcctctctggtggacagagcgaggaggaggcgaccctgaacctgaacgccatgaacaagctcgagaccaagaagccatggaacctgtccttctccttcgggcgtgccctccagcagagcaccctcaaggcctgggctggcaaggtggagaacgaggagaaggccaggaaggcgttcctggtgaggtgcaaggccaactctgaggccaccctcggcacctacaagggcgatgcca

SEQ ID NO: 1323 - DNA, 1463 bp, Avena sativa
aatcccaccctccaaagccgcctccctcttccctgccaaccccaaatctcccttcccgacgctcgaatcctcccccaagcagccaccatgtcggcctactgcggaaagtacaaggatgagctcatcaagaacgctgcctacattggcacccctggcaagggtatcctcgctgcggacgagtccactggcaccatcggcaagcgctttgccagcatcaacgtcgagaacgttgaggacaaccgccgtgccctccgtgagctcctcttctgcacccctggtgccctccagtacatcagcggtgtgatcctctttgaggagaccctctaccagagcaccaaggctggcaagcccttcgtcgaggtcctcaaggaggccaatgtcctccctggcatcaaggtggacaagggcaccatcgagctcgctggaaccgacaaggagaccaccacccagggccatgatgaccttggcaagcgctgcgccaagtactacgaggctggtgcccgcttcgccaagtggcgtgctgtcctcaagatcggccccaacgagccatcacagctgtccattgaccagaatgctcagggtcttgctcgctatgccatcatctgccaggagaacggtctggtgcccattgttgagcctgagatccttgttgatggtcctcatgacattgaccgctgtgcctatgtgaccgaggtggtccttgctgcctgctacaaggctctcaatgaccagcatgttctccttgagggtaccctcctgaagcccaacatggtcacccctggatctgactccaagaaggttgccccagaggtcattgccgagtacaccgtccgcaccctccagaggaccgtcccacctgccgtgcctgccattgtcttcctctctggtggccagagcgaggaggaggcgaccaagaacctcaacgccatgaacaagctccagaccaagaagccgtggtctctgtccttctccttcgggcgtgccctccagcagagcaccctcaaggcctggggtggcaaggcggagaacgtcgcgaatgcccagaaggcgttcctggtgaggtgcaaggccaactccgaggccaccctcggcaagtaccagggcgatgctacccttggcgagggcgcctccgagagccttcacgtcaaggactacaagtactgagctgccttcggcgccggtccgtttgggccttcctgcataccagtattattgtttggttttctgagtcctatatatcttcggatatcgaacatcgtttaataatatgaagcttgtgctttcataataccgtagtagttttttggtgttgctctccctgaaactcaggtgctgggtatggtaaattggagcagctggattttgttctatcgtcctgtaattttgctgcttgaaaccgcaatgggataaaccttttctatgctgagtatagttaaatgtgtgtttgcagtaattttattatt

SEQ ID NO: 1324 - DNA, 1050 bp, Triticum aestivum
ctcgaatctccccccgagcatcgaccatgtcggcctactgcggcaagtacaaggatgagctcatcaagaacgctgcctacattggcacccctggcaagggtatccttgctgctgatgagtccaccggcaccatcggcaagcgcttcgccagcatcaatgttgagaacgttgaggacaaccgtcgtgccctccgtgagctcctcttctgcacccctggtgccctccagtacctcagcggtgtgatcctgtttgaggagaccctgtaccagagcaccaagggtggcaagcccttcgtcgacatcctcaaggcgggcaatgtcctccccggcatcaaggtggacaagggcaccatcgagcttgctggaaccaacggtgagaccaccacccagggctttgatgaccttggcaagcgctgtgccaagtactacgaggctggtgcccgcttcgccaagtggcgtgcagtcctcaagatcggcgccaccgagccatcacagctctccatcgaccagaacgctcagggtctggctcgctatgccatcatctgccaggagaatggtctggttcccattgttgagccagagatccttgttgatggacctcatgacattgaccgctgtgcttacgtcaccgagatcgtccttgctgcctgctacaaggccctcaacgaccagcatgtcctcctcgagggcaccctcctgaagcccaacatggtcacccctggttccgactccaagaaggtggcccctgaggtgattgctgagtacaccgtccgcaccctccagaggaccgtccctgctgccgtccccgccattgtcttcctctctggtggacagagtgaggaggaggcgaccctgaacctgaacgccatgaacaagctccagaccaagaagccatggaacctgtccttctccttcgggcgtgccctccagcagagcaccctcaaggcctggtccggcaagacggagaatgaggagaaggccagggcggcgttcctggtgaggtgcaaggccaactctgaggccaccctcgggacctacaagggcgacgcca

SEQ ID NO: 1325 - DNA, 1277 bp, Brachypodium distachyon
cccctcacctccaaagccgcctctcctgccaaccccaaatctccctttgcaactctcgaatctcccccccaagcatcgaccatgtcggcctactgcggcaagtacaaggatgagctcatcaagaacgctgcctacattggcacccctggcaagggtatcctcgctgctgacgagtccaccggcaccattggcaagcgctttgccagcatcaacgttgagaacgtcgaggacaaccgccgtgctctccgtgagctcctcttctgcacccctggtgccctccagtacatcagcggtgtgatcctctttgaggagaccctgtaccagagcaccaaggctggcaagcccttcgttgatgtcctcaaggagaacaatgtcctccctgggatcaaggttgacaagggtaccattgagattgctggaactgacaaggagaccaccacccagggccatgatgaccttggcaagcgctgtgccaagtactacgaggctggtgcccgctttgccaagtggcgtgcagtcctcaagattggccccaatgagccatcacagctttccattgacctgaatgctcagggtctggctcgttatgccatcatctgccaggagaacggtctggtgcccattgttgagcctgagatccttgttgatggacctcatgacattgatcgttgtgctcatgtgacggaggtggtccttgctgcctgctacaaggcactcaatgagcaccatgtcctcctcgagggtacccttctgaagcctaacatggtcacccctggttctgactccaagaaggtggctcctgaggtcattgctgagtacactgttcgcactctccagaggaccgtcccgcccgccgttcctgccatcgtcttcctttctggaggacagagtgaggaggaggcgaccctgaacctgaacgccatgaacaagctccagacaaagaagccgtggttcctgtccttctcctttgggcgtgccctccagcagagcaccctcaaggcctgggctggcaaggaggagaacatcgagaaggccaggcaggccttcctggtgaggtgcaagtccaactctgaggccactctcggcacatacaagggtgatgctactcttgctgagggcgcttctgagagccttcacgtcaaggactacaagtactgatctgccttctggtgctgatccgtctggccttctgcctatgagtattgtttggttttcagagtcctatcttcggatatcgaacctctttttaataatatgcaacttgcaactttcatgtt

SEQ ID NO: 1326 - DNA, 1442 bp, Oryza sativa
ccctcctacaaggcggccggacgcccacagatcggatcgggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaaccatgtcggcctactgcggcaagtacaaggacgagctcatcaagaacgctgcctacattggcactcctggcaagggtatccttgctgcggatgagtccactggcaccattggcaagcgcttcgccagcatcaacgtcgagaacgttgaggagaaccgccgctccctccgcgagctcctcttctgcacccctggcgccctccagtacctcagcggcgtgatcctcttcgaggagaccctgtaccagaagaccaaggatggcaagcccttcgtcgatgtcctcaaggagggtggtgtcctcccgggcatcaaggtggacaagggcacaatcgaggttgccggcaccgagaaggagaccaccacccagggccatgatgaccttggcaagagatgcgccaagtactacgaggctggtgcccgcttcgccaagtggcgcgccgtcctcaagatcggccccaacgagccgtcgcagctcgccattgatctgaatgcgcagggcctcgctcgctacgccatcatctgccaggagaacgggctggtgccgatcgtcgagcccgagatccttgttgatggccctcacgacatcgaccgctgcgcctacgtctcggaggtggtcctcgctgcgtgctacaaggccctcaacgagcaccatgtcctcctcgagggtaccctcctcaagcccaacatggtcaccccaggctctgacgccaagaaggtgtctcccgaggtcatcgctgagtacaccgtccgcaccctccagaggaccgtccccgctgccgtgcccgccatcgtcttcctgtccggtgggcagagcgaggaggaggcgaccctgaacctcaacgccatgaacaagctcagcaccaagaagccgtggtcgctgtccttctccttcggccgtgccctccagcagagcacgctcaaggcctggtccggcaaggcggagaacattgagaaggccagggcggccttccttaccaggtgcaaggccaactccgaggctaccctcggtacatacaagggtgacgctgtcctcggcgagggcgcctccgagagccttcacgtcaaggactacaagtactgatttgccttgggaggtgctggctaccattggaacattctgcggctgttgcttaatgtggttttgatatctagagggcaatctatggttatctaaaatgtcttgtcgtaataattctggaacctttttgtgtaacacattaccaaatatcaattgcctggattgaaatatcgtttttatcag

SEQ ID NO: 1327 - DNA, 1505 bp, Panicum virgatum
gcgtccggccaaaccattctcccccaaatctccctcgcaatccccatccccgtagccctcccagcgagcatcgaccatgtcggcctactgcggaaagtacaaggatgagctcatcaagaacgctgcctacattggcacccctgggaagggtatccttgcagctgatgagtccactggcaccattggcaagcgtctttccagcatcaatgtcgagaacgttgaggagaaccgccgtgccctccgtgagctcctgttctgctgccctggtgccctccagtacataagtggtgtgatcctcttcgaggagaccctgtaccagaagaccaaggatggcaagcccttcgtcgatgtcctcaaggagggaggcgctctccccggcatcaaggttgacaaggggaccattgaggttgctggcactgataaggagaccaccacccagggccatgatgaccttggcaagcgctgcgccaagtactacgaggctggtgcccgctttgccaagtggcgtgctgtcctcaagattggccccaacgagccatcacagcttgccattgacctgaacgctcagggtcttgctcgctatgccatcatctgccaggagaatggtctggtgccgatcgtggagcctgagatccttgtcgatggccctcatgacattgagcgctgcgcatatgtcactgaagtggtccttgctgcctgctacaaggctctcaacgagcaccatgtcctccttgagggtaccctcctgaagcccaacatggtcacccctggctccgactccaagaaggtgactcctgaggtcattgctgagtacaccgtccgcaccctccagaggactgttcctgctgctgtgcctgccatcgtcttcctctctggtggacagagcgaggaggaggccaccctgaacctgaatgccatgaacaagctcaacaccaagaagccttggtccctgtccttctccttcggccgtgccctccaggcaagcacactcaaggcctggcttggcaaggtggagaacgtggagaaggctagggcggccttccttgccaggtgcaaggccaactctgaggctaccctcggcacatacaaaggtgacgctgctgctggagagggtgtctctgagagccttcacgtgaaggactacaagtactgatctacctcgtcttgcctacccgtgctggtgtctgcctacgagcatttaggttgctgagtgtcatttgctccttagagcctatatccggacctctaaaaaaaccctgaacttaatcttcccttttgtggatgatggtttgttaccttatttttgtattcgtatattaactagtctatttggtgttaaatctcgtgtaatttggtcctgccgatggagaatcgtgcagccacattttgtttatctttcctgtaatgctggttacatatcggcaaaaccattttatatgctgagctggccggggtgcaggcgttttgctcctagttatcttccacttttggctattagagattcg

SEQ ID NO: 1328 - DNA, 1490 bp, Oryza sativa
cctcttgaccccatttcggtgcttaaccaaactcaccataatatcagttcatccacaacaatgtcggcctactgcggcaagtacaaagatgagctcataaagaatgctgcctacattggcaccccgggcaagggtatcctcgctgcggacgagtccactggcaccatcggcaagcgcttcgccagcatcaatgttgagaacgtcgaggataaccgccgtgccttccgcgagctcctcttctgcacccctggcgccctccagtacatcagcggcgtgatcctcttcgacgagaccctctaccagaagaccaaggatggcaagcccttcgtcgatgtcctcaaggaggccggtgccctccccggcatcaaggtggacaagggcaccatcgaggtcgccggcaccgacaaggagaccaccacccagggccacgatgacctcggcaagcaatgcgccaagtactacgaggccggtgcccgcttcgccaagtggcgtgccgtcctcaagatcggacccaaccagccctcccagcttgccattgatctgaacgcccagggccttgcttgctacgccatcatctgccaggagaacgggctggtgccgatcgtcgagccggagatcctcgtcgatggccctcacgacatcgatcgatgcgcgtacgtctccgaggtggtcctcgccgcgtgctacaaggcgctgaacgagcaccatgtcctcctcgagggcaccctcctgaagcccaacatggtcaccccgggttccgacgccaagaaggtggcgccggaggtcatcgcggagtacaccgtccgcaccctccagaggaccgtccctcctgctgtgccggccatcgtcttcctctccggtggacagagcgaggaggaggcgacgctgaacctgaacgccatgaacaagctcagcgccaagaagccgtggtcgctgtccttctcctttggccgtgccctgcagcagagcacgctcaaggcctgggctggcaagacggagaacgtagagaaggccagggcggccttcctcgtcaggtgcaaggccaactccgaggctaccctgggtacttacaagggtgatgctgtcctcggcgagggcgctgctgaaagcctgcacgtcaaggactacaagtactgatctgcatcaggcgctggcctgctatggcttggctacctgatcgatttcccattctggggccgttacataatgcggttttgatatctagaggctctaacaggattcacaatttcggatcggaatttcagaatttttccctttccgatagatcgaaccctggagcacaatatatctgtggttatctaaaagccttgtcttaataatccagaacctttttttttcttgtaaaatatttgctgatgaacatcagctggcccggagtttttatttttatcaatcactttgtaactgtctgatttgcccggtgctgtgtgattttgttgaatgaaattaacttcacttctttgagttta

SEQ ID NO: 1329 - DNA, 1712 bp, Sorghum bicolor
cggagggcgaaatagggagtagtatactccgcacatggttggatctctgcatccggcaccgcctaccgccctcgccctgctgcgcccgcaccgcaggccgcgcttgcctggtggcgcacccagatcggatccacgtttctttcccctcgcacaagcctgagcctcccttgaaatactccccatctccatcgccccgcctaccccgctcagccattcgaccccaatttcgcttgcagttccagtagcctccctcccctcccgcgcgcatcgatcatgtcggcctactgcggaaagtacaaggatgagctcatcaagaacgccgcatatattggcacccctggaaagggtatccttgctgctgatgagtccacaggcaccattggcaagcgactttcaagcatcaatgtcgagaacattgaggagaaccgccgtgcccttcgtgagctcctcttctgtgcccctggtgccctccagtacctcagcggtgtgatcctctttgaggagaccctctaccagaaaaccaaggatggcaagccctttgttgatgtcctcaatgagggaggtgtgctccccggcatcaaggttgacaagggcaccattgaggttgctggcaccaacaaggagaccaccacacaaggccatgatgaccttggcaagcgctgcgccaagtactatgaggctggtgcccgctttgccaagtggcgtgccgtcctcaacatcggccctaacgagccatcacagcttgccattgacttgaacgctcagggtcttgctcgctacgccatcatctgccaggagaatggtctggtgccaattgttgagcctgagatcctcgtcgatgggccacatgacattgagcgttgtgcctatgttacggagatggtccttgctgcctgctacaaggctctcaatgagcaccatgtcctccttgagggtaccctcctgaagcccaacatggttacccctggctctgactccaagaaggtggctcctgaggtgatcgctgagtacactgtgcgtgccctccagaggactgtccctgctgctgtgcccgccatcgtcttcctctctggtggacagagtgaggaggaggccacactaaacctgaatgccatgaacaagctcaacaccaagaagccgtggtccctatccttctcattcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcggagagcctccacgtgaaggactacaagtactgagctgcctcacattctggacccctgagtctgcttgcgtttaggttgagtgtttgtcagtcagagcccaaattttggacatcggaacttggttttaataatcctgaacttatggatgatggttgcttactttttatactcatgtattaattagtattttttggtgttcatcttgtgtaatctggtcgtaccgatggtaaatcgaggggccacattttgttctgtccgttgctgtaatatgctggttatgttattggtatagtatatgtcaaaccaaatgcttagttggccgatgtgcagaggttctgcattgtgcactgacatatttgatgtgaattatgatgattccagagcttcgttgttag

SEQ ID NO: 1330 - DNA, 1404 bp, Panicum virgatum
cgccccgccaacccaaccattcgccccgccacccccgatcgatctcgtccctcgtagcatctcctcctcacgcgcgcatcgaccatgtcggcctactgcggaaagttcaaggacgagctcatcaagaacgccgcctacattggcacccctggcaagggtatccttgctgctgatgagtccactggcactattggcaagcgcctttccagcatcaatgtcgagaacattgaggagaaccgccgtgccctccgtgagctcctcttctgcgcccctggtgccctccagtacctcagtggtgtgatcctctttgaggagaccctctaccagaagaccaaggatggcaagcccttcgtcgatgtccttaaggagggaggtgtcctccccggcatcaaggtcgacaagggtaccattgaggttgctggcaccaacaaggagaccaccacccagggccatgatgaccttggcaagcgctgtgccaagtactacgaggctggtgcccggtttgccaagtggcgtgctgtcctcaatatcggccctaatcagccatcacagcttgccattgacctgaatgctcagggtctcgctcgttacgccatcatctgccaggagaacggtctggtgccgattgttgagcctgagatccttgttgatggtccgcatgacattgagcgctgcgcttatgtcaccgagatggtccttgctgcctgctacaaggctctgaatgagcaccatgtcctcctcgagggtaccctcctgaagcccaacatggtcacccctggatctgatgccaagaaggtggcccctgaggtgattgccgagtacactgtacgtgcccttcagaggactgtccctgctgctgtgcctgccattgtcttcctctctggtggacagagcgaggaggaggccaccctgaacctgaatgccatgaacaagctcaacaccaagaagccatggtccctgtccttctcctttggccgtgcccttcaggcgagcaccctcaaggcctgggctggcaaggaggagaatgtggagaaggccagggctgccttcctcaccaggtgcaaggccaactcagaggccaccctcggcacgtacaagggtgatgctgctgccggcgagggcgtctcagagagcctccacgtcaaggactacaagtactgatctgctccccttttggacctgctggctacgagcatttaggtgagtttagtttgcccgtcagagcgtggttggacagcgaaactcctttgtaataatcctgaacttatgcttcccttttgtggatgatggttggctacttattattcgtatattagtctttttggtggtaatctcgtgtatgcctcagctactttttgttctgtcgttgctgtaatgctggttatataatggaaaaaaccactt

SEQ ID NO: 1331 - DNA, 1670 bp, Saccharum officinarum
atgagaatgacaaataaataaaaagcccgaactccggacattgtccgctaccgcccgcagcgccgcctgcgcattcctggtggcgcacccagatcggatcccgtttctttcccctcgcacaagcctgagcctcccttgaaataccaccccccatctccatcgccgcctaccccgctcagccatccgcccccaatttcccttgcaattcccagagcctcccctcccgcgcgcatcgatcatgtcgtcctactgcggaaagtacaaggatgagctcatcaagaacgccgcatacattggcacccctggaaagggtatccttgctgctgatgagtccacgggcaccattggcaagcgcctttcaagcatcaatgtcgagaacattgaggagaaccgccgtgcccttcgtgagctcctcttttgtgcccctggtgccctccagtacctcagcggtgtgatcctcttcgaggagaccctctaccagaaaaccaaggatggcaagcccttcgtcgatgtcctcaatgagggaggtgtgctccctggcatcaaggttgacaagggcaccattgaggttgctggcaccaacaaggagaccaccacacagggccatgatgaccttggcaagcgctgcgccaagtactacgaggctggtgcccgctttgccaagtggcgtgccgtcctcaacatcggccctaacgagccatcacagcttgccattgacttgaacgctcaaggtcttgctcgctacgccatcatctgccaggagaacggtctggtgccaattgttgagcctgagatcctcgtcgatgggccacatgacattgagcgctgtgcctatgtcacggagatggtccttgctgcctgctacaaggctctcaacgagcaccatgtcctccttgagggtaccctcctgaagcccaacatggtcacccctggctctgactccaagaaggtggctcctgaggtgatcgctgagtacactgtccgtgccctccagaggactgtccctgctgctgtgcccgccatcgtcttcctctctggtggacagagtgaggaggaggccaccctaaacctgaacgccatgaacaagctcaacaccaagaagccgtggtccctatccttctcgttcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcagagagcctccacgtgaaggactacaagtactgagctgcttctcgttcaggacccctgagtctgcttgcgtttaggttgagtgttcgtccgtcagagcccaatttttggacatcggaacttggttttaataatcctgaacttatggatgatggttgcttactttttatactcatgtattaattagtcttttttggtgttaatcttgtgtaatctggtcgtaccgatggtaaatcgagcggccacgttttgttctatccgttgctgtaatatgctggttatgttattggtatatgccaaaacgaactacatgcttagttggccgatgtgcagagattctgcaatgtgcactgacatatttgatgtgaattatgatgattccagagctttt

SEQ ID NO: 1332 - DNA, 1523 bp, Oryza sativa
cccccggcgtccaagactggactctcctctttataacccgtctcccttctcatctttttctccacagtcgcctcctcccctgccaaaccagtctcccccaaatctcctttgcgtcctctcgattcctcagcgaccatgtcggcctactgcggcaagtacaaggacgagctcatcaagaatgctgcctacattggcactcctggcaagggtatccttgctgcagatgagtccactggcaccattggcaagcgctttgccagcatcaatgtcgagaacgttgaggagaaccgccgctctctccgcgagctgctcttcaccacccctggtgccctccagcacctaagtggtgtgatcctcttcgaggagaccctgtaccagaagaccaaggacggcaagcccttcgtcgatgtcctcaaggagggtggtgtcctccctggcatcaaggttgacaagggtaccgttgaggttgccggcaccaacaaagagaccaccacccagggccacgatgatcttggcaagcgttgcgccaagtactacgaggccggtgcccgcttcgccaagtggcgtgctgtcctcaagattggccccaacgagccatcgcagctttccattgacctgaatgctcagggtcttgctcgctatgccatcatctgccaggagaacgggctggtgccgattgtcgagcctgagatccttgtcgatggctctcatgacattgagcgctgtgcctatgtcaccgagaaggtcctcgctgcctgctacaaggccctcaacgaacaccatgtcctcctggagggttccctcctgaagcccaacatggtcaccccaggatctgaatccaagaaggtttcccctcagctcatcgccgagtacaccgtccgcgccctccagaggactgtccctgctgccgtgcctgccattgtcttcctctctggtggacagagcgaggaggaggcgaccgtgaacctcaacgccatgaacaagctcagcaccaagaagccgtgggctctgtccttctccttcggccgtgctctccagcagagcacgctcaaggcctggggcggcaagacggagaacgtggtgaaggcgcagaaggccttcatcaccaggtgcaaggccaactctgaggctacccttggtacataccagggtgatgctgtgctcggcgagggtgcctctgagagccttcacgtcaaggactacaagtactgatctgcttctggtggtggctgaagatccgattggacatcctccgtatgcatatttagggttctgagtgtggtttggctatcaagcgtccaatcttacgggtatcaaaaacttttgtcgcaataatctgaacctgtgctttttaataattaatacctgtcatcggtagtagttttttggtattcctgtaatcaaatgctgcgtatggtaaattggagcagcggctttaattccatgctatctttttattgttattttctgctgtactcctatgttaattaaaccttttacctatatggcgttttgctgtgtct

SEQ ID NO: 1333 - DNA, 1186 bp, Panicum virgatum
tccacccccaatcgatctcttccccccccgtcgcgattccctcgtagcatcccctcacgcgcgcgtcgaccatgtcggcctactgcgggaagtacaaagacgagctcatcaagaacgctgcctacattggcacccctggcaagggtatccttgctgctgacgagtccactggcaccattggcaagcgcctttcaagcatcaatgttgagaacattgaggagaaccggcgtgccctccgtgagctcctcttctgcacccctggtgccctccagtacctcagtggtgtgatcctctttgaggagaccctctaccagaagaccaaggacggcaagcccttcgttgatgttcttaaggagggaggtgtcctccctggcatcaaggtcgacaagggtaccatcgagatcgctggcaccaacaaggagaccaccacccagggccatgatgaccttgggaagcgctgcgctaagtactacgaggctggtgcccgctttgccaagtggcgtgctgtcctcaatatcggccccaatcagccatcacagcttgccattgacctgaatgctcagggtcttgctcgttacgccatcatctgccaggagaatggtctggtaccaattgttgagcctgagatccttgttgatggtccacatgacattgagcgctgcgcttatgtcaccgagatggtccttgctgcctgctacaaggctctgaatgagcaccatgtcctcctcgagggtaccctcctgaagcccaacatggtcacccctggatctgacgccaagaaggtggcccctgaggtgattgccgagtacactgtgcgtgcccttcagaggaccgtccctgctgctgtgcccgccattgtcttcctctctggtggacagagcgaggaggaggccaccctgaacctgaacgccatgaacaagctcaacaccaagaagccgtggtccctgtccttctcctttggccgtgcccttcagcgagcaccctcaaggcctgggctggcaaggaggagaatgtggagaaaggcaaggactgccttcctcaccagtgcaaggccaactcagaggccacccttggcacgtacaaggtgatgctgccgccggcgaagcgtctcagagagcctccacgtcaaggactacagtactgatctgctcccgcttttggatctgttgggctgcactcatttagg

SEQ ID NO: 1334 - DNA, 1472 bp, Manihot esculenta
agataaaacccccccctaatacccctcgctttttctcatctttgaaaaaccctttctagaattctctacctcagtctctgctattcaaccatgtcttgcttcaagggcaaatacgccgacgaactcattgccaatgctgcctatattggcacccctggaaagggcatccttgctgctgacgagtctactggcaccattggcaagcgtctagccagcatcaacgttgagaatgttgaggacaacagaagggctcttcgcgaacttctcttcaccacccctggtgccctccaatatctcagcggtgtgattctgtttgaagaaaccctgtaccagaagtcgaaatcaggcaagccttttgttgacatcttgaaggaaggtggtgtcctccctggtattaaagtcgacaagggtaccgttgagcttgctggtaccaatggtgagactacaacccagggtcttgatggccttgcacagcgatgccaaaaatactatgaagctggtgctcgctttgccaaatggcgtgctgtactcaagattggccccaatgagccatctcagcttgccatcaacgagaatgccaatggattggccagatatgccatcatttgccaggagaatggtttggtccctattgtggagcctgagatcttggttgatggacctcatgacattaacaagtgtgctgaggtcactgagcgggttcttgctgcatgctacaaagctctcaatgatcatcacgtcttgcttgagggaactcttttgaagcccaatatggtgaccccaggatcagaatccaaaaaggttgcacctgaggtgattgcggagtacacagtccgtgccctccaacgcactgtgcctgcggcagtccctgctattgtgttcttgtctggaggccagagtgaggaggaggctaccctcaacctcaatgccatgaacaagcttaagaccaagaagccatggtctttatccttctcctttggacgtgcccttcaacagagtaccctcaaggcctgggctggcaaggaggagaatgtgaagaaggctcaagattcatttattgtcaggtgcaaggccaactcagaggcaactcttggaacttacaagggtgatgctactcttggtgagggtgcttcagagagcctccacgtgaaggactacaaatactaaatggtctcggtgcgttggaagtgatgaggagtaataggctggcacatctcaggcttagtttttttttttttttccttcttcctttaaagtcgctgatcagatttactaggatgaagtagcataataaaagcatgaagaaatattgagtttgaatggttttggacagtctggggggaaactgttttctatttatttatcctacttttttgtggaggttcaatgatccggttttctgatgtaaacatggagtctatgaacttgtttcttttctttatgaattatgtgcgctttattttatcgcaaaa

SEQ ID NO: 1335 - DNA, 1635 bp, Sorghum bicolor
agatgccccccccttttttttttcctggtttctttccccttcgccaagcccgaacccggaaccctcgtctttaaatacgccctcggcccatcctccgcatcccccgtctccgtctgccaaaccattcctcccaacaacacccgcctcctcctgcaatcctcgtagcctccgtcgagcatcgatcatgtcggcctactgcggaaagtacaaggatgagctcatcaagaatgctgcctacattggcacccctggcaagggtatccttgctgctgatgagtccactggcaccattggcaagcgtctttccagcatcaatgtcgagaacgtggaggagaaccgccgtgccctccgtgagctccttttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgctggcacggacaaggagaccaccacccagggccatgatgaccttggcaagcgctgcgccaagtactacgaggccggtgcccgctttgctaagtggcgtgctgttctcaagatcggccccaatgagccatcacagcttgccattgacctgaatgctcagggcctggctcgctatgccatcatctgccaggagaacggtctggtgccgattgttgagcctgagatccttgttgatggccctcatgacattgatcgctgcgcttatgtcactgaggtcgtccttgctgcctgctacaaggctctcaacgagcaccatgtcctcctggagggtaccctcctgaagcccaacatggtgaccccaggctctgactctaagaaggtgacccctgagttgattgctgagtacaccgtccgcaccctccagaggaccgtccctgctgctgtgcctgctgttgtcttcctctccggtggacagagcgaggaggaggccaccctcaacctcaatgccatgaacaagctcaacaccaagaagccgtggtccctgtccttctccttcggccgtgccctccaggcgagcacactcaaggcctgggctggcaaggtggagaacatcgagaaggctagggcggccttcctcgccaggtgcaaggccaactctgaggctaccctcggcacctacaagggtgatgctgctgctgacaccgagagcctccacgtcaaggactacaagtactgagttgcttctctttgcgtgcccgttttggaactcctgcctacgagtaggttgctgagtgtggtttgctcgtttgagcttatattcggacaacaaaaaaaaacatgcttcctatgtggatgatggttatctttatattcgtatattaactagtctctttggtgttaaatttcgtgtaatatggtcctgccgatggagcatcgagcagcctcttttttttgttctatctactaatgctgtaatgctggttatgtatcggcaaaaaccattctatatgctgagttggagacagcaacctatgtggatcatattttgttgagacgaactcatgagagattttagacataataatagagtattggaagttatttccactggttagctga

SEQ ID NO: 1336 - DNA, 1388 bp, Manihot esculenta
aaaacccctaatgccccttgctctatctctctctcaaaaccatctctagtaatctctgtttctactattcataattcgataatgtcttgctacaagggcaaatacgccgatgagctcattgccaatgctgcttacattggcacccctggaaagggtattctcgctgccgatgagtctacaggcacaattggcaagcgtctagccagcatcaatgttgagaatgttgaggacaacagaagggctcttcgtgagctcctattcaccacccctggtgccctccaatacctcagcggtgtgattctttttgaggaaacactgtaccagaagtctaaatcaggcaagccttttgttgacatcttgaaggagggtggtgtcctccctggtattaaggttgacaagggtactgttgagcttgctggtaccaatggtgagactacaacccagggtcttgatggccttgcccagcgttgccaaaagtattatgaagctggtgcacgcttcgccaaatggcgtgctgtgctcaagattggccccaatgagccatctcagcttgcaatcaacgagaatgccaatgggttggccagatatgccatcatttgccaggagaatggcttggtacctattgttgagcctgagatcttggtagatgggcctcatgacatcaacaagtgtgctgaggttaccgaacgagtacttgctgcatgctacaaagctctcaatgaccaccatgtcttgcttgagggaactcttttgaagcccaatatggtgacaccaggatcagaatccaaaaaggttgcacctgaggtgattgctgagtacacagtcctcgccctccaacgcactgtgcctgctgcagttcctgccattgtattcttgtctggtggccaaagtgaggaggaagcaaccctcaacctcaatgccatgaacaagctcaagaccaagaagccatggtcattgtccttttcttttggacgtgctcttcagcagagcaccctcaaggcttgggcaggcaaggaggagaatgtgaagaaggctcaggatgcattcattgtcaggtgcaaggccaactcagaggccactcttggagcttacaagggcgatgccactcttggcgagggtgctgcagagagcctccatgtcaaggactacaaatactaagaggtctgcggcattgtaattgtagggcttcatttaatcttttcccctttcccctcttaagttgctgatcagttatagcgcgaagtagcataataagaaggcttgaggaaatattggcgtgtttaatttgaatggtttttggacagtttcgattgagaactggttacgttttgttttcctacagttctaatgaaaaattgaatgaaccgttttctcttttcttttctgaa

SEQ ID NO: 1337 - DNA, 1697 bp, Zea mays
gccgcgtcgacgagactgcacatgaaaaccgggggcagcgccgcgccgaaccgggcgcgccgcacaaggttcgatccgccggctccggtggcgcacccagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggcaggtgcccgctttgccaagtggcgcgctgttctcaagattggccctaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacctggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagctccctttttttgttctatcaactatgctgtaattctggctatgtatcggcaaaaacaattctatatgctgagttggagtcggcaaaaattcatatatgctgagttggagacagcaacttgtttggatcatattttgctgagacactcgtgagagattggcatagc

SEQ ID NO: 1338 - DNA, 1436 bp, Elaeis guineensis
ctctctctctctctctctctctctctctctctctctctctctctctcaatcacttgtctctagcctgtttctttcttccctcttctaccaactaaagatgtcggcctactgcggaaagtatcacgatgagctcattaagaatgctgcctacatcggcaccccaggcaaggggatccttgcagccgatgagtccaccggcacaattggcaagcgcttagccagcatcaatgttgagaatgttgaggagaaccgccgtgccctccgtgagctcctcttttgtacccctggtgctctccaatacctcagtggtgtcatcctctttgaggagactctttaccagaagactaaagatgggaagccttttgtcgaagtcttgaaggagggtggagtccttcctggtatcaaggtggacaagggcaccatcgaacttgctggcactaatggtgaaaccacaacccagggccatgatgaccttgccaagcgctgccagaagtactatgaagcaggggcacgctttgctaagtggcgtgccgtcctcaagattggtccaaccgagccatctcagctagccatcgatctaaatgctcatgggttggcccgctatgctattatctgccaggagaatggcctggtacccattgtagagcctgagatccttgttgatgggccacacgacatcaaacgttgtgctgatgttacagagagggtgcttgctgcttgctacaaggcacttaacgaccaccatgttctcctagaagggactctcctgaagccaaacatggtaaccccagggtcagagtctgcgaaggtggcacccgaggtggtggctgagtacgctgtgcgggctctccaaaggacggtcccagctgctgtgccagctattgtcttcctctcaggcggccagagtgaagaggaagcgaccttgaacctgaatgccatgaacaagctggggggcaagaagccctggtcactttctttctcttttggccgtgccctgcagcaaagcacgctcaaggcttgggctgggaaggtggagaatgtggagaaggcgagggctgctttccttgcaaggtgcaaagcgaactcagaggcaacacttgggaaatacgagggagatgctgctggtggtgaaggcgtctctgagagccttcatgtgaaggattacaagtattgagcttggtctgttactggaaccacctatctttttttgttagtaaatgttgagagggagatgggaatggattttcctcggactagggtatctttctccttaatgctttaaatgtttttaataagtttgtaaggcatttgctgccttcagtgtactgtcttagctgtttatcatacctcgatgggcttcttattggttttgttgttcgtctttctggcataattggttgcttcttattagaatttgacattggatggtttgcttg

SEQ ID NO: 1339 - DNA, 1334 bp, Zingiber officinale
tttgatctttctttctcgacccgagatgtctgcctactgcggccaatatcatgatgagcttattgccaatgctacttacattggcacccctggcaagggtatccttgctgctgatgaatccactggcactataggcaagcgccttgcaagcatcaacgtggagaatgtggaggagaaccgtcgtgcactgcgtgaacttctctttttgactcctggagccctccagtatctcagtggtgtgatcctcttcgaggagactctctaccagaaaactgctgacggcaaacccttcgttgatgtactcaaggagggtggagtccttccaggtatcaaggtagacaagggcactgttggacttgctggcaccaatggtgagaccaccactcaagggcatgatgatcttggcaagcgctgcaagaagtattatgaggcaggggctcgttttgccaagtggcgtgctgttctcaatattggccccaatgagccatcgcaactgtctatcgatgcaaatgccaatggcttggcacgctatgctatcatctgccaggagaatggacttgtcccaattgtagaaccagagatccttgtcgacgggtcacatgacattgaaaaatgtgcttatgttacagaacgggtgctagctgcgtgctacaaggccctaaatgatcaccatgtgcttctggaaggaaccctcttaaaaccaaacatggtgactcctgggtctgaatccaaaaaggtggctcctgaggtggttgctgagtacactgtgcgtgctctccagaggactgttcctgctgctgtgcccgccattgttttcctttcaggaggacagagtgaagaggaagctaccttgaacttgaatgctatgaacaagttgaaggggaagaagccatggtcactttctttctcatttggtcgtgccctgcagcaaagtacactcaaggcatggcaagggaaggcagagaatgtggagaaggcaaggacagccttccttggccggtgcaaggcaaactcagaggcaactcttggcgtctacaagggtgatgctgctggaggtgaaggcgtctcagaaagcctccatgtcaaggattataagtactgatcgagcttgttcattttgaaactgaatgtcatgcggaggacatgcaagtttgagatattcgccaacctagggatcttttctgttgctgctttatgtgcttctaaataagtagggttgcattgtaccactaaacttaacaatgcttggatatttgttcttttcactgcacatttgtattccctacatgactggttttggtcaagtttggttctgtttggttcagagatgccgc

SEQ ID NO: 1340 - DNA, 1513 bp, Vitis vinifera
cgcgcatagcgaaaatctcgatgcccctctcgctttccctttctctctctctctccctcttgtaataaaaccctaaccgatcatctcttttcagtctctgtgtcgcctcttctatctctagcaacgactctctctacaaatctctaaatctaatcatccatccatgacttgctacaagggaaaataccatgacgagcttattgccaatgctgcctacattggcactcctggaaagggtattcttgctgctgatgagtcaactggcacaattggcaagaggctagctagcatcaatgtcgagaatgttgaaggaaacaggcgtgctctccgtgagctccttttctgcactcctggtgccctccagtaccttagtggagtgatcctctttgaggagactctctatcagaagactgcctctggcaaaccctttgtggatgttatgaaggaaggtggagttcttcccggaatcaaagtagacaagggcacagttgtgcttactggcactgatggtgaaactaccacccagggtcttgatggccttggtgaacgatgtgcaaaatactatgcagctggtgcccggtttgctaaatggcgtgctgtgcttaagattggccctactgagccatctgagttggcaatccatgaaaatgcatatgggttggcaagatatgcaatgatctgccaggagaatggccttgtccccattgttgagcctgagatcctggtggatggccctcatgatattgaaaagtgtgcttatgtaactgaacgtgttctggcagcatgctacaaagcactgaatgaccatcacgttctgcttgagggaactctgttgaagcctaacatggtgactcctggatcagaagccaagaaggtttccccagaggtggtggccgagtacactgttcggaccctccagcgaactgtgcctgcagctgttcctgctattgtgtttttgtctggggggcagagtgaggaggaggccactctcaacctcaatgccatgaacaagctcaaggggaagaagccatggaacctgtccttctcctttggacgtgcacttcagcagagcactctcaaggcctggtcaggaaaggaggaaaatgttgtgaaggccaggggagcattcctggtaaggtgcaaggcaaactctgaggccactcttggaacctacaagggtgatgccaaacttggagagggtgccgcggaaagcctccatgtcaaggactacaagtactgatgaagttttgggttcggtttgcttttctgtttttctctggagagtatatgcagtgcaggtatgggggacattaaaggtctcatctcaggcatcataggtttagggtgttttacgttatcttccggatctttttatgcttgtagttgaatggtggtagaataataagcttgaggagcgctgttgccttgttgagtttgaacgcttttcaattaaaactctgttaatgtgtttttccacctttaatatataaagtattgtcatttggaacaatca

SEQ ID NO: 1341 - DNA, 1877 bp, Zea mays
agatcccattttctgtctggtttctttccccttggccaagcccaagcccaaacccgggaaccccgtctttaaaaagtacaccctcgactcgtcctccgcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggagaacgtggagaaggctagagcggccttcctcgccaggtgcaaggccaactccgaggctaccctcggcacctacaagggtgatgctgccgccgacaccgagagccttcacgtcaaggactacaagtactgagttgcttctctttgcgatcccgttgttttggaactcctgcctgcgagtaggttgctgagtgttgtttgcttgttagagcttttatattcggacatgaaaaaaacatgcttcctatgtggatgatggttatctttatattcgtatattaactactagtctctgttgttaatttccgtgtaatttgctcctcccagatgggagaatcgaacgccgcttttttgttctatctgatattctgtatgctggagtcctattctttgggggtgtttggtttatagggactaaactttagtccctccactttattccatttctgttcataaattgttaaataaggaaactaaaatatagttttagtttctatatttaataatttagggactaaaatggaataaaatggagggactaaacattagtccctataaaccaaacacccactttatattgacctttggtatcggcaaaagccatttatatgctgagtggagaccaacttgttggatcatattttgctgagacgagaaactcacgagcacccactttttaccacttttaattgagttggttccgaacataccgatttacctattagtttatagatattagattcttaattttttaaaaaacaagaag

SEQ ID NO: 1342 - DNA, 1595 bp, Elaeis guineensis
cactactccgagaggcaagaagaagaggaaaggagagccgacgacgatgtctgcttactgtggaaaatatcgcgatgaactgattgccaatgcagcttacattgcgacccctggcaaggggattctcgcagctgatgagtccaccggcaccataggcaaacgtctcgccagcatcaatgtggagaacgttgaagccaatcgccgtgctttacgtgagcttcttttctgcacaccgggtgctctacagtacctcagcggtgtcatcctttttgaagagaccctttaccagaagacagctgatggaaaaccgtttgtcgaagtcctcaaggaaggtggggtcctccctggcatcaaggtagacaagggtaccgttgagcttgctgggaccaatggtgagaccacaacccaaggccatgatgatcttggcaagcgctgtgccaagtactatgaagcaggggctcgttttgctaagtggcgtgctgtcctgaagattggcccaaccgagccatcccagcttgcgatcaatgagaatgccaacgggttggctcgatatgccatcatctgccaggagaatggccttgttccaattgtggagcctgagatcctcgttgatgggccccatgatatcaatcgctgtgctgaggtgacagagcgggtgcttgctgcttgttataaggcactgaacgatcaccatgttctcttggaaggaagtttattgaagcccaacatggtgactcctgggtcagactcaaagaaggtagctccgaaggtagtggctgagtgcacggtgcgtgctctcttgagaactgtcccggcagctgttccagccatcgtcttcctttctggcggtcaaagtgaggaggaggctactttgaacctaaatgcgatgaaccagcttaaggggaagaagccatggtcgctctccttctcgtttggccgtgcgctgcagcagagcacgctcaagacatgggctggaaaacaggagaatgttgagaaggccagggctgctttcctttctaggtgcaaggcgaattcagaggccaccctaggggcatacgagggagatgctgccaagggagaaggtgtctcagagagcctccatgtcaaggactacaagtactgattctgattcctctaggtttctgatctgttgacgagtaatggagaaaagggcatgaggttgttagggtatttagtgtgtagtagtagtacttcagccactctgcaagtgtcttgtcagaattcaataacctgaggctttcggtgcctcggctggtatgagtcttcagaatgttcgcttctctcttttcccattccaactctaatggtttcttcgctgtaacaagggccttttcgagtacgagtatatgccatgtgtgattattgtctggctgtatcttgctgttcttgatgttcatgtcttcctatgattctggactttcaaaactagtgcatttaacttggttgtgttgtttttgcaagcttaatttcgactttggctgtatctcttcgagtcctgtttaatccctaatacaactattgtcaaagttgtgatcaattaacattacgtgaaaattacatcccccccggggggg

SEQ ID NO: 1343 - DNA, 1464 bp, Cynodon dactylon
agccagccgccttcgttttccctgcacatctccgacctccgtcgtcgcagttccctcctcccgcgcgcctcagacatggctggttccgcctacaacggcaagtacgccgaggagctgatcaagaacgctgcctacatcggcacccctggcaagggtatccttgctgctgatgagtccaccggcaccattggcaagcgcctttccagcatcaatgttgagaacgtggaggagaaccgccgtgccctccgtgagctcctcttctgcacccccggtgccctccagtacctcagcggtgtgatcctcttcgaggagaccctgtaccagaagaccaaggatggcaagccgttcgtcgatgtcctcaaggagggtggtgtcctccccggcatcaaggttgacaagggtaccatcgaggttgttggcaccgacaaggagaccaccacccagggccacgatgaccttggcaagcgctgcgccaagtactacgaggctggtgcccgcttcgccaagtggcgtgccgtcctcaagattggccccaacgagccatcgcagctggccattgacctgaacgcccagggtctggctcgctacgccatcatctgccaggagaatggtctggtgcccattgttgagcctgagatccttgttgacggacctcatgacattgagcgctgtgcctatgtcaccgagatggtccttgctgcctgctacaaggctctcaacgagcaccacgtcctccttgagggtaccctcctgaagcccaacatggtcacccctggctccgatgccaagaaggtgacccctgaggtcattgctgagtacaccgtccgtgccctccagaggaccgtccctgctgccgtgcccgccatcgtcttcctctctggtggacagagcgaggaggaggccaccctcaacctcaatgccatgaacaagctcaacaccaagaagccatgggctctgtccttctcctttggccgtgcccttcaggcgagcaccctcaaggcctgggctggcaaggaggagaaccttgagaaggccagggctgtcttcctcaccaggtgcaaggccaactccgaggctaccctcggcacctaccagggtggctctgccgccggtgaggcgcttgagagcctccacgtcaaggactacaagtactgatctgcctcgcctgttggctatcccttttggcatcctgcctaatatgtttaggttgctgagtgtgcactttggacatcaaatcaaacctgcgttttaataatcctgaacttatgattccctttgtggatgatcgtttcttttcattttcgtatattagtctttttcctgttataatcttctgtaagcctggccctggtcctgccgacggaagtcggagcagccacattttgttctgcgttcgtctatgtaatgctgatatatatttgcgaaaaccgttatatatatgctgagttggctggttttgctctg

SEQ ID NO: 1344 - DNA, 1345 bp, Platanus occidentalis
gtgtgtgaaaacaaatctccctaatccccgactccaacatgtcttgctacaagggaaaatatcatgatgaactcattgccaatgctgcttacattggcacccctgggaagggtatccttgctgctgatgagtccaccggtacaattggcaagcgtctatctagcatcaacgttgagaatgttgagtctaacaggagggccctccgtgagcttctcttctgcgccccaggtgccctccaatacctcagtggggtaatcctctttgaggagaccctctaccagaagactgcctctggtaagccttttgttgatgtccttaaggaaggtggagttcttcctggcatcaaggttgacaagggcacagttgaacttgccggcaccaatggtgagaccaccacccagggacttgatgggcttgcccagcgctgccagcagtattatgcggctggagcccggtttgccaaatggcgtgctgtgctcaagattggacccaacgaaccatctcaactggccattaacgagaacgctaatggactggcccgatatgccatcatctgccaggagaatggtctcgtcccgattgttgagcctgagatcctggttgatggtcctcatgacattgaccgctgtgcggatgtgaccgaacgtgtccttgcagcatgctacaaggccctgaatgatcaccatgttctgcttgaggggaccctgttgaagcccaatatggtgacccctgggtctgatgcaaagaaggttaccccagaggtggtagctgagtacacagtgcgagccttgcagaggacgatgcctccagcagtcccagctgtggtgttcctgtccggtggacagagtgaggaggaggcaactcttgaacctgaaatgccatgaacaagctcaaggggaagaagccatggtctctctcattctcctttggacgtgcgctacagcagagcactctcaaggcatgggcaggcaaggaggagaacgtggagaaggcacgggctgccttcctcacgagatgcaaggcaaactcagaggcgaccttgggtacctacaagggtgatgccgcacagggagaaggtgtctctgagagcctccatgtcaaggattacaagtactgatgaagtttttggttcttgtttatctctattttatttggagaggagactgtccgttttgaggcgtaaggttaaggttttattttacttctgagtgaaaggatgatggaataagtttgtagggatttgcttgaggagtttgaatgttttgtccttgaggtggaacttgtgtttttcctcaatggtatctatgtgtttctttttgttcattattaactgaatgtggctttc

SEQ ID NO: 1345 - DNA, 1417 bp, Saccharum officinarum
accattcctcccagcaacaccgcctcctctgcaatcctcctcgtagcctccgtcgagcatcgatcatgtcggcctactgcggaaagtacaaggatgagctcatcaagaatgctgcctacattggcaccgctggcaagggtatccttgctgctgatgagtccactggcaccattggcaagcgcctttccagcatcaatgttgagaacgtggaggacaaccgccgtgccctccacaagctccttttatgctgacctggtgccctcagtacatcagtggtgtgatcctcttcgaggagaccctctaccagaagaccaaggatggcaagccttttgttgatgtcctcaaggagggaggcgtcctacctggcatcaaggtcgacaagggcaccattgaggttgcaggcaccgacaaggagaccaccacccaaggccatgatgaccttggcaagcgctgcgccaagtactacgaggctggtgcccgctttgccaagtggcgtgctgttctcaagattggccccaatgagccatcgcagcttgcaattgacctgaatgctcagggtctggctcgctatgccatcatctgccaggagaacggtctggtgccgattgttgagcctgagatccttatcgatggccctcatgacattgatcgctgcgcttatgtcactgagaccgtccttgctgcctgctacaaggctctcaacgagcaccatgtcctcctggagggtaccctcctgaagcccaacatggtgactccaggctctgactctaagaaggtgacccctgaggtgattgctgcgtacactgtccgcaccctccagaggaccgtccctgctgctgtgcctgctgttgtcttcctctccggtggacagagcgaggaggaggccaccctgaacctcaatgccatgaacaagctcagcactaagaagccgtggtccctgtccttctccttcggccgtgccctccaggcgagcaccctcaaggcctgggctggcaaggtggagaacatcgagaaggctagggcggccttcctcgccaggtgcaaggccaactctgaggctaccctcggcacctacaagggtgatgctgccgctgacaccgagagcctccacgtcaaggactacaagtactgagttgcttctctttgcgtgcccgttttggaactcctgcctacgagctaggttgctgagtgtggtttgctcgtttgagcttatattcggacataaaaaaaaacatgcttcctatgtggatgatggttatctttatattcgtatattaactagtctctttggtgttaaatttcgtgtaatttggtactgccgatggagaatcgagcagtcccttttttttgttaaaactatgctgtaatgctgtttatgtatcggcaaaaaccattctatatgctgagtttggagaca

SEQ ID NO: 1346 - DNA, 1341 bp, Platanus occidentalis
tcttgtttcaagggaaagtatgctgatgaactcattaccaatgctgcctacattggcacccctgggaagggtatcctcgctgctgacgagtccactgggacaattggcaagcgcctttccagcattaatgtcgagaatgttgagactaaccggagggctctccgtgagcttctcttctgcacccctggtgctctccagtacctcagtggtgttatcctctttgaggagaccctctaccaaaagactgcctctggtaagcctttcgttgaagtcatgaaggaaggtggagttcttcctggtatcaaggttgacaagggcacagttgagcttgccggaaccaatggtgagaccaccacccagggacttgatggccttgctcagcgctgccagcagtactatgcagctggtgcccggtttgccaaatggcgtgctgtgttgaagattggtcctaccgagccatctcaactggccatcaatgagaatgccaatggactggccaggtatgccatcatctgccaggagaatggcctggtcccgattgttgagccagagatcctagtggatggtcctcacgatattgaccgatgtgcagatgtgacagagcgtgtcctggcagcatgctacaaggcactgaacgaccaccatgtgctgctcgagggaactctgttgaagcccaacatggtgacccctgggtctgatgcaaagaaggtttctccagaggtgatagcagagtacacagtgcgagccttgcagcggacggtgccggcagcagtccctgctgtggtgttcctgtcaggtggacagagtgaagaggaagctactcgcaacctgaatgccatgaacaagctcaaggggaagaagccatggtctctctcattctcctttggccgtgccctgcagcagagcactctgaaggcatgggcagggaaggaggagaacgtgaagaaggcacgagctgccttcctcacaaggtgcaaggcaaactcagaggcgaccctgggtacctacaagggtgatgcagtactgggagaaggtgtctcagagagcctccatgtcaaggactacaagtactgatgtagttttgggttctgttttagtgtatctgcataaatgagtaactaaggaaagaggaatggaaagaagagtggttttcttttttcagactgatggtaaggtttccttctccctagacttggtgagtagttaggatgaatctatgatggaataagtatttagggcttggttttttgagtttgaatgatgtcttatccttgagggtgaactagtgtttttcttcttatgatatgtatgtttctacttgtggactattataatcaatcg

SEQ ID NO: 1347 - DNA, 1325 bp, Musa acuminata
gggggttgcgctcctccaaacgctccgtctgtgcttctggctcgttctccttccgatcaccctctcgaatccaagatgtctgcctactgcagccagtttcacgatgagcttattgctaatgctgcctacattggcacccctgggaagggtatccttgctgctgatgagtccactggcacgataggcaagcgccttgcgagcatcaatgtggagaatgtcgaggagaaccgtcgtgctctccgtgagcttctcttttgcactcctggatctcttcagtacctgagtggtgtcatcctctttgaggagactctctaccagaagacagccgatggaaagctttttgtcgaagtcctcaaggagggtggagtccttcccggtatcaaggtagacaagggtaccgttgaacttgctggtaccaatggtgagaccaccacccagggtcacgatgacctgggcaaacgctgcaagaagtactatgaggcaggggctcgctttgccaagtggcgtgctgttctcaagatcagtccaaatgagccatcacaactgtcaattgatgcaaatgctaatgggttggcacgctatgctatcatctgccaggagaatggtcttgtcccaatcgttgaaccggagatccttgttgatgggccacatgatattgcaaaatgtgctgaggttacagagcgtgtgctggccgcatgctacaaggcgctcaatgatcaccatgtccttctcgagggaagtctgttgaaaccaaacatggtgacaccagggtcagaatcaaagaaggtagctcctgaggtggttgccgagtacaccgtgcgagctctccagaggactgttcctgctgctgtccctgcgatcgtcttcctctcaggagggcagagtgaagaggaggctactttgaacctgaatgccatgaacaagctgcaggggaagaagccatggtcactttccttctcattcggccgtgctctgcagcaaagtacactcaaggcatgggcaggtaaggtggagaatgtcgagaaggcgaggactgcattcctcaccaggtgcaaggcgaactcggaggcaacgctcggcacatacaagggtgatgctgcaggaggcgtaggcgtctcggagagcctccatgtcaaggactacaaatattgatcatgcatggttggtgagtcttcaaatagctttatcatgttgagagaatgtcaagtgggatccagtagctttgtgtctttgctgctaaataagttgcgatgtattatgccctgaaaccgttcaggtttttgttatccgtttttgtaatatctatcaaccattgcttgtaatcg

SEQ ID NO: 1348 - DNA, 1593 bp, Citrus clementina
atgcctcgctttctctacgaagccctcaccttctctctctctctctcttttaaaagccccccaaagccactctcgtctctgcataaaattcgctctctctgtttctccctctaacaaaacaaattttctatcttcaagtagatcaccatgtcttgcttcaagggcaaatacgccgatgagctcattaaaaacgctgcctacattggcacccctggaaagggtatccttgctgctgatgagtcaacaggcaccattggcaagcgtctatccagcatcaatgttgagaatgttgagtcaaacaggcgtgctctccgcgagctccttttctgcactcccggtgcccttcagtacctcagtggtgtcatcctcttcgaggagaccctctaccagaagactgctgctggcaagccctttgttgatgtcttgaaggagggtggagtcctccctggaattaaggttgacaagggtactgttgagcttgctggtaccaatggtgagaccaccacccagggtcttgatggcctcgcccagcgctgccagaaatactatgaagctggtgctcgttttgccaaatggcgtgctgttcttaagattggccctaatgagccttcgcagctggccatcaatgagaatgccaatggcctggcccgatatgctatcatctgccaggagaatggccttgttcccattgttgaacctgagatccttgttgacggtccccatgacatcaagaagtgtgctgatgtgaccgagcgtgttcttgctgcatgctacaaggctctgaatgaccaccatgtccttcttgagggtacccttttgaagcccaacatggtgacccctggatctgaagctcccaaagttacaccggacgtgattgctgaacacactgtccgggccctgcaacgcactatgcctgcagcagttcctgctgttgtgttcttgtctggtgggcagagtgaggaggaggctacccgcaaccttaatgccatgaaccagctcaagacgaagaagccatggtcactttccttctcctttggacgtgcacttcagcagagcactctcaaggcatgggctggaaaggaagagaatgtgcagaaggcccaggctgctttccttgtcaggtgcaaggccaactctgaggctaccctcggtacttacaagggtgatgcccagcttggtgaaggtgccgcagagtctctccatgtcaaggactacaaatactaagcacagttgaagctttgggtgttgtgctttatgaactttatgagagtaaatggcggtatgaacattaggttggcccattctcattcataattttagagctttttcatattaggtggagcaataaaaagcttgggaacttcggtttgagtggttttgatcaaaactaaactgaaaactgtgtatgcttttgtttttgtttttgtttttttttttcctttcccctaatggcactaaatttctgtgattttgtcacataattgataatgttttcttgtgcttattgctttcggttcttttctaatgcgttgctttctcacatgtgattatgtcatggctgattcgctgaataaatgaagaggtattttgaca

SEQ ID NO: 1349 - DNA, 1405 bp, Cucurbita pepo
caagtggcgataatctctctctctctaaaatccctttttgtgtctcccgaaccgcttaatataaacgcagagcggccggaattcttcgttcaattcactgctctctctctctctctgtttccatttctccactctgcttcttcaatcctcatttccgtttggaaaatgtcttccttcaagagcaagtaccaggatgagctcattgccaatgctgcctacattggcactcctggaaagggtatccttgctgctgatgagtcaactggtaccattggcaaacgtttagcgagtatcaatgtcgagaacgttgagtcaaatagacgtgctcttcgagaacttctcttcctcactcctggtgcccttcagtatctcagtggagttatcctgtttgaggagactctctaccagaagactgctgcaggaaagccatttgttgatgttttgaaggaaggcggtgtgttgcctggcatcaaggttgacaagggtactgttgaacttgctggtactaatggtgaaacaaccacccagggtcttgatggccttgcccagcgctgccaaaagtattacgaagccggtgctaggtttgctaagtggcgtgctgtgctcaagatcggtcctaccgagccctcacaattgtctatcaatgaaaatgcttatggattggctcgatacgctgctatctgccaggagaacggtcttgttccaattgttgagcctgaaattctggttgatggttctcacagcattgacaagtgcgctgaggtgaccgagcgtgttcttgctgcatgctacaaggccctcaacgatcaccacgtcctccttgaaggaactctattgaagcccaacatggtaacccctggatccgaggctgccaaggttgctccagaagtgatcgccgagtacactgttcgagctcttcaacgcaccgttcctgctgcagttcccgccatcgttttcttgtcaggtgggcagagtgaagaggaggcaactctcaacctgaatgccatgaacaagctaaagggtaagaagccatggtctttgtctttctcctttggccgtgcccttcagcagagtactctcaaggcatgggcaggaaaggacgacaatgtcgagaaggcccgagctgctttcctaacaaggtgcaaagcaaactccgaggcaacactcggaacttacaagggcgatgccgtgatcggtgagggcgcagctgagagtcttcatgagaaggattacaagtactaaaaattgttgttccgtgctgcttcggtgtagtatgttgagcatcttgagatgtgttttatgaatgtttaggtacaacaaataagccctttgaaggttagctttttgctgtgattgttgagtgtgctggttttctgtttcagttgtaaaggaaaagaaggaaaaa

SEQ ID NO: 1350 - DNA, 1586 bp, Citrus sinensis
atgcctcgctttctctacgaagccctcaccttctctctctctctcttttaaaagccccccaaagccactctcttctctgcataaaaatcgctctctctgtttctccctctaacaaaacaaattttctatcttcaagtcgatcaccatgtcttgcttcaagggcaaatacgccgatgagctcattaaaaacgctgcctacattggcacccctggaaagggtatccttgctgctgatgagtcaacaggcaccattggcaagcgtctatccagcatcaatgttgagaatgttgagtcaaacaggcgtgctctccgcgagctccttttctgcactcccggtgcccttcagtacctcagtggtgtcatcctcttcgaggagaccctctaccagaagactgctgctggcaagccctttgttgatgtcttgaaggagggtggagtcctccctggaattaaggttgacaagggtactgttgagcttgctggtaccaatggtgagaccaccacccagggtcttgatggcctcgcccagcgctgccagaaatactatgaagctggtgctcgttttgccaaatggcgtgctgttcttaagattggccctaatgagccttcgcagctggccatcaatgagaatgccaatggcctggcccgatatgctatcatctgccaggagaatggccttgttcccattgttgaacctgagatccttgttgacggtccccatgacatcaacaagtgtgctgatgtgaccgagcgtgttcttgctgcatgctacaaggctctgaatgaccaccatgtccttcttgagggtacccttttgaagcccaacatggtgacccctggatctgaagctcccaaagttacaccggacgtgattgctgaacacactgtccgggccctgcaacgcactatgcctgcagcagttcctgctgttgtgttcttgtctggtgggcagagtgaggaggaggctacccgcaaccttaatgccatgaaccagctcaagacgaagaagccatggtcactttccttctcctttggacgtgcacttcagcagagcactctcaaggcatgggctggaaaggaagagaatgtgcagaaggcccaggctgctttccttgtcaggtgcaaggccaactctgaggctaccctcggtacttacaagggtgatgcccagcttggtgaaggtgccgcagagtctctccatgtcaaggactacaaatactaagcacagttgaagctttgggtgttgtgctttatgaactttatgagagtaaatggcggtatgaacattaggttggcccattctcattcatagttttagagctttttcatatttaggtggagcaataaaaagcttgggaacttcggtttgagtggttttgatcaaaactaaactgaaaactgtttatgcttttgtttttgttttttttttccttttcccctaatggcgctaaatttctgtgattttgtcacataattgataatgttttcttgtgcttattgctttcggttcttttctaatgcgttgctttctcacatgtgattatatcttggctgattcactgaataaatgaagaggtattttgaca

SEQ ID NO: 1351 - DNA, 1556 bp, Citrus sinensis
cacgcgtccggttttaaaagccccccaaagccactctcgtctctgcataaaaatcgctctctctgtttctccctctaacaaaacaaattttctatcttcaagtcgatcaccatgtcttgcttcaagggcaaatacgccgatgagctcattaaaaacgctgcctacattggcacccctggaaagggtatccttgctgctgatgagtcaacaggcaccattggcaagcgtctatccagcatcaatgttgagaatgttgagtcaaacaggcgtgctctccgcgagctccttttctgcactcccggtgcccttcagtacctcagtggtgtcatcctcttcgaggagaccctctaccagaagactgctgctggcaagccctttgttgatgtcttgaaggagggtggagtcctccctggaattaaggttgacaagggtactgttgagcttgctggtaccaatggtgagaccaccacccagggtcttgatggcctcgcccagcgctgccagaaatactatgaagctggtgctcgttttgccaaatggcgtgctgttcttaagattggccctaatgagccttcgcagctggccatcaatgagaatgccaatggcctggcccgatatgctatcatctgccaggagaatggccttgttcccattgttgaacctgagatccttgttgacggtccccatgacatcaacaagtgtgctgatgtgaccgagcgtgttcttgctgcatgctacaaggctctgaatgaccaccatgtccttcttgagggtacccttttgaagcccaacatggtgacccctggatctgaagctcccaaagttacaccggacgtgattgctgaacacactgtccgggccctgcaacgcactatgcctgcagcagttcctgctgttgtgttcttgtctggtgggcagagtgaggaggaggctacccgcaaccttaatgccatgaaccagctcaagacgaagaagccatggtcactttccttctcctttggacgtgcacttcagcagagcactctcaaggcatgggctggaaaggaagagaatgtgcagaaggcccaggctgctttccttgtcaggtgcaaggccaactctgaggctaccctcggtacttacaagggtgatgcccagcttggtgaaggtgccgcagagtctctccatgtcaaggactacaaatactaagcacagttgaagctttgggtgttgtgctttatgaactttatgagagtaaatggcggtatgaacattaggttggcccattctcattcatagttttagagctttttcatatttaggtggagcaataaaaagcttgggaacttcggtttgagtggttttgatcaaaactaaactgaaaactgtttatgcttttgtttttgtttttctttttttttcctttcccctaatggcactaaatttctgtgattttgtcacataattgataatgttttcttgtgcttattgctttcggttcttttctaatgcgttgctttctcacatgtgattatatcatggctgattcgctgaataaatgaagaggtattttgaca

SEQ ID NO: 1352 - DNA, 1281 bp, Cucumis sativus
cttcttcaactttcaatcctcgtttccattccaatatgtcttccttcaagagcaagtaccaggatgagctcatagccaatgctacctacattggcactcctgggaagggtatccttgctgctgatgaatcaactggtaccattggtaaacgtctagcgagtatcaatgtagagaatgtcgagtccaaccgacgtgcactccgggaacttctcttcctcactcccggtgcccttcaatatctcagtggagttatcctgtttgaggagactctctaccagaagacagctgcaggcaagccatttgttgatgtcttgaaggaaggtggtgtgttgcctggcatcaaggttgacaagggtactgttgaacttgctggtactaatggtgaaacaaccacacaaggtcttgatggtcttgctcagcgctgccaaaagtactatgaagccggtgctaggttcgccaaatggcgtgcagtgctcaagatcggtcctactgagccttcacaattgtctatcaacgagaatgcctatggattagctcggtatgctgctatctgccaggagaatggtcttgttcccattgttgagcctgagattctggttgatggacctcacagcattgagaaatgtgctgaagtgacagagcgtgttcttgctgcgtgttacaaggccctgaacgatcatcacgtccttctcgaaggaactctgttgaagcccaacatggttacccctggatctgaagctgctaaggttgccccagaggtgattgctgaatacacgattcgggctctacaacgtactgtccctgctgcagttccagccatcgttttcttgtcaggcgggcagagtgaggaggaagcaaccctcaacctcaatgccatgaacaaactgaagggaaagaagccatggtcgttatctttctcgtttggacgtgcccttcagcagagtactctcaaggcatgggcaggaaaggaggagaatgttgagaaggcaagggctgctttcctcacaaggtgcaaggcgaactcggaggcaaccctcggaacatacaagggtgatgcagagctcagtgagggtgcggcagaaagtcttcatgtaaaggattataagtactgaaaagggttttattttgctgtttctattgttattctgttttgttttagtttgtttaattaagcatgaggtaaaagagcattctgacatgtgttgatgaggctcatcagggacaacaataagccttttgaagaagcttttttgttttgttttgttttgttttcttttcttt

SEQ ID NO: 1353 - DNA, 1632 bp, Aristolochia fimbriata
ggcgatgtggggcccgctctcgtgacggatgacgacattttcgatgccacccgtctacgaatcactttttccgtcgcctccttaaaaagggccttcgtcgccctgccatttcggtgcgttgcgttgcatagtcctctgttattttcccttccagccgcttctgttgtttgttgttctctctggaactctctaccaaggggaggaagatgtcggcttaccgtggaaaatacgctgacgaactcattaagaatgctgcctacattggcactccgggcaagggtattcttgctgctgatgaatctaccggcactattggcaaacgcctttctagcatcaatgtggagaacgttgagactaaccgcagggcccttcgtgagctcctcttctgcactcctggtgccctccagtatctcagtggtgtgattctcttcgaggagaccctttaccagaaaactgcctcaggcaagcctttcgtggatgtcatgaaagaaggcggtgtcctccctggtatcaaagttgacaagggaaccgttgagctggccggcaccaacggcgagaccaccacccagggccacgatggtctcgcccagcggtgccagcagtactatgctgctggagctcgctttgccaaatggagggctgtcctgaagattggcccgaatgagccttcccagcttgcaatcaacgagaacgccaatggattggcgcgctatgccattatctgccaggagaacggtctggttccaattgtggaacccgaaatcttggttgatggaccgcacgatatcaagcgttgtgctgaagtcaccgagcgagtccttgctgcctgctacaaggcacttaacgaccacaaggtactcttggagggcactctcttgaagcccaacatggttactccaggatccgagtctaagaaggtagctcccgaggtggtggccgagtacaccgtcagcgcactccagaggacagttccggcagcagtccctgccatcgtgtttttgtctggaggtcagagcgaggaagaagcaactttgaacttgaacgcgatgaaccagtatcaggggaagaagccatggagcttgtctttctcgtttggacgggctctccagcagagcacactcaagacctgggccgggaaggaggagaacgtcgagaaggctcgggcagcgttcctttcccgctgcaaagcaaattcggaggcgacattgggcacatacaagggagatgcggccaagggcgagggcgtctctgagagcctccatgtcaaggactacaagtactgatctgcttttcttttcctgtataagtgcatggggtagtgagagaggtcagactctccagttgcttttttatttgaactttgggctgctcgagggaaaataagttttgttacataaagttgaggctttgttgattacagataaaacacagtttcttcgatatctggaattagaattgttttttcagtaacaatttcaccatgttgtggaagtctttccttcgatgttgtgtttaaatatgtcccgccttcggcggtggagagatgtgttttgcagtttggaataaaaaaacaaaaaaaaaaaaaaaaaaacaaaaaactgagacacgacaagagggatagacgaaggcaca

SEQ ID NO: 1354 - DNA, 1354 bp, Chelidonium majus
atcctctctcccaagaaatctctctgtttctccaacccaacatcatgtcttgctacaagggaaagtaccatgatgagcttattgccaatgctgcctacattggcactcctggaaagggtatccttgctgctgatgagtccactggaacaattggaaagcgtctttccagcatcaacgtcgagaatgttgaatcaaacaggcgtgctcttcgtgaacttctcttctgcactcctggtgctcttcaatacctaagtggtgttattctttttgaagaaactctttaccagaaaactgctgctggtaagcccttcgtagatgttctcaaggaaggtggtgttctccctggtattaaagttgacaagggtaccgttgagctagctggaaccaatggcgaaaccacaactcagggtcttgatggccttgctcagcgttgccagcaatactacgctgctggtgcccggttcgccaagtggcgtgccgtgctcaatattggtcctaatgaaccatctcaattggccatcaatgaaaatgccaatgggttagctagatatgccatcatctgccaggagaacggattggtcccaattgttgaaccagaaatccttgttgatggttctcacgatattgacaggtgcgctgatgttaccgagcgtgttcttgctgcttgttacaaggctttgaacgaccaccatgtcctcctagaaggaactcttttgaagcctaacatggtgactcctggttctgactccaagaaggtttcccctgatgttattgctgagtacacagtccgtactcttcaacgcaccatgcctgctgcagttcctgctgtggtgttcttatcaggtggacagagtgaggaggaagccacgctaaaccttaacgccatgaacaagctcaacgcaaagaagccatggtcactctcattctcttttggaagggctcttcaacagagcactctaaagacatggggagggaaagatgagaatcttgagaaggcacaggctgctttcttggctaggtgcaaggcaaactctgaagctactctcgggacatacaagggtgatgctgctaaggttgaaggtgcatcagaaagccttcacgttaaggactacaagtactaattcaacaatgcttttttgttctgttttgataagtagtagagaaggaaatggagggaggtttttcccttctttcgctatggctttttttttctgcagtaggaaaagattgtgtgaaataagtctggacttgggtaaggaggggcatggcatggttggtttgaataatgtttgcactcatggtgaaccgtggttatgacctaagactgtttttattaaatagtaattgtgtttac

SEQ ID NO: 1355 - DNA, 1343 bp, Humulus lupulus
tctctaccagtattttctctaatcttcctctctcaaattttgtaatcgaaaatgtcttgcttcaagagcaaataccaagatgagctcattgccaacgctgcttacatcggtacccctggaaagggtatccttgctgctgacgagtcaactggcaccattggcaagcgtctttctagcatcaatgtagagaatgttgagtccaacaggcgtgcacttcgtgagcttcttttcaccactcctggaggccttgaatgcctcagtggtgtcattctttttgaggaaactctctaccaaagcactgctgctggtaagccttttgttgacgtgttgaaggagggtggagtcctgccaggaattaaggttgacaagggtacagttgagcttgctggaaccaatggtgaaaccaccactcagggtcttgacggccttggtgcaagatgccagaagtactatgaagccggtgctcgatttgccaagtggcgtgctgtgcttaagattggtcccaacgaaccttctcagttgtccatcaatgaaaatgccaatgggttagctcgctatgctgccatatgccaggagaatggtcttgtccccattgttgagcctgagatcctggttgatggaccccattccattgagcagtgcgccgatgtcactgaacgtgttcttgctgcatgctacaaggcactcaatgatcaccatgtccttctcgagggaactcttttgaaacccaacatggttacccctggatcagaagccaaaaaggttgcaccagaggtgattgcagaatacacagttcgtgccctgcaacgcaccgtgcctccagctgttcctgctattgtgttcttgtctggtggacagagtgaggaggaagctaccgttaatctcaacgccatgaacaagctccagacaaagaagccatggtcactatccttctccttcggacgtgcactccagcagagcacactcaaggcatgggccggcaaagaagaaaacatcccaaaagctcaggccgctttcctcaccagggccaaggccaactcccaggcaacccttggaacttacaagggtgacgccactctgggcgagggtgcctcagagagccttcatgtcaagggctacaaatattaagcaagtcatgggctttgagctcaattttgtgttttgttttggtgactgcattgcgcagtatgggtttaagactctggtgttatctcaggcatagagttaagactctttaaaaatcttattttctgatctcgagtttgtgtagagggatgttggtattggtattaataagcttgaggacagtatagctgtagcggtgagtatgccgacggtatttt

SEQ ID NO: 1356 - DNA, 1389 bp, Curcuma longa
ttgcttgtgattctctcgtcttctagttcgagatgtctgcctactgcggccaatatcatgatgagcttattgccactgctgcttacattggtactcctggcaagggtatccttgctgctgatgaatccactggcactataggcaagcgccttgcaagtatcaatgtggagaatgtggaggagaaccgtcgtgcactgcgtgagcttctctttttgactcctggagccctccaatatctcagcggtgtgatcttcttcgaggagactctctaccagaaaactgctgatggcacaccctttgttgatgtactcaagaagggtggagtcattccaggcatcaaggtagacaagggcactgttgaacttgctggcaccaatggcgagaccactactcaagggcatgatgaccttggcaagcgctgcaagaagtattatgaggcaggggctcgttttgccaagtggcgtgctgtactcaatattggccccaatgagccatcgcaattgtctatcgatgcaaatgcaaatggattggcacgctatgctatcatctgccaagagaatggccttgtcccaattgtggaaccagagatccttgtcgacgggccacatgacatagcaaaatgtgctgatgttacagaacgggtgctagctgcgtgctacaaggccttaaatgatcaccatgtgcttctggaaggaaccctcttaaaacccaacatggtgactcctgggtctgaatctgcaaaggtggctcctgaggtgattgctgagttcactgtgcgagctctccagaggactgttcctcctgctgttcctgctattgttttcctttcaggaggacagagtgaagaggaggctaccttgaacttgaatgccatgaacaagctgaaggggaagaagccatggtcactttctttctcgtttggtcgtgccctgcagaaaagtacactcaaggcatggcaagggaaggcggagaatgtggagaaggcaaggatagccttccttgcccggtgcaaggcaaactcagaggcaactcttggcgtctacaagggtgatgctgcaggaggtgaaggcgtctcagaaagcctccatgtcaaggactataagtactgatcatgtttgttcattttgaatccgaatgtcatgaaggacattcaagtttgagatatttgccaacctagggatctttcccgctgctgcttgatgtgcttctaaataagtagggttgcattgtgccactaaacttacaatgcttggatattagttctttctttgtactgctcgtttgtattccttacaagactggttttggttgagtttggttctgttcggctcagagatgctgctctcttttcttcacttcagtaatatggtcgaccatctagtttcaacc

SEQ ID NO: 1357 - DNA, 1451 bp, Prunus persica
cctccaagccgcactaacataaaaagccccacccacccttcactttctcccatctcactctctctatctctaagaaaaaccagtcttcttcctcttaagccttagcatcaaccatgtctgctttcaggggcaaatacgctgatgagctcattgccaatgctgcctacattggcacccctggaaagggtattcttgctgctgatgagtcaactggaacaatcggcaaacgttttgccagcatcaatgttgagaatgttgaatcaaacaggcgtgctcttcgtgagctcctcttcaccgcccctgatgtgctccaataccttagtggagtgattctctttgaagaaactctctaccagaagacagcctcaggcaagccattcgttgatgtcttgaaggaaggaggtgttctacctggaatcaaggttgacaagggcaccgttgagcttgccggaaccaatggtgagaccacaacccagggtctagatgggctcgcccagcgttgccaaaagtactatgaagctggtgccaggttcgcaaaatggcgtgctgtcctcaagattggtcccaatgagccatctcagctgtccattaacgaaaacgctaatggcttggctcggtatgctatcatttgccaggagaatggcctagtccccatcgttgagccagagatcctggttgatggaccccatgacatcgagaagtgtgctgatgtgactgagcgtgttcttgctgcatgctacaaggctcttaatgaccaccacgtcctccttgaaggaactctcttgaagcccaacatggttactccaggatctgatgccaagaaggcttcacccgaagtgattgctgagtacacagtccgtgccttgttgcgcactacccctgcagctgtccctgctgtggtgttcttgtctggtggccagagtgaagaggaggctaccctcaaccttaatgccatgaacaagctcaaggggaagaagccatggtctctttccttctcattcggaagggctcttcagcagagcacacttaaagcctgggcaggaaaggaggaaaacattggaaaggcacaggctgctctcctcacaagggccaaggccaactcagaggctaccctcggaacatacaagggtgatgcaaagcttggtgaaggcgctgccgagagtcttcatgttaaggattacaagtactgaagaaatttacagttcttgcttctcttgttttgtttttggaaaactattttgcggtatgtgtatgactctgtcattctcgggcgtatagtgttagggatttttcaaatttctgttcttgctctcggtttttaggatgttggtagaataagaagcttgaggacgattggcatatgttgagtttgataaatgttctctttccccttcaaaagaaccgtttatgttttttattatttcctgaatgaagatcaggattctattttc

SEQ ID NO: 1358 - DNA, 1469 bp, Aristolochia fimbriata
aagcagtggtaacacgcatccgacgcgggggcagctcgattccttcgttccttctcctcggccctatccagacgcagtcactctcagtgagcccttgccctaccagattcagaaaccatgtctgcctatcgtggaaaatacgccgatgagctcatcaagaatgctgcctacattggtactcctggcaagggaatcctggctgcagatgaatctactggtaccattggcaagcgacttgcgagcatcaatgttgagaatgttgagtccaatcgtcgagccctcagggagcttcttttttgtgctcctggagctttgcaatacctgagtggtgtgatcctatttgaagaaaccctctaccagaagactgcctcagggaaaccttttgtggatgtcctcaaagaagggggagtccttcctggtattaaggttgacaaaggcacagttgagcttgctggcactaatggtgagactaccactcagggtcatgatggccttgcacaacgttgccagcagtactatgctgcaggtgctcgctttgccaagtggagggctgtcctgaagattggcccctatgaaccatcacaattagcgatcaatgagaacgccaatgggttggctcgatatgctatcatctgccaggagaatgggctggtgccaattgtggagccagaaatattggttgatggaccccatgacattaatcgctgtgctgaagtgactgaacgggttcttgcagcgtgctacaaggctttgaatgatcacaaggtgcttcttgaagggactcttctgaagcccaacatggtgactccgggttccgagtctaagaaggtgacccctgaagtggtggctgagtacactgtgcgagctctgctgaggacagtcccagcagctgtgccggcaattgtgttcttgtcaggtgggcagagtgaggaggaggccaccttgaacttgaacgccatgaaccagtttgaggggaagaagccatggagcctctcattttccttcggaagggccctgcagcaaagcaccctcaagacatggcaagggaaggaggagaatgtaggaaaggctagagcagcacttttgtctcgttgcaaggcaaactcagaggcaacattgggcaagtacaagggcgacgctgcaacggtggaaggtgcctctgagagtcttcacgtgaaggactacaagtactgatcacccattttttccttttctatctattttctagcgagggtaggtactagcgtgtggaagagtggtttctctttgtagaagtcttaaagaattttatccgatggtattgaggatgcgtgagatgaataaatagcttctttttaggtcaaatttgttggagagtgattaaaagaatttctcgtggctctgcatgggtttattcgatatcgtgtttctttttggagtatgagaaataaacccatagtgggttccttctgggttcctctaaaaaagaa

SEQ ID NO: 1359 - DNA, 1457 bp, Euonymus alatus
gtttgtctctcgtctacgccttcgaaattccatttactctcctttcgtcctcttcaatcagtttaccatgtcttgcttcaagggaaaatacaccgatgagctcattgccaatgctgcctacattggtactcctggtaagggaattcttgccgcggatgaatcgactgggacaatcggaaagcgtctggcaagcatcaacgttgagaatgttgaagcaaataggcgtgctctgcgtgagctcctattcacagcccctggtgccctccaatgcctcagtggtgtcattctctttgaggaaaccctgtaccagaatactgcagcaggcaagccctttgttgatgtgttgaaggaaggtggagtgctacctggtattaaggttgacaagggcaccgttgagcttgccggaaccaacggtgagacgacaactcaaggtcttgatggccttgctcagcgttgccagaagtactatgaagctggtgctcggtttgccaagtggcgtgctgtgttgaagattggtccaactgagccatctcagctggctatcaatgagaatgccaacggtttggctagatatgctatcatctgccaggagaatggtcttgttccaattgttgagcctgagatcctggttgatggtccccatagcattgagaagtgtgctgatgtgactgagcgtgtgctcgctgcatgttacaaggctttgaatgatcaccatgtcctgcttgagggtactctgttgaagcccaacatggttacccctggatcggatgcacctaaggttgcacctgaggtgattgctgagcacacagtgcgtgctttacagcgaaccgtccctgcggcagttcctgctattgttttcttgtctggtgggcagagtgaggaagaggctaccgtcaacctcaatgctatgaacaagcttaaggggaagaagccatggagcctttccttctcatttggacgtgccctccagcagagcactctcaaggcctgggctggcaaggaggagaacgtgaaggcggctcaagctgcactccttaccaggtgcaaggctaactctgaggcaactcttggtacctacaagggtgattctaagcttggtgagggtgcctctgaaagcctccacgtcaaggactacaaatactaggaagttccggctttttggtccagtttgtgtgttatgttttgtggagcaaattaggttgtcctacactcgtattctctgaagcttagttttagattatattctcatctttcccagtggaattcaccgaggtaggataattaaggttgaggcttgtatgtattttccttgttcctcctagtggaggttcatgaccggggacttccttttagattatgttttctcgttgtggtttgttttcttctaaattctcccccattgaagttgatctctctgggtgtgcaatgtgctacctttagataagaggaaggctgtt

SEQ ID NO: 1360 - DNA, 1449 bp, Lippia dulcis
atgtacacactctcactttctctctacccttctgtcgttttctcgctgctccgaattctattgctgtaatcatgtcttgctacagggggaaatatgctgatgagctgattgccaatgctgcatacattgggaccccgggaaagggtatccttgctgctgatgagtctactggcaccattggcaagcgtctatccagcatcaatgttgaaaatgtcgaatcaaacaggagggcccttcgtgagcttcttttcaccacccctggtgcccttcagtacctcagtggagttattctctttgaggaaactctataccagagcactgctgcaggtaaaccctttgttgaggtcttgaaggaaggcggtgtcctccccggtatcaaggtcgacaagggtacagttgagcttgcaggcaccaatggtgaaaccactacccaaggtcttgatggtcttgcccagcgctgccaaaagtattacgaagccggtgcccgttttgccaaatggagagctgttctcaagattggccctaacgagccatcccagcttgccatcaatgaaaacgccaacggtctagcccgttatgccatcatatgccaggagaacggcttggtacccattgttgagcctgagatccttgttgacgggccccatgacattaacaagtgcgcagatgtaacagagcgggtccttgctgcttgctacaaggccctcaatgaccaccacgttctccttgagggaactctattgaagcctaacatggttacacctggctcagacgcagcaaaggttgcccctgaggttatagccgagtacacagtccgtgccttgcagcgcacgatgcctgctgctgttcctgcagtggtgttcttgtccggtggacagagtgaagaagaggccacagtcaaccttaatgccatgaacaagctgaagaccaagaagccttggtcgctgtccttctcattcggacgtgctctccaacagagcactctcaaggcttgggctggaaaggaagagaacgttccaaaggctcaggctgcattccttgcgagggccaaggccaactctgaagcaacacttggaacttaccagggttcttcttctttgagtgagggtgcctctgagagcctccacgtcaaggactataagtactaggttgagttttgggtttcctccttggtttttctgcgtttgtgtggagagcatataatcaaaactagtttgtagactttggctgcatatttatatgctttgttatccttttatgtttttgtagacctgtgttttaataagcttgaggaacatcggagctgtgagattgttgtgttcttttgttatctgcggcttttttttacgtgtaccttatcctgttacttgccgtttatggctcattcaaacttgcccatcatttttgtagttggttaaaagtattattttgtctagtactaaaaaaaag

SEQ ID NO: 1361 - DNA, 1555 bp, Malus domestica
ctttcgagccggattcacataaaaagcctcacccacccttcactttcttccatctttctctttatctctcagaaagcaaccaactcgtcttcttcttcctctcaagtcttcagcatcattcaaacatgtctgcttacagaggcaaatacgctgatgagcttatcgccaatgctgcctacattggcacccctggaaagggtattcttgctgctgatgagtcaactggcacaatcggcaaacgttttgccagcatcaatgttgagaatgttgaatcaaacaggcgtgctcttcgtgagctcctcttcactgcccctgatgtgctccaataccttagtggagtgatcctctttgaggaaaccctctaccagaagactgcttcaggcaagccattcgttgacgtcttgaaggaaggtggtgttctccctggtattaaggtcgacaagggtaccgttgagctcgccggaaccaatggtgagaccacaacccagggtcttgatggccttgcccagcgctgccagaagtactatgaagccggtgcacggtttgcaaaatggcgtgctgtgctcaagattggccccaatgagccatctcagctgtccattcaagagaacgctaatgggttggctcgttatgctatcatctgccaggagaatggtctagtcccaatcgttgagccagagatcctggttgatggaccccattccatcgataagtgtgctgatgtgacagagcgcgttcttgctgcgtgctacaaggctcttaatgaccaccatgtcctcctcgaaggaactctgttgaagcccaacatggtcactccaggatctgatgccaagaaggcttcaccagaagtgattgccgagtatacggttcgtgccttgttgcgcactacccctgcagctgtccctgctgttgtgttcttgtccggtggacagagtgaggaggaggctaccctcaaccttaacgccatgaaccaactcaagggaaagaagccatggtctctatccttctccttcggacgtgctcttcagcaaagcacactgaaggcatgggcagggaaagaggaaaacatcccaaaggcacaggctgctctcctcacaagggccaaggccaactctgaggctactcttggaacctacaagggtgatgccaagctcggtgagggtgccgctgagtctctccatgtgaaggattacaagtactgaaaaaatttacagttcttgcttctcttgttttggttttggaaaactatcttgcggtatgtgtatggcttttgtcattctcgggcgtatagtgttagggtttttttcggatttctgttcttgatctctctgattttaggacggtggtagaataaaaggcttgaggaccattggcatatgttgagtttgaaaaatgtttccttttcttgttcaaaagaactgtgtaggttcttttttattgcctgaattgaaggtaagcattctaatttccaaaatccagtttttgtgtatttgattctgctcttaattacccttatttcttgaatggttatatgcgtgttcgttgtcttgtcttt

SEQ ID NO: 1362 - DNA, 1421 bp, Malus domestica
ctcagaaagcaaccaactcgtcttcttcttcctctcaagtcttcagcatcattcaaacatgtctgcttacagaggcaaatacgctgatgagcttatcgccaatgctgcctacattggcacccctggaaagggtattcttgctgctgatgagtcaactggcacaatcggcaaacgttttgccagcatcaatgttgagaatgttgaatcaaacaggcgtgctcttcgtgagctcctcttcactgcccctgatgtgctccaataccttagtggagtgatcctctttgaggaaaccctctaccagaagactgcttcaggcaagccattcgttgacgtcttgaaggaaggtggtgttctccctggtattaaggtcgacaagggtaccgttgagctcgccggaaccaatggtgagaccacaacccagggtcttgatggccttgcccagcgctgccagaagtactatgaagccggtgcacggtttgcaaaatggcgtgctgtgctcaagattggccccaatgagccatctcagctgtccattcaagagaacgctaatgggttggctcgttatgctatcatctgccaggagaatggtctagtcccaatcgttgagccagagatcctggttgatggaccccattccatcgataagtgtgctgatgtgacagagcgcgttcttgctgcgtgctacaaggctcttaatgaccaccatgtcctcctcgaaggaactctgttgaagcccaacatggtcactccaggatctgatgccaagaaggcttcaccagaagtgattgccgagtatacggttcgtgccttgttgcgcactacccctgcagctgtccctgctgttgtgttcttgtccggtggacagagtgaggaggaggctaccctcaaccttaacgccatgaaccaactcaagggaaagaagccatggtctctatccttctccttcggacgtgctcttcagcaaagcacactgaaggcatgggcagggaaagaggaaaacatcccaaaggcacaggctgctctcctcacaagggccaaggccaactctgaggctactcttggaacctacaagggtgatgccaagctcggtgagggtgccgctgagtctctccatgtgaaggattacaagtactgaaaaaatttacagttcttgcttctcttgttttggttttggaaaactatcttgcggtatgtgtatggcttttgtcattctcgggcgtatagtgttagggtttttttcggatttctgttcttgatctctctgattttaggacggtggtagaataaaaggcttgaggaccattggcatatgttgagtttgaaaaatgtttccttttcttgttcaaaagaactgtgtaggttcttttttattgcctgaattgaaggtaagcattctaatttccaaaatccagtttttgtgt

SEQ ID NO: 1363 - DNA, 1409 bp, Persea americana
ccaaaacaacaatctaacaagccatctcttcttcttctcaacacaaacacgatcatgtctgccttctgtggaaaatatcaggatgagctcattgcaaatgctgcctacattggcactcctggaaagggaatcctcgcggcggatgagtccactggcacaattggtaagcgcctggcaagcattaatgtggagaatgttgaatccaaccgtcaggccctccgtgagctcctgttctgtactcctggtgctcttgagtgcctcagcggtgtgattctttttgaggaaactttgtaccagaagactgcatctggtaagccctttgtcgacgtcctcaacgaaaggggtgtcctgcccggcatcaaggttgacaagggtactgttgaactagccggcaccaacggggagaacaccactcagggtcttgatggcctggcacaacgttgccagcagtactattccgctggggcccgatttgcaaagtggagggctgttctcaagattagccctaatgagccatcccagttggcaattaatgagaacgccaatgggttggcgcgttatgccatcatctgccaggagaatgggctagtcccgattgttgaaccagaaatcctggttgatgggtcccatgacattgaccgatgtgcggatgtgacggagcgggtgctagctgcctgctacaaggcactgaatgaccaccatgttttgctggaagggacattgctgaagccaaacatggtgacccccgggtcagatgcaaagaaggttacaccggaggtgatagccgagtacactgtgagggcgctgcagaggaccacgcctgctgcagtgcctgccattgtcttcttgtcaggtgggcagagtgaggaggaggcaacactgaacttgaatgccatgaacaagctgaagggaaagaagccttggagcctgtcgttctcttttggccgtgcactgcagcagagcactctcaagacgtgggctgggaaggaggagaatgttaagaaggctcagtctgctttcttgtcccgctgcaaggcaaactcagaagccaccttgggaacttacaagggtgatgctgcaaagggagaaggtgtttctgagagtctccatgtcaaggattacaagtactaatttgggttatttgtgcaagagaagttttcgttttgtttagacattagaaacagaataagccatgggatgatatggcagttttgggcacgtttgatgtccttgtgctcttcattgaggtctgtttttgtctctgtttttatgtgttgacttgttttaacgcaggttcattcaggtcattttgcttattgtacttctattatgactgttacttgtggtgtggaggctactgattatgttttctaagatatattttgttcatggtttgttttttctcataa

SEQ ID NO: 1364 - DNA, 1090 bp, Triticum aestivum
gcctccctccctccctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcacctcaagcctggtccggcagacggaaaacgagagatgccagacggcgttcctggtgaagtgcaagtcaactccagcacacttggcactaaaggcgaagccacc

SEQ ID NO: 1365 - DNA, 1998 bp, Setaria italica
ttccgctataaacatgtatcaatcatcacgataatcagcaataaataggtagcaatcctttcatctattaacaagtatcacagcatgtatagctgatgctcaacaaacaagctcagatctttttcttacagtcaggaacaaagagcacaaactacaaaagaaccaaaagaaactgactgtgtggtgtcaagccttattgaatatttgaattcacggtatatgtgcatgaacgattcctgttacccaaaaatatgggcaacatggatggtaatcagtgtcagtcatatcaagctcataggccaccttcagatggtgataaccctggatctctcgggagacaagtcttgctccaccaatggaccagtggaagaggtgaccacgaacccatcaactctggccgctgtatccatatcgattgttactacgctcaaccctcttccaatcacgtaaatcttcctgccgatagccacgagctggcatgggggccttgtaaccttgtccgagagcctgccaaaccatcccctccccgaatctcccctcgcaatccccgtagcctccccgcgagcatcgaccatgtcggcctactgcggcaagtacaaggatgagctcatcaagaacgctgcctacattgggggtatccttgcagctgatgagtccactggcaccattggcaagcgtctctcaagcatcaacgttgagaacattgaggagaaccgccgtgccctccgtgagctcctcttctgctgccctggtgccctcccgtgcctgagtggtgtgattctcttcgaggagaccctgtaccagaagaccaaggatggcaagcccttcgtcgatgtcctcaatgaaggaggtgttctccccggcatcaaggtcgacaagggcaccattgaggttgctggcactgacaaggagaccaccacccagggccatgatgaccttggcaagcgctgcgccaagtactacgaggctggtgcccgctttgccaagtggcgtgctgtcctcaagatcggccccaatgagccatcgcagcttgccattgacctgaacgctcagggtcttgctcgctatgccatcatctgccaggagaatggtctggtgccgattgtggagcctgagatcctcgtcgatggctctcatgacattgagcgctgtgcttatggtccttgctgcctgctacaaggctctcaacgagcaccatgtcctcctcgagggtaccctcctgaagcccaacatggtgacccctgggtctgactccaagaaggtgactcctgaggtcattgctgagtacactgtccgcaccctccagaggaccgtccctgctgctgttcgtcttcctctcaggtggacagagcgaggaggaggccaccctgaacctgaacgccatgaacaagctcaacaccaagaagccgtggtccctgtccttctctttcggccgtgccctccaggcgagcaccctcaaggcctgggctggcaaggaggagaacgtggagaaggctagggcggccttcctcgccaggtgcaaggccaactctgaggctaccctcggcacatacaagggtgacgctgccgccggcgagggtgtctctgagagcctccacgtgaaggactacaagtactgatctgcctctccttgcggtacccgattcggacctgtgcctacgagcatttaggttgctgagtgtggtttgctccttagagcatatatccggacatcaagaaaacctgaacctgcttcccttttgtggatgatggttcgttacctttacattttcgtatattaagtagtttcgttggtgttaattaatctcgtgtaatttggacctgccgatggagaatcgtgcagccacattttgtttatctttgctgaaatgctggttacatatcggcaaaaccattctatatgctgagttggtcggggtgcaggccttttgctctgatatcttcgttgtgatggattgcagcatctagctttatatttttcgcccacatgcttttttt

SEQ ID NO: 1366 - DNA, 1546 bp, Euonymus alatus
caatataaacccttggccccttgtctttctttctttctcttgtattcgtctctttcgtctaactctctcgaaatctcatctctcctctcgtcctattcaatcaatctataatgtctagtttcaagggcaaatacgccgatgagctcattgccaatgctgcctacattggcactcctggtaagggtattcttgctgctgatgaatcgactgggacaatcggaaagcgtctagcaagcatcaacgttgagaatgttgaaacaaataggcgtgatcttcgtgaactcctattcaccgcccctggtgccctccaataccttagtggtgtcattctcttcgaggaaactctgtaccagaagactgcagcaggcaagcccttcgttgatgtgttgaaggaaggtggagtgctacctggtattaaggttgacaagggcactgttgtgcttgctggaaccaacggcgagaccacaactcaaggtcttgatggcctcgctcagcgttgccagaagtactatgaagctggtgcccggtttgccaagtggcgtgctgtgttgaatattggtccaactgagccatctcagctgtctatcaatgagaacgcgaacggtttggctagatatgctatcatctgccaggagaatggtcttgtcccaattgttgagcctgagatcctggttgatggttctcatagcattgagaagtgtgccgatgtgactgagcgtgtgctcgctgcatgttacaaggctctgaatgatcaccatgtcctgcttgagggtactctgctgaagcccaacatggttacccctggatcagatgcccctaaggttgcacctgaggtgattgctgagcacacagtgcgggctttacagcgcaccgtccctgctgcagttcctgctattgttttcttgtctggtgggcagagcgaggaagaggctaccatcaacctcaatgccatgaacaagctcaaggggaagaagccatggaacctttccttctcatttggacgtgcccttcagcagagcactctcaaggcttgggctggcaaggaggataatgtgaaggcggctcaaaatgcacttcttgccaggtgcaaggctaactctgaggcaacccttggtacctataagggtgatgctcagcttggtgagggtgcctccgaaagcctccatgtcaaggactacaaatactaggaagtgccggcttttttggtcagtttgtgttttatgttttgcggtgcaaattaggttgtggtattctctcaggcatagttttagattatattcttacctctcctagtggaatttacaatggagacagaaaaataaagcttgaggtgtttgaactttgaaatggttttggtcattgtttttcattactctttatgttttgtactcatttctcctagtggaggctcatgactggattttttcttttgcattatgttttcagttttctcgtcttttggataaatttttgtaattccaacagcacttttacaaccctagtcgactacctcaattccccttattaaatatcaagtcatttgttc

SEQ ID NO: 1367 - DNA, 1427 bp, Tripterygium wilfordii
tttctcaaatctgtctgtcttcgtctccaaatctcatctactctcctcttgttctcttcaatcagtctatcatgtcttccttcaagggcaaatacgctgatgagcttattgccaatgctgcctacattggcactcctggaaaaggaattcttgctgctgatgaatcgactgggacaattggaaagcgtctggcaagcatcaacgttgagaatgttgaaacaaacaggcgtgctctgcgtgagctcttattcacggcccctggtgccctccaatacctcagtggtgtcatcctcttcgaggaaaccctgtaccagaagactgctgaaggcaagccctttgttgatgtgttgaaagaaggtggagtgctacctggtattaaggttgacaagggcaccgttgagcttgctggaaccaacggtgagacaacaactcaaggtcttgatggccttgctcagcgttgccagaagtactatgaagctggtgcccggtttgccaagtggcgtgctgtgttgaatattggtccaactgagccatctcagttgtctatcaatgagaatgccaacggtttggctagatatgctatcatctgccaggagaatggtcttgtaccaattgttgagcctgagatcctggttgatggtacccatagcattgagaagtgtgctgatgtgaccgagcgtgtgctcgctgcatgttacaaggctttgaatgatcaccatgtcctgcttgagggtactctgttgaagcccaacatggttacccctggatcagaggcccctaaggtcgcacctgaggtgattgctgagcatacagtgcgggctttacagcgcaccgtccctgccgcagttcctgctattgttttcttgtctggtgggcagagcgaggaagaggctaccatcaacctcaatgccatgaacaagcttaaagggaagaagccatggagtctttccttctcatttgggcgtgcccttcagcagagcactctcaaggcgtgggctggcaaggaggagaatgtaaaggcggctcaagctgcactccttaccaggtgcaaggcgaactccgaggcaactctgggtacctacaagggtgatgctaaacttggtgagggtgccgctgaaagcctccacgtcaaagactacaaatactaggaagtgcaggctttttggtcagtttgtgtttttatgttttgcggagcaaattaggtttatactcctattctctcaggcatagttttagattatattcctatatttcctggtggaatttaagaggagaataataaagcttgtggtgcttgagctttgaaattggtttggtcaatgcttttcattactttgtatgtttcgttctcgttcctccttcctagtagagcttcatgacgggggagcggacttccttttgggttatgttttcttcttgtttgttgg

SEQ ID NO: 1368 - DNA, 1402 bp, Aquilegia formosa
ctaaacaccattttcttgaacccttttctcctcgtttctatctttcgcctctctctttttctcacacatttcatcaaacatgtcttgctacaagggcaaatatgctgatgaactcattgccaatgctgcctatattggcacccctggaaagggtatccttgctgctgatgagtccactggaacaattgggaagcgtctatccagcatcaatgttgagaatgttgagacaaacagacgtgcgctccgtgaacttctcttctgcactccaggtgctctcaattatttgagtggtgtgatcctatttgaggagactctctaccagaagtctgccgctggtaagcccttcgttgatatccttaaggaaggtggagttcttcctggtatcaaggttgataagggtaccgttgagcttgctggaaccgatggtgagaccactacccagggacttgatgggcttgcccagcgttgtgcacaatattattccgctggagccaggttcgccaaatggcgtgcagtgctcaagattggtcctaatgagccatctcagctagccattaatgagaatgctaatgggctggccagatatgccattatctgccaagagaatggtttggtcccaattgttgagccagagatcttggtcgatgggtctcatgacattgatcgttgtgcggatgtgacagagcgagttattgctgcttgctacaaggcattgaatgaccatcacgtcctccttgagggaactctattgaagccaaacatggtgacccctggatctgaatctaagaaggtcgccccagaagtcattgctgagtataccgttcgtgctttgcagagaacaatgcccgcagcagttcctgctgttgttttcttgtcaggtggacagagtgaagaggaggccaccctgaaccttaatgcaatgaaccagcttaaaggaaagaagccatggtcactctcattctcctttggacgtgctctgcagcagagcactctcaaggcatggtctggaaaagaggaaaatgtggagaaggcacaggctgccttcctagcaaggtgcaaggcaaactcagaggctacccttggtacctacaagggtgatgctcccgtcggcgatggtgcttcagaaagccttcacgtcagtaactacaagtactgatgaatttcagtcctgctatgttatgagtggataagaggaggataatgagagtgtctttaaggcgtaatggtaggtcttttttcctgattgaataatttcggagggacagggttaattaattaagagtgcttttttctcctctgtcatttgtgtgcgtgaaaactctaatggaaatgtttctgttttattttacttaagagtttttgttacctgattgtttggagttaaatatgagctgctgtggcc

SEQ ID NO: 1369 - DNA, 1401 bp, Aquilegia formosa
ctaaacacccttttcttgaacccttttctcctcgtttctatctttcgcctctctcttgttctcacacatttcatcaaacatgtcttgctacaagggcaaatatgctgatgaactcattgccaatgctgcctatattggcacccctggaaagggtatccttgctgctgatgagtcgactggaacaattgggaagcgtctatccagcatcaatgttgagaatgttgagacaaacagacgtgcgctccgtgaacttctcttttgcactccaggtgctctcaattatttgagtggtgtgatcctatttgaggagactctctaccagaagtctgccgctggtaagcccttcgttgatatccttaaggaaggtggagttcttcctggtatcaaggttgataagggtaccgttgagcttgctggaaccgatggtgagaccactacccagggacttgatgggcttgcccagcgttgtgcacaatattattccgctggagccaggttcgccaaatggcgtgcagtgctcaagattggtcctaatgagccatctcagctagccattaatgagaatgctaatgggctggccagatatgccattatctgccaagagaatggtttggtcccaattgttgagccagagatcttggttgatgggtctcatgacattgatcgttgtgcggatgtgacagagcgagttattgctgcttgctacaaggcattgaatgaccatcacgtcctcctcgagggaactctattgaagccaaacatggtgacccctggatctgaatctaagaaggtcgccccagaagtcattgctgagtataccgttcgtgctttgcagagaacaatgcccgcagcagttcctgctgttgttttcttgtcaggtggacagagtgaagaggaggccaccctgaaccttaatgcaatgaaccagcttaaaggaaagaagccatggtcactctcattctcctttggacgtgctctgcagcagagcactctcaaggcatggtctggaaaagaggaaaatgtggagaaggcacaggctgccttcctagcaaggtgcaaggcaaactcagaggctacccttggtacctacaagggtgatgctcccgtcggcgatggtgcttcagaaagccttcacgtcagtaactacaagtactgatgaatttcagtcctgctatgttatgagtggataagaggaggataatgagagtgtctttaaggcgtaatggtaggtcttttttcctgattgaataatttctgagggacagggttaattaattaagagtggtttttctcctctgtcatttgtgtgcgtgaaaactctaatggaaatgtttctgttttattttacttaagagtttttgttacctgattgtttggagttaaatatgagctgctgtggcc

SEQ ID NO: 1370 - DNA, 1413 bp, Ricinus communis
gggaaaaaagccaagaaaaacaagtagcgacaatttggatacccgaaattgccccttccccaaaccctctactaacctttctccctacctctcttttcaaatataaacccctcctaatccctcttttctctctatctctatctctctccatctcttctctactgctttccagaactctctcttctacttttcaacaaccagccatgactgcttacaagggcaaatacgctgatgagctcattgccaatgctgcctacattggcacacctggaaagggtatccttgctgccgatgagtcaaccggcacaatcggcaagcgtctatccagcatcaatgttgagaatgttgaggaaaacaggcgtgcccttcgggagctactcttcaccgctcctggtgcccttcaatacctcagtggagtaattctcttcgaggaaaccctgtatcagaagactaaatcaggcaagccttttgctgagcttttgaaggagaatggtgtcctccctggtattaaggttgacaagggtacagttgagattgctggcaccgatggtgagactacaacccaaggtcatgatgggcttgcccaacgttgccagaagtactatgaagctggtgcgcgatttgcaaagtggcgtgctgtgctcaagattggccccaatgagccatctcagctttccatcaatttgaatgctgaggggttggccagatatgccatcatttgccaggagaatggtttggtcccaattgttgagcctgagattttggttgatggacctcatgatattaacaagtgtgctgaggtcactgagcgtgttcttgctgcctgctacaaagcactcaatgatcaccatgtcttgcttgagggaactcttttgaaacctaacatggttacccctggatcagattcccctaaggttgcacccgaagtggttgctgagtacacagtccgcgcccttcaacgcactatgccagctgctgttccagctgttgtgttcttgtctggtggacagagtgaggaggaggctaccctcaacctgaacgccatgaacaagctcaagacaaagaagccatggactctttccttctcttttggacgtgcccttcaggcaagtaccctcaaggcttgggccggaaaggaggagaatgtgaagaaggctcaggaagcattgcttgtcaggtgcaaggccaactcagaggcaactctcggaacttacaagggagatgctactcttggcgagggtgccgcagagagcctccatgtcaaggactacaaatactaagagatctcaaagtgacagtaatagagcgtcttgtctcaggcatagttttagggcttcacttttttaatgttgctgatcggatttagtatgaagtagcataataaaatgctcgaggagtattttcttgttgagt

SEQ ID NO: 1371 - DNA, 1573 bp, Castanea mollissima
ccggtattctcccaaaccctctctctctcatatcagttctctctctgtctctctaaaactctctctcaaaaacgtccttaacacacacactctctctctctctctcagactatcaaccatgtctgcttaccagggcaaatacgctgatgagctctgtgccaatgctgcatacattggtacccccggaaagggtatccttgctgctgatgagtcaactggcacaatcggcaagcgtctttccagcatcaatgttgagaatgttgaggagaacaggcgtgctctccgtgagcttctcttcaccactcctggtgccctccagtaccttagtggagtaattctctttgaggaaaccctctaccagaagacacatgacggtaagccctttgttgatcttttgaaggaaaatggtgttcttcctggcatcaaggttgacaagggtacagttgagcttgctggaaccaatggtgagaccaccacccagggtcttgatggccttgcacagcgttgccagaagtactatgaagctggtgctcgttttgccaaatggcgtgctgtcctcaagattggcccaactgagccatctcagcttgccatcaatgaaaatgccaatggattggcccgatatgctatcatctgccaggagaatggcctggtccccattgttgagcctgagatattggttgatggaccccatgatattttgaagtgcgctgatgtgaccgaacgtgttcttgctgccgtatacaaagctcttaatgatcaccatgtcttgcttgagggaaccttgttgaaacccaacatggtgacccctggatcagaagcacctaaggttgcaccagaggtgattgctgagcacactgttagggctcttcagcgaacaatgcctgcagcagttcctgctgttgtgttcttatctggtggtcagagtgaggagcaggcaaccatcaacctaaacgccatgaacaaatacaagggaaagaagccatggaccctttccttctcctttggacgtgcccttcaacagagcactctcaaggcatggggcggaaagaaagaaaatgtgcagaaggcccaggctgcattccttgctagggctaaggccaactcagaggcaactcttggaacctataagggtgatgcaaccctaggtgagggtgcctctgagagccttcacgtgaaggactacaagtattgatgaagctaaaagcttctggtgggttttgtgttttgttttggagagttaatggcggtatgggggtataaggttgtcctattctcaggcatagagttagggctgtttttcaattttctttattacatgttttagtaggacgatgctagagtaataatgcttgagtagcatttgcctggtgagactggatttttcggttgagaactgctgattgatgcttctcgtttgtgttttttaaaccttttctcctttttaaccgagtttaatgaattatggactgtcatgctccaatttattgtgaatgttgctttacttttttgtttgtaatggttttggagggttttggttaatacatatttggctgttgcctaaacttggatc

SEQ ID NO: 1372 - DNA, 2225 bp, Eucalyptus grandis
ctcctttcgaatattatatataaaaaggctttcggccctgctccttctctctccaacctcaatcccttggtcaaatctcttctctcgcattctccgtcatctcaagccgcgtcctcctctctgagtccctcagatcgcccgaaactagcgaaaaccatgtcgtgctacaagggcaaatacactgatgagctcattgccaatgctgcctacatcggcacccctgggaagggtattctagctgctgatgaatcgactggcaccattggcaagcggttggccagcatcaacgttgaaaatgtcgagaccaacaggcgcatcctccgcgaactcctcttcaccgctcctggagctctcccgtgccttagtggcgtgattttgtttgaggaaactctctatcagaagaccgccagtggtaagccctttgttgatgtcctgaaggaaggtggagtccttcctggcattaaggttgacaagggcacagttgagctcgctggcacaaatggtgagaccaccactcagggtctcgatggccttgctcagcgatgccaacaatactacaaagcaggtgctcgctttgccaaatggcgtgctgtgctcaagattagcccaaccgagccatctcagcttgctatcaatgagaacgcaaatggattggcaaggtacgccattatctgccaggagaatggtctggtccccattgtggagcccgagatcttggttgatggtccccacagcattgacaagtgtgccgacgtgactgagcgtgttcttgccgcttgctacaaggccctaaatgaccaccatgtgctcctcgagggaaccttgttgaagcccaacatggtcacccccggatcagatgcccccaaggttgctccggaggtcattgctgagtacaccgttcgtgccctgcagcgaacagtgcctcctgctgttccggccattgtcttcttgtccggtgggcagagtgaggaggaggccactttgaacctcaatgccatgaacaagctcaagggcaagaagccatggagcctctccttctcttttggtcgggccctacagcagagcaccttgaaggcgtgggctggaaaggaagagaacattcccaaggcacaggctgcacttctcagaagatgcaaggccaactcggacgcaactcttggaacatacaagggtgatgctcaacttggcgagggtgcttccgagtctctccatgttaaggactacaagtactgagtggcggatctaggctttgctgcgatactattacttgtgcttcgtttgtttcgtggattactgaccgtgcaaaataaggtttgagtttttggcaatgggagttacaatggtttttcattgatgacttttagaacccttggcccttttcttctggcttgctttataattatggatgcttttgagaaagaatacaccttttgcgttgttgagagaccatgcttgcagtggttgatgtactctttagacatgcgatgctcattcattcatgtaatggttgatggaagaacatcagctccactaatcttcctggtcccagtaaaatggacatgatgtttgagtctcttcatggcctagtccttgttgcataattaaggacaaagtagttatttagattcagcatcggttgttggacatggatctacataagatcataggatgctagaaatgttatcgtgcgcatcttcattacaccaaggctattgaaatactaaaactagatagagtgtaattaaaccaagttcgtaccccttagccaaaaagggtgtgttaatagcgagaatttaactcacagaattgggccagacgaaagaggggaagcaatagcatgagccagaattcatctctgcagcactcgtcttgttatcctatcgtctccctcaaactccaagtcagaattttctagcatcgataaaattgagtttgtttgtcctaaaaaatttattttgctgaccccatgccgtctcgggaagctctgttgtcaaaagtgtccattttctgggattcgacttggagaaagcattgacaagagaagttgctaggagataagaccattgtctgtgtttgacttgaatttccatttatagttcgcctaaaaattggtgttgtgtagtgtgtggtacgagtttctcacaaactatgcattggtctattgtttctatcgtgtagttgtaatttacttttcttttcttcttgtacctttaatttgtctagat

SEQ ID NO: 1373 - DNA, 1403 bp, Eucalyptus grandis
  misc_feature (878)..(878): n is a, c, g, or t
  misc_feature (1045)..(1045): n is a, c, g, or t
  misc_feature (1066)..(1066): n is a, c, g, or t
  misc_feature (1136)..(1136): n is a, c, g, or t
  misc_feature (1183)..(1183): n is a, c, g, or t
  misc_feature (1189)..(1189): n is a, c, g, or t
cggtgtattttttttatggtttacctctatgtaaaagaacctcaatcccttggtcaaatctcttctctcgcattctccgtcatctcaagccgcctcctcctcctcctctctcagtccctcagatcgcccgaaactagcgaaaaccatgtcgtgctacaagggcaaatacactgatgagctcattgccaatgctgcctacatcggcacccctgggaagggtattctagctgctgatgaatcgactggcaccattggcaagcggttggccagcatcaacgttgaaaatgtcgagaccaacaggcgcatcctccgcgaactcctcttcaccgctcctggagctctcccgtgccttagtggcgtgattttgtttgaggaaactctctatcagaagaccgccagtggtaagccctttgttgatgtcctgaaggaaggtggagtccttcctggcattaaggttgacaagggcacagttgagctcgctggcacaaatggtgagaccaccactcagggtctcgatggccttgctcagcgatgccaaaaatactacacagcaggtgctcgctttgccaaatggcgtgctgtgctcaagattagcccaaccgagccatctcagcttgctatcaatgagaacgcaaatgggttggcaaggtacgccattatctgccaggagaacggtctggtccccattgtggagcccgagatcttagttgatggtccccacagcattgacaagtgtgccgacgtgactgagcgtgttcttgccgcttgctacaaggccctaaatgaccaccatgtgctcctcgagggaaccttgttgaagcccaacatggtcacccccggatcagatgcccccaaggttgctccggaggtcattgctnagtacaccgtccgtgccctgcagcgaacagtgcctcctgctgttccggccattgtcttcttgtccggtgggcagagtgaggaggaggcaactttgaacctcaatgccatgaacaagctcaagggcaagaagccatggagcctctccttctcctttggtcgggccctncagcagagcaccttgaaggcntgggctggaaaggaagagaacattcccaaggcacaggctgcacttctcagaagatgcaaggccaactcgnacgcaactcttggaacatacaagggtgatgctcaacttggcgagggngcttcngagtctctccatgttaaggactacaagtactgactggtggatctaggctttgctgcgatactagtacttgtgcttcgtttgttgcgaggattactgaccgtgcaaaataaggtttgagtttttggcaatgggagttacaatggtttttcattgatgacttttagaactcttggcccttttcttctggcttgctttataattatggatgtttttg

SEQ ID NO: 1374 - DNA, 1599 bp, Populus trichocarpa
agacgtgatatccaacggcagcagggcgttacgtggaaaaaaagccaacaattagcgacaatttcgatgctctcactgacctttcttggctactcgcctactcctatttcaaaatataaaccctcacaaccccctttcatccctccccacatcgcctccctctctttcattgatctccccgaactattcttcctgcaaaaatgtcttgcttcaagagcaaatacgctgatgaactcattaagaatgctgcctacattggcacccctgggaagggtatcttagctgctgatgagtcaactggcacaattggcaagcgtctatccagtattaatgttgagaatgttgaggaaaacaggcgagcccttcgtgagctccttttctgcgcccctggtgctcttcaatacctcagcggagttattctctttgaggaaactctctaccaaaagactgcatcaggcaagcccttcgttgatgtcttgaaggaaggtggtgttctccctggtatcaaggttgacaagggtaccgttgagcttgctggcacaaacggtgagaccacaactcagggtcttgatggccttggccagcgctgcgcaaagtactacgaagctggtgcacgtttcgccaaatggcgtgctgtgctcaatattggtgccaatgagccatctgagctggccatccatgagaatgcctatggtttagccagatatgccgtcatctgccaggaaaatggcttggtccccattgtagagcctgaaatcttggttgatggttctcacgatattgagaagtgtgccgcagtaacagagcgtgttcttgctgcatgctacaaagctctcaatgatcaccatgccatacttgagggtactctcttgaagccgaacatggttactcctggatcagaagctcccaaggttgcacatgaggttattgccgagtacacagtccgtgcacttcaacgtactgtgccccctgcagttcctgctattgtattcttgtctggtggccagagtgaggaggaggccaccctcaacctcaatgccatgaacaaactaaacaccaagaagccatggtctctatccttttcctttggacgtgctcttcagcagagtaccctcaaggcctgggctggcaagccggagaatgtggggaaggctcgtgctgcattgcttgccagatgcaaagctaactcagaggctactcttggtacgtacaagggtgatgccactcttggtgagggtgcctcagagagcctccacgtcaaggactacaagtactaagaagtcccgtcatttcaaagttccggagagttgttatctcgccatagttctagctttcttttttctgtgatgctgctcggattttgcttggaactagataataaaaggatgaggaaaaacactggggtgttgagcttgaatggctttgatcactactgtttatgttttcttttcaaaaattcaattaagattatgattatgattgtattttgttgcaattgaagtttttcgcatttcttcttcatgcaaggtgtgtgattctcgtcagctattttatttctttttttttgcattagaaagccgtaagctctcaatcttattc

SEQ ID NO: 1375 - DNA, 1387 bp, Aquilegia formosa
gcgtcttgttattcttctagtttcttctctctctctcgatcaaaaaccatgtcttgctacaagggaaaatatcatgatgagctcattgccaatgctgcttacattggcactcctggaaagggtatccttgctgctgatgagtccacaggcacaattggcaagcgtctagctagcatcaatgttgagaacgttgagactaacaggcgtgctctacgtgaacttcttttctgcacacctggtgctcttcaatacctcagtggtgtcatcctctttgaagagacactctatcagaagactgctgctggtaagccttttgtggaagtgctgaaggaaggtggtgtcctccctggtatcaaggttgacaagggtactgttgaacttgctggtaccaatggtgagactacaactcaggggcttgatgggcttgctcagcgatgccagcagtattatgcagctggtgctcggtttgctaagtggcgctctgtgcttaagattggtcccactgaaccatctcagttggctatcaatgaaaatgccaatgggctggccaggtatgctatcatttgtcaggaaaatgggttggtcccaattgtcgagccagagatccttgttgatggttctcacgacattgaccggtgtgcggatgtgacagagcgtgtagtagctgcctgttacaaggcactcaatgaccaccacgtcctacttgagggaactttgctgaagccaaatatggttacccctggttctgatgctaaaaaagttgccccagaggtggtagctgagtacacagtgcgtgccttgcagcgaacaatgcctccagcagttcctgctgtggtgttcttgtcaggtggacagagtgaagaggaggcgacactgaatctaaatgcaatgaaccagcttaaaggaaagaagccatgggcactgtcattctcctttggacgtgctttgcagcagagcactctcaagacctgggcaggtaaagaggagaaccttgaaaaggcacaggctgctttcctttcaaggtgcaaggccaactctgaagctacccttggtacttacaagggtgatgctgcacaggttgaaggtgcttctgagagcctgcatgtcaaggactacacttactaatgcagtcaattttcaagggtctatctgttatgtttacgagttttaagtaggagagtgttaaagttgagtttcctatcctatagatgtgtcaatgtctctgttgcctaagaaaattgataatggtgcaataagttttagtatgtcaagttacttaggcttgtgtctgtcatgtgtgtctttttaatagttaagaactatcatgcagctgtttttctcattctggtggtttttgaaatgatattaacctatggcttaacttgtg

SEQ ID NO: 1376 - DNA, 1497 bp, Euonymus alatus
gggcctttcttgcaatacccaaaccacaatataaaccattggcccccaactctctcaaacgcttctgtgttcgtctctttgatctaacttcgaaatattatctctctctttaatcagttgatcatgtcttccttcaagggcaaatacgctgatgagctcattgccaatgctgcttacattggcactcctggtaagggtattcttgctgctgatgaatcaactgggacgatcggaaagcgtctggcaagcatcaacgttgagaatgttgaaacaaacaggcgtgctcttcgtgagctcctattcactgcccctggtgctctcccatgcctcagtggtgtcatcctctttgaggaaaccctataccagaagactgcagcaggcaagcccttcgttgatgtattgaaggaaagtggagtgctaccaggtattaaggtcgacaagggcactgttgagcttgctggaaccaacggcgagacaacaactcaaggtcttgatgggcttgctcagcgttgccagaagtactatgaagctggtgcccggtttgccaagtggcgtgctgtgttgaagattagtgcaactgagccatctcagctggctatcaatgagaatgccaacgggttggctagatatgctatcatctgccaggagaatggccttgttccaattgttgagcctgagatcctggttgatggtccccatagcattgagaagtgtgctgatgtgactgagcgtgtgctcgctgcatgttacaaggctttgaatgatcaccatgtcctgcttgagggtactctgttgaagcccaacatggttacccctggatcggatgcacctaaggttgcacctgaggtgattgctgagcacacagtgcgtgctttacagcgaaccgtccctgcggcagttcctgctattgttttcttgtctggtgggcagagcgaggaggaggctaccatcaacctcaatgccatgaacaagctcaaggggaagaagccatggaacctttccttctcatttggacgtgcccttcagcagagcactctcaaggcttgggctggcaaggaggagaacgtgaaggcggctcaagctgcactccttgccaggtgcaaggctaactctgaggcaacccttggtacctacaagggtgatgctcagcttggtgagggtgcctctgaaagcctccatgtcaaggactacaaatactagaaagtgccggctttttggtcagtttttgtttttgttttacgttttgcggagcaaattatgtcgtactctcaggcatagttttagattatattctcatctttccttgcggaatctacaatggagacggaaaaataaagcttgaggtgtcttgtaactctgtatttggaaatggttttggtcaatgtttttgattaccttgtatgttctgtcctcgttcctcctggaggaggttcttgaattccttttggattatgttttctcgtctttcacgagttttgatattttgaattttgaatt

SEQ ID NO: 1377 - DNA, 1447 bp, Malus domestica
cgcataaaaatcctcacccacccttcactttcttccatcgtctcttcctctctctcgatctctcagaaaacaaccaactcgtcttcttcttcctctctcaatcttcagcatcaatcaaacatgtctgcttacagaggcaaatacgctgatgagcttatcgccaatgctgcctacatcggcacccctggaaagggtattctcgctgctgatgagtcaactggcacaatcggcaaacgttttgccagcatcaatgttgagaatgttgaatcaaacaggcgtgctcttcgtgaactgctcttcactgcccctgatgtgctccaataccttagtggagttatcctctttgaggaaaccctctaccagaagaccgcttcaggaaagccattcgttgatgtcttgaaggaaggtggtgttctccctggaattaaggtcgacaagggtaccgttgagcttgccggaaccaatggtgagaccacaacccagggtcttgatggccttgcccagcgttgccagaagtactatgaagctggtgcacggttcgcaaagtggcgtgctgtgctcaagattggccccaatgaaccatctcagctgtccatccaagagaatgccaacgggttggctcgttatgccatcatctgccaggagaatggcctagtgcccatcgttgagccagagatcctggtcgatggaccccattccatcgataagtgtgccgatgtgactgaacgtgttcttgccgcatgctacaaggcccttaacgaccaccatgtcctgcttgaaggaactctcttgaaacccaacatggttaccccaggatctgatgccaagaaggtttcaccagaagtgattgctaagtacacagttcgcgccttgttgcgcactaccccagcagctgtccctgctgttgtgttcttgtccggtggacagagtgaggaggaggctaccctcaacctcaacgccatgaaccaactcaagggaaagaagccgtggtctctatccttctccttcggacgtgctcttcagcagagcacactgaaggcatgggcagggaaagagggaaacatcccaaaggcgcaggctgctctcctcacaagggccaaggccaactcagaagctactcttggaatctacaagggtgatgccaagctcggtgagggtgccgctgagtctctccatgtgaaggattacaagtactgaagaaatttacagttcttgttttatttttggaaaactatcttgcggtctgtgtatggcttttgtcattctcaagcgtattattagggttttttcgaacttctgttcttgatctcggatattaggatggtggtagaataaaagcttgacggccagtgacatgttgagtttcaaaaatgtttcctaaacagttactttttattgcctgaattgaagataagcactataatttccaacatccagtttttgtcta

SEQ ID NO: 1378 - DNA, 1384 bp, Malus domestica
tctctctcgatctctcagaaaacaaccaactcgtcttcttcttcctctctcaatcttcagcatcaatcaaacatgtctgcttacagaggcaaatacgctgatgagcttatcgccaatgctgcctacatcggcacccctggaaagggtattctcgctgctgatgagtcaactggcacaatcggcaaacgttttgccagcatcaatgttgagaatgttgaatcaaacaggcgtgctcttcgtgaactgctcttcactgcccctgatgtgctccaataccttagtggagttatcctctttgaggaaaccctctaccagaagaccgcttcaggaaagccattcgttgatgtcttgaaggaaggtggtgttctccctggaattaaggtcgacaagggtaccgttgagcttgccggaaccaatggtgagaccacaacccagggtcttgatggccttgcccagcgttgccagaagtactatgaagctggtgcacggttcgcaaagtggcgtgctgtgctcaagattggccccaatgaaccatctcagctgtccatccaagagaatgccaacgggttggctcgttatgccatcatctgccaggagaatggcctagtgcccatcgttgagccagagatcctggtcgatggaccccattccatcgataagtgtgccgatgtgactgaacgtgttcttgccgcatgctacaaggcccttaacgaccaccatgtcctgcttgaaggaactctcttgaaacccaacatggttaccccaggatctgatgccaagaaggtttcaccagaagtgattgctaagtacacagttcgcgccttgttgcgcactaccccagcagctgtccctgctgttgtgttcttgtccggtggacagagtgaggaggaggctaccctcaacctcaacgccatgaaccaactcaagggaaagaagccgtggtctctatccttctccttcggacgtgctcttcagcagagcacactgaaggcatgggcagggaaagagggaaacatcccaaaggcgcaggctgctctcctcacaagggccaaggccaactcagaagctactcttggaatctacaagggtgatgccaagctcggtgagggtgccgctgagtctctccatgtgaaggattacaagtactgaagaaatttacagttcttgttttatttttggaaaactatcttgcggtctgtgtatggcttttgtcattctcaagcgtattattagggttttttcgaacttctgttcttgatctcggatattaggatggtggtagaataaaaagcttgacggccggtgacatgttgagtttcaaaaatgtttcctaaacagttactttttattgcctgaattgaaaataagcactataatttccaaa

SEQ ID NO: 1379 - DNA, 1298 bp, Aquilegia formosa
gcgtcttgttattcttctagtttcttctctctctctcgatcaaaaaccatgtcttgctacaagggaaaatatcatgatgagctcattgccaatgctgcttacattggcactcctggaaagggtatccttgctgctgatgagtccacaggcacaattggcaagcgtctagctagcatcaatgttgagaacgttgagactaacaggcgtgctctacgtgaacttcttttctgcacacctggtgctcttcaatacctcagtggtgtcatcctctttgaagagacactctatcagaagactgctgctggtaagccttttgtggaagtgctgaaggaaggtggtgtcctccctggtatcaaggttgacaagggtactgttgaacttgctggtaccaatggtgagactacaactcaggggcttgatgggcttgctcagcgatgccagcagtattatgcagctggtgctcggtttgctaagtggcgctctgtgcttaagattggtcccactgaaccatctcagttggctatcaatgaaaatgccaatgggctggccaggtatgctatcatttgtcaggaaaatgggttggtcccaattgtcgagccagagatccttgttgatggttctcacgacattgaccggtgtgcggatgtgacagagcgtgtagtagctgcctgttacaaggcactcaatgaccaccacgtcctacttgagggaactttgctgaagccaaatatggttacccctggttctgatgctaaaaaagttgccccagaggtggtagctgagtacacagtgcgtgccttgcagcgaacaatgcctccagcagttcctgctgtggtgttcttgtcaggtggacagagtgaagaggaggccacactgaacctaaatgcaatgaaccagcttaaaggaaagaagccatgggcactgtcattctcctttggacgtgctttgcagcagagcactctcaagacctgggcaggtaaagaggagaaccttgaaaaggcacaggctgctttcctttcaaggtgcaaggccaactctgaagctacccttggtacttacaagggtgatgctgcacaggttgaaggtgcttctgagagcctgcatgtcaagggctacacttactaatgcagtcaattttcaagggtctatctgttatgtttacgagttttaagtaggagagtgttaaagttgagtttcctatcctattgatgtgtcaatgtctcagttgcctaagaaaaacgataatggtgcaataagttttagtatgtcaagttacttaggcttgtgtctgtcatgtg

SEQ ID NO: 1380 - DNA, 1678 bp, Quercus alba
tagtatcagcggaattcccgggatcgatactacatacacatctctttctcacttaactttctcaccgcaaacggcaaacccactctctagtctctcccaaatataaaaccccctattcccccaaaccctctctctcatctcaattctctctctacctctcaaaaacatcgttaacacacactctctcagactatcaaccatgtctgcttaccagggcaaatacgctgatgagctctgtgccaatgctgcatacattggtacccccggaaagggtatccttgctgctgacgagtcaactggcacaattggcaagcgtctttccagcatcaatgttgagaatgttgaggagaacaggcgtgctctccgtgagcttctcttcaccacccctggtgccctccagtaccttagtggagtaattctcttcgaggaaaccctctaccagaagacacatgacggtaagccctttgttaatcttttgaaggaaaatggtgttcttcctggcattaaggttgacaagggtacagttgagcttgctggaaccaatggtgagaccaccacccagggtcttgatggccttgcacagcgttgccagaagtactatgaagctggtgctcgttttgccaaatggcgtgctgtgctcaagattggcccaactgagccatctcagcttgccatcaatgaaaatgccaatggattggctcgatatgctatcatctgccaggagaatggcctggtccctattgttgagcctgagatattggttgatggaccccatgatattttgaagtgcgctgatgtgaccgaacgtgttcttgctgccgtatacaaagctcttaatgaccaccatgtcttgcttgagggaaccttgttgaaacccaacatggtgacccctggatcagaagcaccaaaggttgcaccagaggtgattgctgagcacactgtcagggctcttcagcgaacaatgcccgctgcagttcctgctgttgttttcttatctggtggtcagagtgaggagcaggcaactgtcaacctaaatgccatgaacaaatataagggaaagaagccatggaccctttcattctcctttggacgtgcccttcaacagagcactctcaaggcatggggaggaaagaaagaaaatgttccgaaggcccaggctgcattccttgctagggccaaggccaactcagaggcaactcttggaacctacaagggtgatgcaacccttggtgagggtgcctccgagagccttcacgtgaaggactataagtattgatgaaactaaaagcttctagtgggttttgtgttttgttttggagagttaatggcggtatggggtataaggttgtcctattctcaggcatagagttagggctgtttttcaattttctttattatatgttttagtaggatgatgctagagtaataatgcttgagtagcatttgcctggtgagcttggatttttcggttgggaactgctgatggatgcttctcgtttgtgttttttaaacctttttcctgttaaaccaagtttatgtgaatgttgctttacttttttgcttgtaattgtattggagggttttggttgaatacatatttggctgttgtctaaacttggacctatgtaggtccatatctgcactattatgttatgtatgatatttgaaatcggtcttt

SEQ ID NO: 1381 - DNA, 1387 bp, Fragaria vesca
ttcacaaccgtcttcacatctccgcttccgatctgctccttctccaaatgacggcctacaagggaaagtaccatgatgagctcattaagaatgctgcctacattggcacccctggaaagggtattctagctgctgatgagtctactggcaccattggaaaacgtttcgacagcatcaaagttgagaatgttgaggaaaacaggcgcgctcttcgtgagctcctcttcactgcccctggtgtactccaataccttagtggagtgatcctctttgaggagaccctctaccagaagacagctgaaggcaaaccattcgttgaggtcttgaaggaaggtggtgttctccctggcattaaggttgacaagggtgttgttgagcttgctggtaccaatagtgagaccacaacccagggtctggatggccttggtgcacgctgcgcaaagtactacgaagctggtgcccggtttgccaaatggcgtgctgtgctcaagattggtcccaatgagccatctcagctgtccatcaatgagaatgctaatggattggcacgttatgctatcatctgccaggagaatggcttggtacccattgttgagccagagatccttgttgatggaccccatgacatcaacaagtgcgctgatgtgactgagcgcgtccttgctgcatgttacaaggctctcaatgaccaccacgtccttcttgaaggaactctcttgaagcccaacatggtcactcctggatctgaagccaagaaggcttcaccagaagtgattgctgagtacacagttcgtgccttgcagcgcactacccctgcggcggtccctgctgtggtgttcttgtctggtggacagagtgaggaggaggctaccctcaaccttaacgccatgaaccagctcaagggaaagaagccatggactctttccttctcttttggccgtgctcttcaggccagcactctcaaggcttggtcaggtaagaaagagaatgtcaaggctgcccaggaggctctcctcacaagggccaaggccaactcagaggcaaccttgggaacatacaagggcgatgccaagcttggtgagggtgctgcagagagtcttcatgtcaaggactacaagtattaatcgagctgtttggtagcatgtactctctatgtctcttctgtcattgtttggtagcttgttctctctatgtcttctgtcctagtataggtcggtccttttgggaaaaccattttctctataaactcgggatgagatgctagtctgatataagcttgaggaatattagcaagcaaagagagttgttatttaccccttaatttggtttagttggagaactactcgtgtgttaggtaattttggttaatctttgattttgatgtctt

SEQ ID NO: 1382 - DNA, 1455 bp, Eucalyptus grandis
atataaaaccctaaccccttctctcgatacatccattacactcttgtctgtctccacctctcgaagactcctctccctccctctccctctctctgcgcgttgaaaatgtcgtgcttcaagggaaagtaccatgatgagctcattgctaatgctgcttacatcggcacccctggaaagggcattcttgctgctgatgaatcaactgggacaattggcaagcggttatccagcatcaatgttgagaatgttgaagaaaataggcgtgctctccgtgagcttctgtttactgctccgggtgccctccaataccttagtggagtgattctctttgaggagaccctttatcaaaagacagctgctggcaagccttttgttgaggttctaaaagagggaggagttcttcctggaattaaggttgacaagggcactgttgagcttgcaggcaccaacggtgagacaaccacccaaggccttgatggccttgcacaacgttgccaaaagtactatgaggccggtgcacggtttgctaaatggcgtgctgtcctcaagattggcccaactgagccatcacagctggctatcaatgaaaatgccaatggccttgcgcgatatgcaatcatctgccaggagaatggtttggtccccattgttgaacctgaaatcctggtggatggacctcatgacattgagaagtgtgctgacgtgactgaacgtgtccttgccgcatgctacaaagctctaaatgaccatcatgtccttcttgagggtactcttttgaagccaaacatggtaaccccaggatcagaagccccaaaggtcgcacctgaggtgattgctgagtacactgttcgtgcccttcaacgtactatgcctccggctgtccctgccgttgtgtttttgtctggtgggcagagtgaggaggaggcaaccctcaacctcaatgccatgaacaagctcaagggcaagaaaccatggtctctttccttctcctttggacgggctcttcagcagagcactttgaagtcttgggctggaaaggaggagaacgtgcccaaggcacaggctgcattatttactaggtgcaaggcaaactcagaggcaactcttggtacttacaagggtgacgcaaagcttggcgagggagctgctgaaagtctccatgttaaggattacaagtactaaggtgcttttttgctggcggtattttctgcttttcatttgagaaaaataggtgtctggagatatcctatttttgtactaggataataagcatgactgtactggtaatgcattttcattgatgttgtgatggttgaatgtttgcgacttctttatgaagttttatatttttatatgaggaggttaatatctttctgttttgatgtttctgaagaaagttctttttaattatgtaatgcctgtgatatacttttgcttcatacttgggattactac

SEQ ID NO: 1383 - DNA, 1114 bp, Euphorbia peplus
atcatgtcttgctacaggggcaaatacgctgatgagctcattgctaatgctgcctacattggcacccctggaaagggtatccttgctgctgatgagtctactggaacaattggcaagcgtctttccagcatcaatgtcgagaatgttgaagagaacaggagagcccttcgtgagctcctcttcaccgcacctggtgctctccaatacctcagtggagtgatcctttttgaggaaactctctaccagaaaactaagtcaggcaagcctttcgctgaactcttgaaggagaacggtgtcctccctggcattaaggtagacaagggtactgttgtgcttgctggcaccaacggtgagaccacaacccagggtcttgacgggcttgctcagcgttgccagaagtattacgaagctggtgcacgttttgccaaatggcgtgctgtgctcaacattggccccactgagccatctcagcttgccatcaacgagaatgccaatgggttggccagatatgccatcatctgccaggaaaatggcttggttcctattgttgagcctgagatcttggttgatggatcccatgacattaacaagtgcgctgatgtaactgaacgtgttcttgctgcatgctacaaggctctcaatgaccaccatgtcttgcttgagggaactcttttgaaacccaacatggttacccctggatcggaagcccccaaggtatcacccgaagttattgccgagtacactgtccgtgccctccagcgcaccatgccagttgctgttccagccgttgtgttcttgtccggtggccaaagtgaggaggaggctaccgtgaacctcaatgcgatgaacaagcttaaaaccaagaagccatggactctttccttctctttcggacgggcacttcaggcaagcaccctcaaggcttgggctggcaaagaggagaatgtgaagaaggctcaggaagctttacttgtgaggtgcaaggccaactccgaggcaactcttggaatatacaagggtgatgctacacttggtgagggtgcttcagagagcctccatgtgaaggactacaaatactaagaaatccataagtttgttttcaagatatggagag

SEQ ID NO: 1384 - DNA, 1228 bp, Olea europaea
cattggcctacttttttgtacaaagttgcccccgcctctatatttctctctcgataaacactatttgtttcttcaatttcttcctctgtaaccatgtcttgctataagggaaagtacgccgatgagctcattgccaatgctgcatacattgggacccctggaaagggtatccttgctgctgatgagtcgactggcacaattggcaagcgtctagctagcatcaatgtcgagaatgttgagacaaacaggagggctctacgtgagcttcttttcaccactcctggtgctcttcaatacctcagtggtgttatcctctttgaggaaacactatatcaaaagactgcaacaggaaagccatttgttgatgtcatgaaggaggctggagtcctcccagggattaaggtcgacaagggtacagtggagctagctggtaccaatggtgagaccaccacccaaggtctcgatggccttgctcaacgctgccagcagtactatgcagctggtgctaggtttgctaaatggagggctgttctcaagattggtcctactgagccatcacagcttgcaatcaatgaaaatgccaatggcctagcccgttatgccatcatctgccaggagaatggtcttgtacctattgttgagcccgagatccttgttgatggttcccatgatatcaacaagtgtgctgacgtgactgaacgtgttcttgctgcttgctacaaggcacttaatgatcatcacgtcctccttgagggaactttgttgaagcctaatatggttaccccaggatctgattctgccaaggttgcaccagaggtcattgccgagcacacagttcgtgcccttcaacgcacaatgcctgctgcagttcctgctgtggtgtttttgtctggtgggcagagcgaagaggaggctacacgtaatcttaacgcgatgaacaaactgaagaccaagaagccatggtccctttctttctcttttgggcgtgctctgcagcagagcaccctcaaggcttgggctggaaaagaagaaaacattgggaaggctcaggctgcattccttgcaaggtgcaaggccaattccgaagcaacccttggaacttaccagggtggtgcattgagtgagggcgcctctgagagccttcacgtcaaggactacaagtactaggccaaacttctgcatccctcaatctttccgctatattatggagggcaatcgggcaatatgt

SEQ ID NO: 1385 - DNA, 1541 bp, Mimulus guttatus
gatctcttcttcactccaccaactctcacttcgtctatctcaaaaattttccttgttttctccgcttctcagttcgcatcaagcatctgtgacaatgtcttgctacaagggaaagtatgctgatgagcttattgccaatgctgcatacatcggtacccctggaaagggtattctcgctgctgacgagtcaactggcacaatcggaaagcgtttcgaaagcattaatgttgagaatgttgaatcaaacaggagagctctccgtgagcttctcttcaccacccccggtgcccttcagcacctcagtggagtcatcctcttcgaggaaactctataccagaaaaccgccgcaggcaaaccctttgttgatgtaatgaaggagggaggtgttctcccaggtatcaaggttgacaagggcacagtcgagcttgccggaaccaacggtgaaaccaccacccaaggtttagatggccttgcccaacgctgccagcagtactacaaagctggtgcccgctttgccaaatggagagctgttttgaaaatcggcccgaacgagccatcacagctggcgatcaacgagaacgcaaacgggctggcccgttacgcaatcatctgccaggagaacggtctggtgcccatcgtggagcctgagatcctcgtcgacgggtcccacgacatcgacaggtgtgctgatgtcaccgagcgtgttcttgctgcttgctacaaggccctcaatgaccaccatgtcctcctagaaggaaccctattgaagcccaacatggtgacacctggctctgacgccaagaaggttgcaccggaggttattgccgagtacactgttcgcgctttgcagcgaacaatgccaccagctgttccggctgtggttttcttgtccggtggccagagcgaggaggaggcctcagtgaaccttaatgcaatgaacaagctcaaggcgaagaagccatggacactcactttctcattcgggcgggccctacagcagagcaccctcaaggcttgggctggaaaggaagagaatgttggaaaggcgcaggctgctttccttactaggtgcaaggctaactccgaggcgacacttggaacttacaagggtagcagctctttgagtgagggtgcttctgagagccttcacgttaaggactacaagtactaagtcgaagtcgttgctgtttttcttagccctgcctttttttttttccgtgtcaatggggagagagagagagaagtagtaattggtgacggtttttgactagttttcgtatttttctctttatattcccaaactttttattagacttgcgtgttttttaaataagcttttgaggaacttcggcactgtgaaatggatgtttgttgttgaacaggctgttttgctaaattatggctgttagttcttatttaagactttggcccccattgattgggtgagtttttctaatttgaattttcatgatttggtgctatgtgtttatcggcctgtctggaaatcttgttgtgtgtatttatttgttttccttttcttg

SEQ ID NO: 1386 - DNA, 1412 bp, Cajanus cajan
ctttaaacccttctcttcctctcctcacttcttctaacacacaatctcaacccaccatgtcttccttcaagagcaaataccaagatgaactcattgccaatgctgcttacattggcacgccagggaagggtatccttgctgctgatgagtcaactggcacaattggcaagcgtttggccagcattaatgttgagaatgttgaaacaaacaggcgtgctcttcgtgagctcctattcactacacctggtgcttttgagtgcctcagtggtgtgatattgttcgaggaaaccctataccaaaagacagcttcaggaaaaccctttgtggatttgttgaaggaaggtggagttcttcctggtattaaggttgacaagggcactgtagagcttgctggaactaatggggaaaccactactcaaggtttggatggccttggtcagcgttgccagaagtactatgaagccggtgcccgtttcgccaaatggcgtgctgtgctcaagattggcccaaatgaaccatctgagctggctatccatgaaaatgcgtatggtctggctcggtatgcagccatatgccaggagaatggtctggtacctattgtggagccagagatcttggtggatggacctcacgacatcaacaaatgcgctgaggtgactgagcgcgttcttgctgcatgctacaaggccctaagtgaccatcatgttctgcttgagggtactttgttgaagcccaacatggtgacccctggttcagagtctcccaaggtcaccccagaggtgatagctaagtacactgttacagctttgcagcgaactgttccggctgcagttcccgccattgtcttcttgtccggtggacagagtgaggaggaggcaaccctcaacctcaatgccatgaacaagttccagggaaagaagccatggtccctttctttctcctttggaagggcacttcagcagagcactctcaaggcatggtctgggaaagatgaaaacattaagaaggctcaggatgctttcattgtgaggtgcaaggcaaactcacatgcaacccttggaacttacaagggtgatgctacccttgctgagggtgcctctgagtctctccatgtgaaggattacaaatactaaaaaaggtgttggcttcttttggaggtttttgcactattggcaccaacattttcatgttctttaaataggagttagacacgttataggtttatggatttgagaataattgcatcaagcaaaattggcttggtatcgttgcttttcaattgagtttcccctttgttctccgtatttttgatcgagttttgttgtatttggagaagtgtcatttcatgtttcaatgcgatttggatgtgaaaaagcattttgctagcagcatatgaataaactttgaccggc

SEQ ID NO: 1387 - DNA, 1353 bp, Malus domestica
tcccaatccataaccgacccttaaagtttccgctctctcttctcacagtcaaaaatgtcggccttcaagggaaagtatcacgatgagctcattgctaatgctgcctacattggtaccccgggaaagggtatccttgctgccgatgagtcaactggcacgattggcaagcgtctttccagcattggcgttgagaatactgagacaaacaggcgcgctctccgtgagctgcttttcaccactcccggtgccctccaatacctcagtggagtcatcctctttgaggaaaccctctaccagaagacagctgctggtaagccgttcgttgatgttttgaaggagggcggtgtccttgctggaattaaggttgacaagggcactgttgagcttgctggtaccaatggtgaaaccacaactcagggtctggatggccttggcgaacgttgcaagaagtactacgaagctggtgcccgatttgcaaaatggcgtgctgtgctcaagattggccccaccgagccatctcagctggcaatcaacgagaacgccaatgggttggcccgatatgctatcatctgccaggagaatggccttgtccccattgttgagccagagatccttgttgatggatcccacgacattcagaagtgtgcttgtgaccgaacgtgttcttgccgcatgctacaaggcacttaacgaccaccatgtcctgcttgaagggactctcttgaagcctaacatggtgactccaggatctgattccaaaaaggttgcgcccgaggtggttgccgagcacactgtccgcgccttgcagcgcaccatgcctgcagctgtccctgctgtggttttcctctctggtgggcagagcgaggaggacgctaccctcaacctcaacgccatgaacaagttaaaggcgaagaagccatggactctttcattctccttcggacgtgcccttcagcagagcactctcaaggcttggtcaggaaaggaggagaatgtgaagaaggctcaggaagctttcctcaccagggccaaggctaactcggaagcgacattgggagcctacaagggtgacgccaagcttggcgagggtgccgccgagaaccttcatgtcaaggactacaagtattgattggggaagctgtcgaataccaaattgttatgcggttagaaggtagctttgttttcgcggtctcgtaacctaggtcgttcctttttgtttgctgaaactttgatcgtgatctcagtcgtgctgagattattaccggatactagtaggttttgataaaagctttgaggagagttttagtttgttcatcgacttggttttagtttggagaaatgtaaacttctttt

SEQ ID NO: 1388 - DNA, 1140 bp, Euonymus alatus
ctaactctctcgaaatctcatctctcctctcgtcctattcaatcaatctataatgtctagtttcaagggcaaatacgccgatgagctcattgccaatgctgcctacattggcactcctggtaagggtattcttgctgctgatgaatcgacggggacaatcggaaagcgtctagcaagcatcaacgttgagaatgttgaaacaaataggcgtgatcttcgtgagctcctattcaccgcccctggtgccctccaataccttagtggtgtcattctcttcgaggaaactctgtaccagaagactgcagcaggcaagcccttcgttgatgtgttgaaggaaggtggagtgctacctggtattaaggttgacaagggcactgttgtgcttgctggaaccaacggcgagaccacaactcaaggtcttgatggcctcgctcagcgttgccagaagtactatgaagctggtgcccggtttgccaagtggcgtgctgtgttgaatattggtccaactgagccatctcagctgtctatcaatgagaacgcgaacggtttggctagatatgctatcatctgccaggagaatggtcttgtcccaattgttgagcctgagatcctggttgatggttctcatagcattgagaagtgtgccgatgtgactgagcgtgtgctcgctgcatgttacaaggctctgaatgatcaccatgtcctgcttgagggtactctgctgaagcccaacatggttacccctggatcagatgcccctaaggttgcacctgaggtgattgctgagcacacagtgcgggctttacagcgcactgtccctcctgcagttcctgctatcgtcttcttgtctggtgggcagagcgaggaagaggctactgtcaacctcaatgctatgaacaagcttaaggggaagaagccatggagtctttccttctcatttggacgtgcccttcagcagagcactctcaaggcttgggctggcaaggaggagaatgtgaaggcggctcaagctgcactccttgccagtgcaaggctaactctgaggcaacccttggtacctacaagggtgatgcccagcttggtgagggtgcctctgaaagcctccatgtcaaggactacaaatactagaaagtgccagtc

SEQ ID NO: 1389 - DNA, 1449 bp, Arachis hypogaea
aattcaaaacccgccttctcccaattctcaatctttctctcaaccatgtcttcctttaagagcaagtaccaagatgagcttattgccaacgctgcttacatcggcaccccaggaaagggcatccttgccgccgatgagtcaaccggtacaattggcaagcgtttagccagcattaatgttgagaacgttgaaaccaacaggcgcgctcttcgcgaactcctattcaccacacccggtgctttggagtgcctcagtggtgtgatcttgttcgaggaaactctataccaaagcacagctgcaggaaaccttttgtcgaggtgctaaaggaaggtggagttcttcctggtattaaggttgataagggcacagtagagctccctggaacaaatggcgaaaccaccactcagggtttggatggccttggtcagcgatgtgcaaagtactatgaagctggtgcccgttttgctaaatggcgtgctgtgctcaagattggccccaacgaaccatctgagctggctatccatgaaaacgcgtatggtttggctcgctatgccgcaatttgccaggagaatggcttggttcctattgtggagcctgagatccttgttgatggacctcatgacatcaacaagtgtgctgcggtgacagaacgcgttcttgccgcatgctacaaggctctaaatgatcatcatgtcctgctcgagggaactttgttgaagcccaacatggtgacccctggatcggattctccaaaggttgcaccagaggtgattgccgaatacactgttagagctttgcagagaactgttccggccgcagtccctgctattgtcttcttgtccggagggcagagcgaggaggaggcaaccctcaacctcaatgccatgaacaagctcaagggaaagaagccatggtcactttccttctctttcggaagggcacttcagcagagcaccttgaaggcatgggccggaaaggatgaaaacatcaagaaggcccaggatgcattgttcacgaggtgcaaggccaactcacaagcaaccttgggaacatacaagggtgacgctacccttggtgatggtgcctccgagtctcttcatgtcaaggactacaaatactaagcttgtgtgattcaagaacttgttttcgacattttttttcactattgacaccaagttcttggtgttcttttctagttttagactactactctttttccttctgctctttgattaatcataggagggtcagggattaaagaataattgcttctagctgcattggctatcagctaccccttccccctttttccctttctttggatatcttttcggttttcgttgagttagttttcctgtgtaatagagtattgggtaagagttatttcttgcttcaatgcaattggagaacagtttgccaccatttttatgctctgaagcattgttcgtt

SEQ ID NO: 1390 - DNA, 1500 bp, Ocimum basilicum
gtttctgcattcttttctactcttccctttttcttctcctcacacattcaacttaccaacaatgtctgcctaccgcggaaagtacgctgatgagcttattgctaatgccgcatacattggtacccctggcaagggtattcttgctgctgatgaatctactggaacaattggcaagcgtttatctagcatcaatgttgagaatgttgagacaaacaggagggctctgcgagagcttcttttcactgcccctggtgcccttcagtatctgagcggtgtcattctttttgaggaaactctttaccagaaaactgctgcaggcaaacctttcgttgatgtgttgaatgaaggcggtgttcttcctggtatcaaggttgacaagggtactgttgagcttgctgggacagatggtgagacaaccacccaaggtcttgatggccttgcccagcgttgccaaaaatactatgaagccggtgctcgttttgctaaatggagagctgtgctgaagatcggccccaatgagccatcacagcttgctatcaatgagaatgccaatggtcttgcccggtatgccatcatctgccaggagaacggtttggtaccaattgttgagcccgagatccttgtcgatggctcccacgacatcaacaagtgtgccgatgttacagagcgagttcttgctgctgtgtacaaggccctcaatgaccaccacgtccttttggaaggaacattgttgaagcctaacatggttacacctggttctttatccgctaaggttgccccagaggtggttgctgagtacacagtccgcgccttgcaacggacaatgcctgctgcagtacctgctgtggtgtttttgtctggtggacagagtgaggaagaggcaaccctcaacctcaacgccatgaacaagctgaagacaaagaagccatggaccctgagcttctcattcggacgtgctctccagcaaagtaccctcaaggcatgggctggaaaagaagagaacattggaaaggcccaggctgctctacttgcaaggtgcaaggccaactcagaagctactcttgggacctacaagggtgatgctgttttgggtgagggtgcctcagagagcctccatgttgccaattacaagtactaggctgagtttttgtttcccttagagaggcatgcattatcagtgactagtttgttgacttatgaatttttatgcttcctttcttctcattctcctgctttaataagtctcgagggattgaacatcttcgctgctgagattgttggctgtcttttttttttgttattattatatcaacggctctttgttttgttctgccaatgtttggcaaagccaaattcgcttgttgttatggttttacatatatgaatttatgattcataaccctttgtttctttttcttaattccggcggctagtcgctgaatttgttgattcctaatgcgttccaataagctgaattgaaatcttggaaaatttttggcc

SEQ ID NO: 1391 - DNA, 1296 bp, Solanum melongena
atcatacgatatctctctcaaaattgtataccataaacatctctctcgtctttaaataagtccattaatcatgtcttgctacaagggaaagtatgctgatgagcttatcaagaatgctgcatacattggaacacctggaaagggtatccttgctgctgatgaatccactggcacaattggcaaacgtctctcaagcatcaatgttgagaatgtagaatcaaacaggagggctctccgtgagcttctcttctgtacccctggttgtcttcagtaccttagcggtgttatcttgttcgaggagacactctaccagaagactgctgctggcaagccttttgttgatgtcttgaaggaaggtggagtccttcccggtattaaggttgacaagggtactgttgagctccctggaaccaacggtgagaccactacccaaggtcttgatggccttgcagagcgttgcaaaaagtactatgaggctggtgctaggttcgccaaatggcgtgccgtgctcaagattggtgccaatgagccatctcagctcgccatcaatgaaaacgccaatggccttgctagatacgccattatctgccagcagaatggtcttgtacctattgttgagcctgagatccttgttgatggatcccacgacattaacaagtgtgctgatgttaccgagcgtgttcttgctgcttgctacaaggctctcaatgaccaccatgtcctccttgagggtaccttgttgaagcctaacatggttactcctggttctgattccgccaaggttgcaccagaagtgattgctgagtacaccgtccgtgtcttgcaacgcacaatgccagctgctgttcccgctgtggtgttcttgtctggtggacagagcgaagaggaagccaccgtcaacctcaacgccatgaacaagctccagactaagaagccatggtcactttccttctctttcggacgtgctcttcagcagagtaccctcaaggcgtgggctggaaaagaggagaacgtgcagaaggcacaagctgcattccttaccaggtgcaaggccaattctgaggctaccctcggaaagtacgccggagctaccaacttgagtgagggtgcttccgagagccttcatgtcaaggactacacgtactagatcaaagtttttagttttggtttttggtttatgtttcttgatttctgttttgaaaatgagatgaacaatatggttttactaaaatgtctttatcagtggacataatgtgtaaggctttctaaatctttttccctttaataagaaacttt

SEQ ID NO: 1392 - DNA, 1389 bp, Eschscholzia californica
cttctacaagaaaatctctctttctctctcttatcatcaacatcatgtcttgctacaaggggaaatacgctgatgagcttatcgccaatgctgcctacattggtacccctggaaagggtattcttgctgctgatgaatccactggtacaattggaaagcgtctatctagcatcaacgttgagaatgttgaggctaacagacgtgctctccgtgagcttcttttctgtaccccaggctgccttcaatacctaagtggtgtgatcctcttcgaagaaactctctaccaaaagactgctgctggtaagccattcgttgatgttctcaaggaggctggagtcctacccggtatcaaggttgacaagggtaccgttgagcttgccggaaccaatggcgagactaccacccagggtcttgatgggctagctcagcgttgccaacagtactacgccgctggtgctaggttcgctaagtggagggctgtcctcaatatcggcccaaatgagccatctcaattggctatcaacgagaatgctaatgggcttgcacgatatgccattatttgccaagaaaacgggttggtcccaattgttgagcctgagatcttggtcgacggaactcacgacattgaccgatgtgccgatgtcactgagagagtccttgcagcttgctacaaggcattgaacgatcaccatgtccttctcgagggaactcttttgaaacccaacatggttactcctggttctgaagcaaagaaggttgctccagaggtgatcgctgaatacactgttcgagctcttcagaggacaatgccaccagctgttcctgctgtggttttcttgtctggtggacaaagtgaagaggaagcaaccgtcaaccttaacgcaatgaacaagctcaagggaaagaagccatggtccctatctttctcctttggacgtgctcttcaatcaagtactctcaaggcatgggctggaaaggatgagaacattgagaaagcacagacagctttcctcacaagatgcaaggcaaactctgaagctaccttgggtacctacaagggtgatgctgtgattggagatggtgcctccgagagccttcacgttgctggttacaagtactgattgattccttgaaaaagggttctttctttactgttcttgtttcttttcgtttctgcttttgttgctgttttgattagtaaacttatctgggaatagaagataaaacaaagagtggtttctttggacttcaattttaagggtttagggagagagggtttaagagttaaggagtgatgcaataatttttgggcagggtcatgaatctgagatgatgtgttcttctccctctgcttgattcagattaattatgttttatcttatcggtgtt

SEQ ID NO: 1393 - DNA, 1530 bp, Arachis hypogaea
gacttctcttttattccttctcagtctgttgtcatcgttcacaacctaaccctctctctatctctctttccgttctccgatctaatcaatcatgtcgaacttcaagagcaagtaccatgatgagttgattgccaatgctgcatacattggcacccccggaaagggaattcttgctgctgatgagtcaactggaacaattggcaagcgtctatccagcatcaatgtcgaaaacgtcgaaactaacaggcgggctctcagggagctcctcttcaccactcctggagctcttcagtatctcagtggagttatcctttttgaggaaaccctctaccagagcactgctgcaggcaaaccttttgttgaggtcttgaaggaaggtggtgtgcttccaggtatcaaggttgataagggtaccgtcgagcttgccggaaccaatggagaaaccacaactcagggtcttgatggccttggtcagcgttgcgccaagtactacgaagctggtgcacgttttgccaaatggcgtgctgtgctcaagattggccccaccgagccatccgaacttgccatccacgagaatgcatatggattggccagatatgccgccatttgccaggagaatggtcttgttcccattgttgagcctgagatcctcgttgatggaccccatgatatccacaagtgtgctgcagtaacagagcgagtgcttgcagcatgctacaaggcactgaacgaccaccatgtcttgcttgagggaacactcttgaaaccaaacatggttacccccggatctgactctgcaaaggttgcccccgaggttgttgccgagcacactgtgagagctcttcagcgaactgtcccgtctgctgtccctgccgtggttttcctctctggtggacagagtgaggaggaggcaaccctcaacctcaatgccataaaccaagtcaagggtaagaagccatggtccctttccttctctttcggaagggcacttcaacagagcactcttaaggcttggagtggaaaagaggagaatgtgaagaaggctcaagaagcattcctcacaagggcaaaggccaattctgaagcaactctcggaacatacaagggtagtgcaaaccttggtgagggtgcctcagagagccttcatgttaaggactacaagtactgagcaaggtttctgtgcgttactatttacatccctggaggataggaatttggggtatttgggggtacaagtcaagttttctgttgagggttttgagcgagtgtttttatggttggacttgtgacaaaaaaaataattgcctttgagctttttcgctattttggttttgcaagtgttcctatgctcatttcagtgtatgtaaaactgtactgagactgagaatttggttttcaagacacttatgtgtgcgcttatgaattttatttttccaactgaatgtaagtctcatggggattctacagacttcagtcaataactgtcttttcaatatttgataaactaaaatgttttaatttgagtagaag

SEQ ID NO: 1394 - DNA, 1449 bp, Arachis hypogaea
aattcaaaccccgccttctcccaattctcaatcttcctctcagccatgtcttcttttaagagcaagtaccaagatgagcttattgccaacgctgcttacatcggcaccccaggaaagggcatccttgccgccgatgaatcaaccggtacgattggcaagcgtttagccagcattaatgtcgagaatgttgaaaccaacaggcgcgctcttcgcgaactcctattcaccacacccggtgctttggagtgcctcagtggtgtgatcttgttcgaggaaactctataccaaagcacagctgcaggaaaacctttcgtcgaggtgctaaaggatggtggagttcttcccggtattaaggttgataagggcacagtagagctccctggtacaaatggcgaaaccaccactcagggtttggatggccttggtcagcgatgtgcaaagtactatgaagctggtgcccgttttgctaaatggcgtgctgtgctcaagattggccccaatgaaccatctgagctggctatccatgaaaacgcgtatggtttggctcgctatgctgcaatttgccaggagaatggcttggttcctattgtggagcctgagatccttgttgatggatctcatgacatcaacaagtgtgctgcggtgacagaacgcgttcttgccgcatgctacaaggctctaaatgatcatcatgtcctgctcgagggaactttgttgaagcccaacatggtgacccctggatcggattctccaaaggttgcaccagaggtgactgccgaatacactgttagaactttgcagagaactgttcccgcagcagtccctgctattgtcttcttgtccggagggcagagcgaggaggaggcaaccctcaacctcaatgccatgaacaagctcaaggggaagaagccatggtcactttccttctctttcggaagggcacttcagcagagcaccttgaaggcatgggccggaaaggatgaaaacatcaagaaggcccaggatgcattgttcacgaggtgcaaggccaactcacaagcaaccttgggaacatacaagggtgacgctacccttggtgatggtgcctctgagtctcttcatgtcaaggactacaaatactaagcttatgtgattcaagaacttgttttcgacatttttttcactattaacaccaagtttttggtgttcttttatagttttagactaccactcttttgccttctgctcttttgattaatcataggagggttagggattaaagaataattgcttctagctgcattggctatcagctacccttccccctttttccctttctttggatatcttttaggttttcgttgaggtagttttcctgtgtaatagagtattggataagagttatttcttgcttcaatgcaattggagaacagtttgccaccatttttatgctccgaaccattgttcgtt

SEQ ID NO: 1395 - DNA, 1396 bp, Prunus persica
ccatctccctcctccctcaatctctagataaaccaaaacagtctttcatattccagtctcttcttactatcaacaatgtcggccttcaagggaaagtaccatgatgagctcattgctaatgctacctacattggcacccctggaaagggtatccttgctgctgatgagtcaactggcacaattggcaagcgcctttcaagcattaatgttgagaatagtgagacgaacagacgcgccctccgtgagttactcttcaccacccctggtgccctccaatacctcagtggagtgattctctttgaggaaaccctctaccaaaagacagctgctggtaagccatttgttgacgttttaagggaaggcggtgttctccctggcatcaaggttgacaagggcactgttgagcttgctggtaccaatggtgagaccacaacccagggtctggatggccttggagagcgttgcaaaaagtactatgaagctggtgctcggtttgcaaaatggcgtgctgtgctcaatattggccccagtgagccatctcagctctcaatcaatgagaatgccaatgggttggcccgatatgctatcatctgccaggagaatggcctggtccccattgttgagccagagatcctggttgatggatcccatgacattcacaagtgtgctgaggtgaccgaacgtgttcttgctgcatgctacaaagctcttaacgaccaccatgttctgcttgaaggaactctcttgaagcctaacatggtgactccgggatctgattcaccaaaggttgcaccagaggtgattgctgagcacacagtccgttccttgcagcgcaccatgcctgtggctgttcctgccgtggttttcttgtccggtgggcagagtgaggaggaggctaccctcaacctcaatgccatgaacaaattgaaggggaagaaaccatggactctatccttctctttcggacgggctcttcagcaaagcaccctcaaggcttgggcaggaaaggaggaaaatattaaggcggcacaggaggctttcctcaccagggcaaaggccaactcggaagcgacattgggaacctacaagggtgatgccaagcttggtgagggtgctgcagagagccttcatgtcaaggactataagtattgatgcagagctgtgtaaaagccaatgattttgctcttacaaaaacggtgttttggtgtcgtagtgtaggttctttttcaagttttctttctaatctctgccttgacgagattattgccagttactagtagaatatgataaaagcttgaggaacggtttgcaagcatgaagagttttttgttgtttatgtcgctcgttttggttggtgaagtgctcatgctcatgtatttgggtaatctgcttttat

SEQ ID NO: 1396 - DNA, 1406 bp, Fragaria vesca
aggcgatttctcagaccaaaccctccctctctctctctccaagcttagtaccaaccaaccatgactgcttacagaggcaaatacgctgatgagctcattaagaatgctgcctacattggcacccctggaaagggtattctagctgctgatgagtccactggcactattggaaaacgttttgacagcatcaaagttgagaatgttgaagagaacaggcgtgctcttcgtgagctcctcttcactgcccctggtgtcctccagtaccttagtggagtgatcctctttgaggagaccctctaccagaagacagctgaaggcaagcctttcgttgatgtcttgaacgagggtggtgttcttcctggtatcaaggttgacaagggtgttgttgagcttaaaggtactgatggtgagaccacaacccagggattggatggccttggtgcccgctgcgctaagtactacgaagctggtgccaggtttgccaaatggcgtgccgttctcaagattggtcccaatgagccatctcagctctcaatcaacgagaatgctaatggcttggctcgttatgctatcatctgccaggagaatggtttggtacccattgttgagcctgagatccttgttgatggaccccactccattgacaagtgtgctgatgtgactgagcgtgtacttgctgcatgttacaaggctctcaatgaccaccacgtccttcttgaaggaactctcttgaagcccaacatggttactcccggatctgaagccaagaaggcttcaccagaagtgattgctgagtacaccgtccgtgccttgcagcgcactacccccgcagctgtccctgctgtggtgttcttgtctggtggacagagtgaggaggaggctaccctcaaccttaacgccatgaaccagctcaagggaaagaagccatggactctttccttctcttttggccgtgctcttcaggccagcactctcaaggcttggtcaggaaagaaagagaatgtcaaggctgcccagcaggcactcctcacaagggccaaggccaactcagaggcaaccttgggaatctacaagggtgatgccaagctcggagaaggagctgctgagagccttcatgtcaaggactacaagtactgaagaagttttagacttctctccatgtgctctgtttttggaaaactatctttctgagttgtgtatcacattggctttttcaggcatatagttttagggatttttcaaagttctgtttttcaatcttgatcttggtttgtagggtttgttagaataaaaagcttgaagagcattgacatgttgagtttgaaatgtttctatgcctgttcaaaagaacggatcatgatatatattttgcttgaatgaagataagcatcttacattctgaataa

SEQ ID NO: 1397 - DNA, 1420 bp, Fragaria vesca
ctctttcgtctctctcgatttctcagaccaaaccctccctctctctctctccaagcttagtaccaaccaaccatgactgcttacagaggcaaatacgctgatgagctcattaagaatgctgcctacattggcacccctggaaagggtattctagctgctgatgagtccactggcactattggaaaacgttttgacagcatcaaagttgagaatgttgaagagaacaggcgtgctcttcgtgagctcctcttcactgcccctggtgtcctccagtaccttagtggagtgatcctctttgaggagaccctctaccagaagacagctgaaggcaagcctttcgttgatgtcttgaacgagggtggtgttcttcctggtatcaaggttgacaagggtgttgttgagcttaaaggtactgatggtgagaccacaacccagggattggatggccttggtgcccgctgcgctaagtactacgaagctggtgccaggtttgccaaatggcgtgccgttctcaagattggtcccaatgagccatctcagctctcaatcaacgagaatgctaatggcttggctcgttatgctatcatctgccaggagaatggtttggtacccattgttgagcctgagatccttgttgatggaccccactccattgacaagtgtgctgatgtgactgagcgtgtacttgctgcatgttacaaggctctcaatgaccaccacgtccttcttgaaggaactctcttgaagcccaacatggttactcccggatctgaagccaagaaggcttcaccagaagtgattgctgagtacaccgtccgtgccttgcagcgcactacccccgcagctgtccctgctgtggtgttcttgtctggtggacagagtgaggaggaggctaccctcaaccttaacgccatgaaccagctcaagggaaagaagccatggactctttccttctcttttggccgtgctcttcaggccagcactctcaaggcttggtcaggaaagaaagagaatgtcaaggctgcccagcaggcactcctcacaagggccaaggccaactcagaggcaaccttgggaatctacaagggtgatgccaagctcggagaaggagctgctgagagccttcatgtcaaggactacaagtactgaagaagttttagacttctctccatgtgctctgtttttggaaaactatctttctgagttgtgtatcacattggctttttcaggcatatagttttagggatttttcaaagttctgtttttcaatcttgatcttggtttgtagggtttgttagaataaaaagcttgaagagcattgacatgttgagtttgaaatgtttctatgcctgttcaaaagaacggatcatgatatatattttgcttgaatgaagataagcatcttacattctgaataacc

SEQ ID NO: 1398 - DNA, 1390 bp, Musa acuminata
gggggatccgtctctcttctctcctacgctccatcgccccatcgtttcgttcttcttccgatctctctcttcctgaactcgaagatgtctgcctactgcggccagtaccacgatgagcttatcgccaatgctacctacattggcaccccaggcaagggtatccttgctgctgatgagtccactggcacaataggcaagcgccttgctagcatcaacgtggagaatgttgaggagaaccgccgctctctccgagagcttcttttttgcgctcctggcgccctccagtacctcagtggtgtaatcctcttcgaggagaccctctaccagaagacagccagcgggaagccttttgtcgaagtgctcaaggagggtggagtccttcctggtatcaaggtggacaagggcaccattgaactcgctggtaccaatggcgagaccactacccagggtcatgatgacctgggcaagcgctgcaagaagtattacgaggcagggggctcgctttgccaagtggcgtgccgttctgaagattggtccaaatgagccgtcgcaattggcgatcgatgcaaatgctgatgggctggcacgctatgctatcatctgccaggagaatggcctcgtcccgatcgtagaaccagagatcctcgtcgatgggccacatgatatcgcgaaatgtgcttatgttacagagcgggtgcttgccgcttgctacaaggcgctaacaacacatgttcttctggagatctctgttgaaccaaacatggtgacccaaggtcagaatccgcaaaggtggctcccgaggtgatcgcagagtacaccgtgcgagctctccagaggactgttcctgctgctgtccctgcaatcgtcttcctctcaggagggcagagcgaagaggaggctactctgaacctgaacgcaatgaacaagctgaaggggaagaaaccatggtcgctgtccttttcattcggccgcgctctgcagcagagcacgctcaaggcgtgggctggcaaggaggagaacgtccagaaggcgagggccgctctcctcacaaggtgcaaggcgaactccgaggcaacactcgggacgtacaagggtgatgctgccggaggagaaggtgtctccgagagcctccatgtcaaggactacaagtactgatcaggcttgtttatttattctacccgatgagtgtttaaacaatcgcattaagttcaaactaatgctggaccgggggatctttaatcttttgctgcttaagatgttgcttaataagttggggggcggtttatgccttcaacttttacggtttaggtctgttatccctcatgcattttgttttacttggataatgactgatcttgcggtttgttcctctaaaaatgattgttgcttg

SEQ ID NO: 1399 - DNA, 1466 bp, Euonymus alatus
ggcctttcttgcaatacccaaaccacaatataaaccattggcccccaactctctcaaacgcttctgtgttcgtctctttgatctaacttcgaaatattatctctctccttaatcagttgatcatgtcttccttcaagggcaaatacgctgatgagctcattgccaatgctgcttacattggcactcctggtaagggtattcttgctgctgatgaatcaactgggacgatcggaaagcgtctggcaagcatcaacgttgagaatgttgaaacaaacaggcgtgctcttcgtgagctcctattcactgcccctggtgctctcccatgcctcagtggtgtcatcctctttgaggaaaccctataccagaagactgcagcaggcaagcccttcgttgatgtattgaaggaaagtggagtgctaccaggtattaaggtcgacaagggcactgttgagcttgctggaaccaacggcgagacaacaactcaaggtcttgatgggcttgctcagcgttgccagaagtactatgaagctggtgcccggtttgccaagtggcgtgctgtgttgaagatggtccaactgagccatctcagctggctatcaatgagaatgccaacggtttggctagatatgctatcatctgccaggagaatggccttgttccaattgttgagcctgagatcctggttgatggtccccatagcattgagaagtgtgctgatgtgactgagcgtgtgctcagtgcatgttacaaggctttgaatgatcaccatgtcctgcttgagggtactctgttgaaacccaacatggttacccctggatcagaggcccctaaggttgcacctgaggtgattgctgagcacacagtgcgggctttacagcgcaccgtgcctcctgcagttcctgctattgtgttcttgtctggtgggcagagcgaggaagaggctactgtcaacctcaatgccatgaacaagcttaaggggaagaagccatggagtctttccttctcatttggacgtgcgcttcagcagagcactctcaaggcttgggctggcaaggaggagaacgtgaaggcggctcaagctgcactccttgccaggtgcaaggctaactctgaggcaacccttggtacctacaagggtgatgctcagcttggtgagggtgcctctgaaagcctccatgtcaaggactacaaatactagaaagtgccggctttttggtcagtttttgtttttgttttacgttttgcggagcaaattatgtcgtactctcaggcatagttttagattatattctcatctttccttgcggaatctacaatggagacggaaaaataaagcttgaggtgtcttgtaactctgtatttggaaatggttttggtcaatgtttttgattaccttgtatgttctgtcctcgttcctcctggaggaggttcttgaattccttttggattatgttttctcgtctttc

SEQ ID NO: 1400 - DNA, 1233 bp, Parthenium argentatum
aactttctctccaagcttctcttctcttttccagatctcacctttcacagccatgtcttgctacagaggaaagtatgctgatgagctaattgccaatgctgcttacattggcacacccggcaagggtattcttgctgctgatgagtcaactggcaccattggaaagcgtctatcgagcatcaatgttgagaatgttgagtcaaacaggagagctcttcgtgagcttcttttctgcactcccggtgccctccaatacctcagtggagttattctttttgaagaaaccctttaccagaagactgctgcaggtaagccatttgtggatgtcatgaaggaagctggagtcctccctggtatcaaggttgacaagggtaccgttgagcttgctggaacaaacggtgagaccactacccaaggtctagatggtctagcccaacgatgtgctcagtactactcagccggtgccaggtttgccaaatggcgtgcagtcttgaaaatcggcccaaacgagccatcacagcttgccatcaatgagaacgccaacggtctagctaggtacgccatcatctgccaagagaacggtttggtcccaattgttgagcctgagattctcgtggatggaccacacgacatcaacaagtgtgctgatgtaactgagcgtgttctagctgcctgctacaaagctctcaacgaccaccatgttcttcttgagggtacccttttgaaacccaacatggttacccccgggtctgatgccaaaaaggttgcaccagaagttgtagctgagtacaccgtccgtgccctgcaacgaaccatgccagctgcagtcccagccgttgtgttcttgtctggcggtcagagtgaggaagaggctaccgttaacctcaacgccatgaaccagtacaagggcaagaagccatggacgttgtcgttttcattcgggcgtgccttgcaacaaagcaccctcaaggcttgggccgggaaagaagagaatgtgcagaaagcccaggctgcgtttcttgcaaggtgcaaggccaactctgaggcaacccttggaaagtatcagggtggttctggtttgagtgaaggagcatccgaaagtctccatgttaaggactacaagtactaaactttactacataagtcttaagtattattatgtttcttaggagacgattttgtttggataaggtggatttgtttttctggacctatttctatgttttttgcttt

SEQ ID NO: 1401 - DNA, 1271 bp, Thalictrum flavum
ggaaaataccatgatcagctcattgccaatgctgcttacattggcactcctggaaagggtatccttgctgctgatgagtccacaggcacaattggtaagcgtctagctagcatcaatgttgagaatgttgagactaacaggcgtgccctacgtgaacttcttttctgcacacctggtgctcttcaatacctcagtggtgtcatcctctttgaagagactctctatcagaagactgctgctggtaaaccatttgtagaagtcctgaaagaaggtggagtcctccctggtatcaaggttgataagggtactgttgaacttgctggtaccaatggtgagactacaactcaggggcttgatgggctcgcccagcgatgccagcagtattatgcggctggtgctaggtttgctaagtggcgtgctgtgcttaagatcggtcccactgaaccatctcagttggctatcaatgagaatgccaatggactggccaggtatgctatcatttgtcaggagaatggattggtcccaattgtcgagccagagatccttgttgatggttctcacgacattgaccgatgtgcggatgtgacagagcgtgtactagctgcctgctacaaggcactcaatgaccaccatgtcctacttgagggaactttactgaagccaaatatggttacccctggttctgatgctaaaaaagtcaccccagatgtggtagctgagtacacagtgcgtgccttgcagcgaacaatgccttcagcagttcctgctgtgttattcttgtcaggtggacagagtgaagagcaggccacactgaacctaaatgcaatgaacaagcttaagggaaagaaaccatggtcgctctcattctcctttgggcgtgctttgcagcagagcactctcaaggcctgggccggtaaagaggtgaacttggaaaaggctcaggctgctttcctttcaaggtgcaaggcaaactctgaagctacccttggtatttacaagggtgatgctgcacagggagaaggtgcttctgagagcctgcatgtcaaaggctacacatattaacgcagtcaattctatgaggggttttttgctatgtttatgagttaagtaggtgaggtttggatcggagttgagtttcctatgcgatagatgtgtcaatgtttctgttgcctttgacaaaaaaaagtatgatggtgcaataagttgtcacttaggcttgtgtctgttatgtgagtgtttctttttaatagtaaatagcttattatgcagtt

SEQ ID NO: 1402 - DNA, 1428 bp, Tripterygium wilfordii
aatcagtctaccatgtcttgcttcaaggggaaatacgctgatgagctcattgccaatgccgcctacattggcactcctggtaagggtattcttgctgctgatgaatcgactgggacaatcggaaagcgtctatcaagtatcaacgttgaaaatgttgaaacaaacaggcgtgctcttcgtgagctcctattcaccgcccctggtgcccttcaatacctcagtggtgtcatcctctttgaggaaaccctgtaccagaagactgcagcaggcaagccctttgttgatgtgttgaaggaaggtggagtgctaccgggtattaaggttgacaagggcactgttgagcttgctggaaccaatggcgagaccacaactcaaggtcttgatggccttgctcagcgttgtcagaagtactatgaagctggtgcccggtttgccaagtggcgtgctgtgttgaagatcggtctaactgagccatctcagttggctatcaatgagaacgccaacggtttggctagatatgctatcatctgccaggagaatggtcttgtccctattgttgagcctgagatcctggttgatggttctcatagcattgagaagtgtgctgatgtgactgagcgtgtgctcgctgcatgttacaaggctttgaatgatcaccatgtcctgcttgagggtactctgttgaagcccaacatggttacccctggatcagaggcccctaaggttgcacctgaggtgattgctgagcacacagtgcgggctctacagcgcactgtccctcctgcagttcccgctattgttttcttgtctggtgggcagagtgaggaagaggctaccatcaacctcaatgccatgaacaagcttaaggggaagaagccatttagtctttccttctcatttggacgtgcccttcagcagagcactctcaaggcttgggctggcaaggaggagaatgtgaaggcggctcaagctgcgctccttgccaggtgcaaggccaactctgaggcaacccttggtacctacaagggtgatgccaagcttggtgagggtgcctctgaaagcctacatgttgcggactacaaatactaggaagtgccggcttttttggtcagtttgtgttttatgttttgcggagcaaattaggttgtggtgttctctcaggcgtaggattagattatattcctctcttctagtggaatttacgatggggacaggaaaataaagcttgagttgtttgaagtttgaaatggttttgctcattgcttttcattactttgtatgttttgtcctcattcctccttgtggaggttcatgactgaggaattcctttccttttggattatgtttccagttttctcgtctttcgttggataatttttttatgatttctactgtacttttgcaaccctggtcgactaccttaattcc

SEQ ID NO: 1403 - DNA, 1440 bp, Amborella trichopoda
  misc_feature (1074)..(1074): n is a, c, g, or t
  misc_feature (1208)..(1208): n is a, c, g, or t
  misc_feature (1215)..(1215): n is a, c, g, or t
  misc_feature (1250)..(1250): n is a, c, g, or t
ctttcttcttgttaaaaaccccaaacaaatctcgtcgaccctctgtttctatctctgctctctaaaaatgtcggctttttgtgggaaatataccgatgagctgatcaagaatgcggcctatattgggacccctggcaggggcatcctcgctgctgatgagagtacaggcaccattgggaagcggttgtcaagcatcaacgtcgagaatgttgagtccaaccgtcgtgctctccgcgagctcctcttctgcacacctggtgccctccagtgcctaagcggggtcatcctctttgaagaaaccctctaccaaaagtcatcgtcagggaaaccctttgttgaaatcttgaaggagggtggtgtgttgcctggtatcaaggtcgataagggcactgtggagctcgcagggaccaatggagagaccacaacacaaggacttgatgggctcgcggcgaggtgccagcagtattatgcggccggtgcgaggtttgcgaagtggcgtgctgtgttgaagatcggacccacagagccatcaccactttcaatccttgaaaatgcaaatgggcttgcacgatatgccataatctgccaggagaacgggttggtacctattgtggagccagagatcctggttgatggctcccacagcattgaggtgtgtgctgcagccaccgagcgtgtgcttgctgctgtctacaagtcccttaacgaccaccatgtgctcctcgagggcaccctcctgaagcccaacatggtcacccctggttccgatgctcccaaggttgcccctgaggtcattgctgagcacaccatccgcgccctccagcgcactgtacctgcagccgtccctgccattgtgttcctctcaggagggcagagcgaggaggaggcgacattgaacctgaatgcaatgaacaagctgaagacgaacaagccatggaatttgagcttttctttcgggcgagccctccaacagagtacactcaagacctgggccgggaaagaggagaacattcctgcagcacaaaagtcgtttttggcacggtgcaaggcaaactcggaggcgacacttggganatacaagggagacgcccctgtcggggagggtgcatcagagagtcttcatgtcaaggattacaagtattagagagtatatgttctctctctgtcccctgagtccctctctcatcttcttctttttttggacattnctgagtntctgtttgttgtctctgtcctttggttcggctggnttggtttgctgcttttgagagggtttttcctcttttttttaggattttgtcatgttactggttttggtttagggagaggagtgcaaataaactttttgagggcatgtctgatggcgtgttctccaccaaagaagtagcacttgaggtgttattaacttgcacttgaggtgttattaacttattttgttct

SEQ ID NO: 1404 - DNA, 1373 bp, Helianthus annuus
actttcctcttttctgtaactaacttcttctccaagcttctcttttcagatctcaaaccatgtcttgctacagaggaaagtatgctgatgagctaatcgccaatgctgcttacattggtacacccggaaagggtattcttgctgctgacgagtcaactggcactattggaaaacgtctatccagcatcaatgttgagaacgttgagtcaaacaggagagctcttcgtgagcttcttttctgcactcccggtgccctccaatacctcagtggagttattctttttgaggaaaccctctaccagaagactgctgcaggtaagccgtttgtggatgtcatgaaggaagccggagttctccctggtatcaaggttgacaagggtaccgttgagcttgctggaacaaatggtgagaccacaacccaaggtctagacggtctagcccaacgatgcgcccaatactattcagccggtgcccgtttcgccaaatggcgtgcagtcttgaaaatcggcccgaacgagccatcacagctcgccatcaacgagaacgctaacgggctagctaggtacgccatcatctgccaagaaaacggcttggtcccaatcgttgagcctgagattctcgtggacggaccccacgacatcaacaagtgtgctgatgtaaccgagcgtgttctagccgcctgctacaaagctctcaacgaccaccatgttctcctcgagggtacccttttgaaacccaacatggtcacacccgggtcagacgccaaaaaggttgcaccggaagttgtagccgagtacactgtccgcgctttgcaacgaaccatgccagcagcggttccagccgttgtgttcttgtcaggcggtcagagcgaggaagaggctactgttaacctcaacgccatgaaccagtacaaaggtaagaagccgtggtcgttgtcgttttcatttgggcgggccctacaacaaagcaccctcaaggcttgggccgggaaagaagagaatgtgcagaaagcacaggctgcgtttcttgcgaggtgcaaggctaactctgaggcgacccttggaaagtatcaaggtggttctggtttgagtgaaggtgcatctgaaagcctccatgttaaggactacaagtactaaacgttgctgcgtaagtcttcagtactatgttttttttttgagacatttttgtctgaatgaggttggttggattttgattttctggacctatttctatgtttgttttttgttttagacctgtggtttaaatccgagtaggagatttttataataagcatgagtaacatttctgcttggtttgattgatatatacttctgtttgctgcttttgaggtttgatttgtgctgaggattgat

SEQ ID NO: 1405 - DNA, 1336 bp, Nicotiana tabacum
attgtattctcttctatctctctcagttgaacttctcactttgtctcttttttctctagtttcttttaagccttttatcatgtcttgctacaagggcaaatacgccgatgagcttattgctaatgctgcatacattggaacccctggaaagggtatccttgctgctgatgaatccactggcacaattggcaagcgtttctcgagcatcaacgttgagaatgtcgaatcaaacaggagggctctccgtgagttgctcttcaccacccccggagctgttcagtacctcagcggtgttatcttgttcgaggaaacactttaccagaagaccgcttctggcaagcctttcgtcgatgtcttgaaggagggtggagttctccccggtattaaagttgacaagggtaccgttgagctcccaggaaccaacggtgagaccaccacccaaggtcttgacggccttgcagagcgatgccaaaagtactacgaggctggtgctaggttcgccaaatggcgtgccgtactcaagatcggtgccaatgagccttctcagctcgcgatcaatgagaacgccaatggccttgcaagatatgccattatctgccaacaaaatggtcttgtacccattgttgagcccgagatccttgttgatggatcccatgacattaacaagtgcgctgatgttaccgagcgtgttcttgctgcttgctacaaggctctcaatgaccaccatgtactcctcgagggtaccttgttgaagcctaacatggtcactcctggttctgaagccgccaaggttgcacctgaggtgattgctgagtacaccatccgtgccttgcagcgcacaatgccggctgctgttcccgctgttgtgttcttgtctggtggtcaaagtgaagaggaggccaccgtcaacctcaacgccatgaacaagctccaaaccaagaagccatggtcgctttcattctcctttggacgtgctcttcagcagagcaccctcaaggcttgggccggaaaggaggagaatgtacagaaggcgcaagctgcattccttactaggtgcaaggccaactccgaggctacactcggaaagtatgctggtgctaccaacttgagtgagggtgcttccgagagtcttcatgtcaaggactacaagtactagaacaagttttttggtttctgtccctttttttgatttccgttttgaaaacgagatggcagtatcgaattacgaaagtgtctgttttaatggacatagtgtgtaaggctttctttctgtttttttctatctgatgtatggccgcggattggtttaataacaaacaatattggtgttgtgaca

SEQ ID NO: 1406 - DNA, 1515 bp, Solanum lycopersicum
agagggtaaaagggtaaataaagatccgctattttcgtgcagaaggggtcgaaaattggcgataacaccgatgcgaacgctgtattaaacctaaattttcccactcctccatttgtctgtgatctctctctctctgcaaaacttctcttctacactcttcttcatcgtcgaagcaataacaatgtcgtgctacaagggaaaatacgccgatgaactgatcaagaatgctgcatacatagctacccctggtaagggtatccttgctgctgacgagtctactggtacaattggcaagcgtctatccagcattaatgttgagaatgtcgagtcaaacaggagggctcttcgagagctgctcttctgcgcacctggagctcttcagtaccttagtggaattatcttgttcgaggaaaccctttatcagaagacagcagctggcaagccttttgttgatgttatgaaggagggtggagtcctccctggaattaaagtcgacaagggtaccgtagagcttcccggaaccaatggtgagacaactacccagggtcttgatggccttgcggagcgctgccaaaagtactatgaagccggtgctaggtttgccaaatggcgtgcagtgctcaagattggtgccaatgagccatctcagctcgctatcaatgataatgccaatggccttgccagatatgccatcatctgccagcaaaacggtcttgtccccattgttgagcctgagatccttgttgatggatcccatgacattaacaagtgtgctgatgtcacagagcgtgttcttgctgcttgctacaaggccctcaatgaccaccatgtcctcctcgagggtacattgttgaagcccaacatggtcactcccggatctgatgcccctaaagttgcaccagaggtcattgcggagtacaccgtacgtgccttgcagcgaacaatgccagctgctgttcctgctgtggttttcctgtctggtggtcagagtgaggaagaggctacccgcaacctcaacgccatgaacaaacttcaaaccaagaagccctggaccctctccttctccttcggacgtgctctccaacagagcaccctcaaggcctggtcaggaaaggtggagaatatcgggaaggcccaagctgcacttctcacaaggtgcaaggccaactctgaggctacccttggaaagtatgccggtagttccaacttgggcgacggtgcttccgagagccttcacgtcaaggactacaagtattaggacattattcggttccctcgctctctttttggtttctgttttgatgatgaggttttgcaagatggtttactagaagtgtcttttaccggtcatagtgtgctagtcttttctttttgtcacaagatttgttcaataaaagcttgagaaacgtcggctttgtgacattgtaggggtctttattagtgtgttaatctagattatgttatcggatttattccctgttggggttttacatattaatctttggtttttgcata

SEQ ID NO: 1407 - DNA, 1418 bp, Solanum lycopersicum
agagggtaaaagggtaaataaagatccgctattttcgtgcagaaggggtcgaaaattggcgataacaccgatgcgaacgctgtattaaacctaaattttcccactcctccatttgtctgtgatctctctctctctgcaaaacttctcttctacactcttcttcatcgtcgaagcaataacaatgtcgtgctacaagggaaaatacgccgatgaactgatcaagaatgctgcatacatagctacccctggtaagggtatccttgctgctgacgagtctactggtacaattggcaagcgtctatccagcattaatgttgagaatgtcgagtcaaacaggagggctcttcgagagctgctcttctgcgcacctggagctcttcagtaccttagtggaattatcttgttcgaggaaaccctttatcagaagacagcagctggcaagccttttgttgatgttatgaaggagggtggagtcctccctggaattaaagtcgacaagggtaccgtagagcttcccggaaccaatggtgagacaactacccagggtcttgatggccttgcggagcgctgccaaaagtactatgaagccggtgctaggtttgccaaatggcgtgcagtgctcaagattggtgccaatgagccatctcagctcgctatcaatgataatgccaatggccttgccagatatgccatcatctgccagcaaaacggtcttgtccccattgttgagcctgagatccttgttgatggatcccatgacattaacaagtgtgctgatgtcacagagcgtgttcttgctgcttgctacaaggccctcaatgaccaccatgtcctcctcgagggtacattgttgaagcccaacatggtcactcccggatctgatgcccctaaagttgcaccagaggtcattgcggagtacaccgtacgtgccttgcagcgaacaatgccagctgctgttcctgctgtggttttcctgtctggtggtcagagtgaggaagaggctacccgcaacctcaacgccatgaacaaacttcaaaccaagaagccctggaccctctccttctccttcggacgtgctctccaacagagcaccctcaaggcctggtcaggaaaggtggagaatatcgggaaggcccaagctgcacttctcacaaggtgcaaggccaactctgaggctacccttggaaagtatgccggtagttccaacttgggcgacggtgcttccgagagccttcacgtcaaggactacaagtattaggacattattcggttccctcgctctctttttggtttctgttttgatgatgaggttttgcaagatggtttactagaagtgtcttttaccggtcatagtgtgctagtcttttctttttgtcacacgatttgttcaataaaagcttgagaaacgtcggctttgt

SEQ ID NO: 1408 - DNA, 1458 bp, Cynara scolymus
  misc_feature (731)..(731): n is a, c, g, or t
  misc_feature (1092)..(1092): n is a, c, g, or t
  misc_feature (1177)..(1177): n is a, c, g, or t
  misc_feature (1222)..(1222): n is a, c, g, or t
  misc_feature (1314)..(1314): n is a, c, g, or t
  misc_feature (1316)..(1316): n is a, c, g, or t
ttcgtttccctttcttcacagttttctctcgaatcgtcttttttagatctaaatctcatcgccatgtcttgctacaaaggaaagtatgctgatgagcttattgccaacgctgcttatattggtacccctggcaagggtattctcgctgctgatgagtcaaccggcacaattgggaaacgtctatccagcatcaatgttgagaatgtcgagtcaaacaggagagcacttcgtgagcttcttttctgcactcctggtgctctccagtacctcagcggagttattcttttcgaggaaactctttaccagaagactgctgcaggcaagccatttgttgatgtcatgaaggaagctggagtcctccctggtattaaggttgacaagggtaccgttgaacttgctggaaccatggggagaccacaacccaaggtcttgacggtcttgcccagcgatgtgcccagtactatacagctggtgctagatttgccaagtggcgtgcagtcctaaatattggtgacaacgagccatcccagcttgccatcaacgagaatgcaatggcttggcccgatatgccatcatctgtcaggagaacggtctggtccccatcgttgagccagagattcttgtagatggatcccatgacattaacaagtgcgcagatgtgaccgagcgcgttctcgctgcctgctacaaagctctcaacgaccaccatgttcttcttgagggtacccttntgaagcctaacatggttacacctgggtctgatgccaagaaggttgcacccgaagtagtggcagagtacacagtccgtgccctgcaacgaaccatgccaccagctgtcccagctgttgtgttcttgtcaggtggtcagagtgaggaggaggctaccgtcaacctcaatgccatgaaccaatacaagggaaagaagccatggaacctatctttctcgtttggacgtgccctgcagcaaagtaccctcaaggcttggtctgggaagttagagaatgtgaagaaagctcaggatgcattccttgccaggtgcaaggccaactctgaggctactcttgggacataccagggcagcgctgggttgancgagggtgcttccgaaagcctccacgttaaggactacaagtactgaggtttgtcatccgatttattcggtaattcttctctgatntacgtttgtttttctgacaattttgtctgaaagaggtggcttttntgcccttaaaacttatttctagctttgtgttctattttgaagttgtggtgtagggatggttatatagcatgagaaacatctgcatgtttgangnttgattatattttgaatggtttaaggctttcatgcttattttgttcattttgttttgaagttctttttttccataaatggaacatgtatgtttttaaattgggagggacaagtttgaaaaaaagcttggttttttataaaag

SEQ ID NO: 1409 - DNA, 1463 bp, Euonymus alatus
ccccaactctcccaaacccttctgtattcgtctctttcatctaacttcgaaatattatctctctctttaatcagttaatcatgtcttccttcaagggcaaatacgccgatgagctcattgccaatgctgcttacattggcactcctggtaagggtattcttgctgctgatgaatcaacggggacaatcggaaagcgtctggcaagcatcaacgttgagaatgttgaaacaaataggcgtgctcttcgtgagctcctattcactgcccctggtgctctcccatgcctcagtggtgtcatcctctttgaggaaaccctataccagaagactgcagcaggcaagcccttcgttgatgtattgaaggaaagtggagtgctaccgggtattaaggttgacaagggcactgttgagcttgctggaaccaacggcgagacaacaactcaaggtctagatgggcttgctcagcgttgccagaagtactatgaagctggtgcccggtttgctaagtggcgtgccgtgttgaagattagtgcaactgagccatctcagctggctatcaatgagaatgccaacgggttggctagatatgctatcatctgccaggagaatggccttgttccaattgttgagcctgagatcctggttgatggtccccatagcattgagaagtgtgctgatgtgactgagcgtgtgctcagtgcatgttacaaggctttgaatgatcaccatgtcctgcttgagggtactctgttgaaacccaacatggttacccctggatcagaggcccctaaggttgcacctgaggtgattgctgagcacacagtgcgggctttacagcgcaccgtgcctcctgcagttcctgctattgtgttcttgtctggtgggcagagcgaggaagaggctactgtcaacctcaatgccatgaacaagcttaaggggaagaagccatggagtctttccttctcatttggacgtgcgcttcagcagagcactctcaaggcttgggctggcaaggaggagaacgtgaaggcggctcaagctgcactccttgccaggtgcaaggctaactctgaggcaacccttggtacctacaagggtgatgctcagcttggtgagggtgcctctgaaagcctccatgtcaaggactacaaatactagaaagtgccggctttttggtcagtttttgtttttgttttacgttttgcggagcaaattatgtcgtactctcaggcatagttttagattatattctcatctttccttgcggaatctacaatggagacggaaaaataaagcttgaggtgtcttgtaactctgtacttggaaatggttttggtcaatgtttttgattaccttgtatgttctgtcctcgttcctcctggaggaggttcttgaattccttttggattatgttttctcgtctttcacgagttttgatattttgaattttgaattgcacttttg

SEQ ID NO: 1410 - DNA, 1565 bp, Euonymus alatus
aaccacaatataaaccattggcccccaactctctcaaacgcttctgtgttcgtctctttgatctaacttcgaaatattatctctctctttaatcagttgatcatgtcttccttcaagggcaaatacgctgatgagctcattgccaatgctgcttacattggcactcctggtaagggtattcttgctgctgatgaatcaactgggacgatcggaaagcgtctggcaagcatcaacgttgagaatgttgaaacaaacaggcgtgctcttcgtgagctcctattcactgcccctggtgctctcccatgcctcagtggtgtcatcctctttgaggaaaccctataccagaagactgcagcaggcaagcccttcgttgatgtattgaaggaaagtggagtgctaccaggtattaaggtcgacaagggcactgttgagcttgctggaaccaacggcgagacaacaactcaaggtcttgatgggcttgctcagcgttgccagaagtactatgaagctggtgcccggtttgccaagtggcgtgctgtgttgaagattagtgcaactgagccatctcagctggctatcaatgagaatgccaacgggttggctagatatgctatcatctgccaggagaatggccttgttccaattgttgagcctgagatcctggttgatggtcctcatagcattgagaagtgtgctgatgtgactgagcgtgtgctcagtgcatgttacaaggctttgaatgatcaccatgtcctgcttgagggtactctgttgaaacccaacatggttactcctggatcagaggcccctaaggttgcacctgaggtgattgctgagcacacagtgcgggctttacagcgcactgtccctcctgcagttcctgctatcgtcttcttgtctggtgggcagagcgaggaagaggctactgtcaacctcaatgctatgaacaagcttaaggggaagaagccatggagtctttccttctcatttggacgtgcccttcagcagagcactctcaaggcttgggctggcaaggaggagaatgtgaaggcggctcaagctgcactccttgccaggtgcaaggctaactctgaggcaacccttggtacctacaagggtgatgcccagcttggtgagggtgcctctgaaagcctccatgtcaaggactacaaatactagaaagtgccagctttttggtcagtttttgtttttgttttatgttttgcggagcaaattaagttgtcttactctcaggcatagttttagattatattctcatctttccttgcggaatctaccatggagacagaaaaataaagcttgaggtgtcttgtaatctgtacttggaaatggttttggtcaatgtttttgattaccttgtatgttttgtcctcgttcctcctggaggaggttcttgaattccttttggattatgttttctcgtctttcctcgcacgagttttgataatttgaattttgaattgcacttttgcaactccagtctactaactcagttctcctttcaagtcatttcctgatctctctagtcataattaatttgcctt

SEQ ID NO: 1411 - DNA, 1418 bp, Humulus lupulus
tgtcttatttctcattctctcccaaccctgaaaaaaaagctttcaatcttcagtagctgaaaatgtcttgctacaagggcaaatatcatgatgagctcattgccaacgctgcttacattggtacccctggaaagggtatccttgccgccgatgagtccactggcaccattggaaagcgtctttccagcatcaatgtagagaatgttgagactaacaggcgtgctcttcgtgagctcctcttcaccactcctggggcccttcagtacctcagtggagtcattcttttcgaggagaccctctaccaaagcacagctgctggtaagccatttgttgaggttatgaaggaaggtggagtcctccctggcatcaaagttgacaagggtaccgttgagcttgctggaacaaatggtgagaccaccactcaggggcttgacggccttgctcagcgctgccagaagtactacgaagctggtgctaggttcgccaagtggcgtgctgtgctcaagattggccccaatgagccatctcagttggccattaacgaaaacgccaatggtttggcaagatatgccatcatctgccaagagaatggccttgtccccattgtggagccagagatactggttgatggatcacacgacatcaacaagtgtgctgaggtcaccgagcgtgttcttgctgcctgctacaaggccttgaatgaccaccatgtcctcctcgagggaactcttttgaagcccaatatggtcacccctggatcagattccccaaaggttgctcctgaggtgatcgctgagtacacagttcgcgccctgcagcgtaccatgccaccagcagttccagctgttgtgtttctatctggtgggcaaagtgaagaacaggccactgttaatctcaatgccatgaacaagcttaagggaaagaagccatggtcgctatcattctcttttggcagggcccttcagcagagtaccctcaaagcttggtctggaaaagaggaaaatctagccaaggctcaggctgcattcctcacaaggtgcaaggccaactctgaagctacattgggaacttacaagggtagtgagaaccttgatgatggagcgtccgagagtctccatgtcaagaactacacttactgagaaagcttttttcatcagcaaaaatgtatttgattgataaaggtctttagggattatcttcatgtctttcttttcaagattaaatggcacagttgtgcatgatctatgatttcattgtcaattttcaatttgattgaagctgtaattgcatttttctggggaagtttttagctttcgtaacaagttctcttattttactttggtaattgccgagtatacgagtcaatttggctctatgcatcgagaatatgttgttcaataactaataatccttttgtc

SEQ ID NO: 1412 - DNA, 1474 bp, Momordica charantia
atatctgttccattttccctatttctcttccgatttccgaaagctccattttttatccctaacttttaggtgttgaagatgtcttgctacaggggcaaatacgctgatgagcttattgccaatgctgcgtacattggaacccctggaaagggtattcttgctgccgatgagtcaactggcacaattggtaagcgtctttccagtatcaatgtcgaaaatgttgaaacaaacagacgtgcccttcgtgagctccttttcactgctcctggtgctctccaatacctcagtgggatcattctgttcgaggaaactctctaccagaagactgctgcaggcaagcctttcgtcgatgtcatgaaggaaggtggtgtactccctggcattaaggttgacaagggtactgtagaacttgctggtaccaatggtgagacaaccacccagggtcttgatggccttgctcaacgctgccaaaagtattatgaagcaggtgctcggtttgccaaatggcgtgctgtgcttaagattggcgataatgaaccttctcagttggctatcaacgaaaatgccaatggattggccagatacgccatcatatgccaggagaatggccttgtacccattgttgagcctgagatcttggttgatggtcctcatgacatccacaagtgcgctgatgtaaccgaacgtgttcttgctgcgtgctacaaggctctaaatgatcaccatgtcctccttgaagggaccttgttgaagcccaacatggttaccccaggatctcaatctgcaaaggttgcacccgaagtgattgccgagcacactgtccgtgcccttcagcgcactgtccctgctgcagttcctgctgtggtgttcttgtctggtggacagagcgaagaggaggccactatcaaccttaatgcgatgaacaaactcaaggggaagaaaccatggtctctctctttctcctttggacgagctcttcagcagagtactctcaaggcatgggctggaaaggatgagaacatccccaaggctcagggtgctttgctcgtaaggtgcaaggccaactccgaagcaactctgggaacttacaagggtgatgctaagctcagtgagggtgcctcggagagcctccaccaggataactacaagtattgatgagttattggactcggtattgcctttgtagacaacaaggctgcggcatattgtgtttggattctcaggcataggggtagttctcttctttttcttctaatttcaattctaatatcaagctatatggtaggcgttggtaataagcttgatgagcgtcgccatgtgaggtttttgcaagttttttgttattacatttcagtggaagaactggttatcttctggtttctgttgtaatttttggttttttcatcagttaataacaccattcataatgggagttttgtattatgttgccgcactgtatgagattgttttgttt

SEQ ID NO: 1413 - DNA, 1478 bp, Tabernaemontana elegans
tcaccccactgttctcttctgctttcgtttagctctctgtctctgcccaacgctactgctccagttttgcctcctaatctcgatcttcaaccatgtcttgctacaaaggagaatacgccgatgagctcatcgccaatgctgcatacattgctacccctgggaagggtatccttgccgctgatgagtcaactggcacaattggcaagcgtctagccagcatcaaagttgagaatgttgagacaaacaggagggctctccgtgagcttttgttcacaacacctggtgcccttcagtacctcagtggtgttatcctctttgaggaaactctctaccagaagactgctgctggtaagccatttgttgatgtcctcaaggagggtggtgtcctccctggaattaaggtcgacaagggcactgttgagcttcctggtacaaatggtgagaccaccactcaaggtcttgatggtctcgctcagcgatgccagcaatactacaaggctggtgccaggtttgccaaatggcgtgctgtgcttaatattggccccaatgaaccatcccaacttgccatcaatgagaatgccaatggtttagcgcgttatgcaattatctgccaacagaatggcttggttcctattgtggagcctgagatccttgttgatggatcccatgatattaacaagtgtgctgatgtaaccgagcgtgtgcttgctgcatgctacaaggcattgaacgaccaccatgttcttctcgagggtacgcttttgaagcccaacatggttactccagggtctgattcccccaaagttgcaccggaggtcattgctgaatacactgtccgtgctttgcagcgcaccatgcctgctgcagttcctgctgttgtgttcctctccggtggtcagagtgaagaggaggcctctctcaacctcaatgccatgaacaaacttcagaccaagaaaccatggaccctttccttctcatttggacgtgccttgcagcagagcactctcaaggcttggtctggaaaggaagaaaacattccgaaggcacaggctgcattccttgctaggtgcaaggccaactctgaagcaacccttgggaagtatgctggtggtgcgtcattgggcgacggtgcttctgagagcctccatgtcaaagactacaagtattaagctttcagttttgtttgtttttgttttggagagtacatcgaaggttttggatacaacaatgtttatcatcggatgtagcatttttaggttttgttttatttttcggcctgacctatgctagcaaattgtggtttaataagctcgtggaagatacactgggagttggtacttacttgtctgatgtttttttccctgctcattgtcatgaatggcaccaattagcttttcttaatagtttttgtcatacctatttgaccattactttccacggtgtggttggtgtggtgtttgttttcatcattttaattt

SEQ ID NO: 1414 - DNA, 1383 bp, Artemisia annua
agatctcaaattgcgtaaagatgtcttgctacagaggaaagtatgctgatgagcttatcgccaatgctgcttacattggtactcctggaaagggtattctcgccgctgatgagtcaactggtactattgggaagcgtctttccagcatcaatgtcgagaatgttgagtctaacaggagagcacttcgtgagcttcttttctgcactcctggtgccctccagtacctcagtggagttattctctttgaggaaactctctaccagaagactgctgcaggcaagccatttgttgatgtcatgaaggaggctggagtcctccctggtatcaaggttgacaagggtaccgtagagcttgctggaaccaacggtgagaccacaacccaaggtcttgacggtcttgcccagcgatgtgcccaatactacacagctggtgcaaggtttgccaagtggcgtgccgtcctaaagatcggccccaacgagccatctcagcttgccatcaacgagaacgccaacgggttggcccgatatgccatcatctgccaagaaaatggtttggtcccaattgtcgagcctgagattcttgttgacggaccccatgacattaacaagtgtgctgatgtcactgagcgtgttcttgctgcctgctacaaagctcttaatgaccaccatgttcttctagaaggtacccttttgaaaccaaacatggttacacccggatcagattccaagaaggttgcaccagaagttgtggccgagtacactgtccgtgccttgcagaggaccatgccatcagcggttccagctgttgtcttcttgtctggcggtcaaagtgaggaagaggccactgtcaaccttaatgccatgaaccagtacaagggaaagaagccatggagcttgtctttctcatttggaagggcccttcaacaaagcacactcaaggcatggtctggaaaagaagagaatgtgaagaaggctcaagctgcgttccttgctaggtgcaaggctaattctgaagccactcttggaaagtatgttggtggttctgggttgagtgaaggtgcatctgagagccttcacgttaaggactacaagtactaggctagtggtttggtaattgtttacggattggtgttttcttgttatttcgagggtctcatatgacagtttgtctaggtgtcttttgtggtcttgaactgtgtctatggttgtgttttctatggagcttgtggtctaatccgagtatggatggttataataagcttgaaaaatctgcttgttgatctttaaagcatgttttgtgcctttcggtgaactacctctggattagtgttgttttttttgctagcgtaacttcctaacatggttcgttcgaattgtcttgaaa

SEQ ID NO: 1415 - DNA, 1442 bp, Mesembryanthemum crystallinum
gcctcgtgccgaattcggcacgagctatctttcaactctctctctttaaatttctccctttttttctctctctaaaaaaaaatctctcgcaaccatgactgcctacagagggaaatacgctgatgagcttattgccaatgctgcctacatcggtacccctggaaagggtatcctcgcagctgacgagtcaaccggaacaattggcaagcgttttgctggcattaacgttgagaatgtcgagtctaacaggagggccctccgtgagcttcttttcaccacccccggtgctgtgcagtaccttagtggagtgattctctttgaggaaactctgtaccagaagactgctgcaggtaagcctttcgttgaggttctgaaggaaggcaatgttcttcccggaatcaaggttgacaagggtgttgtcgagcttgctggaaccaacggtgagaccaccacccagggtcttgacggccttggtgcacgatgtgcccagtactacgctgctggtgccaggttcgcaaagtggcgtgccgtcctcaagatcggcccaaccgagccatctcctcttgcaatcttggagaacgctaacggcctcgcccgttatgctatcatctgccaagaaaacgggttggtcccaatcgttgagcccgagatcttggtcgatggaccccatgacattgataggtgtgctgaggtcaccgagcgtgtgctcgcagcctgctacaaggccctcaacgaccaccatgttctcctcgagggtacccttttgaagcccaacatggtcacacccgggtccgagagcaagaaggttgctcccgaagtgatcgccgagtacaccgtccgtgccctacagaggaccgtccccccagccgtgcccgcagtcatgttcttgtccggtggacagagtgaggaggaggctaccgtcaacctcaacgccatgaacaagctccagggcaagaagccatggaccctgtctttctcctacggtcgtgcccttcagtcaagcaccctcaaggcctggtcaggcaaagaggagaacgtcgagaaggctcaggctgttttccttgctagggccaagggtaactccgaggctactcttggaaagtaccagggtggtgctggaggagctgatgcttctgagagccttcacgtcaaggactacaagtactaagcaacaatttttttgtgtttgcgtctttctgatatcttgtttccagcagcaaaattgcgaggcttttgtgggaagtgcccgaattttagaatcgtgtgcgtcttttagactgttatttacccctttttcgtttgtgtctaggcttttaagtaatgaacttcaaaataagagcatttaaggtaaatgtttcctgtgaaaaagaaagatctgttgcttttgatattggaaaacagatattcacagtataaatcagagtgatttgtttctggtttta

SEQ ID NO: 1416 - DNA, 1467 bp, Lotus japonicus
tataaaaacccaaaaccccctcacccacttttcaccttccattcacacccgctctctcaaacctaccctctctattcaaataccaaaccctctcttctctcttctcctcgttcctatcgatcatgtcgaacttcaagggaaagtaccatgatgagctcattgccaacgctgcctacattggcacccctggaaagggtattctcgctgctgatgaatcaacaggaactattggaaagcgtctagccagcatcaatgttgagaatgttgaaaccaacaggcgtgctcttcgtgagctccttttcaccacccctggagctctccagtacatcagtggagtgatcctctttgaggaaaccctgtaccagagtactgctgcaggcaagccctttgttgatgttttgaaggaagctggtgttctccccggtatcaaggttgacaagggtactgttgaacttgccggaactgatggagagaccaccactcagggtctagatggccttggtgcgcgttgcgctaagtactatgaagccggtgcacgctttgccaaatggcgtgccgtgctgaagatcggccccaacgagccatctgagctttctatccatgagaacgcctatggtttggccagatatgctgtcatatgccaggagaatggtctggttccaattgttgagcctgagatcctggttgatggacctcatgacattcacaagtgtgctgctatcacagagcgtgtccttgctgcatgctacaaggctttgaatgaccaccatgtcctcctcgagggtactctcttgaagcctaacatggtgacccccggatctgattctcctaaggttacccctgaggtggtcgccgagcacactgtcagggccctccagaggactgtgccagctgcagttccagctgtggttttcttgtctggtgggcagagtgaggagcaagcttccgtcaacctcaatgccatcaaccaggtcaagggaaagaagccatggactctctccttctcttttggaagggcacttcagcagagcacccttaaggcatggtctggaaaggaagagaatgtgaagaaggctcaagctgccttcttgacaagggccaaggctaactcagaggcaactcttggaacttacaagggagactctcaacttggtgagggcgcctcagagagcctccatgtcaaggactacaagtactgatcagagaaacactggtgggtagggaattgttttgcggggttgatttcttgttaatgagtactttggtttgactagaagaataattgctctaagttttgcgttttttttttgttttctggtgtttcttttgataatttcaattccagtgtattggtcaaacctatgcaaatggtttagctgtatttggttcttaaaatacactttccttaatgagggtctgagtttattatgcaccccccgtttccgcttttacatctctggtgcccgt

SEQ ID NO: 1417 - DNA, 1607 bp, Cucumis melo
ccaaagaccccatttttcctctcttacttttttatctcttccaaaatgtcttgctacagaggcaaatacgctgatgagcttattgccaatgctgcctacattggaactcctgggaagggtattcttgctgctgatgaatcgactggcactattggaaagcgtctttccagcatcaatgttgagaatgttgaaacaaacagacgtgctcttcgtgagctccttttcactgctcctaatgttcttcaatacctcagtggggtcattctcttcgaggaaacactataccagaagacagctgcaggcaagcctttcgtcgatgttttgaaggaaggtggggttctccctggcattaaggttgacaagggtactgttgaacttgctggaaccgatggcgaaaccacaacccagggtcttgatggccttgcccagcgctgccaaaagtactatgaagctggtgctcgttttgccaaatggcgtgcagtgctcaagattggtcctaacgaaccctcacagttgtccattaatgaaaatgccaatggattggccaggtatgctatcatttgtcaggagaatggtcttgtacctattgttgagcctgagatcttggttgatggtcctcatgacatcaagaagtgtgctgacgtaactgaacgtgttcttgctgcctgctacaaggctctaaatgaccaccacgttctccttgaaggaaccttgttgaagcccaacatggttacccctggatctcaatctgcaaaggttgcaccagaagtgattgccgagcacaccgtccttgccctacagagaactgttccagctgcagttccggctattgtgttcttgtctggtggacagagtgaagaggaggccaccgtcaaccttaatgccatgaacaaactcaaggggaagaagccgtggtctctttctttctcctttggacgtgctctgcagcagagtactctcaaggcatgggccggaaaggatgaaaacatccccaaggctcaggctgctttgctcgtaaggtgcaaggccaactccgaagcaactcttggaacttacaagggtgatgctaagatcagtgagggtgcagctgagagcctccatgttgacaactacaaatattgattagttttgggactcgatatctttgttttaagaaaggaaaaaaagaaactgcggcataattgtgttttggattctcgggcatcgtaggagtagctttctttataatctcaatgctaatatcaagttatgggataggcgttggtaataagcttgaggagcgttggcatgcaaggtttttgcaaggtttttgcaagtattttattttattttattttttacatttcagttgaagaactgagtaatctgctgttttcagttgtaattttggattttcatcggttaataacaaccattcgtgatgtgagttgtgtttatattgcgtacgtttatttttttaatattgttattttggctcggttcgtgtgaattcttttgcgttggtctaaacttcaggggtaatctgagaggagcgttttctacaattgttttcttattgtaaaatggcttttgtttgattgtggtatttattcgaaagatcaatatga

SEQ ID NO: 1418 - DNA, 1426 bp, Orobanche aegyptiaca
tcaaaactcttcatctctgtctttctctctctacattttaacttcgcttttcatactattaaccatgtcttgctacaggggaaagtacgctgacgagcttattgctaatgctgcatacattggtacccctgggaagggtatccttgctgctgatgaatcaaccggtacaatcggcaagcgtttatctagcatcaatgtcgaaaatgtcgagtcaaacaggagggctttacgtgagctccttttcaccacccctggtgcccttcagtacctcagtggagtcattctctttgaggaaactctttatcagaaaaccgctgccggcaaaccatttgttgaggtcatgaaggaaggtggtgtccttcccggtattaaggtcgacaagggcacagtcgagttagccggcaccaatggcgagaccaccacccaggggcttgacggtctggcccagcgctgccagaagtactatgaggctggtgcccgttttgccaaatggagggccgtcctgaagatcggccccaatgagccctcccagcttgccatcaatgaaaacgccaatggcctggctcggtacgccatcatctgccaggagaatggtcttgtcccgatcgtcgagcctgagatcctcgtcgacggaacccacgacatcaaaaagtgtgccgatgtcaccgagcgtgtgcttgccgcctgctacaaggccctaaacgaccaccatgtcctcctcgagggaacccttttgaagcccaacatggtcaccccgggctcagattccgccaaggttgcacctgaagttgttgctgagtacactgttcgggccttgcagcgcacgatgccccctgcggtccccgcggtggtgttcttgtctggtgggcagagtgaggaagaggctacagtcaatcttaatgctatgaacaagctgaaggctaagaagccttggagcctttctttctctttcggtcgggccctacaacagagcactctcaaggcttgggctggaaaggaggagaatattcccaaggcccaggctgctttccttaccaggtgcaaggctaactctgaagcgactcttggtacttatcaaggtggcgatttgagtgagggtgcatctgagagccttcatgttaaggactacaagtactaagtggctaagctaagatttattttttggtggttttactttgattttttatgcctttgtcgcatagagaacaagctttagattttctgcatgtttatgcatatgttatttttcgtaagactttgttataataagggttgaggatcatgctatttcttgagagaactttgttttttttgcttattatcggcgggttttttgttgttttatactgttctgcaattgcttgccattgatgttcaagttaaatttggttgctattaccagacaatacatgaataacatgaatgt

SEQ ID NO: 1419 - DNA, 1451 bp, Orobanche aegyptiaca
cgcgttcgtataaaagccctagcccatctcttttaatcgcactcaggaaaaggttccaactttttcatctctcatcttttagttttgtgctttgtctttgattttggattctctcacaacatcagtaatcatgtcttgctaccgtggaaagtacgctgacgagcttattgccaatgctgcatacattggtacccctggcaaaggtattcttgctgccgatgagtctactggcacaatcggcaagcgtttatcgagtatcaatgtagagaatgttgagtcaaacaggagagctctgcgcgagcttcttttcaccacccccggtgcccttcagtacctaagtggagtcatcctctttgaggaaactctttaccaaaatacagctgcaggcaaacccttcgttgaggtcctaaaagaaggtggtgtcctccccggtatcaaagtcgacaagggcacagtcgagctcgctggcaccaatggtgagaccaccacccaaggcctcgacggcctcgcccagcgctgccagcagtactatgccgctggtgcaaggttcgccaagtggcgggctgtcctcaagattgggcccaacgagccttcccagctcgccatcaacgaaaatgccaacggcctggcccgttatgccatcatctgccaggagaacgggctggtccccattgttgagcccgagatcctcgtcgatggaccccacgacatcaacaggtgtgccgacgtgaccgagcgggtcctcgccgcctgctacaaggcgctcaacgaccaccacgtcctcctggaaggtaccctcttgaagcccaacatggtgacacctggctcggattccgccaaggtggcacctgaggtggtggctgagtacacggtccgagctctgcagcgcacgatgccggcggcggtccccgccgtggtgtttctgtcaggcgggcagagtgaggaggaggctacggttaatctgaatgcaatgaataagctcaaggggaagaagccgtggagccttagtttctcattcggacgggctttgcagcagagcacgctcaaggcatgggctgggaaggaggagtatattcccaaggcccaggcggcgttcctagctaggtgcaaggcgaattcggaggcgacacttgggacttaccaggctggaagtggtttgagtgagggtgcatccgagagtcttcatgtcaaggattataagtattaggtgactttgagtaatgttcttgtaattttgttcgagggagtgttatttggtgacggttttttggctttttttcaatattttttttctgctttccatgtttgcagacaacatattagtcgtaaattcttgataataacataagcaccgtggtggtagctttattaaaaggctgtttatttctatttttaatgtttggatgttttactttccattggggtggtgatttctggttttatttatatga

SEQ ID NO: 1420 - DNA, 1428 bp, Solanum tuberosum
gctgtattaacctaaattttcccacacatctatttgtctttgatctatctctctctgcaaaacttctcttctacactcttcttcatcgtccaaagcaataacaatgtcgtgctacaagggaaaatacgccgatgaactgatcaagaatgctgcatacatagctacccctggtaagggtatccttgctgctgacgagtctactggcacaattggcaagcgtctatctagcattaatgttgagaatgtcgagtcaaacaggagggctctccgagagctgctcttctgcgcacctggtgctcttcagtaccttagtggaattatcttgtttgaggaaaccctttatcagaagactgcagctggcaagccttttgttgatgttatgaaggagggtggagtcctccctggaattaaagtcgacaagggtaccgtagagcttcccggaaccaatggtgagacaactacccagggtcttgatggccttgcggagcgctgccaaaagtactatgcggctggtgctaggtttgccaaatggcgtgcagtgctcaagattggtgccaacgagccatctcagctcgctatcaatgacaatgccaatggccttgccagatatgccatcatctgccagcagaacggtcttgtccccattgttgagcctgagatccttgttgatggatcccatgacattaaaaagtgtgctgatgtcacagagcgtgttcttgctgcttgctacaaggctctcaatgaccaccatgtcctcctagagggtacattgttgaagcccaacatggtcactcccggatctgatgcccctaaagttgcaccagaggtgattgcagagtacactgtacgtgccttgcagcgaacaatgccagctgctgttcctgctgtggttttcttgtctggtggtcagagtgaggaagaggccacccgcaacctcaacgccatgaacaaacttcaaaccaagaagccctggaccctctccttctccttcggacgtgctctccagcagagcaccctcaaggcctggtcaggaaaggaggagaatattgggaaggcccaagctgcactcctcacaaggtgcaaggccaactctgaggctaccctcggaaagtatgccggtagttccaacttgggcgacggtgcttccgagagccttcacgtcaaggactacaagtattaggacattattctgtttggtttctgttttgatgatgaggttttgcaggatggtttactagaagtgtcttttactggtcatagtgtgctagtcttttctttttgtcacaatatttgttcaataaaagcttgagaaacgtcggctttgtgacattgtaggggtctttaatctttattagtgtgttaatctagattatgttatcgaatttatgccctgttgatggggttttacatattaaactttggttttgc

SEQ ID NO: 1421 - DNA, 1510 bp, Solanum phureja
agagggcagaagggtaaaaaaaaatccgctattttcgtgcagaaggggtcgcaaattggcgataacatcgatgcgcacgctgtattaaacctaaattttcccacacatccatttgtctttgatctatctctctctgcaaaacttctcttctacactcttcttcatcgtccaaagcaataacaatgtcgtgctacaagggaaaatacgccgatgaactgatcaagaatgctgcatacatagctacccctggtaagggtatccttgctgctgacgagtctactggcacaattggcaagcgtctatctagcattaatgttgagaatgtcgagtcaaacaggagggctctccgagagctgctcttctgcgcacctggtgctcttcagtaccttagtggaattatcttgtttgaggaaaccctttatcagaagactgcagctggcaagccttttgttgatgttatgaaggagggtggagtcctccctggaattaaagtcgacaagggtaccgtagagcttcccggaaccaatggtgagacaactacccagggtcttgatggccttgcggagcgctgccaaaagtactatgcggctggtgctaggtttgccaaatggcgtgcagtgctcaagattggtgccaacgagccatctcagctcgctatcaatgacaatgctaatggccttgccagatatgccatcatctgccagcagaacggtcttgtccccattgttgagcctgagatccttgttgatggatcccatgacattaaaaagtgtgctgatgtcacagagcgtgttcttgctgcttgctacaaggctctcaatgaccaccatgtcctcctcgagggtacattgttgaagcccaacatggtcactcccggatctgatgcccctaaagttgcaccagaggtgattgcagagtacactgtacgtgccttgcagcgaacaatgccagctgctgttcctgctgtggttttcttgtctggtggtcagagtgaggaagaggccacccgcaacctcaacgccatgaacaaacttcaaaccaagaagccctggaccctctccttctccttcggacgtgctctccagcagagcaccctcaaggcctggtcaggaaaggaggagaatattgggaaggcccaagctgcactcctcacaaggtgcaaggccaactctgaggctaccctcggaaagtatgccggtagttccaacttgggcgacggtgcttccgagagccttcacgtcaaggactacaagtattaggacattattctgtttggtttctgttttgatgatgaggttttgcaggatggtttactagaagtgtcttttactggtcatagtgtgctagtcttttctttttgtcacaatatttgttcaataaaagcttgagaaacgtcggctttgtgacattgttaggagtctttaatctttattagtgtggtaatctagattatgttatcgaatttatgccctgttgatggggttttacatattaaactttggttttgcat

SEQ ID NO: 1422 - DNA, 1385 bp, Helianthus annuus
aatctcttctatataaaccctcactccccatcattgactcttacaatctcctttctctataatttctttctctgcacgcctctttttctcagatctcagattcatccaccatgtcttgctacagaggaaagtatgctgatgagctaattgccaatgcggcttacattggcacgcctggcaagggtattcttgctgctgatgagtcaaccggtacaatcggaaaacgtttgtccagcatcaatgttgagaatgtcgagtcaaacaggagggctcttcgtgagcttcttttttgcactcctggtgctcttcaatacctcagtggagtcattcttttcgaggaaactctctaccagaagacagccgcaggtaagctatttgtggatgtcatgaaggaagctggagtcctccccggtatcaaggttgacaagggtacggtcgagcttgctggaaccaacggtgagaccacaacccaaggtctagacggactagcccagcgatgtgcccaatactacacagccggtgcccggttcgccaagtggcgtgcagtccttaagatcggcccgaacgagccatcacaacttgccatcaacgagaacgccaacgggctagcccgatacgccatcatctgccaagagaacggtttggtccccattgtcgagcccgagattcttgtagatggaccccacgacatcaacaagtgtgctgatgtaaccgagcgtgttctcgctgcttgctacaaagctcttaacgaccaccatgttcttctcgagggaacacttttgaaacccaacatggttacccccggttctgacgccaaaaaggtcgcaccagaagtcgtggctgagtacaccgtccgtgcacttcaacgaaccatgccaccagcggtcccagccgttgtgttcttgtcaggtggtcagagtgaagaggaggctacagttaacttgaacgccatgaaccagtacaagggtaaaaaaccatggtcgttgtctttctcgttcggacgggccctacaacagagcacccttaaggcgtgggccgggaaagaagagaatgtggcgaaagctcaggccgcttttcttgccaggtgtaaggccaactctgaggcgacccttggaacgtatcagggcggttctgggttgagcgaaggcgcatctgaaagcctccatgttaaggactacaagtactaaacattgctctcaggtaattcttcactgatttgtgtttttagtgacgatttttgtatggacgaggcgggttttatgttttgaacgtatttctatgtttgttttttgtttttacgcctgggtagcggattgctgtaataagtatgagaaacatttgctcgtttgagattgattcatatatcaaatgcttcaggttttaat

SEQ ID NO: 1423 - DNA, 1343 bp, Nicotiana tabacum
tctattctctctctcagttgtataaacacaacttctcccttttgtctcgtttctttctccagtcgcctattcatcatgtcttgctacaagggaaagtacgcagatgagcttattgctaatgctaaatacattggaacccctggaaagggtatccttgctgctgatgaatccactggcacaattgggaagcgtttctcgagcatcaacgtcgagaatgtcgaatcaaacaggagggctctccgtgagttgctcttcaccacccctggtgctgttcagtatctcagcggtgttatcttgtttgaggaaacactctaccagaagaccgcttctggcaagcctttcgtcgatgtcttgaaggagggtggagttctccccggaattaaggttgacaagggtaccgttgagctcccaggaaccaacggtgagaccaccacccaaggtcttgacggccttgcagagcgatgccaaaagtactacgaggctggtgctaggtttgccaaatggcgtgccgtgctcaagatcggtgccaatgagccttctcagcttgcgatcaatgagaacgccaatggcctagcaagatatgccattatctgccaacaaaatggtcttgtacccattgttgagcctgagatcctcgttgatggatcccatgacattaacaagtgcgctgatgttaccgagcgtgttcttgctgcttgctacaaggctctcaatgaccaccatgtactcctcgagggtaccttgttgaagcctaacatggtcactcctggttctgaagcagccaaggttgcaccagaggtgattgctgagtacaccatccgtgccttgcagcgcacaatgccggctgctgttcccgctgtggtgttcttgtctggtggtcaaagtgaagaggaggccaccgtcaacctgaacgccatgaacaagctccaaaccaagaagccatggtcgctttcattctcctttggacgtgctcttcagcagagcaccctcaaggcttgggccggaaaggaggagaatgtacagaaggcgcaagctgcattccttaccagatgcaaggccaactccgaggctacactcggaaagtatgctggtgctaccaacttgagtgagggtgcttctgagagccttcatgtcaaggactacaagtactagaacaagttttttggtttctctccctttttgtgatttccgttttgaaaacgagatggcagtatggaattacaaaagtgtctgttttaatggacataatgtgtaaggctttctttctgttttttctatctgatgtatggcagcggattggtttaataacaaacaatattggcgttgtgacaaaaaacaacaac

SEQ ID NO: 1424 - DNA, 1371 bp, Amsonia hubrichtii
tcatttagctctctatctccaacctaattcatctccagtttcttcttctagttcttcaaccatgtcgtgctacagaggagaattcgccgatgagctcatcgccaacgctgcatacattggtacccctggaaagggtatccttgctgctgatgagtcaactggcacaattggcaagcggctatccagcatcaatgttgagaatgtcgagacaaacaggagggctctccgtgagcttttattcaccactcctggtgccgttcagtacctcagcggagtcatcctctttgaggaaactctctatcagaagactgctgctggcaaaccatttgttgatgtcttgaaggagggtggtgtccttcccggaattaaggttgacaagggcactgttgagcttcctggtacaaatggtgagaccaccactcaaggtcttgatggtcttgctcagcgatgccagcaatactacaaggctggtgccaggtttgccaagtggcgtgctgttcttaagattggccccaatgaaccatctcagcttgctatcaatgataacgccaatggcttagctcgttatgcaattatctgccaacagaatggcttagttccaattgttgagcctgagatccttgttgatggatcccatgatattaacaagtgtgctgatgtaaccgaacgtgtccttgccgcatgctacaaggcattgaatgaccaccatgttctccttgagggtacacttttgaagcccaacatggtcactccaggttccgactcccccaaagttgcacctgaggtcatagctgaatacaccatccgtgctttgcagcgcaccatgcctgctgcagttcctgctgtggtcttcctttcaggtgggcagagtgaagaggaggctaccctcaacctcaatgcaatgaacaaacttcagaccaagaaaccatggagcctttccttctcatttggacgtgccttgcagcagagcacactcaaggcttggtctggaaaggaagaaaacgttaagaaggcacaggctgcattccttactaggtgcaaggccaactctgaagcaacccttgggaagtatgctggttcttctgaattgagcgagggtgcttctgagagcctccatgttaaggactacaagtattaagctactgcaagaattaagcttttggttttgtttgttttggagagtacatcgcaagttgggtacaagagtgtttaccatcggatgtagcaattttaggttatgttttggtttttttttatgttgccaaagtggttcaaataagcatgatgacggttaatgtttctctccttttagtaatcgactttatgaatgcatcaagttgctcttaatagatttgattttgtcaattgatg

SEQ ID NO: 1425 - DNA, 1530 bp, Euonymus alatus
gggggcttctgtgttcgtctctttgatctaacttcgaaatattatctctctctttaatcagttgatcatgtcttccttcaagggcaaatacgctgatgagctcattgccaatgctgcttacattggcactcctggtaagggtattcttgctgctgatgaatcaacggggacaatcggaaagcgtctggcaagcatcaacgttgagaatgttgaaacaaacaggcgtgctcttcgtgagctcctgttcactgcccctggtgctctcccatgcctcagtggtgtcatcctctttgaggaaaccctataccagaagactgcagcaggcaagcccttcgttgatgtattgaaggaaagtggagtgctaccgggtattaaggtcgacaagggcactgttgagcttgctggaaccaacggcgagacaacaactcaaggtcttgatgggcttgctcagcgttgccagaagtactatgaagctggtgcccggtttgccaaatggcgtgctgtgttgaagattagtgcaactgagccatctcagctggctatcagtgagaatgccaacgggttggctagatatgctatcatctgccaggagaatggccttgttccaattgttgagcctgagatcctggttgatggtcctcatagcattgagaagtgtgctgatgtgactgagcgtgtgctcagtgcatgttacaaggctttgaatgatcaccatgtcctgcttgagggtactctgttgaaacccaacatggttactcctggatcagaggcccctaaggttgcacctgaggtgattgctgagcacacagtgcgggctttacagcgcactgtccctcctgcagttcctgctatcgtcttcttgtctggtgggcagagcgaggaagaggctactgtcaacctcaatgctatgaacaagcttaaggggaagaagccatggagtctttccttctcatttggacgtgcccttcagcagagcactctcaaggcttgggctggcaaggaggagaatgtgaaggcggctcaagctgcactccttgccaggtgcaaggctaactctgaggcaacccttggtacctacaagggtgatgcccagcttggtgagggtgcctctgaaagcctccatgtcaaggactacaaatactagaaagtgccggctttttggtcagtttttgttttatgttttgcggagcaaattaagttgtcttactctcaggcatagttttagattatattctcatctttccttgcggaatctacaatggagacagaaaaataaagcttgaggtgtcttgtaactctgtacttggaaatggttttggtcaatgtttttgattaccttgtatgttttgtcctcgttcctcctggaggaggttcttgaattccttttggattatgttttctcgtctttcctcgcacgagttttgataatttgaattttgaattgcacttttgcaactccagtctactaactcagttctcctttcaagtcatttcctgatctctctagtcataattaatttgccttttgca

SEQ ID NO: 1426 - DNA, 1470 bp, Beta vulgaris
ggggagttcccggggggggcgggcggctttagaattaggggatccccgggcctgcgggatttgggcaggaggatctctttctctctctactttttctctctctaaacaaacaatctttcatcacccaacaaccatgactgcctacagagggaaatacgctgatgagctcattgccaacgctgcctacattgctacccctggaaagggtattcttgcggctgatgagtcaactggtaccattggcaagcgttttgccagcatcaatgttgagaatgtagaggacaacaggagggctcttcgtgagctcctctttacgacccctggtgctcttcagtacctcagtggagtgatcctttttgaggaaactctctaccagaagaccgctgctggtaaacttttcgttgatgtcatgaaggaaggtggtgtccttcccggaattaaggttgacaagggtaccattgagcttgccggaaccaatggtgagacaactactcagggtcttgacaatcttggcaagcgttgtgccgaatactatgctgctggtgcccgttttgccaaatggcgtgctgtcctcaagattggcccaaatgagccatccccacttgccatcttggagaatgctaatggtcttgctcgttatgccatcatctgtcaggaaaatggattggtccccattgttgagcctgagatcttggttgatggatcccacgacatcgacaggtgtgccgaggtttctgagcgtgtgctggctgcttgctacaagtccctcaatgaccaccatgtccttctcgagggtaccctcttgaagccaaacatggtcacccccggttcagatagcaagaaggttgccaatgatgtgatcgctgaatacaccgtccgtactttgcagaggactgttcctccagctgttcctggcatcatgttcttgtctggtgggcagagtgaggaggaagctaccctcaacctgaacgccatgaacaagcttcaggccaagaagccatggactctgtccttctcatatggccgtgcccttcagcaaagtaccctcaaggcctggtcaggcaaagaggagaatgtgtcaaaggctcaggaagtcttccttgctagggctaaggctaactctgaggctactcttggtaagtatcaaggtggtgctgcaggagctgatgcctctgagagccttcacgtcaaggactacaagtactgagcaaagttttttttcctccccgtctccattccggcagcaaattcgcgagttttttcccctgggaagggcgccctattcttagaagcggtgtgtgcgttttttagaatgttaatttaagttcacttgtttttttagttttgatggctaccataataaatttgtatgaattagttttgtccttttgaaaagaggatcttattggttttaaaatatgtgaaaaaatgtactcacaatataaatcagagtgacttcgcttctatttc

SEQ ID NO: 1427 - DNA, 1269 bp, Vigna unguiculata
  misc_feature (580)..(580): n is a, c, g, or t
  misc_feature (910)..(910): n is a, c, g, or t
ccatcaatattaaaacaccatgtcttccttcaagaccaaataccaagatgaactcattgccaatgctgcttacattggcactccggggaagggtatccttgctgctgatgagtcaaccggtacaattggcaaacgtttggccagcatcagtgttgagaatgttgaaacaaacagacgtgctctcagggaactcctattcacgacacctggtgcttttgactgtctcagtggtgtcatattgtttgaggaaactctataccaaaagacagcttcaggaaaaccctttgtagagttgttgaaggaaggtggtgttcttcctggtataaaggttgacaagggcactgtggagcttgccggaactaacggtgaaaccaccactcaagggttggatgggcttggtcagcgttgccagaagtattatgaagccggtgcccgttttgcgaaatggcgtgctgtgttgaagatcggtccaaacgaaccgtctgagttggctatccatgaaaatgcgtatggtcttgctcgatacgcattgatatgccaggagaatgggctggtgcctattgtggagccagagattctngtggatggaccccatgacatcaacagatgtgctgcagtgacagagcgtgttcttgctgcatgctacaaggcactgaacgatcaccatgttgtgcttgaaggaactttgctgaagcccaacatggtgactcctggttccgagtctccaaaggtggccccagaggtgatagccgaatacactgttgcggcgttgcagaggactgttcctgctgcagttccggctattgtgttcttgtctggagggcagagcgaggaggaggcaaccctgaacctgaatgccatgaacaagttccagggaaagaagccgtggtctctttctttctcttttggnagggcacttcaacagagcactctgaaggcatggggtgggaaagatgaaaacattaagaaggctcaggatgccttcattgccaggtgcaaggcaaattcagaagcaaccttgggaacatacaaaggtgatgctaccctttctcaggctgcctctgagtctctccatgtcaaggactacaaatactagaaaatggtgttggcttccattgttggagagaattttgtactattggtttctgcattttgcactctaggttataggttataggaataattgcaccaacctaaattggcttggcatcgttgcttctcgtgttagtttgtgtccctttggatttctatgattgagttttgtattgg

SEQ ID NO: 1428 - DNA, 1512 bp, Cucumis sativus
atatccattcgcccattttccccatctctctctctgcacacaaatcccccatttttcctctcttccaaaatgtcttgctacagaggcaaatacgctgacgagcttattgccaatgctgcctacattggaactcctggaaagggtattcttgctgctgatgaatcgactggcactattggaaagcgtctttccagcatcagtgttgagaatgttgaaacaaacaggcgtgctcttcgtgagctccttttcactgctcctaatgttcttcaatatctcagtggggtcattctcttcgaggaaacactctaccagaagacagctgcaggcaagcctttcgttgatgttttgaaggaaggtggggttctccctggcattaaggttgacaagggtactgttgaacttgccggaaccaatggcgaaaccacaacccagggtcttgatggccttgcccagcgctgccaaaagtactatgaagctggtgctcgttttgccaaatggcgtgcagtgctcaagattggtcctaacgaaccctcacagttgtccattaatgaaaatgccaatggattggccaggtatgctatcatttgccaggagaatggtctggtacctattgtggagcctgagatcttggttgatggtcctcatgacatcaagaagtgcgctgacgtaactgaacgcgttcttgctgcctgttacaaggctctaaatgaccaccacgttctcctcgaaggaaccttgttgaagcccaacatggttacccctggatctcaatctgcaaaggttgcaccagaagtgattgcagagcacaccgtccttgccctacagcgaactgttcctgctgcagttccggctgttgtgtttttgtctggtggacagagtgaagaggaggccaccatcaaccttaatgccatgaacaaactcaaggggaagaagccgtggtctctttctttctcctttggacgtgctctgcagcagagtactcttaaggcatgggccggaaaggatgaaaacattcccaaggctcaggctgctttgctggtaaggtgcaaggccaactccgaagcaactcttggaacttacaagggtgatgctaagatcagtgagggtgcagctgagagccttcacgttgacaactacaaatattgattagttttgggactcaatatctttgttttagactcaaaaaaaaaaaaagaaaaaaaactgcggcatattgtgttttggattctcgggcatcgtaggagtagctttctttataatctcaatgctaatatcaagttatggggtaggcgttggtaataagcttgaggagcgttggcatgcaaggtttttgcaagtattttattttattttattttttacatttcagttgaagaactgagtaatctgctgttttcagttgtaattttggattttcatcggttaataacaaccattcgtgatgtgagttttctgtttacattgccgtacgtttattttttaatgttgttattttggcccggttggtgtgaa

SEQ ID NO: 1429 - DNA, 1344 bp, Nicotiana benthamiana
  misc_feature (1298)..(1298): n is a, c, g, or t
cttctcacttttgtctcatttctctctccagtcgcctattcatcatgtcttgctacaagggaaagtacgcagatgagcttattgctaatgctaaatacattggaacccctggaaagggtatccttgctgctgatgaatccactggcacaatcggaaagcgtttctcgagcatcaacgttgagaatgttgaatcaaacaggagggctctccgtgagttgctcttcaccactcccggtgctgttcagtacctcagtggtgttatcttgttcgaggaaacactctaccagaagaccgcatctggcaagccttttgttgatgtcttgaaggagggtggagttctccctggaattaaggttgacaagggtaccgtagagctcccaggaaccaacggtgagaccaccacccaaggtcttgacggccttgcagagcgatgccaaaagtactacgaggctggtgctagatttgccaaatggcgtgccgtgctcaagattggtgccaatgagccttctcagcttgcgatcaatgagaacgccaatggccttgcaagatatgccattatctgccaacaaaatggtcttgtacccattgttgagcctgagatcctcgttgatggatcccatgacattaacaagtgcgctgatgttaccgaacgtgttcttgctgcttgctacaaggctctcaatgaccaccatgtactccttgagggtaccttgttgaagcctaacatggtcactcctggttctgaggcagccaaggttgcaccagaggtgattgctgagtacaccatccgtgccttgcagcgcacaatgccggctgctgttcccgccgtggtgttcttgtctggtggtcaaagtgaagaggaggccactgtcaacctcaacgccatgaacaagctacagaccaagaagccatggtcgctttcgttctcctttggacgtgctcttcagcagagcaccctcaaggcttgggccggaaaggaggagaatgtacagaaggcgcaagctgcattccttaccaggtgcaaggccaactctgaggctacccttggaaagtatgctggtgctaccaacttgagtgatggtgcttctgagagccttcatgtcaaggactacaagtactagaacaagttttttgggttctctccctttttgtgatttccattttgaaaacgagatggcagtatcgaattacaaaagtgtctattttaatggacataatgtgtaaggctttctttctgttttttctatctgatgtattgcagcggattggtttaataacaaacaatattggcgttgtgncaaaaaaaaaaaagggcggccgctcgcgatctaggagtaggcgcgc

SEQ ID NO: 1430 - DNA, 2655 bp, Capsicum annuum
cctatgtagccgtattatataaagcctaacatacatctcccaatttcctcgttcaatttctcttattttctctctatattaatattatttttcactatcttcttgtaatcatgtcttgctacaagggaaagtatgctgatgagcttatcaagaatgctgcatacattggcacccctggaaagggtatccttgctgctgatgaatccactggaacaatcggcaagcgtctctcaagcatcaaagttgagaatgtagaatcaaacagaagggctctccgcgagcttctcttttgcacccctggttgtcttcagtacctcagcggagttattttgttcgaggaaacactctaccaaaagactgctgctggcaagccttttgttgatgtgttgaaagaaggcggtgtccttcccggtattaaggttgacaagggtaccgttgagcttcctggaaccgatggtgagaccaccacccaaggtcttgatggccttgcagaacgctgccaaaagtactatgaggctggtgctaggtttgccaaatggcgtgccgtgctcaagattggtgctaatgagccatctcagctagccatcaatgaaaacgccaatggccttgccagatatgccattatctgccagcagaacggtcttgtacccattgttgagcccgagatccttgttgatggagcccatgacattaacaagtgtgctgatgttactgagcgcgttcttgctgcttgctacaaggctctcaatgaccaccatgtcctccttgagggtaccttgttgaagcctaacatggtcactcccggttctgaatctgccaaggttgcaccagaagtgattgctgagtacaccgtccgtgccttgcagcgcaccatgccggctgctgtccccgctgtggtgttcttgtctggtggtcaaagtgaagaggaagccactgtcaacctcaatgccatgaacaagctcgagaccaagaagccatggtcactttccttctctttcggacgtgctcttcagcagagcaccctcaaggcctgggccggaaaggaagagaacgttcagaaggcacaagctgcattccttaccaggtgcaaggccaactccgaggctacccttggaaagtatgccggagcttccaacttgagtgaaggtgcttccgagagccttcacgtcaaggactacaagtactagatcaaagttttagtttttggtttatgtttcttgatttctgttttgaaaatgagatgacaatatggttttacgaatgtgtctatcagtggacataatatggtaaggcttttttttttttctttttttttccgtttaataagaactttttgaggaacattattttggtcttgtgacatctttcatgtaacagttttcggggttggtttattaaatgaacattatcttttgcgagaaatggagattacactgaacagcgggtacaaaatgccgatgattggacttggtgtttggcgaatggaaggcaaagatatcaaaaatctgctcatcaacgccatcaaaattggataccgtcacttcgattgtgctgctgactatcgaaatgaagctgaagttggggaagcacttgcagaagcgtttcaaacggggctcgtcaagagggaggatcttttcattacaaccaagctttggaactcagaccatggtcatgttcttgaggcctgtaaagacagtcttaagaagttacgccttgattatctggatctctaccttgttcatttccctgtagccacaagacatacaggagttggtacaacagatagtgcattgggtgaggatggtgttcttgatatagacaccaccatatcattggagactacttggcacggaatggaaaatctagtatccctggggttggttcgcagcataggaatcagcaactatgatgtctttctcacccgagattgcctagcatattccaaagtgaagcctgcagtgaatcaaattgaaactcatccttatttccagcgtgaatctcttgtcaaattctgccaaaagcatggcatctgtgttacagcacacaccccacttggtggtgctgccgctaatgctgaatggtttggtacagtgtcatgcctagaggacccggctctaaaatgtctagctgagaaatataagaagactgttgcccaggttattctgcgctggggcatccaacggaacacagttgtgattccaaaatcatcgaaactggagagactgcaggagaatttcaacgttctcgtctttgagctcaccaaagaagacatggacgtcatcaaaagtttggaccgcaactacaggaccaaccaacctgcaaagttttggggcatagatctgtatgcgtaaaagtttcatatgcctcatcttggcaccaaggttggtataggaaccaggaaaagggacaagctacttagaccagcatcttatttgagtatggcagagtgagtttatgttataggatatgagggagtctgactattcactgttctacctgtgatgtaatttatgttttttcatttcaaactagtgtactaaggatgatggatgatggttggttgagtttatgggagtgtgcatgccccttctccctagggcaaaacttctcccatccaacggcaaataaatagaaccatccgctattaaagtgctg

SEQ ID NO: 1431 - DNA, 1540 bp, Glycine max
agggaagacgaacgtggaaacgcacctaccccctttccacgccaccccatctcatgagtcataaatagtcaccccaccccactctcacatttcacactccctttttaaaaccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaagacagcttcaggaaaacccttcgtagagttgatgaaggaaggaggagttctccctggtatcaaggttgacaagggcacagtagagcttgcaggaactaatggggagactactactcaaggtttggatggccttggcgcccgatgccagaagtactatgaagccggtgcccgttttgccaaatggcgtgctgtgctcaagatcggcccaaacgaaccatccgagctggctatccatgaaaatgcctacggtcttgcccgatatgccgtcatatgccaggagaatggtctggtacctattgtagagccagagatcctggtggatggacctcatgacatcaacaagtgtgctgaggtgaccgagcgcgttcttgcagcatgctacaaggctctaaatgatcaccatgttctgcttgagggcactctgttgaagcccaacatggtcacccctggttcagagtctaagaaggtcaccccagaggtgattgctcaatacactgttacagctttgcagcgaactgttcccgctgctgttccggccattgtcttcttgtctggtgggcagagcgaggaggaggcaaccctcaacctcaacgccatgaacaagtcccagggaaagaagccgtggtccctttctttctcttttggaagggcacttcagcaaagcactctcaaggcatggggtgggaaagatgaaaacattaagaaggctcaggatgctttatttgccaggtgcaatgcaaactcacatgcaactttgggaacttacaaaggtgatgctacccttgctgagggtgcctccgagtctctccatgtcaaggactacaaatactaactaaaggtgttgacttcttttaatttggagaatttttgcactattggctacaccattctcatgttctttccttcatagaagttagactcggccgatttgctttctgctctcggttataggatgtctacggattaaagaataatcgcatcaagctaaattggcttgctactgtactgttgctttacattttaatttctcttgtttttttctgaatgacttttactgtattattatggagaagttccattctatgtttcaatgctatttggatgtgaaagagcattttgatatcaa

SEQ ID NO: 1432 - DNA, 1432 bp, Glycine max
aaaaccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaagacagcttcaggaaaacccttcgtagagttgatgaaggaaggaggagttctccctggtatcaaggttgacaagggcacagtagagcttgcaggaactaatggggagactactactcaaggtttggatggccttggcgcccgatgccagaagtactatgaagccggtgcccgttttgccaaatggcgtgctgtgctcaagatcggcccaaacgaaccatccgagctggctatccatgaaaatgcctacggtcttgcccgatatgccgtcatatgccaggagaatggtctggtacctattgtagagccagagatcctggtggatggacctcatgacatcaacaagtgtgctgaggtgaccgagcgcgttcttgcagcatgctacaaggctctaaatgatcaccatgttctgcttgagggcactctgttgaagcccaacatggtcacccctggttcagagtctaagaaggtcaccccagaggtgattgctcaatacactgttacagctttgcagcgaactgttcccgctgctgttccggccattgtcttcttgtctggtgggcagagcgaggaggaggcaaccctcaacctcaacgccatgaacaagtcccagggaaagaagccgtggtccctttctttctcttttggaagggcacttcagcaaagcactctcaaggcatggggtgggaaagatgaaaacattaagaaggctcaggatgctttatttgccaggtgcaatgcaaactcacatgcaactttgggaacttacaaaggtgatgctacccttgctgagggtgcctccgagtctctccatgtcaaggactacaaatactaactaaaggtgttgacttcttttaatttggagaatttttgcactattggctacaccattctcatgttctttccttcatagaagttagactcggccgatttgctttctgctctcggttataggatgtctacggattaaagaataatcgcatcaagctaaattggcttgctactgtactgttgctttacattttaatttctcttgtttttttctgaatgacttttactgtattattatggagaagttccattctatgtttcaatgctatttggatgtgaaagagcattttgatatc

SEQ ID NO: 1433 - DNA, 1299 bp, Arnica chamissonis
tccaatgacttacccgattttccccttctccaagcttctctttctcagatctcagatttcacaactatgtcttgctacagaggaaagtatgctgatgagctaatcgccaatgctgcctacatcggtacacctggcaagggtattctagctgccgacgagtcaacaggcacaattggaaaacgtctatccagcatcaatgttgagaatgttgagtcaaacaggagagctcttcgtgagcttcttttctgcacccctggtgccctccaatatctcagtggcgttattctttttgaggaaaccctctaccagaagactgctgcaggtaagccatttgtcgatgtcatgaaggaagttggagtcctccctggtatcaaggtcgacaagggtactgttgagcttgctggaacaaacagtgagaccacaacccaaggtctagacggtctagctcagcgatgtgcccagtactattcagccggtgcccggtttgccaaatggcgtgcagtcctgaaaatcggcacaaacgagccatcacagcttgctatcaatgaaaacgcctacgggctagctagatacgccatcatctgccaagagaacgggttggtcccgattgtcgagcccgagattctcgtggatggaccccatgacatcagcaaatgcgctgatgtaaccgagcgtgttctagccgcgtgctacaaagctcttaacgaccatcatgttcttctcgagggcacccttttgaaacccaacatggttacccctgggtctgacgccaaaaaagttgcaccagaagtagtagctgagtacaccgtccgtgccctgcaacgaaccatgccagcagcggtcccagccgttgtgttcttgtcaggcggtcagagcgaagaagaggccacggttaacctcaacgccatgaaccagtacaagggtaagaagccatggtctttgtcgttttcattcgggcgggccctacaacaaagcactctcaaggcttgggctggaaaagaagagaatgtgaagaaggcccaggatgcttttcttgcaaggtgcaaggctaactctgaggcaactcttggcaagtatcagggtggttctgggttgagtgaaggagcatctgaaagcctccatgttaaggactacaactactaaactttgccatgtaagtcttccgtactactacttttttaatgtcaattttgtcggatgaggtggatttcatgttctggacctatttctatgtttatatttggtggtttagttaatccgagtaggggattatttataataataagcataaaaaacctt

SEQ ID NO: 1434 - DNA, 1381 bp, Gossypium hirsutum
aaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgtccttaagattagtgctaatgagccaaccgagcttgcaatccaagaaaatgccaatgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccctgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgatgcaaagattagtgagggtgctgcagagagccttcatgttaaggactacaaatactaagaatttagtcttgtggtctgtgtatcagagatattttctgtattgatgataggcgtttattgctgtttttgagggtttccgtttcttctcatggaatttaggttgtgaaatcagaccgtttcttctcatggaatttaggttgtgaaatcagactcaaataagcttgggcggccttagttctcgctgagtgttcatggttttttgtttgcttcagtttaaaacaatattctctgcatatacaactgagtgtgctttgcacttttt

SEQ ID NO: 1435 - DNA, 1425 bp, Gossypium hirsutum
aaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgacgcaaagattagtgagggtgctgcagagagccttcatgttaaggactacaaatactaagaatttagtcttgtggtctgtgtatcagagaaattttctgtattgatgattttgggggttttccgtttcttctcatggaatttaggttgtgaaatcagaccgtttcttctcatggaatttaggttgtgaaatcagactcaaataagcttggggggccttagttctcgctgagtgttcatggttttttgtttgcttcagtttaaaacaatattttctgcatatacaactgagtgtgctttgcactttttaattgttttgcgtttcttgattcattaatcgtaatcctactatttgaggagct

SEQ ID NO: 1436 - DNA, 1376 bp, Euphorbia peplus
tctatcatcaattccgatcatgtcgtgctacaagggcaaatacgctgatgagctcattgctaatgctgcctacattggcacccctggaaagggtatccttgctgctgatgagtctaccggaacaattggaaagcgtctttcaagtatcaatgtcgagaatgttgaggagaacaggagagcccttcgtgagctcctcttcactgctcctggtgctcttcagtaccttagtggagtgatcctcttcgaggaaaccctctaccagaagaccaagtcaggcaagccttttgctgaactcttgaaggagaatggtgtcctccccggaattaaggttgacaagggtaccattgtgcttgctggcaccaatggtgagaccacaacccagggtcttgatgatcttgctaagcgctgccagaagtattatgaagctggtgcacgtttcgccaaatggcgtgctgttcttaacattggtgccaacgagccatcacagcttgccatcaacgagaatgccaatgggttggccagatatgccatcatctgccaggaaaatggattggtacctatcgttgagcctgagatcttggttgatggatcccacgacatcaacaagtgtgctgatgtaaccgagcgtgtccttgctgcatgctacaaagctctcaatgaccacaaagtcttgctcgagggaactcttttgaagcccaacatggttacccctggatcagatgcccccaaggtatcacccgatgttattgctgagtacactgtccgtgcccttcagcgcaccatgcccccagcagttccagctgttgtgttcttgtccggtggccaaagtgaggaggaagctaccatcaacctcaatgccatgaacaaacttaaaaccaagaagccatggactctaaccttctccttcgggcgtgccctccaggcaagtaccctcaaggcatggggtggcaaagaagagaatgtgcagaaggctcaggaagctttgttcaccaggtgcaaggccaactccgaggcaactcttggaacatacaagggtgatgctacccttggtgctggagcctctgagagcctccatgtcaaggactacaaatactaagaagtctcaagtttgttttcaagatatggagaggtctgttttcgtctcgggcatagttttttaggctttatttcttttttccatatcttctatcagaatttagcatatgaaaagtaaagctttaataaagcttgaggaaaattgtcttcttgagtttgaatattttggttttttccgctgaaaacagtttactgttgtgccatgttaacagtttttatggtcattgattcttacttatggtattgttcatcgagtattgtttcgtattttcatttttcct

SEQ ID NO: 1437 - DNA, 1259 bp, Plantago ovata
gccggggatcactcggtctcacacactctctctctcgttgttgtttctaccaaccaaaaagggaagggcagccagctttcttctagattcatttcctcaacctacaacaacagctctctctctccccaatatgtcttgctacagaggaaaatacgctgatgagcttattgctaatgctgcatacattggcacccccggtaagggtatccttgctgctgatgaatctactggtaccattggcaagcgtttctccagcattaatgtcgagaatgtcgaatcaaacaggagggctctccgtgagcttcttttcaccactcctggtgtccttcaatacctcagtggggttatcttctttgaggaaactctatatcagaaaacagctgcaggcaagctgtttgttgatgtgttgaaggagggtggtgttctcccaggcatcaaggttgacaagggtaccgtggagcttgctggaacaaatggtgagaccacgactcaaggtcttgatgaccttgctcagcgctgtcaaaagtattacgctgctggtgctcggttcgctaagtggagagcagtgttgaagatcggtcccaatgaaccatcacaacttgccatcaatgagaatgccaatggtctagctcgttatgccatcatctgccaggagaatggtttggtacccattgttgagccagaggtcctcgtagacggatcccatgacattgaaaagtgcgctgatgtgaccgagcgtgttctagccgcttgttataaggcactaaatgatcaccacgtacttctggagggtactctgttgaaacccaacatggtgacacctggctctgactctccgaaggttgccccagaagtcattgcagagtacaccgtccgcgctctccaacgcacaatgccatgtgcagtccctgctgttgtgtttttgtcgggtggacagagtgaggaggaggccaccattaacctcaatgccatgaacaaactgaagtccaagaaaccatggagcctttctttctcctttggacgtgctcttcagcagagcaccctaaaagcctgggctggaaaggatgaaaatattaaaaaggcccaagctgccttccttgccagggccacggcgaactctgaggcaacccttggaacttacgctggaagcagctctttgactgagggtgcctctgagagcctccatgtgaaagactacaaatattaggtcagctcatttgttctcctcaatctatcagctttgctggttgcaagaaaaa

SEQ ID NO: 1438 - DNA, 1335 bp, Primula obconica
catgcttcgtccgcccacttacgccgaaaaatactctctctctctctctctcgtcaactcctcttctctctctagccatgtcttgctacaagggcaaatatcatgatgagctaattgccaacgccacctacattggcacccctggaaaaggcattctcgctgctgacgagtccaccggaactattggaaagcgtctgtcgagcattaatgttgagaatgtggagaccaacagacgtgctcttcgtgagcttctgttctgtacacctggcgctcttcagtacctcagtggagtgatcctctatgaggaaactctttaccaaagcaccgctgcagggaagccttttgtggaagtactaaaggaaggaggagtcctccccggaatcaaggtcgacttgggcaccgtcgagcttgccggaaccaacggcgagaccaccacccagggccttgacggcttggccgcccgctgccagaagtactacaaggccggcgcccgttttgccaagtggcgtgccgtcctcaagatcggtcccaacgagccctctcagctcgccatcaacgagaacgccaacggcctcgctcgctacgccatcatctgccaggagaacggactcgtccccattgttgagcctgagatcctcgtcgatgggtcccacagcatcgacacgtgcgctgatgtcaccgagcgtgtgcttgctgcttgctacaaggccttgaacgaccacaaagtgctgcttgaagggactctcttgaagcctaacatggtgaccccagggtctgatgcccccaaggtgaccccggaggtgatagcggagtacacggtgagggccctgcagaggacgatgccgccagctgtcccggcagtggtgtttctctccggcggccaaagcgaggaacaggctacccgcaacctcaacgccatgaaccagctcaaggccaccaagccatggagcctcactttctccttcggtagggctcttcagcagagcactctcaaggcctgggctggcaaagaggagaatctcgagaaggctcaggccgcgtttctcaccaggtgcaaagctaattccgaggctaccctcgggacttatcaggggagcgacactttggtcgagggtgctgctgagagcctccacgtcaaggattacaagtattgagtttttgttttggttttttcgtcgtggtagtgagactatgatttttaagtgttttcgggcggaagtttttagggtctatttctttttccgggttttggttgtgttcggaacaaccttttgtcgtggttgaataagctcgaggatgtttttgttaagttgagggtttaattgtctctgtgtt

SEQ ID NO: 1439 - DNA, 1550 bp, Zostera marina
actccactcgttctcgatttttcatctgtctttcggccaccggtttcgtcttcttccgttcttcgctaagatgtctgcttacgttgggaaatacgccgatgaattgattaccaatgctgcctacatcggcacccctggaaagggaattcttgcggccgatgaatctactggcacaatcggcaagcgtctttccagcatcaatgttgagaacatcgaatccaaccgtcaagcgctccgtgagcttctcttttgcacacctggtgctctcaagaaccacatcagtggtgttatcctttttgaggaaaccttgtaccagagcactgtttctgggaagccatttgttgatgtacttaaggaagctggtgctctacctggtatcaaagtagacaagggtgttgttgaacttgctggtacctgtggtgagacgactacacaaggtcttgatgaccttggcaaacgttgcaagaagtactacgaggctggtgctcgtttcgccaagtggaggtctgttcttaagatcactgccaatgagccatcacagctttccatcaacgaaaatgctaatggactagctcgatatgctataatttgccaggagaatggtcttgtccccattgtcgagcctgagatcctagttgatggtccacacgacatcgatcgatgcgctgacgtgactgaacgtgtccttgccgcttgctacaaggcacttaacgaccaccatgtccttctcgagggttcattgctgaagccaaacatggttacacctggttcagacgcagccaaggttgcacccaaggtagtggctgagtacactgtaagaacacttcagcgcactgtccccccagccgtccctgccgttgtttttctttcaggaggtcagagcgaggaggaggcgacattgaacttgaatgccatgaaccaacttaaggggaaaaagccatggtcgctgtctttctcattcggacgtgcgcttcaggcaagcaccttgaagacatggggtggcaaggtggagaacaaggagaaggcacagacagctttctatgcaaggtgcaaggcaaactcagaggcgacacttggaacttataagggtgatgccatcaaaggtgctggtgttgatgagagtctccatgtcaaagactacaagtactaagtcaggtttgatgatctttcatctgctgcaagttgttgttatggatttggaaattggatggttcttttgtgttttgttaatttaaactctactttatgagtcttatgttattagagaataaataatgtggtcttttttgagctttgagcctttagctttcttcttcaatggtgtattagagaggtcttttgtagcttgttctgaaaaaacagttttttttcatttgcaatctttcttttgtttttgatagatcaagattgcttggtctcactcattctcaatgattagtttaaaatcgtatttttattaatcacagtattaatcattcaatgagagaatgaactagatatgaaattaacatcattaatggtgaaatatcaatatcttttttgataacgac

SEQ ID NO: 1440 - DNA, 1271 bp, Cleome spinosa
cagccttttcacctactttctctctcctttcgctctgctgtctctctctcttcgttttcgatccctcaaccatgtctgccttcacgagcaaatacgctgatgagctgattgctaacgctgcctacatcggtacccccggaaagggtatccttgccgctgatgagtcaactggtaccattggcaagcgtcttgctagcatcaacgttgagaatgtcgaatccaacaggcgtgctctccgtgaactcctcttcaccgctcctggtgctcttccatgcctcagcggtgttatcctcttcgaggaaaccctctaccagaaggcttccaatggcaagcctttcgttgacattttgaaggaaggtggagtcctcccaggtatcaaggtcgacaagggcactgtcgagctccctggaaccaacggcgagaccaccacccagggtctcgatggccttggtgaccgatgcaaaaagtactatgaggctggtgcccgcttcgccaagtggcgttctgttctcaagattggccagaatgagccatccgagttagccatccacgagaacgcatatggattggctagatatgcagtcatctgccaggaaaacggtcttgtccccattgttgagcctgagattctcgttgatggccctcatgacatcaacaaatgcgctgctgtgacagaacgtgtcctggccgcatgctacaaggccctgagcgaccaccatgttttgctcgaaggaaccctcttgaaacccaacatggtaacacccggatctgaatctgccaaggtggcacccgaggtcatagctgagcacacggtccgtgccctacaaaggactgtccctgctgctgtcccggccatcgtgttcttatccggtgggcagagcgaggaagaagcaaccctgaacctcaacgccatgaaccagctgaagggtaagaagccgtggtcactgtcattctcgtttggacgtgcccttcagcagagcacactcaaggcgtgggccgggaaagacgagaacgtggctaaggcgcaggaagcattattagtgaggtgtaaggccaactctgaggctacgctcggaacttacaagggtgatgcgaagcgcggtgaaggtgctgacgagagcctccacgttaaggactacaagtattgaggatgatgtggatgttcatcatcatcatcatcatggttgtgttgtgatattaatattatcctggatatgtatttctagggtttgttcttcttcccttttgggtttctgttgcgacttttgggg

SEQ ID NO: 1441 - DNA, 1587 bp, Vigna unguiculata
gttcacttcttaccaacctcacacctaccttgctctctccgttcaactacctcaccgtcttcttcctcctcgatcatgtctcacttcaagggcaagtaccatgatgagcttattgccaatgctgcttacattggcactcctggaaagggtattcttgctgctgatgagtcgacaggtacgattggtaagcgtttggccagcatcaatgtagagaacgttgaatccaacaggcgtactcttagggagctgcttttcactgctcctggtgctcttcaatacctcagtggagtcatcctctttgaggaaaccctctaccagagcaccgcttcaggcaagccctttgttgagttgttgaaggaggctggtgtgcttcctggtatcaaggttgacaagggcactgttgagcttgccgggaccgatggggaaaccaccactcagggtctagatggccttggtcagcgttgtgccaagtactatgaagcaggtgcacgatttgccaaatggcgtgccgtgctgaagattggtcccaacgagccatcagagctctccatccatgagaatgcctatggattggccagatatgctgtcatatgccaggaaaatgggttggttcccattgttgagccggagatccttgttgatggacctcatgacattaacaagtgtgccgctgtcaccgagcgtgtccttgcagcatgctacaaggctttgaatgatcaccatgttcttcttgagggaactctattgaagccaaacatggtgacacctggatctaaatctgcaaaggttacccctgaggtggttgctgaacacactgttagagccctgcagcgaactgtacctgccgcagttcctgccgtggttttcttgtctggtggacagagtgaggaggaggcaaccctcaacctcaatgccatcaaccaggttaaggggaagaagccatggacactctctttctctttcggaagggcacttcaacagagcacccttaaggcatggggtggaaaagatgagaacgtgaagaaggctcaagaagccttgttggtaagagccaaggctaactcagaggcaactcttggaacctacaagggtgattcagcccttggtgagggtgcctcagagagcctccatgttgagaactacaagtactgagaaaagttggttctctatatcgaggctagtgcgggtaggaatcgggtgacaaccgaatttcttgctattgagtattatggtttgactcctcccagaataatcgtttgaaattttgcttttttgtttttttagtgttctgctatatcattttagtttcagtgtattggtcaaacatgtgcaaatggaggggattttaatttgtcttgaagaaaccacctttctaaacgaagctttgagctttgtgtttatttgcaattctcccgctgttttgttttcgttctgcataatcatgagatcgataaatggaagggtttgtgatatacatacctttttaattcatcaatattttatgaatatatttacacaatgattacgtgtatgttgagtgtatgaatatatttcataatgattacatatgttgacttgattatttac

SEQ ID NO: 1442 - DNA, 1378 bp, Ipomoea nil
aagtataaaacctactgactcccagagtccttacgctactcaccaacctctctttcaactcgccttcgatctctctagtattctacacaaaacagcagccatgtcgtgctacagaggaaaatacgccgatgagctcattgccaatgccgcttatattggtacccctggaaagggtattcttgctgctgatgaatcaactggcacaattggcaagcgttttgctagcatcaatgttgagaatgttgagtcaaacaggagggctctccgtgagctgcttttcactacccctggtgcactccagtacctcagtggagttatcttgttcgaggaaactctttaccagaagactgcttctggcaagccgtttgttgaagtcatgaaggagggtggagtgcttcccggaatcaaggttgacaagggtgttgttgagcttcctggaaccaacggtgagacaaccacccagggtcttgatggcctggctgagcgctgcaagaagtactacgaggctggtgctaggtttgctaaatggcgtgctgtgctcaagatcggagcgactgagccatctcagcttgccatcaatgagaatgccaatggtcttgctcgttatgctatcatctgccagcagaatggtcttgtgcccattgttgagcccgagattcttgttgatggacctcatgacattgacaaatgtgctgatgtaaccgagcgtgttcttgctgcttgctacaaggccctcaacgaccaccatgtccttcttgagggtaccttgttgaagcccaacatggtcactcccggttctgagtgtgccaaggttgcaccagaggtgattgctgagtacaccgtccgtgccctgcagcgcaccatgcctgcagctgtacctgctgtggtgttcttgtctggtgggcagagtgaggaggaggctaccgtcaaccttaatgcaatgaacaagctgaagacaaagaagccatggaacctctctttctcctttggacgtgctcttcaggctagcaccctcaagatttggggtggaaaagaggaaaatgtcaaaaatgctcaggctaacttcctggaaaggtgcaaagccaactctgaggcaactcttggtacatatgcaggttcttctaacctcagtgctgctgcatccgagagccttcatgtgaaggactacaaatactaagcaaggttttgtatttttgtttcattttctggttttgagtaagaggaactgcagtatgttttgtcgagacaatgtttattattgcagggagctgtttagtttttatgtctatcttccaaagcactgttcacaccggttggtcgaataatgtttgctagtcaaattgacgtttatggattaagtgactggttttatcgagtt

SEQ ID NO: 1443 - DNA, 1437 bp, Populus trichocarpa
aatgtcgtttgccccacctcctcatttcatatataaaccctaacgacaacctctttcctactctgctcgcatctatctttttcattaatcccactccaactctccacctctgatcataaaatgtcttgcttcaagaacaaatacgctgatgagcttgttaagaatgctgcctacattggcacccctggaaagggtatccttgctgctgatgagtcaactggcacaattggcaagcgtctatccagtattaatgttgagaatgttgaggaaaacaggcgtgcccttcgtgagctccttttctgcactcctggtgccctccaacacctcagtggagtcattttctatgaggaaactctctaccaaaagactgcgtcaggcaagccctttgttgatgtcttgaagaaaggtggtgttctacctggtatcaaggttgacaagggtactgttgagcttcctggcactaatggtgagaccacaactcagggtcttgatggccttggtcaacgctgtgcaaagtactatgaagctggtgcacgttttgccaaatggcgcgctgtgctaaagattggtctcactgagccatccgagttggccatccatgagaatgcctatggtttagccagatacgctgccatctgccaggagaatggcttggtccccattgtggagcctgaaatcttgattgacgggtctcatagtattgagaagtgtgctgctgtaactgagcgggttctcgctgcatgctacaaagctctcaatgaccaccatgtcatgcttgagggcactcttttgaaacccaacatggtgactcctggatcggatgcaccaaaggttgcaaacgaggtgattgccaagttcactgtccgtgcccttcaacgcactgtgcctgctgcagttcctgctatcgtattcttgtctggtggacagagtgaggaggaggctacacgcaacctcaatgccattaacaaactaaaaacgaagaagccatggtctctttccttttcctttggacgtgcccttcagcagagtacccttaaggcctgggctggcaagaccgagaatgtggagaaggctcgtgcagcattcctttgcaggtgcaaagctaactcagaggctactcttggtacttaccagggtgatgctgctcctggcgagggtgcttcagagagcctccacgtcaaggactataagtattaagaattcccaacttgtcatagttctggagagttgctgtctcgtcatagtttaagcccttttttttttttttcaatctgtggtggtgccggtatttagcttggaactagaacaataaaagcttgagggtaaatattggcatgttgagtttgatgattttgatcagtttcggtctacaaccgtctgatgttttcttttttctaaaacttaatgaagactatgactgtattttgttggatttga

SEQ ID NO: 1444 - DNA, 1401 bp, Nicotiana tabacum
ggccattacggccggggggggtcgcaaatttagcgcactatattaaacctaattttcccccactcttccctcatctctgtctaccaaacttgtatctcttttcttcaatcttcgcccaagcaaataaccatgtcttgttacaagggaaaatacgccgatgagctcatcgcaaatgcttcatacatagccacccctggtaagggtatccttgctgctgacgagtctactggcacaattggcaagcgtctatctagtattaatgttgagaatgttgaggaaaaccggagggctctccgagagctgctcttcctcacacctggtgctcttcagtaccttagtggagttatcttgtttgaggaaaccctttatcagaagactgcatccggcaagccttttgttgatgtcttgaaggagggtggagttctccctggaattaaagtcgacaagggtaccgtagagcttcctggaaccgatggtgagacgactactcagggtttggatggccttgccgagcgctgccaaaaatactatgctgctggtgctaggtttgcaaaatggcgtgcagtgctcaagattggtgccaacgaaccttctcagcttgctatcaatgacaatgccaatggccttgcaagatatgccatcatctgccagcagaacggtcttgtccccattgttgaacctgagatccttgttgatggaggccacgacattaacaaatgtgccgatgtcaccgagcgtgttcttgctgcttgctacaaggctctcaatgaccaccatgtcctcctcgagggtacattgttgaagcccaacatggtcactcctggatctgaatcccctaaagttgcaccagaagttatcgcagaatacactgtacgtgccttgcagcgaacaatgccagctgctgtccctgctgtggttttcttgtctggtggtcagagtgaggaagaggctacccgcaacctcaatgccatgaacaagctacagaccaagaggccctggactctctcattctccttcggacgtgctcttcagcagagcactctcaaagcctggggcggaaaggtggaaaatgttgagaaggcccgtgctgcattcctcacaaggtgcaaggccaactctgaggctacccttggaaagtatgctggtagttccaacttgagcgagggtgcttccgagagccttcacgtcaaggactacaagtattaggacaattttcggtttctgcctctttttggtttttgttttgatgacgaggttgcaggatggtttactaggagcgtcttttactggtcatagtgtgctaggcttttttctcatttctcctcctgaggtatgtcacaggatttggctaataaaagcttgagaaacttcgtctttgtgacattgtgggtgtcattttta

SEQ ID NO: 1445 - DNA, 1308 bp, Silene vulgaris
aaccatgactgcctacagggggaaagtacgccgatgagctgattaagaacgcttcttacattgctacccctggaaagggtatccttgctgctgatgagtctactggtactattggcaagcgttttgccgggatcaatgtcgagaatgttgagaccaacaggagggctcttcgtgagcttctgttcactacccctggtgccttccagtacctcagtggtgtcatcctctttgaggaaactctctaccagaagactgctgcaggaaagccatttgttgaggtgatgaaggaaggtggagtccttcccggtatcaaggtcgacaagggtgttgtcgagcttgctggaaccaatggcgagaccaccactcagggtcttgatgaccttggcaaacgctgtgctcaatactactctgctggtgccaggtttgccaagtggcgtgctgtccttaagatcggcccaactgagccatctgctctctcaatcttggagaatgctaatggtcttgctcgctatgccatcatctgccaggaaaatggtctagtcccaattgtcgagcccgagatcttggttgatggatcccatgacattgacaggtgtgctgaggtcactgaacgtgtgcttgctgcttgctacaaggctcttaacgaccaccatgttctcctcgagggtactcttttgaagcccaacatggttaccccaggatccgacagcaagaaggtggcaccagaggttattgctgaatacacagttcgaaccttgcagaggacagtcccaccagcagtgcctggaatcatgttcttgtctggtggacagagtgaggaggaggctaccctaaaccttagcgccatgaacaagctccagaccaagaagccatggaccctctctttctcttatggacgcgctcttcagtcaagtaccctgaaggcgtggcagggcaaggaggagaatgtcaagaaggcccaggaagtgttccttgccagggctaagggcaactcggaggcaactctaggcaagtatgttggtggtgcaggaggagctgatgcagctgagagtctccatgttaaggactacacgtactaagctcagtgtttgttaagcttcctggattttcattccggtgacgtgttttagactgttaattgtgcctttatcttcgtcttttttttttttgttgacatctaaataatagtattatggatttggaggtagatttgttccaagtacctaaaaagttgtatggttttaagacttggaccgctccgaatatacatcgtagttgattttgcttgcatttgtgaatcttattgct

SEQ ID NO: 1446 - DNA, 1580 bp, Pennisetum glaucum
cagagaccaccaccttctctcccctgcccaaccagccaacccattcatcgcctccgacttccccatcacgagccccccttcacgcgcgcatcgaccatgtcggcttactgcggaaagtacaaggatgaagaatgcggcatacattggcacacctggcaagggtgacgagtccactggcaccattggaaagcgcctttccagcatcaatgttgagaacgtcgaggagaaccgccgtgccctccgtgagctgccctggtgccctccagtacctcagtggtgtgatcctctttgaggaaactctctaccagaagaccaaggatggcaagcccttcgtcgatgtcctcaacgagggaggacaagggtaccattgaggttgctggcaccaacaaggagaccaccacccagggtcatgatgaccttggcaagcgctgcgccaagtactatgaggctggtgcccgctttgccaagtggcgtgctgtcctcaacattggccccaacgagccgtcacagctggccattgacctgaatgctcagggtctggctcgctacgccatcatctgccaggagaacggtctggtgccgattgtggagcctgagatccttgtcgatgggccgcatgacattgagcgctgcgcttatgtcactgaggttgtccttgctgcctgctacaaggctttgaacgagcaccatgtcctccttgagggtaccctcctgaagcccaacatggtcacccctggctctgacaggtggcccctgaggtgattgctgagtacactgtctgtaccctccagaggactgtccctgctgctgtgccggccatcgtcttcctctctggtggacagagtgaggaggaggccaccctgaacctcaatgccatgaacaagctcaacaccaagaagccgtggtccctgtccttctcctttggccgtgcccttcaggcgagcaccctcaaggcatggggtggcaaggcagagaatgtggagaaggccagggctgcctttctcaccaggtgcaaggccaactcagaggccaccctcggcacgtacaagggtgatgccgctgtcggtgagggtgtctcggagagcctccacgtcaaggactacaagtactgatctgcctctccttttgaacctccctacgatgatttgctcgtctctgcatgtttggacatagactccatgtttggacatagagactccttttaataatcctgaactcttatgcttaactttgcggatgatggttgattactttttatattcgtatattagtcttttttggtgctaatctgtataatatggtcttgccgacagtaaatcgagcagccgttctttcttcagtcgtcgtgctctggttatataattgaaaagataaaccatttttatgtcctgagtttcacaggttggttgttttccaccgacctttgtccattgtgatgctagtggtgctttagttttttaaagtagtacgtggcaagctgaggtgctttattagggcagtctcaatgacacatttatggtggtttttagcaaaatggtgatgtggcagcctaatcagggcaactttaacgtatagtcttg

SEQ ID NO: 1447 - DNA, 1424 bp, Chelidonium majus
aaactccatctctctctctctctttcaatctctcaatcatgtcttgctacaagggcaaataccatgatgaactcattgccaatgctacctacattggtacccctggaaagggtattcttgctgctgatgagtctaccggcaccattggtaaacgtctatcgagcatcaatgttgagaataatgagtctaacagacgtgctctccgagaacttctcttctgtaccccaggtgcctttgattgcctaagtggtgtgatcctctttgaggaaactctataccaaaaaactgctgctggtaagccttttgttgaagtcatgaaggaagctggagtccttccaggtatcaaagttgacaagggtaccgttgagcttgccggaactaacggtgagaccaccacccagggtcttgatggccttgcccagcgttgccaacagtactacacagctggtgctcggtttgccaagtggcgtgccgtgctaaagattggtgccaacgagccatctcagctggcaatcaatgagaacgctaacggtttggccagatatgccatcatttgccaagagaatggattggtgccaattgttgagccagagatcctcgtcgatgggtctcacgacattgaccgttgtgccgatgtcacagagagagttcttgcagcttgctacaaggcattgaatgaccacaaggtccttctcgagggaactttgttgaagcccaacatggttacccctggttctgactcaaagaaggtctccccagatgtgattgctgcatacaccgttcgcacccttttgaggaccatgccaccagcagttcctgctgtggttttcttgtccggtggacagagtgaagaggaggctacacttaacctcaacgcaatgaacaaactcaagggaaagaagccatggtcactcactttctcctttggtcgtgctcttcagcagagtacactcaaggcatgggcagggaaagaggagaacgtagagaaggcacaagccgctttcctcaccagatgcaaggccaactctgaagctaccttgggtacctacaagggtgatgctgtaattggagagggtgcctcagaaagccttcacgttaaggactacaagtactgattgatcaaagaaagcgtatgagctgttttctttttcagtactgttttgttttctgtttttgtttgctactttgatgagtaaaggaaacatggttaggaggactgaagataaaagagtcagtctctttggacttctaatttagggttttaggtggttttataaggagtgatgatgcaataattttttggagtgcatgacacatgagtgagtttgaagaacatagtgttgtctgatctcccggtgaattgtctttcaaattatgtttatttcctgttatgttcaatttttcgagtcaatcaatcagttaag

SEQ ID NO: 1448 - DNA, 1525 bp, Zostera marina
ccgaaactttgggctatatttgcaatttactatataaaatatccatgtgttttctgttcccgtctataaaacaatctcaactaccttcacacaaaaatcatccacttctattcgttctcatttctcatcatcaaagcgaaccttaccaaactatctgtcgttctctgcctgcttctttcttccgagatgtctgctttcaccgggaaatacgccgatgagctgattgccaatgctgcctccatcggcacgccgggaaagggaattcttgccgccgatgaatccactggcacaatcggcaagcgtttagccagcatcaatgtcgagaacaccgaatcgaaccgtcaggctctccgtgagctacttttctgcactcccggtgctcttatgtgcatcagtggtgtgatcctttacgaggaaacactgtaccaatccaccgccgctggcaagccattcgtcgacgttctcaatgaagctggggtcctacctggtatcaaagtcgaccagggtgtcgtcgaactctccggtaccaacggggagaccaccacacaaggtctagataatctcggcaaacgttgcaagaagtactacgatgccggtgcccgtttcgccaagtggcgtgccgttctgaagatcggccccaccgaaccgtcgcagctctccatccaagagaacgcaaacggattggctcgctacgccatcatctgccaggagaacggtctggttcccattgtggagcctgagatcctcgtcgacggtcctcacgacatcgaacgttgcgctgacgtcagcgagcgtgtcctggcagcttgctacaaggcactcaatgaccaccacgtccttcttgaaggtactctgttgaagccgaacatggtgacccctggttcggatgcgaagaaagtagcgccggatgttattgcggtgtacactgtcagaaccctacagcgcacagttccaccagccgtccccgctgttgtgttcctctccggtggacagagtgaggaggaagccactcgtaacttgaacgccatgaaccagctgaagggtaagaagccgtgggctctttctttctccttcggacgtgctctgcaggcaagcacactgaagacgtggggtggaaaggtggagaacaaggaaaaagcacaagctgcgttccttgctcggtgcaaggccaactccgaggctactcttggaacttacaagggagacgctgcccaggcggatggcgtgtccgagagcctccatgttaaagactacaagtactgattttatttattggtaatgtttgtttaatcgtttgtttcgcatcttctccccagtggtccagttctctcgcctcttttgtgttttattctcccaagtgggctatcaaaagtcctctgattaataattaataagcaatagttgccggaaacttttatagtgttatggccaatcatacatacccacaaatgcacaatatccagtcctgtttgtcatctttgttctgtatttcgatctaccattagaaagtagtatactgttttca

SEQ ID NO: 1449 - DNA, 1288 bp, Raphanus sativus
  misc_feature (361)..(361): n is a, c, g, or t
  misc_feature (376)..(376): n is a, c, g, or t
  misc_feature (427)..(427): n is a, c, g, or t
  misc_feature (448)..(448): n is a, c, g, or t
  misc_feature (454)..(454): n is a, c, g, or t
  misc_feature (559)..(559): n is a, c, g, or t
tccgtcacaaacgatgtctgccttcaccagcaaatacgccgatgagttgatcgctaacgctgcctacatcggcacacccgggaaaggtatcctcgccgccgatgagtccaccggtaccatcggaaagcgtctcgcgagcatcaacgtggagaacgttgagtccaacagacgtgctctccgtgagcttctcttcaccgcccctggtgctctcccttgcctcagtggtgtcatcctcttcgaggagactctttaccaaaagagctccgatggcaagcttttcgttgatatcttgaaggaaggaggagttcttccaggtatcaaagtcgacaagggtaccgtcgagctagccggaaccaacggngagaccaccactcanggtctcgacggtctcggtgagcgttgcaagaagtactacgaagccggtgcncgtttcgccaagtggcgtgcngttctnaagatcggcgagaacgagccatcggagctttccatccacgagaacgcttacgggttggctagatacgctgttatctgccaggagaacggtcttgttcccatcgtngagcctgagattcttgttgacggttcccatgacatccacaagtgtgctgccgtcaccgagcgtgtccttgccgcttgctacaaggctcttagcgaccaccacgtcttgcttgagggaactttgttgaagcctaacatggttacaccaggatccgacagtgctaaggttgctcctgaggtgatcgctgagcacaccgtccgtgcccttcagagaacggtcccagctgctgttccagccattgtgttcttgtctggtgggcagagcgaggaggaggcgaccaagaacttgaacgcgatgaaccagttgaagaccaagaagccatggtcgttgtctttctctttcggacgtgcgttgcaacagagcactttgaagacatgggcaggtaaagaggagaatgtcaaggctgctcaagaggccttgtatgtgaggtgcaaggctaactctgaagctacgcttggaacttacaaaggtgatgctaagcttggtgatggagccgcagagagccttcacgtgaaggattacaagtactgagaatcgtcgttatcattattaccctcagacattatcggcctttttctcatttttctttggatttgtgttttatctacaactaagatgtgtgccttttgattgagcttcatcttctctacacctcttgtttcggcccttttaaataacagcttttgttgttctgctttttgaatactaatctattctctgtctctgttt

SEQ ID NO: 1450 - DNA, 1435 bp, Triphysaria pusilla
tctctctcatctctgtcttttctatcggatctctctctccctctcatacatttcttcttcgttttctcataccagttagttactatgtcttgctacaaggggaagtacgctgatgagctcattactaatgccaaatacatcggtacccctggtaagggtatcctcgccgctgatgagtccaccggcacaatcggcaagcgtctatctagcatcaatgtcgagaatgttgagtcgaacaggcgggccctacgtgagctcctattcaccacccccggtgcccttcagtatctcagtggtgtcattctatatgaggaaactctatatcagaaaacagctgctggcaagccctttgttgatgtcatgaaggagggtggtgtccttcccggtatcaaggttgattcgggtactgttgagctcgccggcactaatggcgagactaccacccaaggtctcgatgggcttgcccagcgttgccagaagtactatgccgctggagcccgttttgccaagtggagggctgtcttgaaaatcggcgccaatgagccatcccagctcgccatcaacgagaacgctaacggcctggcccgctacgccatcatctgccaggagaatggcctagtccccattgttgagcccgagatcctcgttgacgggacccacgacatcaacaagtgtgctgatgtcactgagcgcgtccttgctgcctgctacaaggccctcaacgaccaccatgttctcctcgagggtacacttttgaagcccaacatggttaccccgggctccgactccgccaaggtcgcccctgaggttgttgccgagtacactgtccgggccctgcaacgcacgatgcctgctgctgtccctgccgtggtgttcttgtctggtggacagagtgaggaagaagcaacagtcaatctgaatgctatgaacaagctcaaggctaacaagccatggagcctttctttctcgttcggccgtgctctccagcagagcacactcaaggcttggtctggaaaggaagagaatgttgccaaggcacaggctgcattcctggccagggccaaggctaactccgaagcgactcttggaacttacaagggtagtggcagtttgagcgagggtgcgtctgagagcctccatgttaaggactacaagtactaggtcattgaaggtttaaaggggtttaatttgatattttggtgaagcaatttgttaagactttctgaggatatatgctgtgttttttctttttacttttattgtcgcggacttttttataataaggttgagtaacatcatcttctcttttagtttgtgtcttttttatcattgtttttttggtgtgttttgtgtcctctttgacagttggttgccattgatggccgagtcaatgtttgttacttttgcactggggaaaatatgaatccgaagtttg

SEQ ID NO: 1451 - DNA, 1171 bp, Primula obconica
gaaaatatctatgtattctctccccacaactaccactctcgcatctaaatctctctctctctctctctctcgtcaactcctcttctctctctagccatgtcttgctacaagggcaaatatcatgatgagctaattgccaacgccacctacattggcacccctggaaaaggcattctcgctgctgacgagtccaccggaactattggaaagcgtctgtcgggcattaatgttgagaatgtggagaccaacagacgtgctcttcgtgagcttctgttctgtacacctggcgctcttcagtacctcagtggagtgatcctctatgaggaaactctttaccaaagcaccgctgcagggaagccttttgtggaagtactaaaggaaggaggagtcctccccggaatcaaggtcgacttgggcaccgtcgagcttgccggaaccaacggcgagaccaccacccagggccttgacggcttggccgcccgctgccagaagtactacaaggccggcgcccgttttgccaagtggcgtgccgtcctcaagatcggtcccaacgagccctctcagctcgccatcaacgagaacgccaacggcctcgctcgctacgccatcatctgccaggagaacggactcgtccccattgttgagcctgagatcctcgtcgatgggtcccacagcatcgacacgtgcgctgatgtcaccgagcgtgtgcttgctgcttgctacaaggccttgaacgaccacaaagtgctgcttgaagggactctcttgaagcccaacatggtgaccccagggtctgatcgcccccaaggtgaccccggaggtgatagcggagtacacggtgagggccctgcagaggacgatgccgccagctgtcccggcagtggtgtttctctccggcggccaaagcgaggaacaagctacccgaaacctcaacgccatgaaccagctcaaggccaccaagccatggagccttactttctccttcggtagggctcttcagcagagcactctcaaggcttgggctggcaaagaggagaatctcgagaaggcccaaagcgcgtttctcactaggtgcaaggctaattccgaggctactcttgggacttatcaggggagcgacactttggtcgagggtgctgctgagagcctccacgtcaaggattacaagtat

SEQ ID NO: 1452 - DNA, 1864 bp, Gossypium hirsutum
acttccgtctctctcttctttcctcctaggcccaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcggcaagcccttcgttgatgttttgaaggaaggtggtgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtcgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgatgcaaagattagtgagggtgctgcagagagccttcatgttaaggactacaaatactaagaatttagtcttgtggtctgtgtatcagagaaattttctgtattgatgatggggtttccgtttcttctcatggaatttaggttgtgaaatcagactcaaataagcttggggggccttagttctcgctgagtgttcatggttttttgtttgcttcagtttaaaacaatattctcagcatatacaactgagtgtgctttgcactttttaattgttttgcgtttcttgattcattaatcgtaatcctactatttgaggagctccagagccttcgaggaatggttgatggggccttgggagtttatagccagccaagtaacttaactgccgttagtgctgcaggaattgctaaagccccttggataaaaacaggacctgaaaaataaaagtccaagcatttttagtgaaaaaatgaataccagtgaacaatcaagagataggagttagctggctaaggatttcagcagggattgggaagtcaacttgttacaatccggttgcagtgtaaggcagctcgtcagggtttgcatcagtatttgtatagaagagaacagtgccacagccaaccaaaaaacctccaaacaagacacaaaggagtcacagcagcaactagggctgagtatttgatagaattatagaactgagtgaacaaatttaaattaacgagtacttttttattaaaagcaaatagcgaagaatattttgtatga

SEQ ID NO: 1453 - DNA, 1457 bp, Theobroma cacao
cactgccaagtctctcactttccattcactctccattttaccctctcctttctcttttaaaaaccctacgctcagtttatttcttccctgtctctctgtttctttctcgctctccctttccaaacaaaactcttgcttacctcttcccctcagctttcctttcaaacatgtcttgcttcattagcaaatacgccgaggagcttgctaaaaatgctgcctacattggcacccctggaaagggtatccttgctgctgatgaatctaccggcacaatcggcaagcgtctttcaagcattaatgtagaaaatgttgaagacaacaggcgtgctctccgtgagctccttttcaccactcccggtgctcttcagtacctcagtggtgttattctctttgaggaaaccctctaccaaaaagcctcttctggcaagccttttgttgaaatcttgaaggaaggtggagtccttcctggcatcaaggtcgacaagggtaccgttgagcttaacggaaccaatggtgagacattcacccagggtcttgatggccttgcccagcgttgccagaagtattatgaagctggtgctcgctttgctaaatggcgtgctgtgctcaagattgccgttaacgagccaactgaacttgctatccaagaaaatgccaatggtctggccatgtatgctgccatctgccagcagtgtggcctcgtccccattgtcgaacctgaaatccttgttgatgggccacatgatattaaaaagtgtgctgaggtgacagagcgtgtactcgccgcttgctacaaggctctgaatgaccaccatgtcatgcttgagggtacactgttgaagcctaacatggtcacccctggttctgagtccccaaaagttgctccagaggttattgccgagtacactgtccgtgccctgcagcgaactgtccctgctgctgtccctgctattgtattcttgtctggtggacagagtgaggaggaggctacccttaacttgaatgccatgaacaagctcaagaccaagaagccatggtcactctcattctcatttggacgtgcccttcaacagagcactctcaaggcttgggctggaaaggaggagaatgtgaagaaggcacaagctgctctccttgttaggtgcaaggctaactccgaggccactcttggtacctacaagggtgatgcacagcttggtgagggtgccgcagagagcctccatgtcaaggactacaaatactaagaatttagggttgtggtttattatgtcatatgttttgcagagtaaattgcggtatggatagtaggcttttagggctttttgtctttttgatttctgtcgcaactcatcgaatttaggggtgaaaatcagactaataagcatggggagccttgtgctcgttgagtgttgatggtttttgtttatttaagtttaaaacaaaattttttgcgttta

SEQ ID NO: 1454 - DNA, 1443 bp, Gossypium hirsutum
aaaaaaaaagcctctttcctttctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccctggttctgactccccgaaggttgccccagaggttattgctgagtacactgtccgtgccttgcagcgtaccgtccctgctgcagttcccgctattgtgttcttgtctggtgggcaaagtgaggaggaggctacccttaaccttaatgccatgaacaagctccagaccaagaaaccatggtcactctctttctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgatgcaaagattagtgagggtgctgcagagagccttcatgttaaggactacaaatactaagaatttagtcttgtggtctgtgtatcagagaaattttctgtattgatgatagacgtttagtgctgtttttgggggttgtccgtttcttctcatggaatttaggttgtgaaatcagactcaaataagcttggggggccttagttctcgctgagtgttcatggttttttgtttgcttcagtttaaaacaatattctcagcatatacaactgagtgtgctttgcactttttaatcgttttgcgtttcttgattcattaatcgtaatcctactatttgaggagctccagagccttcgaggaatggttgatggggccttgggag

SEQ ID NO: 1455 - DNA, 1443 bp, Gossypium hirsutum
aaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccccggttctgactccccgaaggttgccccagaggttattgctgagtacactgtccgtgccttgcagcgtaccgtccctgctgcagttcccgctattgtgttcttgtctggtgggcaaagtgaggaggaggctacccttaaccttaatgccatgaacaagctccagaccaagaaaccatggtcactctctttctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgatgcaaagattagtgagggtgctgcagagagccttcatgttaaggactacaaatactaagaatttagtcttgtggtctgtgtatcagagaaattttctgtattgatgatagacgtttagtgctgtttttgggggttgtccgtttcttctcatggaatttaggttgtgaaatcagactcaaataagcttggggggccttagttctcgctgagtgttcatggttttttgtttgcttcagtttaaaacaatattctcagcatatacaactgagtgtgctttgcactttttaatcgttttgcgtttcttgattcattaatcgtaatcctactatttgaggagctccagagccttcgaggaatggttgatggggccttgggag

SEQ ID NO: 1456 - DNA, 1376 bp, Cucurbita pepo
gacgagcttattgccaatgctgcctacattggaactcctggaaagggtattcttgctgctgatgaatcaactggcacaattggaaagcgttttgccagtatcaatgtcgagaatgttgaaacaaacagacgtgctcttcgtgaactccttttcactgctcctaatgctctccaatacctcagcggagtcattctctttgaagaaactctctaccagaagacctctgcaggcaagcctttcgttgatgttttgaaggaaggtggtgtactcccaggtattaaggttgacaagggcactgttgaacttgctggaaccaacggcgaaacgacaacccagggtcttgacggccttgcccaacgctgccagaagtattatgaagctggtgctcgttttgctaaatggcgtgctgtgctcaagattggtgctaacgaaccttcacagttggctatcaatgaaaatgccaacggattggccagatatgctatcatatgccaggagaacggtcttgtacccattgtagagcctgagatcttggttgatggttctcatgacatcaacaagtgcgctgatgtaactgaacgtgtccttgctgcatgctacaaggctttaaatgaccaccatgttctccttgaaggaaccttgttgaagcccaacatggttacccctggatctcaatctgcaaaggttgcacctgaagttgttgcagagtacaccgtgcgtgccctacagcgtacagttcctgctgcagtccctgctgtggtgttcctgtctggtggacagagcgaagaggaggccaccgtcaaccttaacgccatgaacaaactcaagggtaagaagccatggtctctttccttctcctttggacgagccctgcagcagagtactctgaaggcatggtccggaaaggaagagaacatccccaaagctcaggctgctttactagtaaggtgcaaggccaactctgaagctactcttggaacttacaagggtgatgccaagatcagcgagggtgcctcggagagcctccacgttgacaactacagctattgattagttttgggagtgctcttgtttttagacccaaaaagagataagctgcggcattttgtatttggattctcaggcttcatatatggctctctttctaatcccaccgctaacatcaggttacgccagacgttggtaataataagcttgaggagagtgtttgcatgtgaggttttgcaagtctattttgttaacatttcagttgaagaaccgaatatttcgtgttttctgttgtaattttgatgtttgtcatcggttaataacaacattcgtgatgggagttttgtgttagagaatttttagtctgagtcaattttgcttatgctacc

SEQ ID NO: 1457 - DNA, 1337 bp, Silene vulgaris
aaattcaacctaagaatcttcaccatgactgcttacagaggcaaatacgctgatgagttgattgccaatgctgcatacattgcaacccctggaaagggtattcttgcagctgatgagtctactggtaccattggcaagcgatttgctggcattaatgtcgagaatgttgagaataacaggagggccctccgtgagcttcttttcaccacccctggtgccttcgagtacctcagtggtgtcatcctttttgaggaaactctctaccagaaatctgctgctggtaagccatttgtagagatcttgaaggaaggcggtgttctccctggtatcaaggttgacaagggtgttgttgagcttgctggaaccgatggtgagaccaccacccagggtcttgatgaccttggcaaacgatgtgcccagtactattctgctggtgccaggtttgccaagtggcgtgctgtccttaagattggcccaaccgagccatctgccctctcaatcttggaaaatgccaatggccttgctcgctacgccatcatctgccaggagaatgggttggtcccaattgttgagcccgagatcttggttgatggttcccacgacattgacaggtgtgctgaagtctcagagcgtgtccttgcagcttgctacaaggccctcaacgaccaccatgtcctacttgagggtaccttgttaaagccaaacatggtcacccctggctctgacagcaagaaagttgccaacgaggtcattgctgagtacactgtccgcaccttgcagaggaccgtcccaccagcagttcccggcatcatgttcctttcaggaggacagagtgaggaggaggcaactctcaacctcaacgccatgaacaagcttgagaccaagaagccatggacactatccttctcctacggacgtgcccttcagtcaagtaccctcaagacatggcagggaaaagaagagaatgtcggaaaggcccaagaagtcttccttgctagagccaagggtaactctgaggcaactcttggaaagtacactggtggtgctggtggagctgacgcctcggagtctcttcacgttaaggactacaagtactaattatagtttcgaatccatcattgaggtgtgaagtttttacttcgagagaaataccatcaaaattcatagaatcggtgtgtgatagaccggcaatatgcctgctgtcttgttttttgtttattttgttaggtttgttgacttgctaataatttgctttgaggacgtattgtttttgagacttggagaagagtactcaacctaaatactattgtggcattgtgttttgcactcaatatttc

SEQ ID NO: 1458 - DNA, 1595 bp, Artemisia annua
cgtgtctctaccgaggggataaaaaaggaaattaaaacaagagcgtgatttccgatctttcaacaagccagccagccagccaccctctcttttcttatatataaacccccttaaacctaacaccattcctctcatattctcctcctcctctttcaatacaacaaacttctctctttttcttataaactttattattattaatcatgtcttgctacaagggaaagtacgctgatgagcttattgccaatgctgcctacattggtacacccggaaagggtattcttgctgctgatgagtccactggcaccatcggaaagcgttttgacagcatcaaggttgagaacgttgaatcaaacaggagagctctccgtgagcttcttttctgcactcccggtgccctcgactaccttagtggtatcatcctttttgaggaaactctataccagaagaccgcttcaggtaagccctttgttgatgtgatgaaggaggctaatgtccttcccggaatcaaggttgacaagggtaccgtcgagcttgctggaaccaatggtgagaccaccacccaaggtcttgatggtcttggtgctcgatgtgcccaatactatgctgctggtgctaggttcgccaagtggcgtgccgtccttaagattggtgccaacgagccttcccagcttgccatcaatgaaaatgccaatggattggcccgatatgccataatctgccaagaaaacggtttggtaccaattgttgagcccgagatccttgttgacggacctcatgacatcaacaagtgtgctgatgtgactgaacgtgtcttggctgcttgctacaaggctcttaatgaccaccacgtgcttctagagggtacccttttgaagcctaacatggtcacacctggatctgatgccaagaaggttgccccagaagttgtggctgagtacactgtccgtgctcttcaacgaaccatgcctcctgcagtccccgctgtcgtctttttgtctggtggtcagagtgaggaagaggctaccgttcatctcaatgccatgaaccagttgaagggaaagaagccatggaccctaaccttctcttttggacgtgctctacaacagagtaccctcaaggcatgggctggaaaggaagagaatgtgaagaaggctcaggaggtcttccttattaggtgcaaggccaactctgaggcaaccctcgggaaatacactggtggtgctgctgttgagggtgccactgagtcactccatgttaaggactacaagtactgatcaatttggtaattacttcactgtgttccgtgttttgtgaaggacatgacttattatttttttgtctgcaaaaattggggtgttttacacctcgggcatactcttagatttgtgtttttgttttctaatcttggtctagtctttagtaacgggctaagaataagctcgaaaacttcgagcattggttgaggttgtttatactttgaaccattttaaagttttatttttgaagttttatatcttgtgcatttcgttattgctttcatatgttgttgtacaatgaacagtgaatgtcaaatgcagagggcatggtgacat

SEQ ID NO: 1459 - DNA, 1472 bp, Brassica oleracea
ccaccacacctaccttcatcctcccttctctctacactttctcgatctttccgtctaaaaccatgtctgccttcaccagcaaattcgccgatgagttgatcgctaacgccgcctacatcggcacacccggaaagggtattctcgccgccgatgagtccaccggaaccatcggaaagcgtcttgcaagcatcaacgtcgagaacgttgagaccaacagacgtgctctccgtgagcttctcttcaccgcccctggtgcactcccttgcctcagcggtgtcatcctcttcgaggaaactctttaccaaaagagctccgatggcaagcttttcgttgacatcttgaaggaaggaggagtactcccaggtatcaaagtcgacaagggtaccgtcgagctagccggaaccaacggcgagaccaccactcagggtcttgacggcctcggtgagcgttgcaagaagtactacgaagctggtgcacgtttcgccaagtggcgtgcggttctcaagatcggcgagaacgagccatcagagctttccatccacgagaacgcttacgggttggctagatacgctgttatctgccaggagaacggtcttgtacccatcgtcgagcctgagattctagtcgacggttcccatgacatccacaagtgtgctgctgtgaccgagcgtgtcctcgcggcatgctacaaggctcttagcgaccaccatgttttactcgagggaactctcttgaagcctaacatggttaccccaggatccgacagtgctaaggttgcaccggaggtgatcgctgagcacaccgtgcgcgcccttcagagaacggtcccagcggctgttccagctatcgtgttcttgtctggaggacagagcgaggaggaggcgaccaagaacctgaacgcgatgaaccagttgaagaccaagaagccgtggtcgttgtctttctcgttcggacgtgcgttgcaacagagcactttgaagacatgggcaggtaaagaggagaatgttaaggctgctcaagaggccttgtatgtgaggtgcaaggctaactctgaagccactcttggaacttacaaaggtgatgctaagcttggtgatggagccgcagagagccttcacgtcaaggactacaagtactgagaatcgtctttcatggtttctgggttgtgacgtaatcatcaccttcaatatatttctaagggtttttactttgacatttcggctttttttctacagtttttcctttggatttgtgtttttatttttgttgggttgttatatttagaactgagagtttgaaaaaacgcccaaataagaaagccatttgaggttatttctgttgaacttcttctcacacacttgtttttattatgtaagaacagcttttgttgttctacttattagagactaatctattgtctctggttctgatttctgaatatttatgttcaaaacgtctgcgtttttgttctt

SEQ ID NO: 1460 - DNA, 1469 bp, Brassica rapa
  misc_feature (1406)..(1406): n is a, c, g, or t
ctctacactccctcgatctttccgacaaaaaccatgtctgccttcaccagcaaattcgccgatgagttgatcgctaacgccgcatacatcggcacacctggaaagggtattctcgccgccgatgagtccaccggaaccatcgggaagcgtctcgcaagcatcaacgtcgagaacgttgagaccaacagacgtgctctccgtgagcttctcttcaccgcccctggtgctctcccttgcctcagcggtgtcatcctcttcgaggaaactctttaccaaaagagctccgatggcaagcttttcgttgatatcttgaaggaaggaggagttctcccaggtatcaaagtcgacaagggtacagtcgagttagccggaaccaacggcgagaccaccactcagggtcttgacggtctcggtgagcgttgcaagaagtactacgaagctggtgcacgtttcgccaagtggcgtgcggttctcaagatcggcgagaacgagccatcagagctttccatccacgagaacgcttacgggttggctaggtacgctgttatctgccaggagaacggtcttgtacccatcgtcgagcctgagattctagtcgacggttcccatgacatccacaagtgcgctgccgtcaccgagcgtgtcctcgcggcttgctacaaggctcttagcgaccaccacgtcttgctcgagggaactttgttgaagcctaacatggttacacctggatccgacagtgctaaggttgcgccagaggtgatcgctgagcatacggttcgtgctcttcagagaacggtcccagcggctgttccagctattgtgttcttgtctggaggacagagcgaggaggaggcgaccaagaacttgaacgcgatgaaccagttgaagaccaagaagccgtggtcgttgtctttctcgttcggacgtgcgttgcaacagagcactttgaagacatggggaggtaaagaggagaatgtcaaggccgctcaagaggccttgtatgtgaggtgcaaggctaactctgaagccactcttggaacttacaaaggtgatgctaagcttggtgatggagccgcagagagccttcacgtcaaggattacaagtactgagaatcctcgttcatggtttctgtgacgttatcatcaccctcgatatatttccaagggtttttactatgacatttcggctttttttctacagtttccttttggatttgtgtttttatttttgttgggttgttatgtttagaacttgagagtttgaaaaacgccaaaataagaaaaagcctttcgaggttatttctgttgaacttcttctcatactcctgtttttattatgtaagaacagcttttgttgttctgcttattaaagactaatctattgtctctggttctgatttctgaanatttgtgtccaaaacgtctgcggtttaggtcccttttaattttgtaatttcaaaacctcgtgc

SEQ ID NO: 1461 - DNA, 1425 bp, Theobroma cacao
cggggacgctcagtttatttcttccctgtctctctgtttctttctcgctctccctttccaaacaaaactcttgcttacctcttcccctcagctttcctttcaaacatgtcttgcttcattagcaaatacgccgaggagcttgctaaaaatgctgcctacattggcacccctggaaagggtatccttgctgctgatgaatctaccggcacaatcggcaagcgtctttcaagcattaatgtagaaaatgttgaagacaacaggcgtgctctccgtgagctccttttcaccactcccggtgctcttcagtacctcagtggtgttattctctttgaggaaaccctctaccaaaaagcctcttctggcaagccttttgttgaaatcttgaaggaaggtggagtccttcctggcatcaaggtcgacaagggtaccgttgagcttaacggaaccaatggtgagacattcacccagggtcttgatggccttgcccagcgttgccagaagtattatgaagctggtgctcgctttgctaaatggcgtgctgtgctcaagattgccgttaacgagccaactgaacttgctatccaagaaaatgccaatggtctggccatgtatgctgccatctgccagcagtgtggcctcgtccccattgtcgaacctgaaatccttgttgatgggccacatgatattaaaaagtgtgctgaggtgacagagcgtgtactcgccgcttgctacaaggctctgaatgaccaccatgtcatgcttgagggtacactgttgaagcctaacatggtcacccctggttctgagtccccaaaagttgctccagaggttattgccgagtacactgtccgtgccctgcagcgaactgtccctgctgctgtccctgctattgtattcttgtctggtggacagagtgaggaggaggctacccttaacttgaatgccatgaacaagctcaagaccaagaagccatggtcactctcattctcatttggacgtgcccttcaacagagcactctcaaggcttgggctggaaaggaggagaatgtgaagaaggcacaagctgctctccttgttaggtgcaaggctaactccgaggccactcttggtacctacaagggtgatgcacagcttggtgagggtgccgcagagagcctccatgtcaaggactacaaatactaagaatttagggttgtggtctattatgtcatatgttttgcagagtaaattgcggtatggatagtaggcttttagggctttttgtctttttgatttctgtcgcaactcatcgaatttaggggtgaaaatcagactaataagcatggggagccttgtgctcgttgagtgttgatggtttttgtttatttaagtttaaaacaaaattctctgcgtttataatggagttgatgaccgcattttggcaca

SEQ ID NO: 1462 - DNA, 1531 bp, Brassica napus
ccaggtcacggatcacaagctgatatcgaattcgatcggcattactggcggggacacaccatcctctttctctctacactccctcgatctttccgacaaaaaccatgtctgccttcaccagcaaattcgccgatgagttgatcgctaacgccgcatacatcggcacacccggaaagggtattctcgccgccgatgagtccaccggaaccatcgggaagcgtctcgcaagcatcaacgtagaaaacgttgagaccaacagacgtgctctccgtgagcttctcttcaccgcccctggtgctctcccttgcctcagcggtgtcatcctcttcgaggaaactctttaccaaaagagctccgatggcaagcttttcgttgatatcttgaaggaaggaggagtactcccaggtatcaaagtcgacaagggtaccgtcgagctagccggaaccaacggcgagaccaccacccagggtcttgacggtctcggtgagcgttgcaagaagtactacgaagctggtgcacgtttcgccaagtggcgtgcggttctcaagatcggcgagaacgagccatcagagctttccatccacgagaacgcttacgggttggctaggtacgctgttatctgccaggagaacggtcttgtacccatcgtcgagcctgagattctagtcgacggttcccatgacatccacaagtgcgctgccgtcaccgagcgtgtcctcgcggcttgctacaaggctcttagcgaccaccatgttttgcttgagggaactttgttgaagcctaacatggttacacctggatccgacagtgctaaggttgcgccagaggtgatcgctgagcatacggttcgtgctcttcagagaacggtcccagcggctgttccagctattgtgttcttgtctggaggacagagcgaggaggaggcgaccaagaacttgaacgcgatgaaccagttgaagaccaagaagccgtggtcgttgtctttctcgttcggacgtgcgttgcaacagagcactttgaagacatgggcaggtaaagaggagaatgttaaggcagctcaagaggccttgtatgtgaggtgcaaggctaactctgaagccactcttggaacttacaaaggtgatgctaagcttggtgatggagctgcagagagccttcacgtcaaggattacaagtactgagaatcctcgttcatggtttcggggttgtgacgttatcatcaccctcgatatatttctaagggtttttactttgacatttcggcttttttttctacagtttgctttggatttgtgtttttatttttgttgggttgttatatttagaacttgagagtttgaaaaacgcccaaataagaagccatttctgttgaacttcttctcacacttgtttttattatgtaaggacagcttttgttgttctgcttattaaagactaatctattgtctctggttctgtttattccaaaaagaaaaaaacctcgaggggggcccgacccacgttgcggatgcaaacaacactaaactcgaac

SEQ ID NO: 1463 - DNA, 1433 bp, Brassica napus
ggaccacacctaccttcatcctcctttctctctacactttctcgatctttccgtctaaaaccatgtctgccttcaccagcaaattcgccgatgagttgatcgctaacgccgcctacatcggcacacccggaaagggtattctcgccgccgatgagtccaccggaaccatcggaaagcgtcttgcaagcatcaacgtcgagaacgttgagaccaacagacgtgctctccgtgagcttctcttcaccgcccctggtgctctcccttgcctcagcggtgtcatcctcttcgaggaaactctttaccaaaagagctccgatggcaagcttttcgttgacatcttgaaggaaggaggagtactcccaggtatcaaagtcgacaagggtaccgtcgagctagccggaaccaacggcgagaccaccactcagggtcttgacggcctcggtgagcgttgcaagaagtactacgaagctggtgcacgtttcgccaagtggcgtgcggttctcaagatcggcgagaacgagccatcagagctttccatccacgagaacgcttacgggttggctaggtacgctgttatctgccaggagaacggtcttgtacccatcgtcgagcctgagattctagtcgacggttcccatgacatccacaagtgtgctgctgtgaccgagcgtgtcctcgcggcatgctacaaggctcttagcgaccaccatgttttactcgagggaactctcttgaagcctaacatggttactccaggatccgacagtgctaaggttgcaccggaggtgatcgctgagcacaccgtgcgcgcccttcagagaacggtcccagcggctgttccagctatcgtgttcttgtctggaggacagagcgaggaggaggcgaccaagaacctgaacgcgatgaaccagttgaagaccaagaagccgtggtcgttgtctttctcgttcggacgtgcgttgcaacagagcactttgaagacatgggcaggtaaagaggagaatgttaaggctgctcaagaggccttgtatgtgaggtgcaaggctaactctgaagccactcttggaacttacaaaggtgatgctaagcttggtgatggagccgcagagagccttcacgtaaaggactacaagtactgagaatcgtctttcatggtttctgggttgtgacgtaatcatcaccttcaatatatttctaagggtttttactttgacatttcggctttttttctacagtttcctttggatttgtgtttttatttttgttgggttgttatatttagaactgagagtttgaaaaaacgcccaaataagaaaagcctttcgaggttatttctgttgaacttcttctcacacacttgtttttattatgtaagaacagcttttgttgttctgcttattaaagactaatctattgtctctggttctgatttc

SEQ ID NO: 1464 - DNA, 1091 bp, Manihot esculenta
aacaatcatgtcttgctttaagggaaagtaccatgatgaactgattgccaatgctgcttacattggaacccctggaaagggaatccttgcagcagatgaatcaactggcacaataggcaagcgtttagctagcatcaatgttgagaatgttgagtccaataggcgagcttatcgcgagctcctcttttgtgcgcctggagtccttcaattcctcagtggtgtgatcctttttgaggaaacactttaccagaaaacaactgatggtaagctctttgttgacattctcaagggaggcggagttcttccaggaatcaaagttgataaaggcattgttgagcttcctggaaccaatggtgaaacttcaactcttggtcttgatggcctagctgagcgctgccagaaatattatgaagctggtgctcgatttgctaaatggcgagctgtgctaaaaattggtccaactgaaccatctcagcttgctatcagtgagaatgccaatggcttggcacgttacgccattatctgccaggaaaatggcttagtacctatcgtcgagccggagattttagtcgatggatctcacgatattaatcgctgtgctgatgtgactgagcgtgttcttgcagcttgctacaaagctctaaatgataaccatgtgctgcttgaaggaacacttttgaagccaaacatggtgacccctggctcagatagtgcaaaggtgaaacctgaggtggtggctgagtacacagtcagggctttacagcggacagttcctcctgctgttcctgctattgtgttcctttccggcggacagagcgaggaggaagccaccatcaatttgaatgcaatgaacaaactcaaatgcaaaacaccatggtcacttacattctcttttggccgtgctcttcagcagagtactctcaaggcatgggctggaaaggaggaaaatgtgaagccggcccaggctgctttacatgtaagatgcaaagcgaattcagaagctactttaggttcctacaaaggtgatgctacgttgggagaaggtgctgcagagagtcttcatgtgaaggattacaaatactaaatcattt

SEQ ID NO: 1465 - DNA, 1517 bp, Cichorium intybus
ggccaaagcccaaatatcgagaaggaatgaaaaccgcgctttgagaccggttctacaaaacagccaacaacaaaagaaaagagcgacatttccgatctccacctctttaaatataaaccctaaaccttcacactttcgtatcatttcctctctcttctcctttcaccaaaaacctcccaacatttcaaatctcgcgatcatgtcttgctacaagggaaagtacgctgatgagcttattgccaacgctgcctacattggtacccccggcaagggtattctcgccgccgatgagtccaccggcacaatcggaaagcgtctgtcaagcatcaacaccgagaacaacgaaacaaacagaagagcactccgtgaactcctcttctgcactcccggcgccctccaatacctcagcggaatcatcctcttcgaagaaactctctaccaaaaaaccgcagcaggcaaaccattcgtcgagatcatgaaagaagccaaagtcctccccggaatcaaagtcgacaagggcaccgtcgaactcgccggaaccaacggcgaaaccaccacccaaggtctcgacggcctcggccaacgatgcgcccagtactacgccgccggcgcccgcttcgcaaaatggcgcgccgttctcaaaatcggcccaaacgaaccttcccaactcgccatcaacgaaaacgcaaacggattagccaggtacgcaatcatctgccaagaaaacggtctagtcccaatcgtcgaaccagaaatcctcgtcgacgggacccacgacatcaacaaatgcgctgacgtcaccgaacgtgtcctcgccgcctgctacaaagccctcaacgaccaccacgttcttctagaaggtactctcctaaaacccaacatggtcacccccggatccgactccaagaaggtctcaccggaagttgtggcggagtacaccgtcagagctcttcaacgcaccatgccatgtgctgttccggcggtcgtcttcctctccggcggccagagcgaggaggaggccaccgtgaacctcaacgctatgaaccagtacacaggaaagaagccatggagtttgacattttcattcgggcgtgctttacaacagagcacgttgaaagcgtggggtggaaaagaagagaatgtgaaaaaggcacaagaggcgtttcttgcaaggtgtaaggcaaattccgaagctacccttgggaagtataagggcggtgcggcttttgaaggggcttctgagagtcttcatgttaaggactataagtactagaaagggcttattggtaattaactaattgtgtcttttgtttgtgtttttaatgttttgtgaagaacatgggagtttttttttgtttgtaagatagggtgttgttatatgcccttgggatactttttaggtttatgtttttggttttttaatattggtctaagcgatggctaaaataagcttgaaaaatgtctggcattttgttgaggctgttaatggtatttgaaccgttttgaattttttctct

SEQ ID NO: 1466 - DNA, 1383 bp, Ipomoea batatas
ctactcaccaacctctctctctctttcaactcgccttcgatctctctagtattctacacaaaacagccgccatgtcgtgctacagaggaaaatacgccgatgagctcattgccaatgctgcttatattggtacccctggaaagggtattcttgctgctgatgaatcaactggcacaattggcaagcgttttgctagcatcaatgttgagaatgttgagacaaacaggagggctctccgtgagctgcttttcactacccctggtgcactcaagtacctcagtggagttatcttgttcgaggaaactctttaccagaagactgcttctggcaagccctttgttgaagtcatgaaggagggtggagtgcttcccggaatcaaggttgacaagggtgttgttgagcttcctggaaccaatggtgagacaaccacccagggtcttgatggccttgctgagcgctgcaagaagtactacgaggctggtgctaggtttgctaaatggcgtgctgtgctcaagattggagcaactgagccatctcagcttgccatcaatgagaatgccaatggtcttgctcgttatgccatcatctgccagcagaatggtcttgtgcccatcgttgagcccgagattcttgttgatggacctcatgacattgacaaatgtgctgatgtaaccgagcgtgttcttgctgcttgctacaaggccctcaacgaccaccatgtcctccttgagggtaccttgttgaagcccaacatggtcactcccggttctgagtgtgccaaggtttcagcagaggtgattgctgagtacaccgtgcgggccctgcagcgcaccatgcctgcagctgtacctgctgtggtgttcttgtctggtgggcagagtgaggaggaggctaccgtcaaccttaatgcaatgaacaagctgaagactaagaagccatggaacctctctttctcctttggacgtgctcttcaggctagcaccctcaagatttggggtggaaaagaggaaaatgtcaaggcagctcaggctaacttcctggaaaggtgcaaagccaactctgaggcaactcttggtacatatgcaggatctgctaacatcagtgctgctgcatctgagagccttcatgtgaaggactacaagtactaagcaaggttttgtatttttgtttcattttctggttttgagtaagaggaactgcagtatgttttgtggagacaatgtttaactattgcagggagctatttagtttttatgtttatcttccaaagcactgttcacaccccggttggtcgaataatgtttgctagtcaaattgacttttgtggattaagtgattggtttcatcaaggttttcttaatacttttgcttcttaaatttgtg

SEQ ID NO: 1467 - DNA, 1425 bp, Lactuca sativa
ctcggcggggatcactcccatttttccaattttctctaaatcttcgtttcttagatctcaaatctcgcaaccatgtcttgctacagaggaaagtatgctgatgaactcattgccaatgctgcctacatcggaacccctggaaaaggtatcctcgctgctgatgaatcaaccggtacaatcggaaagcgtctatccagcatcaatgttgagaacgtcgaatcaaacagaagagcacttcgtgaactcctcttctgcactcccggcgcccttcaatacctcagtggagtcatcctctacgaagaaactctttaccaaaaaaccgcagcaggcaaaccatttgtggatgtgatgaaggaagccggagtcctcccaggaatcaaagtcgacaagggcacagtcgagctagccggaaccgacggtgaaaccaccacccaaggactcgacggtctagcccaacggtgcgcccagtactacaccgcgggtgcccggttcgccaaatggcgtgcggttctcaaaatcggcccaaacgagccctcacagctcgcgataaacgaaaacgcaaacggtttagcgcgatacgcgatcatctgccaagaaaacggtttggtcccaattgtggagcccgagattcttgtggacgggtcccacgacatcaacaaatgcgcggatataactgagcgcgtattggctgcatgctacaaggctttgaatgaccataaggtgcttcttgaaggaactcttttgaaacctaacatggtgacacctggatcggatgcgaagaaggtggcaccggaggtggtggcggagtacacagttagggctttgcagaggacgatgccgccagcggttccggcggtggtgtttttgtctggtgggcagagtgaggaggaggcgacggttaatctgaacgcgatgaatcagttcaaggggaagaagccgtggactttgactttttcctttgggcgtgctcttcagcagagtactttgaaggcgtggagtgggaaagaggagaatgttgggaaagctcaggctgcgtttttggcaaggtgtaaggctaactctgaagctactcttgggatttacaagggtgggtctgggttgagtgaaggtgcttctgagagtcttcatgttaaggactacaagtactaaatactaaggtttgtttcttgtttcttgtttctattctcgggaattcttgtctcatttgtgttttgatttgaggattttgtgttatgttttgaacttgtggtggtggttataataagcatgagaaacatctgcctattcaggttttggttaatatattttacggtttaggttttcatgagtaatgtttattaattttcgactaaccagttatattattttaagatatttttattccaacttttatgaaagagcgatgaaagtagtatcttggtttta

SEQ ID NO: 1468 - DNA, 4076 bp, Pennisetum glaucum
ctctcccgatctctccaccacctcagtgacgacgacctccttctccagccaaaccagcctccccccaatctccctccccctcgcaatccccgaagccttctcccccccgcgaccagcgaccatgtcggcctactgcggcaagtacaaggatgaagaacgctgcctacattggcacccctggcaagggtgatgagtccactggcaccattggcaagcgtctctcaagcatcaacgttgagaacatcgaggagaaccgtcgtgccctccgtgagctcccctggtgccctcccgtgcctgagtggtgtgattctctttgaggagaccctgtaccagaagaccaaggatggcaagcccttcgtcgatgtcctcaaggagggaggacaagggcaccattgagatcgctggcacagacaaggagaccaccacccagggccatgatgaccttggcaagcgctgcgccaagtactacgaggctggtgcccgcttcgccaagtggcgtgctgtcctcaagatcggccccaatgagccgtcgcagcttgccattgacctcaatgctcagggtcttgctcgttatgccatcatctgccaggagaatggtctcgtgccgattgtggagcctgagatccttgtcgatggccctcatgacattgagcgctgtgcttatgtctctgaggtggtccttgctgcctgctacaaggctctcaacgagcaccatgtcctccttgagggtaccctcctgaagcccaacatggtgacccctggatctgactaggtgactcctgaggtcattgctgagtacaccgtccgcaccctccagaggaccgtccctgctgccgtgcctgccattgtcttcctctcaggtggacagagtgaggaggaggccaccctgaacttgaacgccatgaacaagctcaacaccaagaagccgtggtccctgtccttctctttcggccgtgccctccaggcgagcaccctcaaggcctgggctggcaaggaggagaacattgagaaggctagggcggcattcctcgccaggtgcaaggccaactctgaggctacccttggcacatacaaaggtgacgccgccgctggtgagggtgtctctgagagcctccacgtgaaggactacaagtactgattcgtttaccctttcggacctggctgcctacaacaggcatttaggttgatgagtgtggtttgctatatccgggcatcaaacctgaactataagcttcccttttgtggatgatggttcgttaccttatttttcgtatatttttaagtagtttccgttggtgttaatctcgtgtaattggttctgccgatggagaatcgtgcagcctcattttgtttatctttgctgtaatgctggttatatgtcggcaaaaccattctatatgctgagttggtcgggcgcaggccttttgctctgaagaaaaaaaaatcactaatctcagcactttctacatagatatagatacacaccacatgatacatgtcaattgtcaaatatcattggtaaagactatagcacatacacagcagcaggataggggaaaatgtactttttgcaacaagtattttcttgccaaaggcaacgtgtagaactgaactcctatattttgcattggcataagttaaacaggtgttgaacacagtttcaaaggcgtcgccagcgtccaggcggtacttgctggccttggaaaaccgcccgccttatcgcctaggcaaaatgataacgtgtgcccagattttcaagggcgccttatcacctttgaaatcatggtgttgaatgaatgaactgtacttgtatactttctttctagaaaactatacttctagtatctctaatggtatatggtaatatcttcctttctttttgtttcctactcaatttgtaaagcatctacaagctgatccttgccatatgtacagctgattgagtaactttgtgtgagagaaattaatggaaaacctgcggtgatgtgtaatactcactttcactgaaatatggtctcaagtcctcttggcacatgaaatccaaaggaaaagaaacaagatggccccttactaactgtaatctgtccataggatcagtacctttgagattgccatcttggtaagcttctagtttctcttgagcaatgcccaaatcaattgtggtgtggccagttttgtccctcaagtgagcaaagctttgccgaaattgggcccttgagtggatgagatcgttgggtacgcaagagaagacatcttggtatatcatggtatttgtcttagcagtggccatccagatatttttaaacgtggaatcatctataggatccatgatgtggctaacctctcctggatgaaggccaaggtgctccgcccaaagagatagacgtaggcttagggaaaatttcccaccttcccaaggtcttccatccattttagaattaacaacttctttatcttcaatgaccacagcaatctcagaatctcttgatccaagcaaacttctatcgtttatgttagctgaaccaatcaatgtaatgcggtcatcaattatcattaacttgctatgtacataaatctgactggtgaccaagggacccctatcacacagtttgccatgtgctctaagaccataaaaggagatgtaatcatgtgctttaggtccaataacatcaaatagattctgaagaattgaattagggcctctgcagatagtacgatattgccagtgcatgattgccctcactgatgcagctccaccatcatcaatgcctccctgaaaaccaggtagaagaggaatgatgatgatggccttaaagcgcttttctctctctcagctcgaagtatacgccgatacaatgcttctaatacacggtttttaatagtatcatcccctgacaggcctgatatgaaaaactgattctcaatgtatacaaagtgttctgccttttcaatcagagaaagtaggcattgtggatgcttccttcaatttgaatggttccagctgaccattgaccaacactcctaacaacctgacaacgacaagttgcccttggaccaacttgtccaatgtcaagtactgaagcaatttgatcgcctcgctcctgcttttcccaccatttcttgtccttgtgattcctatcgtcttttgatgaatcaaagcgcctaatagatgatgcctcaagggaactgagattgtccacaaaacttctcataggtaaatcctgatttgaaaaatccagttttgcctttcggttgagcaaaggctgactaaagctctttttgtttacgcgacctgaattgttaatttctaaatcagtcaatcttaaatctgcacttgacaattcctgaggttctagttcttgaggtaaaagcaatggaacatcctgagatgatgtgcgtgatgtcaagactggatttttatcaacatccctatcatgatactgtttaccctcagcctcatcattagtttctttgcttctacctttgtagtgcggaattaccatgtgatgatgaggcatcagtaatggaatagcttgctcatttagagctttattcctctttgcataattccagcgctgaacaaatgcctcgctacatcacggcaaggtggaccatagagagcacactgaacatcatgccaaggcatgcggggatatttagcacggtccagttcatctttcatagtgtcctcccaagaattgggctcagattcccttggattgtagtagtccttccctggccacatcacaggaggagaatctgtgactttgtgcccaggactatcgtagcgaccaaagcatagatcaagacctccaatataacatacttgattatcaacaattacaatcttctcgtggtgtgaccacaagtatactccacttgagaaatgatcagggtaacgcagaactttgacattttcatgaatgttaagtagcctttgcttactgtataagctattaattttcaatgcaagagcaacttccttgtacaatagaacgtaaatctgtacaccctgcttagctcttgcttccagtagagcgtcaagcctggatgacccatgattttggaacgggcgt

SEQ ID NO: 1469 - DNA, 1396 bp, Solanum lycopersicum
atatgccgtattataaaagcctaactttctcttccatttttctcattctctctataaacttctctcactttcttcaaatctaagcttattaatcatgtcttgctacaagggaaagtatgctgatgagcttattaagaatgctacatacattggtacccctggaaagggtatccttgctgctgatgaatctactggaaccattggaaagcgtctctcgagcatcaatgtcgagaatgtagaatcaaacaggagggctctccgtgagcttctcttttgcacccctggttgtcttcagtaccttagcggtgtgatcttgtttgaggagacactttaccagaagactgctgctggcaagcctttcgttgaagtcatgaaggaagctggagtccttcctggtattaaggttgacaagggtaccgttgaactccccgggaccgatggtgagaccaccactcaaggtcttgatggtctcgcagaacgttgccagaagtactacgaggctggtgctaggttcgccaaatggcgtgctgtgttgaagattggtgccaatgagccatctcagctcgccatcaatgataacgccaatggccttgccagatacgccattatttgccagcagaatggtcttgtacccattgttgagcccgagatccttgtcgatggagcccatgacattaaaaagtgcgctgatgttaccgagcgcgttcttgctgcttgctacaaggctctcaatgaccaccatgtcctccttgaaggtaccttgttgaagcctaacatggtcactcctggttctgaatctcccaaggttgcaccagaagtgatcgctgagtacaccgtccgtgctttgcaacgcacaatgccacccgctgttcccgctgtggtgttcctgtctggtggtcagagtgaagaggaagccaccgtcaacctcaacgccatgaacaagcttcaaaccaagaagccatggtcgctttccttttccttcggacgtgctcttcagcagagtaccctcaaggcatggggaggaaaagaagagaatgttcagaaagcacaagctgcattcctcaccaggtgcaaggccaactccgaggctacactcggaaagtacgccggagcttctaacttgagcgagggcgcgtccgagagccttcatgttaaggactacaagtactaagatcaacaaagtttttagttttatgttttctctttgaaaatgagaatgtgacaatatggttttacaaaaatgtcttatatgtggacataatgtgtaaggcttcttttttttttctataatttttcgtttaataaaaaacttatgagtaaacaatattggctttgtgacaatcttcatgtaacagtttttgggatatgatttattaaatggaatattatcttttgg

SEQ ID NO: 1470 - DNA, 2494 bp, Solanum lycopersicum
ttctcattctctctataaacttctctcactttcttcaaatctaagcttattaatcatgtcttgctacaagggaaagtatgctgatgagcttattaagaatgctacatacattggtacccctggaaagggtatccttgctgctgatgaatctactggaaccattggaaagcgtctctcgagcatcaatgtcgagaatgtagaatcaaacaggagggctctccgtgagcttctcttttgcacccctggttgtcttcagtaccttagcggtgtgatcttgtttgaggagacactttaccagaagactgctgctggcaagcctttcgttgaagtcatgaaggaagctggagtccttcctggtattaaggttgacaagggtaccgttgaactccccgggaccgatggtgagaccaccactcaaggtcttgatggtctcgcagaacgttgccagaagtactacgaggctggtgctaggttcgccaaatggcgtgctgtgttgaagattggtgccaatgagccatctcagctcgccatcaatgataacgccaatggccttgccagatacgccattatttgccagcagaatggtcttgtacccattgttgagcccgagatccttgtcgatggagcccatgacattaaaaagtgcgctgatgttaccgagcgcgttcttgctgcttgctacaaggctctcaatgaccaccatgtcctccttgaaggtaccttgttgaagcctaacatggtcactcctggttctgaatctcccaaggttgcaccagaagtgatcgctgagtacaccgtccgtgctttgcaacgcacaatgccacccgctgttcccgctgtggtgttcctgtctggtggtcagagtgaagaggaagccaccgtcaacctcaacgccatgaacaagcttcaaaccaagaagccatggtcgctttccttttccttcggacgtgctcttcagcagagtaccctcaaggcatggggaggaaaagaagagaatgttcagaaagcacaagctgcattcctcaccaggtgcaaggccaactccgaggctacactcggaaagtacgccggagcttctaacttgagcgagggcgcgtccgagagccttcatgttaaggactacaagtactaagatcaacaaagtttttagttttatgttttctctttgattatgagaatgtgacgatatggttttacaaaaatgtcttatatgtggacataatgtgtaaggcttcttttttttttctataatttttcgtttaataaaaaacttatgagtaaacaatattggctttgtgacaatcttcatgtaacagtttttgggatatgatttattaaatggaatattatcttttgggttttttaaacttatggtgtgtactttatatgattcttgattcattggtcccaattttttaatgtgaaatgtagttttctacatgtggggttgtttgtttgcatacattttaccaacttatctatcatgtgatatttgtggggttaggtgtaaagtttaaattcttttctaagtttttcttttcgttttctcttttgggttggtgttcttggtttgtcgcacaagatcgccgaaattatgagttttcaagtttaaattttaacgagataaggaattacgagggttatagttgaattttaaattaagaataatcacattagtcgtaacaaataccgagtatcgattaccagatcgtttatgataaacctatcgaatttcaaaacaaacaatatcacgtcaatcaatattcaacattcatagtgaagtgaagtgcgacgtaggtttacgtattgtgatgtatagtaaataaggattggtacgaaaaagagatagatcctctttttttcttaaattatcgggggcttgattgggctgctatttatacaaggcccatatttaaacttaaagtaacaaagcccatatatagtaaatccatttgtttaacacaggcccaacagccttatacaagaggaagaatgggtaaagcccaaatccatgtgaagttctaatttacaggaacttcagcaatgtatatcgttcgcgtcattagtttatcaacatgttcgaaatatacacaatatatacacttatataacttatacattaggtatacgcgttatacatattttgcaaattagataatcgaatgatttaaaacccgtaatatccagaaaaattgagttcttaattatttaatatgtttcaaatatgttgtttcactaatttataataaagtgtatctattttaggagctaaagtttgaaaaataatttttcgaaactaaaaaacatatatggttaataaacatatattggcctttcgaagatcttacacgagatttagaagtacacacaaaatattttagttacaacttttcttatatcaatacgatgataaatatagttaagtgtattattaataaaatcattttttgagtgaaatttaatttcattagaatatgtatatatatatatatat

SEQ ID NO: 1471 - DNA, 1578 bp, Triphysaria pusilla
ttcttggaggaggggtcgaagattaaggcgatattaccgatggtccaagacaacacaactacccgtcctcttatataaaagccacaccccaactcctttcttcatccattcacaaccaaccctacaatatcactctttttctcatacttttcttcttcactttctcatactactaatcatgtcttgctacaagggcaaatatgctgatgagcttattgctaatgccaaatacattggtacccctggaaagggtatccttgccgctgacgagtccaccggcacaattggcaagcgtctatctagcatcaatgtcgagaacgtcgagtcaaacaggcgggccctacgtgagctccttttcaccacccccggtgcccttcagtacctcagtggtgtcatcctctatgaggaaaccctataccagaagacagctgctggcaagccctttgttgatgtcatgaaggagggaggtgtccttcccggtatcaaggtcgactctggaacagtcgagctcgccggcacaaatggcgagaccaccacccaaggccttgatgggctcgcccagcggtgccagaagtactactctgctggagcccgttttgccaagtggagggctgtcctcaaaatcggccccaacgagccatctcagctcgccatcaacgagaatgccaacggccttgctcgttacgccatcatctgccaggagaatggtctagtccccattgtcgagcctgagatcctcgttgacgggacccacgacatcaacaagtgcgctgatgtcaccgagcgcgttcttgctgcctgctacaaggccctcaacgaccaccacgttctcctcgagggtacccttttgaagcccaacatggttaccccgggctctgactccgccaaggtcgcccctgaggttgtcgctgagtacactgttcgggccctgcaacgcacgatgcctcctgcagtcccagctgtggtgtttttatccggtgggcagagcgaggaagaggctacagtcaatcttaatgctatgaacaagctcaaggctaataagccatggagcctctctttctcgttcggacgtgctctccagcagagtaccctcaaggcttggggtggaaaggaagagaatgttggcaaggcacaggctgctttcttggcccgggccaaggctaactctgaagcgactcttgggacttacaagggtagcggcagtttgagcgagggtgcttctgagagcctccatgttaaggactacaagtactagattgtttaattataattggggctttacttttgttttatgattttggtattgcgtagaacacagttggctggtgatgcattcattttgtcaaggctttctgctgatttatgcctgtgtttttatttttgttttactagacttttattttaataaggttgaggaacatcatcttctcttcttttagaagattgggttgtgttttttgttatcatcggcttttttctgtgtgttttgtactgttttacaattgtttccctttgatgggcttgtcaaatttgttactatcagtatctcggaatatatgaatttgcagtctgtttttt

SEQ ID NO: 1472 - DNA, 1217 bp, Catharanthus roseus
ttagtttcaatccctagccatgtcgtgctacagaggacaatacgccgatgagctcattgccaatgctacatacatcggtacccctggaaagggtattcttgctgccgatgagtcaactggcactattggcaagcgtctggccagcatcaatgttgaaaatgttgagtcgaacaggagggccctccgtgagcttttgttcacaacacctggtgcccttcagtacctgagtggcgttatcctctttgaggaaactctttaccagaagacagctgatggcaagccatttgttgatgtcatgaaggaggctggagtcctccctggaattaaggttgataagggcactgttgagctccctggcacaaatggtgagaccaccactcagggtcttgatggccttgctcagagatgccaggaatactacaaggctggtgccaggttcgccaaatggcgtgctgttcttaaaattggccccaatgaaccatctcagcttgccatcaatgagaatgccaatggcttagctcgttatgcaattatctgccaacaaaatggtttggtcccaattgttgagcctgaaatcctcgttgatggttcacacgatattaacaaatgtgctgatgtaactgagcgtgttcttgctgcatgctacaaggcattgaatgaccaccatgttctccttgagggtacactgttgaagcccaacatggttaccccagggtccgactcccccaaagttgcacccgaggttattgctgaatacaccgtccgtgccttgcagcgcaccatgcctgctgcagtccctgctgtggtgttcctctcaggaggacaaagtgaagaggaggctactgtcaacctcaatgccatgaacaaacttcagaccaagaaaccatggtccctttcgttctcctttggacgtgccttgcagcagagcactcttaagacctgggctggtaaagaagaaaatagttcagaaggcacaggctgcattcctcaccaggtgcaaggctaactctgaagcaaccctaggaaagtatgcaggtggtgctgctggaggtgccgcagctgaaagcctccatgttaaggactacaagtactaagctcttggtatgcttcccgtttttgttattgttttggagagtacatgcagcaggttggggacaggaatgtttaccatcggatgtagaattttaaggatttggtttaattttgcctgatctatc

SEQ ID NO: 1473 - DNA, 1354 bp, Fagopyrum esculentum
taaaccccgcaaaaccctctctttcagatctcgcgtaaccgattattcttcgatcatgtctgcttacagaggcaaatacgctgatgagctcattgccaatgctgcttacattggtacacccggtaagggtatccttgcagctgacgagtctaccggaaccattggaaagcgtctttccagcatcaacgttgagaacgttgagaccaacaggagggctctccgtgaacttcttttcacaacccccggtgcttttgaatgcctcagcggagttatcctctttgaggagaccctctaccaaaagactgcctctggcaagcttttgttgatgttatgaaggaaggtggtgttcttccaggtattaaggttgacaagggtactgttgagttggctggtaccaatggtgaaacaacacccaaggtcttgatggacttgcccaacgttgccagaagtactacgatgctggtgctaggtttgcaaagtggcgtgctgtcctcaagatcggagagaacgagccatctcagctggcaatcaacgagaatgccaatggacttgccagatacgcaatcatatgccaggagaacggtttggtgcccattgttgagcctgagatcttggtagacggtcctcatgacattgaaaaatgcgctgatgtcacagaacgagttctagctgcttgctacaaggccttgaatgaccaccatgtcctcttagaaggaactttgttgaaacccaacatggttaccccaggatccgaaagcaagaaggtgtcacctcaagtaattgcagagtacactgtccgtgctttgcagaggacggtcccacctgcagtgccagccatcgtgttcttgtccggtggacagagtgaggagcaggctaccgtaaacctagatgccatgaacaggctccagacgaagaagccatggtctctttcattctcgttcggacgtgctctccaacagagcactctcaaggcttggtccggtaaagaagagaatgtcctgaaggctcaggaggtattccttgttagatgcaaggccaactctgatgctactcttggtaagtatgagggtggagctgctgttgagggtgccactgagtctcttcatgtcaaggactacaagtactaagcaagttttgtttatttcttatcctactatttggttttggaatgttagttcaatttgcgctggatgattctaggtgttgttctttctgaaataagcctacttggaaaatcaaaattgtatgattaatgttatcatagttttggcagtcttctaagtttctattttaacactggtgtgatagcctgatagtaggtcttttagtgtacattgggctttttagtgttgtt

SEQ ID NO: 1474 - DNA, 1311 bp, Taraxacum officinale
acggtccggaattccgggatcctaatttctctctgaattttgtgttagatctcaaatatcgcagtcatgtcttgctacagaggaaagtatgctgatgaacttattgccaacgctgcctacatcggaacccccggaaagggtattctcgctgctgatgagtcaaccggcacaatcggaaagcgtctatccagcatcaatgtcgagaacatcgagtcaaacagaagagcactccgtgaactcctcttctgcactcccggtgcccttcaatacctcagtggtgtcatcctcttcgaagaaactctctaccaaaaaaccgccgcaggcaaaccattcgtggatgtgatgaaggaggcaggagtccttcccggaatcaaagtcgacaagggcacagtcgagctagccggaaccgacggcgaaaccacaacccaagggctcgacggtctagcccaacggtgcgcccagtactacaccgcaggcgcccggttcgcgaaatggcgcgcggttctcaaaatcggcccaaacgagccctcacagctcgcgataaccgaaaacgcaaacggcctagccaggtacgcgatcatctgccaagaaaacggacttgtcccaatcgtggaacccgagatcctagtcgacgggtcccacgacatcgccaaatgcgctgatgtcactgaacgtgtactcgccgcatgctacaaagccctaaacgaccacaaagttctcctcgaaggcaccctgttgaaacccaacatggtcacccccggttccgactccaaaaggtcgcaccggaggtcgtggccgagtacacggtccgagccctgcaacggaccatgccgcccgcggttccagccgtcgtgtttttgtccggtgggcagagtgaggaagaggcgactgtgaatctaaacgccatgaaccagtacaaggggaagaagccgtggactttgactttttcatttgggcgtgctcttcagcagagtactttgaaggcgtggagtgggaaagaggagaatgtggagaaagctcaggcggcttttcttgcgaggtgtaaggctaactctgaggctactcttgggatttacaagggtgggtctgggttgagtgagggtgcttctgagagccttcacgttaaggattataagtattgaaaggtttgtaatttggtgtatttcttttcgggaattgttgtctgatttgtgttttgatttgagaattttgtgttttggtttttaagttgtggtgggtataataagcgtgagagacatctactgcctgttttgaggttttgcttatatttttatggtttaggttttcatg

SEQ ID NO: 1475 - DNA, 1303 bp, Lactuca sativa
actccgcttttccaattttctctaaatcttcgtttcttagatctcaaatctcgcaaccatgtcttgctacagaggaaagtatgctgatgaactcattgccaatgctgcctacatcggaacccctggaaaaggtatcctcgctgctgatgaatcaaccggaacaatcggaaagcgtctatccagcatcaatgttgagaacatcgaatcaaacagaagagcacttcgtgaactcctcttctgcactcccggtgcccttcaatacctcagtggagtcatcctctacgaagaaactctctaccaaaaaaccgcagcaggcaaaccatttgtggatgtaatgaaggaagccggagttctcccaggaatcaaagtcgacaagggcacagtcgagctagccggaaccgacggtgaaaccaccacccaagggcttgacggtctagcccaacggtgcgcccagtactacaccgctggtgcccggttcgctaaatggcgcgcggttctcaaaatcggcccaaacgagccttcacagctcgcgataaacgaaaacgcaaacggtttagcgcgatacgcgatcatctgtcaagaaaacggtttggtcccaattgtggagccagagattcttgttgacgggtcccacgacattaacaaatgcgcggatgtaactgagcgcgtattggcagcttgctacaaggctttgaatgaccataaggtgcttcttgaaggaactcttttgaaacctaacatggtgacacctggatcggatgcgaagaaggtggcgccggaggtggtggcggagtacacggttagggctttgcagaggacgatgccgccagcggttccggcggtggtgtttttgtcgggtgggcagagtgaggagaagcgacggttaatttgaacgcgatgaatcagtttaaggggaaaaagccgtggactttgactttttcttttgggagggcacttcagcagagtactttgaaggcgtggagtgggaaagaggagaatgttgggaaagctcaggcggcttttcttgccaggtgtaaggctaactctgaggctactcttgggacttatcaaggtggctctgggttgagtgaaggtgcttctgagagtcttcatgttaaggactacaagtactaaataatactaaggtttgtttcttgtttttattcgggaattattgtcgcatttgtgttttgatttgaggattttgtgttatgttttgaacttgtggtggtggtggtggttatggtaatggtggtggttataataagcatgagaaacatctgcctattcaggttttggttat

SEQ ID NO: 1476 - DNA, 1322 bp, Raphanus sativus
atcccatctctctcgtctgccttctttctcaaaaacttcctcgatctttccgtcgaaaaaccatgtctgccttcaccagcaaattcgccgatgagctgatcgccaacgctgcctacatcggcacacctggaaaaggtattctcgccgccgacgagtccaccggtaccatcggaaagcgtctcgcgagcatcaacgtcgagaacgtggagaccaacagacgtgctctccgtgagcttctctttaccgcccctggtgctctcccttgcctcagcggtgtcatcctcttcgaggagactctttaccagaagagttccgatggtaagcttttcgttgatatcttgaaggaaggaggagtactcccaggtatcaaagtcgataagggtaccgtcgagctagccggaaccaacggtgagaccaccactcaaggtctcgacggtctcggtgagcgttgcaagaagtactacgaagccggtgcccgtttcgccaagtggcgtgcggtcctcaagattggcgagaacgagccatcagagctttccatccacgagaacgcttacggattggctagatacgctgttatctgccaggagaacggtcttgtaccaatcgttgagcctgagatcctcgtcgacggatcccatgacatccacaagtgtgctgccgtcaccgagcgtgtcctcgcagcttgctacaagctcttagcgaccaccacgttttgctcgaggggactctcttgaagcccaacatggtcacacctggatccgacagtgccaaggttgcgccagaggttatcgctgagcacaccgtccgtgctcttcagagaacggtaccagcagctgttccagccatcgtgtttttgtcaggtggacagagcgaggaggaggcgactaagaacttgaacgcgatgaaccagttgaagaccaagaagccatggtcgttgtctttctcgttcggacgtgcgttgcaacagagcactttgaagacatgggcagggaaagaggagaatgttaaggctgctcaagaggcgttgtatgtgaggtgcaaggctaactctgaagccacactcggaacgtacaaaggtgatgctaagcttggtgatggtgccgcggagagccttcacgtgaaggactacaagtactgagagaatcgtctgtgacgtcctcattaaacaccctcgatatatttctatgggcttcttctacattttgctttgacattatcggcttttcgatttgtgttttgatttctgttgcgtgttcaattttagaatgatgagtggttttaaaaacgcccaaataaaaagaccatttgaggttatttctgtt

SEQ ID NO: 1477 - DNA, 1062 bp, Malus domestica
tacagatgaacttgtagccaatgctacctacattggtacccctgggaagggaatccttgctgcagatgagtcaacgggcacgattggcaagcgtttgtcaagcataaatgttgagaatactgaaaacaacaggcgagctctccgtgagctcctcttctgtgccccgggtgcactccagtatctcagcggtgtgatcctttttgaggaaaccctttaccagaaaacagccggtgggaaaccctttgttgatatcctcaaagacggtggcgtccttcctggaattaaagttgacaagggcactgttgagcttgctggaactaatggtgagaccacaactcagggccttgacggtcttgcccagcgctgccagcagtactatgaagctggtgcccgatttgcaaagtggcgtgctgtactcaagattggcccgaacgagccaactcagcttgctatacatgagaatgccaatggcttggcgcgctacgctgtcatttgccaggagaatggcttggtaccaattgttgagccagagatactggttgatggatctcatgacattgagcgatgcgcagatgtgactgagcgtgtccttgcagcgtgctataaagcgctgaacgatcaccatgtccttctcgaggggactcttttgaagccaaacatggttacccctggttcagatgccaaaaaggtttcacctgaggtggtgtcttatcatacattaagggcgttgcagcgaacaatgcctccagctgttcctgctgtagtatttctttctggtgggcagagtgaggaggaagctaccctcaatttgaatgctatgaacaagctcaataccaagaaaccctggtcactttcgttctctttcgggcgggctctgcagcagagtaccctaaaggcgtgggctggaaaggatgaaaatgtggagaaggcacgggctgccttccttgctaggtgcaaagctaattcagatgcaactttgggtacctacaaaggggatgctgctttgggagatggtgcttcggagagccttcacgtgaaggattacaaatattgaagattttg

SEQ ID NO: 1478 - DNA, 1865 bp, Plantago ovata
cctgaacctcactgtaaccatgtcttgctacagaggaaagtacgccgacgagctgattgctaatgcaacctacattggtaccccggggaagggtatccttgctgctgatgaatccactggcacaatcggaaagcgtttatccagcattaatgttgagaatgtagaaacaaacaggagggctctgcgtgagcttcttttcaccacccctgacgtcctccagtatttgagtggagttatccttttcgaggaaactctataccagaagacagctgcaggcaagccctttgttgatgtcttgaaggagggtggtgtccttcccggtatcaaggttgacaagggtaccgtcgagcttgctggaaccaatggcgagaccaccacacaaggtcttgatggccttgcccagcgctgccaacagtattacgctgctggtgctaggtttgctaagtggagagcagtcttgaagattggtcctaatgagccatctcagcttgcaatcaacgacaatgccaacggtcttgctcgctatgccattatctgccaagagaatggtttggtcccaattgttgagcctgagatccttgttgatggttcacatgacatcgagaagtgtgctgatgtgaccgagcgtgtgcttgctgcttgctacaaggcattgaacgaccaccacgtcctccttgagggaactctattgaagcctaacatggttacacctggctcagattctccaaaggtagcccctgaggttattgcagagtacactgtccgtgccttgcaacgcacaatgcctcctgctgtcccagctgttgtgttcttgtctggtgggcagagtgaggaagaagcaactgtcaaccttaatgccatgaacaaactgaagggcaagaagccatggagcctttctttctcctttggacgtgctctccagcagagcaccctcaaggcttgggctggtaaggaagaaaacattggaaaggctcaggctgcattttatgctagggccaaggccaactctgaagccacccttggaacttaccagggttcttcctctttgagcgagggtgctggtgagagcctccacgtcaaggactacaagtactgaggtggaatttcagtgttttgatatattttactttattgttgagagagtaaccggctatgtagtttgactctgttttctcctttttacctccttatctttgtcactgaaccattttaataatcttgttgaacgtcagcaatgtgatactttcgcatccctttttgttattaagaggctgttttcttgtgttagtttgctgtctgttttcgtaaccttcgaccaacgcttcaggagtattcataagcgacttggggtgttttctggtgttattctgttgtttgtggactgggttgcagagccagttgattctgggatcatttctgatggtagtgtgtgctgggtcaaccagaatgacttcgaagtacttgtaggtagagtcctcattgatccagtaagagttgagaaccctaagacctcccaacttccttccggcacgctcctcagcaacagagcgcttgctacgctggaacttgagttgggtaactccctggttggtgggctttccatacacaatacctttaggaacaggcctcttccttccaccacgcttcacacgaacacggtaaataacatatccctgcttagccttgtaaccgaggcggcgggccttgtcgggcctagtgggatgagtgacacgcacaacagaggggagttgacgatactcccagcaacgaacacggagcaaaaacctcatcacatcggattgcttcttcttccatagttctgaaacgtatgtgtaagcacccatggcggcagactggaatagatt

SEQ ID NO: 1479 - DNA, 1274 bp, Vinca minor
atcatgtcgtgctacagaggagaatacgccgatgagctcattgccaatgcttcttacattggtactcctggaaagggtatccttgctgctgatgagtcaaccggcactattggaaagcgtctatccagcatcaatgttgagaatgtcgagacaaacaggagagctctccgtgagctcttgttcaccacacctggttgccttcagtacctcagcggtgttatcctctttgaggaaactctttatcagaagacagctgatggtaaaccatttgttgatgtaatgaaggagggtggagtccttcccggaattaaggtggataagggcactgttgagcttcctggtactaatggtgagactaccactcaaggtcttgatggtcttgctcagcgatgccagcaatactacaaggctggtgccaggtttgccaaatggcgtgctgtgcttaagattggtccaaatgaaccatcccagcttgccatcaatgacaatgccaatggcttggctcgttatgcaattatctgccaacagaatggtttggtcccaattgttgagcctgaaatccttgttgatggttcccacgatattaacaagtgtgctgatgtaactgagcgtgttcttgccgcatgctacaaggccttgaatgaccaccatgttcttctagagggaacactcttgaagcccaacatggttaccccaggatctgactcccccaaagttacacctgaggtcattgctgaacacaccgtccgtgctttgcagcgcaccatgcctgctgcagttcctgctgtagtgttcctctcaggtggacagagtgaagaggaggcttccgtcaacctcaacgccatgaacaaacttcagaccaagaagccatggtctctttccttctcgtttggacgtgccttgcagcagagcactctcaaggcttggtctggaaaggaagaaaatgttaagaaggcacaggaggtattcctcgccaggtgcaaggccaactctgaagcaacccttggaaagtatgctggtggtgcatctggaggtgctgcttctgagagcctccacgtcaaggactacaagtattaggcttttggtttcatatgcctttggctttgttcatgttttgttgagagtgcagcttgggcacacaaatgttttattatcggatttagtatttttaggttctgttttgattttcggcctggcctagcaaaatggttaaataagctcttaaggaaggtaatactctgagagttggtacttcttttgttatgttttttttt

SEQ ID NO: 1480 - DNA, 1373 bp, Arabidopsis lyrata
tcttctggaagctaccatcacccccctcctatataaactcatcatcatcatcatcatcatcatcatcttcaatttctctctttatccaattctcttcatcgattcgattcttcaaccatgtcttgcttcaccaccaaattcgccgatgagctgattgctaacgctgcttacatcggcacacctgggaaaggtatccttgcggcagatgaatcaactggtaccatcggaaagcgtcttgctagcatcaatgttgagaacgttgaatcgaacagacgtgctcttcgtgagcttctctttactactcctggagctcttccttgtctcagtggtgttatcctctttgaagagactctctaccagaagagctctaatggtacgccttttgtggatatgttgaagagtgcaggagtcttgcctggtattaaggttgataagggtaccgttgagcttgctggaaccaatgctgagacgactactcaaggtcttgatggtcttggtgaccgttgcaagaagtactacgaggctggtgctcgtttcgctaagtggcgtgcggttcttaagattggtcaaaacgagccctctgagttagctatccatgagaacgcttatggattggctaggtacgctgtcatttgtcaggagaacggtcttgtgccgattgtggagcctgagattcttgttgatggttctcacgacatccacaagtgcgcagcggtgacagagcgtgttcttgcagcttgctacaaggccctgagtgatcaccatgtcttgcttgaaggaacgctcttgaaaccaaacatggtgactccaggatcagagagtgccaaggttgctccagaggtgattgcagagcacactgtccgtgctcttcagaggactgtgccagctgctgttccagccatagtgttcttgtctggtggacagagcgaggaagaggcgacaagaaaccttaacgcaatgaacaagttgaagacaaagaagccttggtctctgtctttttcctttggaagggcgttgcaacagagcactttgaagacttggggaggaaaagaggagaatgtgaagaaggcgcaagaagcgttcttggtcagatgcaaggccaactctgaggccacacttggtacctacaaaggtgatgccaagctcggtgaaggagcagcagagagcctccacgttaaggattacaagtactgatgaaagaggctatggatcgtagtttttatatcatcgttgcgttcttgctttcactttgtctgtttttgtttggtggtttgtttagtagagtgctacaaaagaaccccgtttaagcttttttttaggagaggtctgtgttgttcctatgaaacctttttaagaatgaatattagcttgtt

SEQ ID NO: 1481 - DNA, 1470 bp, Arabidopsis lyrata
agatccaacggctgaaaaagctatttcttggggaacatgcaaagatctgacccttaattaacatttttcaccaaccaatagactctcatccgcagctataaaagcagcccttttcctctactggtccaccattcgtctgccttcttccgcatctctctaaatttctctctaatttctcgatctctccgtctaaacatgtctgccttcaccagcaaattcgccgatgagttgattgccaacgctgcctacatcggcacacctggaaaaggtattttggccgctgatgagtccaccggtaccatcggaaagcgtcttgcgagcatcaacgttgagaacgttgagaccaacagacgtaacctccgtgagcttctcttcaccgcccctggtgctctcccttgccttagtggtgtcatcctcttcgaagagactctttaccaaaagagttccgatggcaagctttttgttgatatcttgaaggaaggaggagttcttcccggtatcaaggttgacaagggtaccgttgagctagctggaactaacggtgagaccaccactcaaggtcttgacggtcttggtgaccgatgcaagaagtactacgaagctggtgctcgtttcgccaagtggcgtgcagtcctcaagatcggtgagaacgagccatctgagctatccatccatgagaacgcttacggattagctagatacgctgttatctgccaagagaacggtcttgtacccattgttgagcctgagatcctagttgatggatcccatgacatccagaagtgtgctgctgtgactgagcgtgttcttgcagcttgctacaaggcccttagcgaccaccatgtcttgctcgagggtaccctcttgaagcctaacatggtgactcccggatcagacagccccaaggtttcacctgaagtcattgctgagcacaccgtccgtgcccttcagagaaccgtcccagctgctgttccagccattgtcttcttatccggtggacagagcgaggaagaagctacaaggaacttgaacgccatgaaccagttgaagaccaagaagccatggtcattgtctttctcattcggacgtgcgttgcagcagtctaccttgaagacatgggcaggcaaagaggagaatgtcaaggcagctcaagaggcgttgtatgtgaggtgcaaggccaactctgaagccaccctcggaacctacaagggtgacgccaagcttggtgatggagcagctgagagccttcacgttaaagattacaagtactgagcattgtccatttgtgacgttgtcatcttcctggatatatttctagggatttttcgtttttctacatcggattaaagtgttttttttcctcggttttcttttggatttgtgttttgattttggttgggttgtgtttattagaatgagtgtttgaaaacacgcccaaataaaaaacgccatttgaggttatttctgttg

SEQ ID NO: 1482 - DNA, 1388 bp, Arabidopsis thaliana
aatatcttctggaagctaccatcactctctcctatataactcaaaattcaccatcatcttcatcatcatcatcatcatcatcctttctttatccaactttcttcaccaaatcgattcttcttcaaccatgtcttccttcacctccaaattcgccgatgagctgattgctaacgctgcttacatcggaacacctggaaaaggtatccttgcggcagatgaatcaactggtactattgggaaacgtctcgctagcatcaacgttgagaacgttgaatccaacagacgtgctcttcgtgagcttctcttcactactcctggagctcttccttgcctcagtggtgttatcctctttgaagaaactctttaccagaagagctctgatggtacgccttttgttgatatgttgaagagtgcaggagttttgcctggtattaaggttgataagggtaccgttgagcttgctggaaccaatggtgagactactactcaaggtcttgatggtcttggtgaccgttgcaagaaatactacgaggctggtgctcgtttcgccaagtggcgtgcggttcttaagattggtgttaatgagccatctcagttagctatccatgagaacgcttatggattggctaggtatgctgtcatttgtcaggagaacggtcttgtgccgattgtggagcctgagattcttgttgatggctctcatgacattcagaagtgtgccgcggtgacagagcgtgttcttgcagcttgctacaaggctctgagtgatcaccatgtcttgctagaaggaacactcttgaaacctaacatggttactccaggatcagagagtgcgaaggttgcaccagaggtgattgctgagcacactgtccgtgctcttcagaggacagttccagctgctgttccagccatagtgttcttgtctggtggacagagcgaggaagaggcgacaagaaaccttaacgcgatgaaccagttgaagacaaagaagccttggtcgttgtctttctcctttggaagggcgttgcagcagagcactttgaagacttggggaggaaaagaggagaatgtgaagaaggctcaagaagcgttcttggtcagatgcaaagctaactctgaagcaacacttggtgcttacaagggtgatgctaagctcggtgaaggtgcagctgagagccttcacgttaaggattacaagtactgaagaaagaggctgaggatcgtagtttttatatcatcgtttatgttcttgctttcactttctctgttttttgtttggtgttttgtttagaagagtggtggcaccaaagaaccccgtttatacttttttatgaggtctttgtgttcttatgaagcctttttaaaaatgaatattagcttgttgggtt

SEQ ID NO: 1483 - DNA, 1143 bp, Brassica juncea
atgtctgccttcaccagcaagttcgccgatgagttgatcgccaacgccgcctacatcggcacacccggaaagggtattctcgccgccgacgagtccaccggaaccatcgggaagcgtctcgcgagcatcaacgtcgagaacgtcgaatccaacagacgcgctctccgtgagcttctcttcaccgctcccggtgctctcccttgcctcagtggtgtcatcctcttcgaggaaactctttaccaaaagagttccgatggaaagctcttcgtagacatcttgaaggaaggaggagttctcccaggtatcaaagtcgacaagggcaccgtcgagctagccggaaccaacggcgagaccaccactcagggtctcgacggcctcggcgagcgttgcaagaagtactacgaagccggtgcacgtttcgccaagtggcgtgcagttctcaagatcggcgagaacgagccgtcggagcattccatccacgagaacgcttacggtttggctaggtacgccgttatctgccaggagaacggtcttgtgcccatcgtcgagcctgagattcttgtcgacggttcacatgacatccacaagtgcgctgccgtcaccgagcgtgtcctcgcggcttgctacaaggctctcagcgaccaccacgtcttgctcgagggaactctcttgaagcctaacatggttacgcctggatccgacagtgctaaggtcgcaccggaggtgatcgctgagcacaccgtccgtgctcttcagagaacggtcccagcagctgttccagctatcgtgttcttgtctggaggacagagcgaggaggaggcgaccaagaacttgaacgcgatgaaccagttgaagaccaagaagccatggtcgttgtctttctcgttcgggcgtgcgttgcaacagagcactttgaagacatgggcaggtaaagaggagaatgtcaaggcagctcaagaggccttgtatgtgaggtgcaaggctaactctgaagccactcttggaacttacaaaggtgatgctaagcttggtgatggagctgcagagagccttcacgtcaaggattacaagtactgagaatcctctttcatggtttctgggttgtgacgttatcatcaccctcgatatatttctaagggtttt

SEQ ID NO: 1484 - DNA, 1327 bp, Brassica juncea
tctcttctctctacaatttctcgatctctccgtcataataaaccatgtctgccttcaccagcaagttcgccgatgagttgatcgctaacgccgcctacatcggcacacccggaaagggtattctcgccgccgatgagtccaccggaaccatcgggaagcgtctcgcgagcatcaacgtcgagaacgtcgagtccaacagacgcgctctccgtgagcttctcttcaccgctcccggtgctctcccttgcctcagcggtgtcatcctcttcgaggaaactctttaccaaaagagttccgatggaaagctcttcgtagacatcttgaaggaaggaggagtactcccaggtatcaaagtcgacaagggtaccgtcgagctagccggaaccaacggcgagaccaccactcagggtctcgacggcctcggcgagcgttgcaagaagtactacgaagccggtgcacgtttcgccaagtggcgtgcggttctcaagatcggcgagaacgagccgtcggagcattccatccacgagaacgcttacggtctggctaggtacgccgtcatctgccaggagaacggtcttgtgcccatcgtcgagcctgagattcttgtcgacggttcacacgacatccacaagtgcgctgccgtcaccgagcgtgtcctcgcggcttgctacaaggctctcagcgaccaccacgtcttgctcgagggaactctactgaagcctaacatggttacgcctggatccgacagtgctaaggttgcaccggaggtgatcgctgagcacaccgtccgtgctcttcagagaacggtcccagcagctgttccagctatcgtgttcttgtctgggggacagagcgaggaggaggcgaccaagaacttgaacgcgatgaaccagttgaagaccaagaagccatggtcgttgtctttctcgttcggacgtgcgttgcagcagagcactttgaagacgtgggctggtaaagaggagaacgtcaaggctgctcaggaggccttgtatgtgaggtgcaaggctaactctgaagccacgcttggaacttacaagggtgatgctaagcttggtgatggagccgccgagagtcttcacgtgaaggactacaagtactgaggaaggtcgttgatggtttctgttgttacgttatcattacccctcgatacaatttctaagggttttttctttgactttatcggcttgttttttcctacattttcctttggatttgtgtttttatttctattgtgctgagagtttgaaaaacacctaaataagaagccatttgaggttttttctttgactttatcggcttgtttttt

SEQ ID NO: 1485 - DNA, 1326 bp, Brassica rapa
catctctctcgtctgccttctctattaaaaacttttctcgatctttccgtcaaaaaccatgtctgccttcaccagcaaattcgccgatgagctgatcgctaacgctgcatacatcggcacacctggaaaaggtattctcgccgccgatgagtccaccggtaccatcggaaagcgtctcgcgagcatcaacgtcgagaacgttgagactaacagacgtgctctccgtgagcttctcttcaccgcccccggtgctctcccttgcctcagcggtgtcatcctcttcgaagagactctttaccaaaagagctccgatggcaagcttttcgttgatatcttgaaggaaggaggagtcctcccaggtatcaaagtcgacaagggtaccgttgagctagccggaaccaacggcgagaccaccacccaaggtctcgacggtctcggtgagcgttgcaagaagtactacgaagctggtgcacgtttcgccaaatggcgtgcggttctcaagatcggcgagaacgagccatcagagcattctatccacgagaacgcttacgggttggctagatacgctgtcatctgccaggagaacggtcttgtaccgatcgttgagcctgagatccttgtcgacggatcccacgacatccacaagtgtgctgccgtcaccgagcgtgtccttgcggcttgctacaaggctcttagcgaccaccacgttttgctagagggaactttgttgaagcctaacatggtgacgcctggatccgacagtgccaaggttgcacctgaggttatcgctgagcacaccgtccgtgctcttcagagaacggtaccagcagctgttccagctattgttttcttgtccggtggacagagcgaggaggaggcgactaagaacttgaacgcgatgaaccagttgaagaccaagaagccatggtcgttgtctttctccttcggacgtgcgttgcaacagagcacattgaagacatgggcggggaaagaggagaatgttaaggctgctcaagaggcgttgtatgtgaggtgcaaggctaactctgaagccacacttggaacgtacaaaggtgatgctaagcttggtgatggagctgcagagagccttcacgtgaaggactacaagtactgagaatcgtctgtcaatggtttctgttgtcacgtcctcatcaacacaccctcgatatatttctatgggtttcttctactttttccttgacattatcggcttttctatttttgtttttcgatttgtgttttgatttaagaatgatgagtgtttaaaaacgccaaaataaaatgccatctgagtttatttctgtt

SEQ ID NO: 1486 - DNA, 1433 bp, Brassica napus
gcatctataaataccaaaccgtctgggtccactttgctcccatctctctcgtctgcctacttcctcaaaaactttctcgatctttccgtcaaaaaccatgtctgccttcaccagcaaattcgccgatgagttgatcgctaacgctgcatacatcggcacacctggaaaaggtattctcgccgccgatgagtccaccggtaccatcggaaagcgtctcgccagcatcaacgtcgagaacgttgagactaacagacgtgctctccgtgagcttctcttcaccgcccccggtgctctcccttgcctcagcggtgtcatcctcttcgaagagactctttaccaaaagagctccgatggcaagcttttcgttgatatcttgaaggaaggaggagtcctcccaggtatcaaagtcgacaagggtaccgttgagctagccggaaccaacggcgagaccaccacccaaggtctcgacggtctcggtgagcgttgcaagaagtactacgaagctggtgcacgtttcgccaaatggcgtgcggttctcaagatcggcgagaacgagccatcagagcattctatccacgagaacgcttacgggttggctagatacgctgtcatctgccaggagaacggtcttgtaccgatcgttgagcctgagatccttgtcgacggatcccacgacatccacaagtgtgctgccgtcaccgagcgtgtccttgcggcttgctacaaggctcttagcgaccaccacgttttgcttgagggaactttgttgaagcctaacatggtcacacctggatccgacagtgccaaggttgcgcctgaggttatcgctgagcacaccgtccgtgctcttcagagaacggtaccagcagctgttccagctattgttttcttgtccggtggacagagcgaggaggaggcgaccaagaacttgaacgcgatgaaccagttgaagaccaagaagccatggtcattgtctttctcgttcggacgtgcgttgcaacagagcactttgaagacatgggcagggaaagaggagaatgttaaggcagctcaagaggcgttgtatgtgaggtgcaaggctaactctgaagccacacttggaacgtacaaaggtgatgctaagcttggtgatggagctgcagagagccttcacgtgaaggactacaagtactgagaatcgtcttcaatggtttctgttgtgatgtcctcatcagcaccctcgatatatttctgagggtttcttctactttttgcttgacattatcggcttttcgatttttgtttttcaatttcttttcggtttgtgttttgatttaagaatcatgagtgtttaaaaacgcccaaataaaatgccagctgaggttttttctgttaattaacttttatcttttttggggatttgaattgaagaacaaaagcacgttaatcatagg

SEQ ID NO: 1487 - DNA, 1407 bp, Brassica napus
gaccaactcacatctctctctctcgtctgctttattccgcatctttttgatattctctctcgatcaatccgtcacaaaccatgtctgccttcaccagcaaatacgccgatgagttgatcgctaacgctgcctacatcggcacacccgggaagggtattctcgccgccgatgagtccaccggtaccatcggaaagcgtcttgcgagcatcaacgtcgagaacgttgagacaaacagacgtgctctccgtgagcttctcttcaccgcccctggtgctctcccttgcctcagcggtgtcatcctcttcgaggaaactctttaccaaaagagctccgatggcaagcttttcgttgacatcttgaaggaaggaggagttcttccaggtatcaaagtcgacaagggtaccgtcgagctagccggaaccaacggtgagaccaccactcagggtctcgacggtctcggtgagcgttgcaagaagtactacgaagctggtgcacgtttcgccaagtggcgtgcggttctcaagatcggcgagaacgagccatcagagcattccatccacgagaacgcttacgggttggctagatacgctgttatctgccaggagaacggtcttgtacccatcgttgagcctgagattcttgttgacggatcccatgacatccacaagtgtgctgccgtcactgagcgtgtccttgctgcttgctacaaggctcttagcgaccaccacgtcttgcttgagggaactttgttgaagcctaacatggtcacacctggttccgacagcgccaaggttgcgccggaggttatcgctgagcacaccgtccgtgctcttcagagaaccgtcccaccggctgttccagctatcgtgttcttgtctggaggacagagcgaggaggaggcgaccaagaacttgaacgcgatgaaccagttgaagaccaagaagccatggtcattgtctttctctttcggacgtgcgttgcagcagagcactttgaagacatgggcgggtaaagaggagaacgtcaaggccgctcaagaggcgttgtatgtgaggtgcaaggctaactctgaagccacgctcggaacatacaaaggtgatgctaagcttggtgatggagccgcggagagccttcacgtgaaggactacaagtactgaggagcgtccttgttgtgacgtactcatcaccctcgatatatttctaagggtttcttctacttttttttttttttttgcttgacaatatcggattaacgatgcttttttcgatttttgttttcgatttgtgtttgattttcgttgggtgttgtttagaatggtgagtgtttgagaaaaaaacgcacaaataaaaggccatgtgaggttatttctgttgagcttatatgaacatgaagtaaattgggcctac

SEQ ID NO: 1488 - DNA, 1410 bp, Catharanthus roseus
ccaaagaattcggcacgagggttttcatttggatctctctctctctctctctctacccaatacttttcctccagatttctgcttcttagtttcaatccctagccatgtcgtgctacagaggacaatacgccgatgagctcattgccaatgctacatacatcggtacccctggaaagggtattcttgctgccgatgagtcaactggcactattggcaagcgtctggccagcatcaatgttgaaaatgttgagtcgaacaggagggccctccgtgagcttttgttcacaacacctggtgcccttcagtacctgagtggcgttatcctctttgaggaaactctttaccagaagacagctgatggcaagccttttgttgatgtcatgaaggaggctggagtcctccctggaattaaggttgataagggcactgttgagctccctggcacaaatggtgagaccaccactcagggtcttgatggccttgctcagagatgccaggaatactacaaggctggtgccaggttcgccaaatggcgtgctgttcttaaaattggccccaatgaaccatctcagcttgccatcaatgagaatgccaatggcttagctcgttatgcaattatctgccaacaaaatggtttggtcccaattgttgagcctgaaatcctcgttgatggttcacatgatattaacaaatgtgctgatgtaactgagcgagttcttgctgcatgctacaaggcattgaatgaccaccatgttctccttgagggtacactgttgaagcccaacatggttaccccagggtccgactcccccaaagttgcacccgaggttattgctgaatacaccgtccgtgccttgcagcgaaccatgcctgctgcagtccctgctgtggtgttcctctcaggaggacaaagtgaagaggaggctactgtcaacctcaatgccatgaacaaacttcagaccaagaaaccatggtccctttcgttctcctttggacgtgccttgcagcagagcactcttaagacctgggctggtaaagaagaaaatgttcagaaggcacaggctgcattcctcaccaggtgcaaggctaactctgaagcaaccctaggaaagtatgcaggtggtgctgctggaggtgccgcagctgaaagcctccatgttaaggactacaagtactaagctcttggtatgcttcccgtttttgttattgttttggagagtacatgcagcaggttggggacaggaatgtttaccatcggatgtagaatttttaaggatttggttttaatttttgcctgatctatcttagaaaactttgttaaaataagctcaggaggaagagatactctgagatacttttgagagtttacttcttttttaatgtttatttcatttgtgatgattgagttct

SEQ ID NO: 1489 - DNA, 1446 bp, Actinidia deliciosa
gcctttctttgctctctctctctctccggcaaaataaaacccctaacccgcatcctctctctctctctctctctctagatatcattcttcttcctcagtcccttcaatctctacaatcatgtcttgcttcaaggggaagtaccatgatgagctcattgccaatgctgcctacattggcacccctggaaagggtatccttgctgctgatgagtccaccggcacaatgggcaagcgtctttcgagcattaatgttgagaatgttgagtcaaacaggcaggctttccgcgagcttctcttcaccactcccggtgctcttcaacacctcagtggagtgattctctttgaggaaactctttatcagaagacctccgatggtaagcctttcgttgagctgctgaaggaaaacggtgtcctgcccggaatcaaggtggacaagggtgttgttgagcttcctgggaccaatggtgagaccaccacccagggtcttgatgaccttggcaagcgctgccagcagtactatgctgctggttgtaggtttgccaaatggcgtgctgtactcaagattggcgtcaccgaaccatctcagcttgccatcaacgaaaatgccaacgggttggctcgatacgccatcatctgccaggagaatggcctggtccccattgtcgagcccgagatcttggtcgatggcaaccacagcatcgacaagtgtgccgatgctactgaacgcgttcttgcagcggtttacaaggctttgaacgaccaccacgtcttgcttgagggaaccctgttgaagcccaacatggttaccccggggtcggacgcacccaaggtggcccccgaggtggtggcggagtacacggtccgtgccctgcagaggacaatgcccgctgccgtcccagctgtggtgttcttgtctggtgggcagagcgaggaggaggccaccctcaacctcaatgcaatgaacaaactcaagactaagaagccatggaccctcacattctcctttggaagggctcttcaggcgagtaccctcaaggcatggctgggcaaggcagagaatgtggagaaggccaaagctgtgttcctccaaaggtgcaaggccaactccgaggcaaccctcggaacctacaagggcagcggttcgttgagtgagggagcgtccgagagcctccacgtcaaggactacaaatactgatttgagttttgctttctgcacggttatgttttctctttttgctgtggagatttatgtgctggcagtgtgtgcaagagtatcttcatccccaggcatcattgctttaggttgtttttttggttttgcatttttatcgtgcttttactgactggtagtagaataaaggtcgaggaacaacatcggcttgttgaggttgggatggtttcatcctttttggtttataagactatatattaatgttaccttttgaa

SEQ ID NO: 1490 - DNA, 1425 bp, Tropaeolum majus
acctaactcaccaaactcatcaaaacctcttttttgtttgcttcttcaggtatcccaatcttcgttgatcatgtcttgcttccagagtaaatatgctgatgagctcattgctaatgccgcgtacattggcacccctgggaaaggtattcttgctgctgatgagtccactggtacaatcggaaagcgtctctctagcattaatgtagagaacactgaagcaaacaggcgtgctttgagggagctactgttctgtgcccctggagcacttcagtaccttagcggaattatcctctttgaggaaactctctaccaaaagactgctgatggcaagcccttcgttgacgtaatgaaggaggccggagttcttcctggaatcaaggttgacaagggtacagtagagcttgctggtaccaatggtgagaccaccactcagggtcttgatggccttggtgcaagatgtgccaaatactatgaagccggtgcccgttttgccaaatggcgtgctgttctaaagatcagtgaaactgagccttctgagttggccattcatgaaaatgcttacggtttggcaagatacgctgttatctgccaggaaaatggccttgttccaattgttgaacccgagatccttgttgatggatcccatgacattgagaaatgtgctgcagtgaccgagcgtgttcttgcagcatgctacaaggctctcagtgaccaccatgtcatccttgagggtactttgttgaagccaaacatggttaccccaggatccgactcacccaaagtttcaccccaaaagattgctgaatacactgtccgtgccttgcaacgcaccacacctgctgcagttcccgctattgtgtttttgtccggtggacagagtgaagaagaagccactcttaacctcaatgccatgaaccaactccagggtaagaagccatggtccctatcattctcattcgggcgtgcccttcagcagagtaccctgaaggcttgggcagggaaagaggaattcattggaaaggcacaggctgcactcctaacaaggtgcaaggccaactcagaggccaccttgggtacctacaagggtgatgctactcttgctgaaggtgctgccgagagcctccatgtgaaggactacaaatactaaatgtaacaaccttttgttgtgtttgggagagtaaatgatggttgtatcttttactatcattctcaggcatagtggtgttttttcccttatcatttctcgtcccatttgaagtttagtttaataataatgtttaggccagcggctgaatttgtattgaggaacaatcgggcctcaaggtgttagacatgtttgcttatttttattttatacttgagactttttattgcggttatacagattattatctgtttgttgtttgatatgacttgcggatatta

SEQ ID NO: 1491 - DNA, 1329 bp, Helianthus annuus
aattgaattttctttttcaaccaaaccaaccatgtcttgctacaagggaaagtacgctgatgagcttattgcgaatgctacctacattggtacgcctgggaagggtattcttgctgctgatgagtcaacgggcactataggaaagcgtctttccagcatcaatgttgaaaatgtggagtcaaacaggagagctctccgtgagcttctcttctgcactcctggtgccctccaatacctcagtggaatcattctctttgaggaaactctttaccaaaagactgccgatggtaagctctttgttgatgtcatgaaggaggctaatgtgctcccaggtatcaaagtcgacaagggtacagtcgagctagccggaaccaacggtgagaccaccacccaaggtctagacggtcttgcccagcgatgtgccaagtactatgaagcaggtgcgaggttcgccaagtggcgtgccgtcctaaagatcggcccaaacgagccatctcagctagctatcaatgaaaatgccaacggcttggctcgatatgccatcatatgccaagagaacgggctcgtccccattgtcgagcctgagatccttgttgacggaccccatgacatcaacaagtgtgctgatgtaaccgaacgagttctagctgcgtgctacaaggctcttaacgaccaccacgtccttcttgagggtacccttttgaaacccaacatggtcactcctggatccgactccaacaaggttgcacctcaagtggtggccgagtacaccgtccgtgccctccaacgaaccatgcctgcagcggtcccagcagtggtgttcttgtcagggggtcaaagtgaggaggaagccacggtgcacctgaatgctatcaaccagtaccagggtaagaagccgtggagcttaaccttctcgttcgggcgcgccctgcaacagagcaccctcaaggcatggggcgggaaagaagagaatgtgaacaaggctcaggaggcgttccttactcggtgcaaggccaactctgaggccacacttgggaagtaccagggcggtgctgcagttgagggtgctactgagagccttcatgttaaggactacaagtactaatttctttcaaactatggggaatgtttacttttgtgtttgtttagtagctagctatcaatggctaaaaataagcctgagaacatcaggtactgactggtttgaggttgatgttgtcctgaccagttttgaaacttttttgttttcttctattctatgatcaatatatcttcttgttcattatgatttttggattgggttaatatgatgtatgagttggtaaaaag

SEQ ID NO: 1492 - DNA, 1442 bp, Glycine max
gtcttctctgctttcgaaacaacactcacaaaacaaagccttctttttcttgtgtgatctcacaagcccctaaaagccaccatgtcttccttcaagagcaaataccaagatgagttgattgccaatgctacttatattggcaccccaggaaagggtatccttgcagctgatgagtcaaccggcacaattgggaaacgtttggcgagcatcaacgtggagaatgttgaaacaaacaggcgcattcttcgtgagctcctattcactgctcccggttgtcttgagtgcctcagtggtgtcatcttgtttgaggaaaccctctaccaaaaatcagctgcaggagtacccttcgtggacatactgaagaaaggaggagttctcccgggcatcaaggtagacaagggcaccgttgagctcgccggaacaaacggcgaaaccaccacccaaggcctcgacgacctcgcccagcgctgcaagaagtactacgaagccggcgcaaggttcgccaaatggcgcgcagtgttaaagataggtccaaacgagccctctccgctctccatccacgagaacgccaacgggcttgctcgctacgcggccatctgccaagaaaacggccttgtacccatcgtggagcccgagatcctctccgatgggccccacgacattgcgaaatgcgccgacgtaacggagcgtgtgctggccgcgtgctacaaggccctaaacgaccaccacgtgctcctcgaaggcacgctgttaaagcccaacatggtaacccctgggtccgaggcggcacgtgtgacggctgaggtcatagcggagcatacggtgagggcgctgcagaggaccgtgcctcccgcagttccggcgatcgtgtttctctccgggggacagagtgaggaagaggcgacggtgaatttgaacgcgatgaatcaactgaaggggaagaagccgtggtcgttgactttctcttatgggagggcgctgcagcagagcacgctgaaggcgtggggtggaaaggacgagaatatccccaaggcgcagagcgcgttgcttgtgaggtgcaaggcgaattcggaggctactctcggaacttataagggggatgccacgcttggggaaggggcttctgagtcacttcatgttaaggattataagtactgagaggtctgagattgttttttttttttggaatggaattgtttctttctttctttttttgaactgttttgtaggtttatggatattctcggtcgtaggtggtaatgtgagaataataatggctttagctgctgctgctgcattggcctgatcggcgtttactttttttctttcttttactatgttattttgttattctatttttacactgcttaatctattttttatattagaaaccaagaaaaatgtactacttctaaattctgagtgcactgtttcttcgaatc

SEQ ID NO: 1493 - DNA, 1454 bp, Arnica chamissonis
gatgacaattgaacagttatctgatttaaacatgttctatcacatgaaggggccttccatacttttcaaatctcaccaaccatgtcttgctacaagggaaaatacgctgatgaacttattgccaatgctgcctacattggttcaccgggcaagggtattcttgctgccgatgagtcaactggcacaatcggaaagcgtctttcaagcatcaatgtcgaaaacgtcgagtcgaaccgtagagccctccgtgagcttcttttctgcactcccggtgcccttcaatacctcagtggaattatcttgtttgaagaaactctctaccagaagaccgctgcaggtaagccctttgttgatgtcatgaaggaggctaatgtgctccctggaatcaaagttgacaagggtacagtcgagcttgctggaaccgacggtgaaaccacgacccaaggtctagacggtcttgcccagagatgtgctaagtactatgaagcaggtgctaggttcgccaagtggcgtgctgttttaaagattggcccgaacgagccatctcagctatccatcaatgaaaacgctaacgggttagcccgatacgccatcatatgccaagagaacgggctcgtccccattgtcgagccagagatccttgttgacggttctcacgacatcaacaagtgtgccgatgtaacagaacgtgtgctcgccgcatgctacaaggctcttaacgaccaccacgtacttctcgagggtacccttttgaaacccaacatggtcacaccaggatcggagtccaaaaaggttgcaccggaagtggtaggcgagtacacggtccgcgcccttcaacgaaccatgccagcagcggtcccagccgtggtgttcttatctggcggtcaaagtgaggaggaagcgacagtgaacctgaacgcgatcaaccagtacaagggtaagaagccgtggagcctaactttctcgttcgggcgggccctgcaacagagcaccctcaaggcatggggtgggaaagaagagaatgtgaagaaggctcaagaggcattcctagcaaggtgtaaggctaactctgaggcaacattggggaaataccagggtggtgctgctgttgagggtgctactgagagccttcatgttaagggatacaagtactaagttgttttcaagtatgtggtttgttaaggggatgaatattttttgtcttgtggtttttaaatttcggtctagtctttggtagcaatgactaaaaataagcctgagaagataccaggcgttggttgaggttgatgatttttgaacttccttttcattttccatgatcaatatatcttgtgctttttaatgtttagaattttggtaatttgatgtgtcatgaatggtttgagtctcgaaggtcttttggggtcaaggaccctgtctcggtcttggttttaaagggcgaggtttatgtgaat

SEQ ID NO: 1494 - DNA, 1455 bp, Arnica chamissonis
accgcctcaagaccggtttcttggacgagacgtcagatttgggggggcgatgataccgatgttcgtctcctttaaatctaaaccctcactccttttctttgactctataacctccctttctctttaacaagtttctttttctcagatctcagatttcaccatgtcttgctacagaggaaagtatgctgatgagctaattgccaatgctgcttacattggcacacctggaaagggtattcttgctgctgatgagtcaactggtacaattggaaaacgtctatccagcattaatgtcgagaacgtcgagtcaaacaggagggcacttcgtgaacttcttttttgcactcctggcgccctccaatacctcagtggagtcattctttttgaggaaaccctctaccagaagacagctgcaggtaagccatttgtggatgtaatgaaggaagctggagtcctccctggtatcaaggttgacaagggtacagtcgagcttgctggaaccgatggtgagaccacaacccaaggtcttgatggtctagcccagcgatgtgctcaatactactctgctggtgcccgtttcgccaagtggcgtgcagttctaaaaatcggcccaaacgagccatcacaacttgccatcaatgagaacgcaaatgggctagcccgatatgccatcatctgccaagagaacggtctggttccaatcgtcgagcccgagattctcgtagacggaccccatgacatcaacaagtgtgctgatgtcaccgagcgtgttctagctgcttgctacaaagctcttaatgatcaccatgttcttcttgagggtacccttttgaaacccaacatggttacacccgggtctgatgctgaaaaggttacaccagaagttgtggctgagtacaccgtccgtgccctgcaacgaaccatgccaccagcggtaccggctgttgtgttcttgtcaggtggtcagagtgaggagcaggcttctattaatctcaatgccatcaaccagtacaagggtaagaaaccgtggtcgttgactttctccttcgggcgggccctacagcaaagcaccctgaaggcctggggtgggaaagaagagaatgtgaagaaagcccaggacgcgtttcttaccaggtgtaaggctaactctgaggcgactcttggaaagtatcagggcagttctgggttgagtgaaggtgcatctgaaagcctccatgttaagggctacaagtactaaactccgctatcggtttcctcagtaagtcttcacggatttgtgttttaatgacgattttttgtatggatgaggtggtctttatgttctgaacctgtttctgtgtttgtttttggttttgtctaatccgggtaggagattgttataataagtatgagaaacatttgctcgtttgaggtttgattttaattttcaatggttcaggtttgatgcccattttg

SEQ ID NO: 1495 - DNA, 1395 bp, Fagopyrum esculentum
aaaactctctatcgcaactcttttcgccaactatctcttgaatcatgtcggctttcagaggcaaatacgctgatgagctcattgccaatgctacctacattggtacccctggcaagggtattcttgcagctgatgagtctactggaactattggcaagcgtctttcgagcatcaatgttgagaatgttgagagcaacagaagggctctccgtgagcttcttttcaccacccctggagctcttaagttcctcagtggtgtgattctctttgaggagaccctctaccaaaagactgctgacggcaagccttttgttgaccttttgaaggaaaacggtgttcttcccggtatcaaggttgacaagggtaccgttgaattggctggtactgatggtgaaaccaccactcaaggtcttgacggtcttgcccaacgctgccagcaatactacgcagctggtgctaggtttgccaagtggcgtgcagttctcaagattggcccaaccgagccatcccagctttccatcaacgagaatgccaacggacttgctcgctacgccatcatctgccaagagaatggtttggtgcccattgttgagccagagatcttggtcgacggatcccatagcattgagaggtgtgctgctatcacagaaaatgttctagccgcatgctacaaggctctcaacgaccaccatgtcctccttgagggaaccctgttgaaacccaacatggtcaccccaggatccgacagcccaaaggtctcacctgaggtgattgctgaacacaccgtccgtgccttgcagaggaccgtccccgctgccgtccctgctatcgtcttcttgtccggtggacagagtgaggagcaggccacaatcaacctcaacgccatgaacaagctccagaccaagaagccgtggtctcttaccttctctttcggacgtgctcttcaacaaagcaccctcaaggcctgggccggtaaggaggagaatgtcaagcatgcccaagaggtcttctacggaaggtgcaaggccaactccgaggcaactcttggcaagtacgagggtggtgctgcagtcgagggtgccaccgagtcccttcacgtcaaggactacaagtactaagcaagttttgttgagacttaattatatttgctgccaaggcattgcggattgtgcatcttttttatgttagtgttggatttgggcttatcggtttctaggatgttttcttaaaaataaaaacatgataaaaacttgtcttttgaaaatttcctttgaagagctgttgtatgttttcaagaccttgtgaacttgaaaatagagacttttcccccattgaaagggcattattgtttgtcaagtttatgtcatagatcacggaaagtgggtgacatgtttg

SEQ ID NO: 1496 - DNA, 1362 bp, Silene vulgaris
tcaacctaacaatcttcaccatgactgcttacagaggcaaatacgctgatgagttgattgccaacgctgcatacattgcaacccccggaaagggtattcttgctgctgatgagtctactggtaccatcggcaagcgatttgctggcattaatgtcgagaatgttgagaataacaggagggccctccgtgagcttcttttcaccacccctggtgccttcgagtacctcagtggtgtcatcctttttgaggaaactctctaccagaaatctgctgctggtaagccatttgtagagatcttgaaggaaggcggtgttctccctggtatcaaggttgacaagggtgtcgttgagcttgctggaaccgatggtgagaccaccacccagggtcttgatgaccttggcaaacgatgtgcccaatactattctgctggtgccaggttcgccaagtggcgtgctgtccttaagattggccccaccgagccatctgctctctcaatcttggaaaatgccaatggccttgctcgctatgccatcatctgccaggagaacgggttggtcccaattgttgagcccgagatcttggttgatggttcccacgacattgacaggtgtgctgaggtctcagagcgtgtccttgcagcttgctacaaggccctcaatgaccaccacgtcctactcgagggtaccttgttgaagccaaacatggtcacccctggctctgacagcaagaaagttgccaatgaggtcatcgctgagtacaccgtccgcaccttgcagaggaccgtcccaccagcagttcccggcatcatgttcctttcaggaggacagagtgaggaggaggcaactctcaacctcaacgccatgaacaagcttgagaccaagaagccatggacactatccttctcctacggacgtgcccttcagtcaagtaccctcaagacatggcagggaaaagaagagaatgtcggaaaggcccaagaagtcttccttgctagagccaagggtaactctgaggcaactcttggaaagtacactggtggggctggtggagctgactcctccgagtctcttcacattaaggactacaagtactaattatagtttcaaatccatcattgaggtgtgaagtttttacttcgagagaaataccatcaaaattcatagaatcagtgtgtgatagaccggcaatatgcctgctgtcttgttttttgttttattttttaggtttgttgacttgctaataatttgcttggaggacgtattgtttttgagacttggagaagagtactcaacctaaatactattgtggcattgtgttttgcactcaatatttcgcagctgaaaatgttcactctgcatcttt

SEQ ID NO: 1497 - DNA, 1156 bp, Brassica rapa
gaccaactcacatctctctctctcgtctgctttattccgcatctttttgatattctctctcgatcaatccgtcacaaaccatgtctgccttcaccagcaaatacgccgatgagttgatcgctaacgctgcctacatcggaacacccgggaagggtattctcgccgccgatgagtccaccggtaccatcggaaagcgtcttgcgagcatcaacgtcgagaacgttgagacaaacagacgtgctctccgtgagcttctcttcaccgcccctggtgctctcccttgcctcagcggtgtcatcctcttcgaggaaactctttaccaaaagagttccgatggaaagcttttcgttgatatcttgaaggaaggaggagttcttccaggtatcaaagtcgacaagggtaccgttgagctagccggaaccaacggtgagaccaccactcagggtctcgacggtctcggtgagcgttgcaagaagtactacgaagctggtgcacgtttcgccaagtggcgtgcggtccttaagatcggcgagaacgagccatcagagcattccatccacgagaacgcttacgggttggctagatacgctgttatctgccaggagaacggtcttgtgcccatcgttgagcctgagatcctcgtcgacggatcccatgacatccacaagtgtgctgccgtcactgagcgtgtccttgttgcttgctacaaggctcttagcgaccaccacgtcttgcttgagggaactttgttgaagcctaacatggtcacaccgggttccgacagtgccaaggttgcgccggaggttatcgctgagcataccgttcgttctcttcagagaaccgtcccaccggctgttccagctatcgtgttcttgtctggaggacagagcgaggaggaggcgaccaagaacttgaacgcgatgaaccagttgaagaccaagaagccatggtcattgtctttctccttcggacgtgcgttgcagcagagcactttgaagacatgggcgggtaaagaggagaacgtcaaggccgctcaagaggcgttgtatgtgaggtgcaaggctaactctgaagccacacttggaacttacaaaggtgatgctaagcttggtgatggagccgcggagagccttcacgtgaaggactacaagtactg

SEQ ID NO: 1498 - DNA, 1460 bp, Ricinus communis
tctttctgaaaactaaagaaacattcattaaacatgtcttgctttaagggaaagtatcatgatgaactgatagccaatgccacatacattggcactcctggaaagggaattcttgcagcagatgaatcaactggcacaattggcaagcgtcttgctagcatcaatgttgagaatattgagccaaataggcgtgcatttcgcgagcttcttttctgcactccaggtgccctggaatgcctcagtggcgtaatcctttttgaggaaacactttatcagaaaacagctgacggtaagctatttgttgacattctgaaaaagaatggtgttcttcctggaatcaaagtcgacaagggcattgttcagcttgccggaactaatgctgaaacctcaacccttggtcttgatggtctagctgagcgctgccagaagtattatgaggctggtgctcgatttgctaaatggcgagctgtgctaaaaattagttcaactgaaccatctcagcttgctattaatgagaatgctaatggcttggcacgttatgctattatctgccaagagaacggcttagtacctattgttgagccagagattttggttgatggatcccatgacattgattgttgcgcagatgtgaccgagcgtgtccttgcatcttgctacaaagcactcaatgatcaccatgtcctcctggaaggaactcttttaaagccaaacatggtcacaccaggttcagataactcaaaggtaaaacctgaagtgatcgctgattatacagtcagggcattgcagcggacggttcctcctgctgttcctgcaattgtgtttctttctggtggacaaagtgaggaggaagccactataaatttgaacgcaatgaacaaactcaagggcaaaaagccttggtctcttacattctcattcggccgtgctcttcagcagagtactctcaaggcatggggaggaaaggaggaaaatattaagaaagcacaggctgctttccttgtaagatgcaaagctaattcggaagctactttaggttcttacaagggtgacgctaaactgggagagggtgctgcggagagtcttcacgttaaggattacaagtattaatccctggaagaaggtctatttcaggttcctgatgtgaaggtcaactacttattctttctatctctatttaaatgagtaattacagagaatgaaagaaaatagacttttcttagttctttttcttctattttgccttttcaattgtaatggtgcaactgtgctgatatgctttttcagcatctagttgtgtgcctgatttgggatatgaattatataggagatttactttacaattaaagagtgctgatctattttcctccatcgttcagtttgttcctttggtttttcaccaagattttttgaataatattgaatttttttgccccactatatagcctggtcatttcaaa

SEQ ID NO: 1499 - DNA, 1546 bp, Actinidia deliciosa
attgtcgatgtttctcagccgctctctctctcttctcctttaaaataaaaccctaacccgcaccctttccatctctccctgtctgcctctctctctctaaaaactctctctccagatatcatcttcttcctctctacaactatgtcttgctacaagggaaagtaccatgatgagctcattgccaatgctgcctacattggcacccctggaaagggtatcctcgctgctgatgagtccaccggcacaatgggcaagcgtctttccagcattaatgtcgagaatgttgagtcaaacaggcgggccttccgtgagctcctcttcaccactcctggtgctcttgaatacctcagtggagtgattctctttgaggaaactctttatcagaagacctccgatggtaagccttttgttgagttgctgaaggaaaacggtgtcctgcctggaatcaaggtggacaagggtgttgttgtgcttcctgggaccaacggtgagaccaccacccagggtcttgatgaccttggcaagcgctgccagcagtactatgcagctggttgcaggtttgccaaatggcgtgctgtgctcaatattggcatcaccgagccatctcagcttgctatcaatgaaaacgccaacggtttggctcgatatgctatcatctgccaggagaatggcctggtccccattgttgagcccgagatcttggtagatggcaaccacagcatcgacaagtgtgccgatgttaccgaacgcgttcttgcagctgtttacaaggctctgaacgaccaccatgtcttgctcgagggaaccctgttgaagccgaacatggttacccctgggtcagaggcacccaaggtggcccctgaggtggtggcggagtacaccgttcgtgccctgcagaggacaatgcctgccgccgttccggctgtggtgttcttgtccggtgggcagagcgaggaggaggccacccttaacctgaatgccatgaacaagctcaagactaagaagccatggaccctcacattttcctttggaagggctcttcaggcgagtaccctgaaggcatggcagggcaaggtggagaatgtggagaaggccaaggctgtgttcctccaaaggtgcaaggccaactccgaggcaaccctcggaacctacaagggcagcagttcgttgagtgagggagcgtccgagagcctccatgtcaaggactacaagtactgattgattgagttttgctttccgcttggttattttttctcttttttgctgtggagatcatgtgatgacagtgtgcttgggtgggggcaggagtatcttcatccccaggtatcatggctttaggttcttttcttggttttcatttttatcgtgcttttagtgactggtagtagaataagaagcttgaggaacaaacgtcggcttgtttgaggttggatggtttcatcctttttggttttctaagaatattaatgttatcttttgaagttggtttccaagattattgtcccttctgtaaaaagttgctgctatggttttggatttctgttga

SEQ ID NO: 1500 - DNA, 2113 bp, Solanum tuberosum
gaactgatgggaagtatgcccaatcaagtcactatgaagggctggacaattctgctgggatagatatctcatttaaagcaagtggcaacttgggttcctccttcatcatcaactcctgttaaacactgctgctactatacgactatactacaacaaggactgtagctggtaaaaagagaaagtgtccatcagatatagttcctgcttcaggccagaactgcggggatagagagataattgatgctatggcagaagcgatgggggagatgattgctgcttcaaagtttcagacagttgtaatgcctcaagttgatggtagatttacaatccgtaaatgtatcaaagctttggatgagatagaaggcgttccagaaaatctttactatgcagctttggatttattcgacaatcccagtctaagggagatgttcatttgtcttaacagcagcagcatgaagctgacatggctgcaggggaaatgtactaatctttcttcatttatctagcctttccccctggtttacaattttagtggttgtacccattttatctagcgaatttttttggaaactgtatacataaattcctatggcctgcttgtagttaccagcatgggacaggtaaatagaatatagttaaggtagcagcatgcatttggagttttggtaaggcattggtggaaactaaagctttacatgttcatagagccccgcttagcaggttagcgattctattctcttgcaaagaatgttttgacctcgtgccgaattcggcacgaggtttctctcccaattttctcattctctctataaacttctctcactttcttcaaatctactttttttaagcttattaatcatgtcttgctacaagggaaagtatgctgatgagcttatcaagaatgctgcatatattggcacccctggaaagggtatccttgctgctgatgaatccactggaacaattggaaagcgtctctcgagcatcaatgtcgagaatgtagaatcaaacaggagggctctccgtgagcttctcttttgcacccctggttgtcttcagtatcttagcggtgttatcttgttcgaggaaacactctaccagaagactgctgctggcaagccttttgttgaagtcatgaaggaagctggagtccttcccggtattaaggttgacaagggtaccgttgagctccccgggaccgatggtgagaccaccacccaaggtcttgatggtcttgcagaacgatgccaaaagtactacgaggctggtgctaggttcgccaaatggcgtgccgtgttgaagattggtgccaatgagccatctcagcttgccatcaatgataacgccaatggccttgccagatacgccattatttgccagcagaatggtcttgtacccattgttgagcccgagatccttgttgatggagcccatgacattcagaagtgtgctgatgttaccgagcgtgttcttgctgcttgctacaaggctctcaatgaccaccatgtcctccttgaaggtaccttgttgaagcctaacatggtcactccaggttctgaatcccccaaggttgcaccagaagtgattgctgagtacaccatccgtgctttgcagcgcacaatgccacctgctgttcccgctgtggtgttcttgtctggtggacagagtgaagaacaggccaccgtcaacctcaacgccatgaacaagcttcagaccaagaagccatggtcgctttccttctcctttggacgtgctcttcagcagagtaccctcaaggcgtggggcggaaaagaagagaatgtgcagaaagcacaagctgcattccttaccaggtgcaaggccaactccgatgctacactcggaaagtatgccggagcttccaacttaagcgagggcgcttccgagagcctccatgtcaaggactacaagtactagatcaaagtttttagtttttatgttttttcttgatttctgttttgaaaatgagatgacaatatggttttacaaaaatgtctttatcggtggacataatgtgtaaggctttttttttaatttttcgtttaataaaaaacttttgagtaacaaacaatattggctttgtgatatcctcatg

SEQ ID NO: 1501 - DNA, 1310 bp, Solanum phureja
gcctaactttctctcccaattttctcattctctctataaacttctctcactttcttcaaatctactttttttaagcttattaatcatgtcttgctacaagggaaagtatgctgatgagcttatcaagaatgctgcatatattggcacccctggaaagggtatccttgctgctgatgaatccactggaacaattggaaagcgtctctcgagcatcaatgtcgagaatgtagaatcaaacaggagggctctgcgtgagcttctcttttgcacccctggttgtcttcagtatcttagcggtgttatcttgttcgaggaaacactctaccagaagactgctgctggcaagccttttgttgaagtcatgaaggaagctggagtccttcccggtattaaggttgataagggtaccgttgagctccccgggaccgatggtgagaccaccacccaaggtcttgatggtcttgcagaacgatgccaaaagtactacgaggctggtgctaggttcgccaaatggcgtgccgtgttgaagattggtgccaatgagccatctcagcttgccatcaatgataacgccaatggccttgcgagatacgccattatttgccagcagaatggtcttgtacccattgttgagcccgagatccttgttgatggagcccatgacattcagaagtgtgctgatgttaccgagcgtgttcttgctgcttgctacaaggctctcaatgaccaccatgtcctccttgaaggtaccttgttgaagcctaacatggtcactcccggttctgaatcccccaaggttgcaccagaagtgattgctgagtacaccatccgtgctttgcagcgcacaatgccacctgctgttcccgctgtggtgttcttgtctggtggacagagtgaagaacaggccaccgtcaacctcaacgccatgaacaagcttcagaccaagaagccatggtcgctttccttctcctttggacgtgctcttcagcagagtaccctcaaggcgtggggcggaaaagaagagaatgtgcagaaagcacaagctgcattccttaccaggtgcaaggccaactccgatgctacactcggaaagtatgccggagcttccaacttaagcgagggcgcttccgagagcctccatgtcaaggactacaagtactagatcaaagtttttagtttttatgttttttcttgatttctgttttgaaaatgagatgacaatatggttttacaaaaatgtctttatctgtggacataatgtgtaaggcttgttttttaatttttcgtttaataaaaaacttttgagtaac

SEQ ID NO: 1502 - DNA, 1423 bp, Thalictrum flavum
attgccaatgctgcttacattggcactcttggaaagggtatccttgctgctgatgagtccacaggcacaattggcaagcgtctagctagcatcaatgttgagaatgttgagactaacaggcgtgccctacgtgaacttcttttctgcacacctggtgctcttcaatacctcagtggtgtcatcctctttgaagagactctctatcagaagactgctgatggtaaaccatttgtagaagtcctgaaagaaggtggagtcctccctggtatcaaggttgacaagggtactgttgaacttgctggtaccaatggtgagactacaactcaggggcttgatgggctcgcccagcgatgccagcagtattatgcggctggtgctaggtttgctaagtggcgtgctgtgcttaagattggtcccactgaaccatctcagttggctatcaatgagaatgccaacggactggccaggtatgctatcatttgtcaggagaatggattggtcccaattgttgagccagagatccttgttgatggttctcacgatattgaccgatgtgcggatgtgacagagcgtgtactagcggcctgctacaaggcactcaatgaccaccacgtcctacttgagggaactttgctgaagccaaacatggttacccctggttctgaggctaaacaagtcgccccagaggtagtagctgagtacacagtccgtgccttgcagcgaacaatgccttcagcagttcctgctgtggtgttcttgtctggtggacagagtgaggagcaggccacactgaacctaaatgcaatgaacaagcttaagggaaagaaaccatggtcgctctcattctcctttgggcgtgctttgcagcagagcactctcaagacctgggccggtaaagaggagaacttggaaagggctcaggctgctttcctttcaaggtgcaaggcaaactctgaagctacccttggtatttacaagggtgatgctgcacagggagaaggtgtttctgagagcctgcatgtcaagggctacaaatattaacggtcgcactcaagtctacgagggggtttctgctatgtttacgagttaagtaggtgagggatggatcggagttgagtttcctatgctatagatatgtcaatatttcttgcttttgacaaaaaaaaggtatgatggtgcaataagttgttgcttaggcttgtgtctgttatgtgagtgtttctttttaatagtaaaatagcttaatatgcagttgtttctgacgttgttctggtttttggaaggttattaacctatggcaagttggcaacttgcttatttgtctgctgtgtaagactgtgggattgtaggctagtaacatgatgtagttccctttaccctgattgcttaattcgctgaatgatggctttataatagcgacccc

SEQ ID NO: 1503 - DNA, 1354 bp, Trigonella foenum-graecum
cccatttaacacaaacccctctttttctctcaaaatctctctatacacaccatgtcttccttcaagagcaaatatcaagatgaactcattgccaatgctgcttacattggcagcccagggaagggtatccttgctgctgatgagtcaaccggtacaattggaaagcgtttggccagcattagtgttgagaatgtcgaaaccaacaggcgtgccctccgtgaacttctgttcaccacccctggagcttttgggtgcctcagtggtgtgatcttgtttgaggaaaccctataccaaaagacagctgcaggaaaaccattcgtagagttgttgaaggaaggaggagttcttcctggtattaaggttgacaagggcactgtagagcttgccggaaccaatggggaaaccaccactcaaggtttggacggccttggtcaatgttgccaaaagtactatgaagctggtgcccgatttgctaagtggcgcgctgtccttaaaattggccctaatgagccatccgagcttgctatccatgagaacgcctatggcctggctcgctatgctgtcatatgccaagagaatggcctagttcctatagtggagcccgaaatcctagtggatggatctcatgacatcaacaagtgtgctgaggtgaccgaacgtgttctagctgcatgctacaaagctttgaatgatcaccatgttctgctcgaaggcactcttttgaagcctaacatggtcactcctggttcagattctccaaaggttgcccctgaagttatagccgaatatactgtcaaagctttgcagcgaaccgttccagctgcagttcctgctgttgtgttcttgtctggtggacagagtgaggaacaggcaacactgaacctcaatgcaatgaacaagtttaagggaaagaagccatgggcactttctttctcttttggaagagcacttcagcagagtactctcaaggcatgggccggcaaagatgaaaacattaagaaggctcaggatgcattcatctctaggtgcaaggcaaactcatgtgcaacttggggaatctatgaaggtgatgctacccttggtgaaggtgcctctgagtctctccatgtcaaggattacaaatactaagtttcttttgcagaggtttttttatcatcaaatttattagagctatatgaattaaagaataataactccaagctattttggcttggtatcggccctttaacactttggtttggcttattcttttctctctgattgagtttttccctttgttattgttaagtgacatttcttgtttaaatttgatctgaaaacattttgttagctgcatatgcataaagctatttaa

SEQ ID NO: 1504 - DNA, 1362 bp, Vinca minor
cagttttcttcttctagtttacatctccaatcatgtcttgctacagaggagaatacgccgatgagctcattgccaatgctgcttacattggtacccctggaaaaggtatccttgctgctgatgaatcaaccggcactattggcaagcgtctatccagcatcaatgttgagaatgttgagacaaacaggagagctctccgtgagctcttgttcaccacccctggttgccttcagtacctcagtggtgttatcctctttgaggaaaccctttatcagaagacagctgctggtaaaccttttgttgatgtaatgaaggaaggtggagtcctccccggaattaaggtggataagggcactgttgagcttgctggcactaatggtgagatcaccactcaaggtcttgatggtcttgctgagcgatgcaagcaatactacaaggctggtgccaggttcgccaaatggcgtgctgtgcttaagattggacccagtgaaccatctcagctagctatcaatgacaatgccaatggcttggctcgctatgcaattatctgccaacagaatggcttggtcccaattgttgagcctgaaatacttgttgatggttcccatgatattaacaagtgtgctgatgtaactgagcgtgttcttgctgcatgctacaaggcattgaatgaccatcatgttctccttgagggtacacttttgaagcccaacatggtcactccaggatcagactcacctaaagtttcccctgaggtcattgctgaacacacagtccgtgctttgcagcgcaccatgcctcctgcagttcctgctgtggtattcctctcaggtggacagagtgaagaggaggcttccgtcaacctcaatgccatgaacaaacttcagaccaagaagccatggtctctttccttctcgtttggacgtgccttgcagcagagcactctcaaggcttgggctggaaaggaagaaaatgttaagaaggcacaggaggtattccttgccaggtgcaaggccaattctgaagctacccttggaaagtatgctggtggtgcttctggtgctgctgcttctgagagcctccacgttaaggactacaaatattaagcttttggtattgtattctttcagtttcattgttttggagagagtgcaggttgggcacaagaatgtttaccaccaccggatttagtatttttggatttcgctttttaattttaaacttgttaaataagcgctcttgaggaaggtattccctgaaagttggtacctcgtttgtgatgtttttaccctgtggtgatcgacttcgtgaatgacaccaagtagcttttcttattagggtgtgtttgtttctgaattggtt

SEQ ID NO: 1505 - DNA, 1491 bp, Arabidopsis thaliana
attagagatccaacggctgaaaaagctatttcttggggaacatgcaaagatctgacccttaattaatattttcaccaaccaatagactctcatccgcagctataaaaccaacccttttcctctactggtccaccactcgtctgccttcttccgcatctcttttaatttctctctaatttctcgatctctccgtccaactatgtctgccttcaccagcaaattcgccgatgagttgatcgccaacgctgcctacatcggcacacctggaaaaggtattttggctgctgatgagtccactggtaccatcggaaagcgtcttgcgagcatcaacgtcgagaacgttgagaccaacagacgtaacctccgtgagcttctcttcaccgcccctggtgctcttccatgcctcagcggtgtcatccttttcgaagagactctgtaccaaaagagttccgatggtaagcttttcgttgatatcttgaaggaaggaggagttcttccaggtatcaaggttgacaagggtaccgttgaactagctggaaccgacggtgagaccaccactcaaggtcttgacggtctcggtgacagatgcaagaagtactacgaagctggtgctcgtttcgccaagtggcgtgcagtcctcaagatcggagagaacgagccatctgagcattccattcatgagaacgcttacggattagctagatacgctgttatctgccaagagaacggtcttgtaccaattgtcgagcctgagatcctagtcgatggatcccatgacatccagaagtgtgctgccgtgactgagcgtgtccttgcagcttgctacaaggctcttagcgaccaccacgtcttgctcgagggtacactcttgaagcctaacatggttactcccggatctgacagccccaaggtttcacctgaagtcatcgctgagcacaccgtccgtgcccttcagagaaccgtcccagcagctgttccagccattgtcttcttatctggaggacagagcgaggaagaagctaccaggaacttgaacgccatgaaccagttgaagaccaagaagccatggtcattgtctttctcattcggacgtgcgttgcagcagtctaccttgaagacatgggcaggtaaagaggagaatgtcaaggcagctcaagaggcgttgtatgtgaggtgcaaggctaactctgaagccacactcggaacctacaagggtgacgctaagcttggtgatggagcagctgagagccttcacgtgaaggattacaagtactgagcatcgtccacgggttgaattgtgacgtttgtcatcttcctggatatatttctagggatttttcgtttttctacttgacattatcggattataagtgttttttcttcattttccttttggatttgtgttttgattttgattgggttttgttttttagaattgagtattttaaaaacacgcccaaataaaaaagtcatttgaggttatttctgttg

SEQ ID NO: 1506 - DNA, 1286 bp, Brassica napus
atccaattttcttcaacagaccatggcttctttcaccagcaaatacgccgatgagctgatcgctaacgctgcctacatcggcacacccggaaagggcatcctcgcagcagacgaatcaaccggcacaatcggaaaacgtctctctagcatcaacgtagagaacgtcgagtccaacagacgcgctctccgtgagcttctcttcaccactccaggcgcacttccttgtctaagtggcgtcatcctattcgaagaaactctataccaaaaaagctccaaagggacgccttttgtggatattctgaaggaaggaggagtcttacctggcatcaaagtcgacaagggcaccgtttctctacccggaaccaacggtgagaccaccacacaaggtctcgacggtctcggcgagcgttgcaagaagtactacgaggccggtgctcgtttcgccaagtggcgtgcggtgctcaagatcggccccaacgagccatcagagctagccatccgcgagaacgcttacgggctcgctagatacgctgccatctgtcaggagaacggtcttgtccccatcgtggagcctgagattctcgttgacggttctcacgatattcagaagtgcgcggaggtgacggagcgtgtcttagcagcttgctacaaggccctgagcgatcaccatgtgatgctcgaaggaacgcttctgaaaccgaacatggtgactccagggtcagagagtggtaaagttgcgccggaggtggtggcggagtatactgtccgtgcgctgcagaggacggtgcctgcggctgttccggctgtggtgttcttgtcgggagggcaaagcgaggaagaggcgacgaggaacctgaacgcgatgaaccagctgaagactaagaagccttggtcgctgtcgttttcgtttgggagggcgttgcagcagagcacgttgaagacttggggagggaaagaggagaatgtgaagaaggcgcaagaggcgttcttggtaaggtgcaaggctaactctgaggctacgcttggtgtttacaaaggtgatgctcagcttggtgaaggtgcagcggagagccttcacgtcaaggactacaagtactaaaggatgagtctaaggatctgtagtttttcatatcatcgtttgtgtttgtgttaccttttcagtgttttgtgtatttgtgttttgtttaaaagagcggtaaaatgaaagatcctttgataaaccttttttctgaggtgtcttgtttctcttgaaaccttttatgaagtgaatgttttggattgaaagc

SEQ ID NO: 1507 - DNA, 1107 bp, Manihot esculenta
tcattgaatttttccttttcttttttgcccttcaaaatgctggtgcagatgaactgattgccaatgctgcttacattggcacccctggaaagggaatcctggcagcagatgaatcaactggcacaataggcaagcgtctagctagcatcaatgttgagaatgttgagtctaataggcgagcttttcgcgagctcctattctgcactcctgatgtccttcagttcctcagtggtgtaatcctttttgaggaaacactttaccagaaaagaactgatgggaagccctttgttgacattctcaaggaagggggtgttcttccaggaatcaaagttgacaagggaattgttgagcttcctggaacaaatggtgaaacctcaactctcggacttgatggcctagctgagcgctgtcagaagtattatgaagctggggctcgatttgctaaatggcgagctgtgctaaagattggtccaactgaaccatctcaactttctattaatgagaatgccaatggcttggcacgttatgctataatttgccaggagaatggcttagtacctattgttgagcctgagattttggtggatggatctcatgatattaatcgctgtgcagatgtgactgagcgcgttctcgcagcttgctacaaagcattaaatgatcaccatgttcttctggagggaactcttttgaagccaaacatggtgacccctggctcagatagcccaaaggttaaacctgaagtgatagctgagtatactgtcagggctctgcagcgaacagttcctcctgctgttccagctattgtgttcctttctggtggacaaagcgaggaggaagccactatcaatttgaatgcaatgaacaaactcaagggcaagaaaccctggtcccttacattctcttttggccgtgctcttcagcagagcaccctcaaggcatgggcaggaaaggaggaaaatgtaaagaaggcgcaggctgctttccatgtgagatgcaaagctaattcagaggctactttaggttcttacaaaggggatgctaccctgggagaaggtgctgcagatagtcttcatgtgaaggattacaagtactaagccttgacgg

SEQ ID NO: 1508 - DNA, 1382 bp, Lactuca sativa
cggggtacatttcttctctctactttcaccaaaatcttccccattttttcaaatcttacgaccatgtcttgctacagaggaaagtatgctgatgaacttattgccaacgctacctacattggaactcccggaaagggtattctcgccgccgatgagtccaccggcacaatcggaaagcgtctgtcaagcatcaacgtcgagaacaacgagtccaacagaagagccctccgcgagcttcttttctgcactcccggtgccctccaatacctcagcggagtcattctcttcgaagaaactctctaccaaaaaaccgccgccggtaaaccctttgtcgacgtcatgaaggaagccaacgtcctccccggaatcaaagtcgacaagggcaccgtcgaactcgccggaaccgacggcgaaaccaccacccaaggtctcgacggcctcgcccagagatgcgcacagtactacgccgccggcgccaggttcgcaaaatggcgcgctgttcttaaaatcggcccaaacgaaccatcacagctcgccattaacgaaaacgcaaacggattagcaaggtacgcaatcatctgtcaagaaaacggtctagtccccattgttgaaccagaaatcctcgtcgacggatctcacgacatcaacaaatgcgctgacgtcaccgagcgtgtcctcgccgcctgctacaaagctctcaacgaccaccatgttcttctagaaggcacccttctgaaacccaacatggtcacacccggctccgacgccaaaaaggtcgcaccggaagtcgtggcggagtacaccgtcagagctcttcaacgcaccatgccaccagctgtcccggcggttgtcttcctctccggcggccagagcgaggagcaagccaccgttcacctcaacgcgatgaaccagttcaaaggaaagaagccatggagtttgactttctcattcggtcgtgctttacagcagagtactttgaaggcgtggggaggaaaagaagagaatgtgaagaaagctcaagaagcttttcttgcaaggtgtaagggaaattccgaagctacccttgggaaataccagggaagtgctgcttttgaaggggcttctgagagtcttcatgttaaggactacaagtactgaaaagggtttattggtaatttacaccgattattgtgtttttatgttttgtgaaaggtatgggaatttttctttgtcttgtgaaaggggtgtttagtgttttatacccttgaaatactttttaggtttttatgtttatgtttttggtttttagtgttggtctaagcttaggagctatggctgaaaataagcttgaaaaatgtcttgcattggttgaggttgatggaattttaaacggtttaaaatag

SEQ ID NO: 1509 - DNA, 1707 bp, Lotus japonicus
ctcctttctcatattgtcttctctgcttttgaaacaccctcacaaaccaaagccttctcattcttctgtgatctcacaaagccaccaaaagccaccatgtctgccttcaagagcaagttcgaagatgaactcatagccaatgctgcttacattggctctcctggaaagggtatccttgctgctgatgagtccacaggcacaattggcaagcgattcgacagcatcaaagtggagaatgttgaatcaaataggcgtgctcttcgcgagctcctattcacggcccctgggtgtgtagagtgcctcagtggtgttatcatgtttgaggaaaccctgtaccaaaagactgcttcaggaaaactctttgtggacgtgttgaaggaagctaatgttcttactggtattaaggttgacaagggcactgttgaacttgctgggacaaatggagaaaccaccacacagggtttagacgaccttggcaagcgctgccagaagtactacgaagctggtgcacggtttgctaaatggcgtgccgttttgaaaatcggtccaaacgaaccatctccattgtcaatccatgaaaatgcatacggtttggctcgatacgctgccatatgccaagaaaacggcttggtccccattgtggagcctgagattctggtggatggatctcatgacatcaacatatgtgctgatgtaaccgagcgcgttctcgcagcatgctacaaggcgctaaatgaccaccatgttcttcttgagggcacccttttgaagcctaacatggtgacaccaggatcagattctccaaaggttgctccggaggtgattgctgagcacacggttcgagccttgttgagaactgttcctccagcggttccggcgatagttttcttgtctggagggcagagcgaggaggaggcgaccgtgaacctcaacgcgatgaacaagctcaaggggaagaagccttggtctcttacattctcctttgggagggcacttcagcagagcactctcaaggcttgggctgggaaggaggaaaatgttgaaacggctcaggctacattcctcaccaggtgcaaggcgaactcagaagcaactcttggaagttacaagggtgatgctaaccttgctgagggtgcctcagagtctctccatgtcaaggattacaaatactgatactaagatggagtgagcttctaattgtacttgtttttgtgttgtttgcactgttggcattcaaggctatggtgatcttttgtaggtttagaaattagagtcacttttttgcttcccatgctcagtcaatggagggttcatggtccaagcaagaataatggctttcaagttgcatctgcattggcttgatcagcatttacttttcagcaacgatgagcctgcttggtttaacattgaaaagtatgaaagcgaaaataacacatctcgttttcataatttctaacggtaaaccaaacaagctcgttagttgtatctgtacactttcgacattacacatttttcaagttagtttctttttgtataataaaatgagaaatacccttctaagtgcactatttttatttctatttctctctagttttccaagcaagtaggtgtgacataaaagtgtaaagaagaaaacagtgtggaaatagcatttctctttatttttgcccctctttaattcagtttcctttttggcttttccccatt

SEQ ID NO: 1510 - DNA, 1252 bp, Artemisia annua
atctcgtcctctctacccgctactcgcccccgctctccgaccgcagccgagatcatgtcttgctacaagggaaaatatcacgacgagctcatcgccaatgccgcctacatcggcactccgggcaaggggatcctcgccgccgacgagtccaccggcaccatcggcaagcggttcgcggccatcaacgtcgagaacgtcgagaccaaccgccgcacctaccgcgagctccttttctgcacccccggagccctccagtacctgagcggcgccatcctcttcgaggagacgctgttccagaagaccgccgacggcaagcccttcgtcgaggtcctccaggagggcggcgtcctccccggcatcaaggtcgacaagggcaccgtcgagctcgccgggaccaacggcgaggccaccactcaggggctcgacggcctcgcccagcgctgccagcagtactacgccgccggcgcccgcttcgccaagtggcgcgccgtcctcaagatcggcgcggccgagcccagccagctcgcgatcaatgagaacgccaacggcctggctcgctacgccatcatctgccaggagaacggcctggtcccgatcgtcgagcccgagatcctcgtcgacggcgaccacgacatcgaccgcagcgctgacgttacggagcgcgtgctcgcggcttgctacaaggcgctcaatgatcaccacgtgctcctggaagggacgcttctgaagccgaacatggtgactcccggatcggattccgccaaggtgccgccggaggtggtggcggagtacaccgtcagggctctgcagcggacggtgccacctgcggtcccgggtatagtgttcctctccggagggcaaagcgaggaggaggcaacggtgcatcttaacgcgatgaacaaaattgaaggtaaaaaaccatggacgctcacgttctcttatggaagagcgcttcagcagagcaccctgaaggcgtaggccgggaaggaggagaatgtggagaaggcgagggaggcttttctggcgaggtgcaaggccaactctgaggctactttgggggcttacagcggcgatgctggttcggtcgaaggtgcttcagagagcctccatgtgaaggattacaagtattgagtactgagtacgagtgattttattgcttctctttttgttcgttctgttcttaatagttgcttcacaaacaccaactgtcgggcaagcagatcataatcaattgtccaatttttgtttactg

SEQ ID NO: 1511 - DNA, 1169 bp, Arabidopsis lyrata
ccgtcgccgccgcatcttttatccagaatgtcgtgcttcaaatccaaattcgccgatgagctcatcgccaatgccgcttacatcggtacaccagggaaaggtattctcgctgctgatgaatccacaggaacaatcggaaaacgtttcgcaagcattaacgttgagaacgttgaatcaaacagacgtgctcttcgtgagctcttgttcaccactcctggagctctccaatacatcagtggtatcatcctcttcgaagaaactctctaccagaaaactgcttcagggaaaccatttgttgatgtaatgaaggaagctggagtgcttccaggtatcaaagtcgataagggaaccgttgagctcgctggtacaaacggcgaaacacaaccattggccttgatggacttggtgaccgttgcaagaaatactacgaagctggtgcacgttttgcaaagtggcgtgctgttctcaaaattggaaacgatgagccttctgagttggctatccatgagaatgcttacggtttagcaagatatgcagttatttgccaagagaatggtcttgtccccattgttgaaccagagattcttgttgatggatctcacgacattgagaaatgtgcttatgttacggaacgagttcttgcggcttgttacaaggctcttagtgatcaccatgtgatcttagaaggaacactcttgaaaccaaacatggttactccaggttcagacagtggttctaaagttaaaccagaagtgatcgccgagcacacggtccgtgctttacagaggacggttcctgcagcggttccagccgttgtgttcttgtctggaggacagagtgaagaagaagcaactgtgaatctaaacgctattaatcagctcaaagggaagaaaccatggagcttgacgttttcgtatggacgtgcgctacaacagagtacactcaaggcttggggaggtaaagaggagaatgttgagaaggctcaaaaggcgttcttggctagagctaaggctaactctgaagcaacccttggtggctacaagggtgatgctcagctcggtgaaggtgcttccgagagccttcacgtcaaagactacaaatactagaaggttatttttggaatttcaatattttttggagttttggttttattgtactgattatataat

SEQ ID NO: 1512 - DNA, 1355 bp, Distylium racemosum
aacggcggtagcgtttggtttgcgcaattgccgaaggagagaagaaagttgactaagtgtttgacaaaatgtcggcatactgcggaaagtacacagaggagctcatcaagactgccaagtatattgcaactcctggcaagggtattcttgcagcagatgagagtactggcactattggcaaacgcctggcaagcatcagtgtcgagaatgtagaggccaatcgtcaggcacttcgacaattgctcttcacaagtcctggtgctctccagtatataagtggagtcatactttttgaagaaactctttaccagaaaactgttggcgggaagccttttgttgatgtccttcaggaaggaggagtaatacctggtatcaaggtggataagggaactgttgagttggctggtacaaatggggaaacaaccacacagggacttgatggccttgctcagagatgccaacagtattacaaagctggtgcaaggtttgccaagtggagggcagtgctaaaaattggcccagctgagccttcagagctttctattcagcagaatgctcatggcttagcccgctatgccataatttgccaagagaacggtcttgttcctattgtggaacccgagattttgactgatggacctcatgatatcaaaaaatgtgccgaagttactgaaaaggttcttgcagcttgctacaaagctttgaatgatcatcatgtccttttggagggcactcttctcaagccaaacatggtaactcctggttcagatggtcctcaggttcctccagaggtaatagctgagtatactgtaaaggcattgcagaggactgttccagttgcagttcctggcattgttttcctctctggtgggcagagtgaagagcaagccaccttaaacttgaatgcaatgaataaactcgacactattaagccatggacattgtcattttcctttggacgagcactgcagcagagcacccttaagacatgggctgggaaaaaggagaacgaggaagcagcacaaaaggcatttcttgtccgttgcaaggccaactctgaatcaactctgggtaaatatgggggaggttctggcgctggcgctgcctctgagagccttcatgttaaagattacaaatactgaacatgtttcaattggactctgcagcaccaactaattgtacatgcacctctcttcatcgagctgttgactgcatgtgatatcaaatgtagcaacgtagcattttattatggaattttaactgtcatattatctgcaagtactagatgagtaggtgatatgaacagtccttcctttagagaagagattaatttgaagggtggtcatttttcctac

SEQ ID NO: 1513 - DNA, 1429 bp, Olea europaea
gtacttgtatttcttacatcttacctaacattttcttttctctgtaattcttcgattttcttcgttttgaacccagagtaatcatgtcttgctacaagggaaagtacgctgacgaacttattgccaatgctgcatacattggtagccctggaaagggtatacttgccgctgatgagtctactggcacaattggcaagcgactagctagcatcaatgttgagaatgttgagaccaaccgaagggctctacgcgagcttctcttcaccgctcctggtgttcttcaatacctgagtggagttatcctttttgaggaaactctataccagaagactgctgcaggtaaaccttttgtcgatgtcttgaaagagggtggtgtcctcccgggaattaaggtcgataagggtactgttgagcttgcgggaaccaatggtgagaccaccactcaaggtctcgatggccttgcccaacgttgccagcagtattataaagcaggtgctagatttgctaaatggagagctgtgctcaatattggtgccaatgaaccatcacagctcgctatcaatgaaaatgccaatggtttagcacgttatgcaatcatatgccaagaaaatggtcttgtccccatagttgagcctgagatccttgttgatggttctcatgacattaacaagtgcgctgatgtgaccgagcgtgttcttgctgttgtctacaaggcactcaatgaccaccacgtcctccttgagggaactttgttgaaaccaaacatggtgactccggggtccagttcacccaaggttgcaccagaagtgattgctgagcacactgtccgtgccttgcaacgtacaatgcctcctgcagttcctgccgtggtgtttttgtctggtggacagagtgaggaggaggccacgctgaaccttaatgccatgaacaaactgaagaccaagaagccatggaccctctccttctcatttggacgtgctctccagcagagcacactcaaggcttgggcggggaaggatgaaaacatcaagaaggcgcaggatgctttgcttacaaggtgcaaggccaactcggaagcaaccctgggaacttaccagggtggtggtgcattgagcgagggtgcctccgaaagccttcacgtcgataactacaagtactagtggactctttgcttccttggattttctacttaattgttgagaaagtgataggcgaatagccttcagccgggttctcaattttcttattacactatctatattttctagcctcgttttaataagctttagaaacaccaaaatgttgagatttgatggcattgtaccaatgacaggtctctttgcatttgctgctgttagctgtttttaggtcgagcttgtctgtttttgttttattgggtccgtctttggtcgtttatttaggtaaacgg

SEQ ID NO: 1514 - DNA, 1442 bp, Coffea canephora
cggccgggggatttctcgagcgtctgcgtctttcttttcctctctccgctatagcaactctctcgctgtcgatttcttcctccgccttccttagataattttgcaaacatgtcttgctacaagggcaaatacaccgatgagcttattgctactgccaactacattggcacccctgggaagggtatccttgccgctgatgagtcaactggcacaattggcaaacgtctatccagtatcaacgtggaaaatgtagagtctaataggagggctcttcgtgagcttctgttcacaactcctggtgcccttgaatgtctcagtggagttattctctttgaggaaacactctaccagaagagtgctgctggcaagccttttgtggatgtgttgaaggagggcggagtcatccctggaattaaggttgacaagggtactgttgagcttcctggcactaatggtgagaccaccactcagggtcttgatggtcttgctcagcgttgccagcaatactatacagctggtgctagatttgccaaatggcgcgctgtgctcaagattggccccaatgaaccatctcagctcgccatcaatgaaaatgccaatggcttggcccgttatgctatcatctgccagcagaatggcctggtgcctattgttgagccagagatccttgtggatggatctcatgacattgaaaagtgcgctgatgtcactgagcgtgtgctcgctgcagtttacaaggcattgaatgatcaccacgttcttcttgagggaacccttttgaagcccaatatggtgactcctggatctgaagcccctaaggttgcgccagaggtgattgctgaatacactgtcagggcattgcagcgcaccatgccagctgctgttcctgctgtggtgttcctgtccggtggccagagtgaggaggaagctactcgtaacctgaatgccatgaacagactgaagacgaagaagccatggtcccttaccttctcatttggacgtgctttgcagcagagcaccctcaaggcttgggctggaaaggaggaaaatattcccaaggctcaggctgcattcctttcaaggtgcaaagccaactctgatgctaccctggggaagtacgagggtggtgcctcattgggtgagggtgcttctgagagcctccatgtgaaggactacaagtattagttcagtttttgtatctcttgttttctgctttgttttggagagtacattgcaggctaggggttctaagtttctctttgtcattttgcaatctaatcttatattagcagactggcttataataagctcgaggaacgatcgacaccgagtggaggtcgtttgccttttgtaatggtttttccttgttttaaagattggcttcgtgaattcagttgagcacctgttttctttttcatgataacttgaataatttagcagcg

SEQ ID NO: 1515 - DNA, 1434 bp, Medicago truncatula
ctttgttgtcttgtttctcaatccatcataatcactatatataaacccaaaacctcactttatttctcactctctctcactaccttattcttaacctaccctctttttcgttctcttccaaaacaaacctacctcgatcatgtcgaacttcaagagcaagtaccatgatgagcttatcgccaatgccgcctacatcggcacacctggaaaaggtattcttgctgctgatgagtcaaccgggacaattggaaagcgtctatctagcatcagcgttgagaatgttgaatccaacagacgtgctctccgtgaactccttttcaccgcccctggtgtccttcagtaccttagtggagtcatcctctttgaggaaaccctttaccaaagcaccgctgcaggcaagccttttgttgatgtcttgaacgaagctggtgtgcttcctggtatcaaggttgacaagggtaccgttgagcttgccggaactgatggagaaaccaccactcagggtcttgatggacttggtgctcgttgtgctaagtactatgaagctggtgcacgtttcgctaaatggcgtgcagtgcttaaaatcggccccaatgagccatctgagcactctatccacgagaatgcctatggtttggcccgatatgcagtcatatgccaagagaatggacttgtaccaattgttgagcctgagatccttgttgatggacctcatgacattcaaaagtgtgctgctgttaccgagaaggtccttgcagcatgctacaaggccttgaatgaccaccatgtcctccttgaaggcactctcttgaagcctaacatggttacccctggatctgatgcaccaaaggttgcacccgaggttgttgctgagcacaccgttagagctttgcagagaaccgtacctgctgcagtcccagctgttgttttcttgtctggtggacagagtgaggaagaggccagcgtcaacctcaacgccattaaccaagttaatggtaagaagccatggaccctttccttctcttttggaagggcacttcaacagagtaccctaaaggcatggtctggaaaagaagaaaatgtgaaggctgcacaagaagctttgttgacaagggctaaggctaactctgaggctactcttggaacttacaagggtaactccaaacttggtgctggtgcctcagagagtcttcatgttaaggactacaagtattgatgagtcaaagttggtgtctcttttgaagactagaaaaagggtttattttgttgttattttgagtattgtggtttgacttgcgagacagaataattggttggagttttatctttttgttttctttttgttcttttgataatttcaggttcagtgtacttggtccaacccgagcaaaagggttattataaaacactatttcgaagtgaagttcttttttc

SEQ ID NO: 1516 - DNA, 1532 bp, Medicago truncatula
acttgtcttctctactttccaaacatcacacaacaaaacaaaacaaactattctttttcttctctcatctcaaaagccactaacatgtcttctttcaagagcaaatatgaagatgaactcattgccaatgctgcttacattggctctcctggaaagggtatccttgctgctgatgaatctactggcacaatcggcaagcgattcgccagcatcaacgtcgagaatgttgaagcaaacagacgtactcttcgcgaactcctgttcactgcccctggttgtttagactgcctaagtggtgttatcttgttcgaagaaacactatatcagaaaaccgctgcaggagtaccctttgtggatgtgttgaagaaagctggagttcttcctggtatcaaggttgacaagggaaccgttgaacttgccggcacaaacggagaaaccacaactcaaggtttggatgaccttggtcagaggtgcaagaaatactatgaagctggtgcaaggtttgctaaatggcgcgccgtgctaaagatcggtccaaatgaaccatctcccttgtcaatccacgaaaacgcctatggtttagctcgttacgccgtcatatgtcaagagaatggtttggttccaattgtggagcctgagattctagtggatggaccccacgacattgcaaagtgcgctgatgtaacagaacgcgttcttgcagcatgttacaaggctctaagtgaccatcatgttcttcttgaaggtactcttttgaagcctaatatggttacaccaggatcagattctcctaaagttgctcctgaggttatagcccaacacaccgtccgagcattgttgagaaccgttcctgccgcggttcctgctatagttttcttgtctggtggacaaagtgaagaggaagcatctgttaaccttaatgcaatgaacaaacttaagggaaagaagccttggactcttacattctcttatggaagggcacttcagcaaagtactcttaaggcatggggtggaaaagatgaaaacattcctaaggctcaagctgcattgcttgttaggtgtaaagcaaattcagaagcaactcttggaacttatcaaggtaatgctaaccttggtgatggtgcttcggagtctcttcatgttaaggactacaaatactaatatgttaagagggttgtgaggctctgattgaacttgttttggagttgtatgcatcatggttatggtgctattttgtagggttacaatagtgtttgtttttgtttaggttggttgtggtaaagtatcaataatggcttcaagctgaactggcttgattggcatttatttttcaacatggttatgttatgtttaccctttttccatcacacatttttcacactactttttcattgtgtaataaaacaagagaaatatgcttcttaataccaaaagcgtgtgaaacaaaaaagtgtaaagcagaaagtggtgtgtaagaagcatttctatgtaacttttccccttttaattgagtttttttaggcctttcctcc

SEQ ID NO: 1517 - DNA, 1697 bp, Glycine max
gagacacgcacccaaaaccgaaccataacccaggtcgacgcttcgcgagtgcgcatcctaagacccacgtcttttttctctgttgtcgccgcctcaacgcaacatcattatcactatcactatatatatgtaaaccctactctactctcttttcacttgttcactttcttccaacctctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaaccaccactcagggtctagatggccttggtcagcgttgcgccaagtactatgaagccggtgcacgttttgccaagtggcgtgctgtgctgaagattggtcccaacgagccatctgagctggctatccatgagaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagcacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggctaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaattttgctttttgtttttcctagtgttccttcatatcaattttagtaattcggtgtattggtcaaacctgtgcaaacaggggaggggatgtaactttgttttcttgatagacaccaccaccttgctgttaacgaggctttgtgtttattttgcaattatctttctttgtgttttcatatttatatgtatgtgatattttctctaaattatttgttacaaaattttagataaacgttgctgataagtttcctaaaaataaatatatgcaattatcaatggc

SEQ ID NO: 1518 - DNA, 1533 bp, Malus domestica
ggcgagaaagtcgaagatcactcgagatacactgactgagagcaacgtgttccgcaaggccttggtctctgatataaaacataactccctcccaccgttttctcccatcttcctcctcaatctctcaaatccaaaacaaaccattcagtttccgttctctcttctgacgatcaacaatgtcggccttcaagggaaagtatcacgcatggattatggaatctggatcaatttatgtatcggtgatttcttactagccataaatgagctcattgctaatgctacctacattggtaccccgggaaagggtatccttgcagccgatgagtcaactggcacgattggcaagcgtttttccagcattggcgttgagaatactgagacaaacaggcgcgctctccgtgagctgctcttcaccactcccggtgccgtccaatacctcagcggagtcattctctttgaggagaccctctaccaaaagaccgctgctggtaagccattcgttgatgttttgaaggaaggtggtgtcctccctggcattaaggttgacaagggcactgtcgagcttgctggtaccaatggtgaaaccacaactcagggtctggatggccttggcgaacgttgcaagaagtactacgaagctggtgcccgatttgcaaaatggcgtgccgtgctgaagattggccccaacgagccatctcagctgtcaatcaacgagaacgccaatgggttggcccgatatgctatcatctgccaggagaatggcctcgttcccattgttgagccagagattctggttgatggatcccatgacattcaaaagtgtgctgatgtgaccgaacgtgttcttgccgcatgctacaaggcccttaacgaccaccatgtcctgcttgaaggaactctattgaagcctaacatggtgactccaggatctgatgcaaaaaaggttccacccgagatgattgccgagtacactgtccgtgccttgcagcgcaccatgcccgcagctgtccctgcggtggtgttcctctctggtgggcagagcgaggaggaggctaccatcaacctcaacgccatgaacaagttgaaggcgaataagccatggtctctttccttctccttcggacgtgcccttcagcaaagcactctcaaggcttggtcaggaaaggaagagaacgtgaagaaggcgcaggaggctttcctaaccagggccaaggccaactcggaagcgacattgggaaactacaagggtgatgccaagctcggtgaaggtgccgcggagagccttcacgtcaaggactacaagtattgattgatgatcgttctggattgctttattctttcagtagtctaggtctttttttttgttgaaactttattcgtataatctcggtcgtgatgagattattaccggatactagtaggttttgataaaagcttgaggaactatggcaagcatggaagagttttgtttgtttcatcaacttggttttggtttggagaaatttaaacctcttgtttatattctggttgatc

SEQ ID NO: 1519 - DNA, 1510 bp, Gossypium hirsutum
attgtgaatactgacagccttgtgcgtcctgcagggtgcgacactagcgcgatccaaagaatctcggcacgagaaaaagcctctttcctttctctcgttctttttcccgttcaatcatgtcttgcttcattagcaaatacgccgatgagttggctaaaaacgctgcttacattggcacccctggaaagggtatccttgctgctgatgaatccaccggcaccattggcaagcgtctttcaagcattaatgtagaaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaatgaaggtggtgtcctccctggcatcaaggtcgacaagggtaccgttgagcttaatggaaccaatggcgagactttcacccagggtctggatggccttgcacagcgatgccagaagtactatgaagctggtgctcgctttgctaaatggcgtgctgtccttaagatcagtgctaatgagccaaccgagcttgcaatccaagaaaatgccaacgggctagctatgtatgctgccatctgccagcaatgtggccttgtccccattgtcgaacctgaaattcttgttgacggatcacatggcattcaaaagtgtgctgcagtgacagagcgtgttcttgctgcttgctacaaggctctaaatgaccaccatgtcatgcttgagggtactcttttgaagcctaacatggtgacccctggttcggactccccgaaggttgccccagatgttattgctgagtatactgttcgtgccttgcagcgaaccgtccctgctgcagtcccagctattgtattcttgtctggtgggcaaagtgaggaggaggctactcttaaccttaatgccatgaacaagctccagaccaagaaaccatggtcactctcattctcatttggacgtgcccttcagcagagcactctcaagacctgggcaggaaaagaggagaatgtgaagaaggcgcaagatgctttgctcgttaggtgcaaggctaactcagaggccactttgggtacatacaagggtgatgctgagctttgtgagggtgctgcagagagccttcatgtcaaagactacaaatattaagaaattaggcttgtagtcaaatatgtgatgtttagaggagtaaatttcggtattgatattagggttctagtgtttttttcttcttcttcttttgagcttctgtcgttgctcatcgaatttagtctgtggaatcagacaaattacaaataaggtttgggaccctgtgtgctcgttgagtatttttggttttctgtttattttagtttaaaacaaaattctctgattaattgagtgtaagcccgcattgtgggacaaaaatgaccaagtataagcccttattctgttgattatttcttattgatttgcatttcatgatt

SEQ ID NO: 1520 - DNA, 1298 bp, Gossypium hirsutum
atgtcttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaacaggcgtgctccccgtgagctcctcttcactgctccaggagctcttcagtacctcagtggtgttattctcttcgaggaaaccctttatcaaaaaccgcttcgggcaagcccttcgttgatgttttgaaggaaggtggtgtcctccctggcatcaaggtcgacaagggtaccgttgagcttaacggaaccaatggcgaaactttcaaccagtgtctagatggccttgcacagcgatgccagaagtactatgaagctggtgcccgctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgacgcaaagattagtgagggtgctgcagagagccttcatgttaaggactacaaatactaagaatttagtcttgtggtctgtgtatcagagaaattttctgtattgatgatagacgtttagtgctgtttttgggggttgtccgtttcttctcatggaatttaggttgtgaaatcagactcaaataagcttggggggccttagttctcgctgagtgttcattggttttttgtttgcttcagtttaaaacaatattctcagcatatacaactgagtgtgctttgca

SEQ ID NO: 1521 - DNA, 1582 bp, Glycine max
gtcttctctgcttccgaaacaacacacaccaaattaacaaagccttctttttcttgtgtgatctcacaagcccctaaaggccaccatgtcttccttcaagagcaaattccaagatgagttgattgccaatgctagttacattggcaccccaggaaagggtatccttgcggctgacgagtcaacagggacaattgggaagcgtttggcgagcatcaacgtggagaatgttgaaacaaacaggcgcattcttcgtgagctcctattcactgcccctggttgtcttgagcgcctcagtggtgtcatcttgtttgaggaaaccctctaccaaaaatccgctgcaggagtacccttcgtggacatactaaagaaaggaggagttctcccgggcatcaaggtggacaagggaaccgtggagctcgccggaacaaacggcgaaaccaccacgcagggcctggacgaccttgctcagcgctgcaagaagtactacgaagccggagcaaggttcgccaagtggcgcgcagtgttaaagataggtccaaacgagccctctccgctctgtatccatgaaaacgccaatggtcttgctcgctacgccgccatctgccaagaaaacggcctcgtccccatcgtggagcccgagatcctctccgatgggccccacgacatcgcgaaatgcgccgacgtaacggagcgcgtgctggccgcatgctataaagccctaaacgaccaccacgtgctcctggagggcacgctgttaaagcccaacatggtgactcctggatccgaaagcgcacgtgtgaaggctgaggtcatagcggagcatacggtgagggcgctgcagaggaccgtgcctcctgcggttccggcgattgtgtttctctccggaggacagagcgaggaggaggcgacagtgaatttgaacgcgatgaatcagctgaaggggaagaagccctggtcgttgactttctcttatgggagggcgctgcagcagagcacgctcaaggcgtggggtggaaaggacgagaacatccccaaggcgcaaagcgcgttgctggtgaggtgcaaggcgaattctgaggctactcttggaacttacaagggggatgccacgcttggggaaggggcttctgagtctcttcatgttaaggattataagtactaagagagaggtgtgagattggttcttttggaatggaattgtttgtttctttgggcctgttttggatattcaagagtgtttttcaaaaaatttctactgaaaaggaaagaaattctccagaacacttctagcattgtttccagagaggctcaaattgtttttgtttgcattgttaaggatgttgatggtgctgttttgtaggtttctatgagtttgtttttggtttgagattctgggtcgtaggaggtaaagtgagaataataatgcctttagctgcattggcctgatcggcttttactctttgactatgttatttgtataattttttttttttgtttttcaattattacactgcttactttcttcttcctttttgtaataaaaaacaagtgaaaggtacttatgagtgcactgtttctctgc

SEQ ID NO: 1522 - DNA, 1578 bp, Glycine max
gtcttctctgcttccgaaacaacacacaccaaattaacaaagccttctttttcttgtgtgatctcacaagcccctaaaggccaccatgtcttccttcaagagcaaattccaagatgagttgattgccaatgctagttacattggcaccccaggaaagggtatccttgcggctgacgagtcaacagggacaattgggaagcgtttggcgagcatcaacgtggagaatgttgaaacaaacaggcgcattcttcgtgagctcctattcactgcccctggttgtcttgagcgcctcagtggtgtcatcttgtttgaggaaaccctctaccaaaaatccgctgcaggagtacccttcgtggacatactaaagaaaggaggagttctcccgggcatcaaggtggacaagggaaccgtggagctcgccggaacaaacggcgaaaccaccacgcagggcctggacgaccttgctcagcgctgcaagaagtactacgaagccggagcaaggttcgccaagtggcgcgcagtgttaaagataggtccaaacgagccctctccgctctgtatccatgaaaacgccaatggtcttgctcgctacgccgccatctgccaagaaaacggcctcgtccccatcgtggagcccgagatcctctccgatgggccccacgacatcgcgaaatgcgccgacgtaacggagcgcgtgctggccgcatgctataaagccctaaacgaccaccacgtgctcctggagggcacgctgttaaagcccaacatggtgactcctggatccgaaagcgcacgtgtgaaggctgaggtcatagcggagcatacggtgagggcgctgcagaggaccgtgcctcctgcggttccggcgattgtgtttctctccggaggacagagcgaggaggaggcgacagtgaatttgaacgcgatgaatcagctgaaggggaagaagccctggtcgttgactttctcttatgggagggcgctgcagcagagcacgctcaaggcgtggggtggaaaggacgagaacatccccaaggcgcaaagcgcgttgctggtgaggtgcaaggcgaattctgaggctactcttggaacttacaagggggatgccacgcttggggaaggggcttctgagtctcttcatgttaaggattataagtactaagagagaggtgtgagattggttcttttggaatggaattgtttgtttctttgggcctgttttggatattcaagagtgtttttcaaaaaatttctactgaaaaggaaagaaattctccagaacacttctagcattgtttccagagaggctcaaattgtttttgtttgcattgttaaggatgttgatggtgctgttttgtaggtttctatgagtttgtttttggtttgagattctgggtcgtaggaggtaaagtgagaataataatgcctttagctgcattggcctgatcggcttttactctttgactatgttatttgtataattttttttttttgtttttcaattattacactgcttactttcttcttcctttttgtaataaaaaacaagtgaaaggtacttatgagtgcactgtttct

SEQ ID NO: 1523 - DNA, 1047 bp, Glycine max
gatgagttgattgccaatgctacttatattggcaccccaggaaagggtatccttgcagctgatgagtcaaccggcacaattgggaaacgtttggcgagcatcaacgtggagaatgttgaaacaaacaggcgcattcttcgtgagctcctattcactgctcccggttgtcttgagtgcctcagtggtgtcatcttgtttgaggaaaccctctaccaaaaatcagctgcaggagtacccttcgtggacatactgaagaaaggaggagttctcccgggcatcaaggtagacaagggcaccgttgagctcgccggaacaaacggcgaaaccaccacccaaggcctcgacgacctcgcccagcgctgcaagaagtactacgaagccggcgcaaggttcgccaaatggcgcgcagtgttaaagataggtccaaacgagccctctccgctctccatccacgagaacgccaacgggcttgctcgctacgcggccatctgccaagaaaacggccttgtacccatcgtggagcccgagatcctctccgatgggccccacgacattgcgaaatgcgccgacgtaacggagcgtgtgctggccgcgtgctacaaggccctaaacgaccaccacgtgctcctcgaaggcacgctgttaaagcccaacatggtaacccctgggtccgaggcggcacgtgtgacggctgaggtcatagcggagcatacggtgagggcgctgcagaggaccgtgcctcccgcagttccggcgatcgtgtttctctccgggggacagagtgaggaagaggcgacggtgaatttgaacgcgatgaatcaactgaaggggaagaagccgtggtcgttgactttctcttatgggagggcgctgcagcagagcacgctgaaggcgtggggtggaaaggacgagaatatccccaaggcgcagagcgcgttgcttgtgaggtgcaaggcgaattcggaggctactctcggaacttataagggggatgccacgcttggggaaggggcttctgagtcacttcatgttaaggattataagtac

SEQ ID NO: 1524 - DNA, 1323 bp, Vinca minor
tctcatttccatctccaatcatgtcgtgctacagaggagaatacgccgatgagctaattgccaatgctgcatacattggtacccctggaaagggtatcctcgctgctgacgagtcaactggaactattggaaagcgtctatccagcatcaatgttgagaatgtcgagaccaacaggagagctctccgtgagctcttgtttaccacccctggttgccttcagtacctcagtggtgttattctctttgaggaaactctttatcagaagacagctgctggtaagccatttgttgaggtgttgaaggagggtggagtcctccccggaattaaggtggacaagggcactgttgagcttcctggcactaaaggtgagaccaccactcaaggtcttgatggtcttgctcagcgatgccagcaatactataaggctggtgccaggttcgccaaatggcgtgctgtgcttaatattggccccaatgaaccatctcagcttgctatcaccgacaatgccaatggtttggctcgctatgcaattatctgccaacagaatggtttggtcccaattgttgagccagaaatccttgttgatggttcccatgatatcaacaagtgtgctgatgtaactgagcgcgttcttgctgcatgctacaaggcattgaatgaccaccatgttctcctcgagggtacacttttgaagcccaacatggtcactccaggatcagactcccctaaagtttcccccgaggtcattgctgaacacactgtccgcgctttgcagcgcaccatgccttgtgcagttcctgctgtggtattcctgtcaggtggacagagcgaagaggaggcttccgtcaacctcaatgcaatgaacaaacttcagaccaagaagccatggtctctttccttctcgtttggacgtgccttgcagcagagcactctcaaggcttgggctggaaaggaagaaaatgttaagaaggcacaggaggtattccttgccaggtgcaaggccaactctgaagcaacccttgggaagtatgctggtggtgcttctggaggtgctgcttctgagagcctccacgtcaaggactacaagtattaagcttttggttttatatgctttttcagtttttttttattgttttggagagaatgttgtgcaggttgggcacaagaatgtttaccaccatcggatttagcatttttaggttttgttttttattttggtcttgtctatgttagcaaactttttaaataagctcttgagggaaggtatgctctgagagatggtacttcttttgtgatgttttaactcttttggttattgactt

SEQ ID NO: 1525 - DNA, 1344 bp, Vigna unguiculata
gatgctgtcatccgttatctctttcccgccattttcaaagcttaattaaccatgtctgcctttgttggaaagtatgcagatgagcttatcaagaatgccaagtacatagccacacctgggaagggtatcttggcagcagatgagagcactggcaccatcggaaagcgtttagccagcattaatgttgagaacattgaagctaaccgccaagcccttcgagagcttctcttcacctcaccaaatgctctccaatacctctctggtgtgatcctctttgaggaaaccctttaccagaaaaccaccgatgggaagccttttgttgaggttcttgaagagaacaatgtgatcccaggcatcaaagtggacaagggtgttgttgagttggccggcacaaacggtgaaaccaccacacagggctttgactctctcggagctcggtgccagcagtactacaaggccggtgcacgctttgcaaagtggcgtgcagttctcaaaattggccccactgagccctctgagctttccatccagcagaatgcacagggcttggcacgctatgccatcatctgccaggagaatggccttgtgcccattgttgagcctgagattctcaccgatggacctcatgacatagccaaatgtgctgctgttactgaaactgttcttgctgctgtttacaaggctctcaatgatcagcatgttcttctcgaaggaactcttctcaagcccaacatggtcactccaggctctgatagcccaaaggtaacacctgaggtgattgctgagcacacagttcaagcactccgcaggactgttccagctgcggtgccagggattgtgttcctttctggtggacaaagtgaagaagaagccaccctcaacctcaatgcaatgaacaagttggaggtgttgaagccatggactctctcattctcatttgggagggcactgcaacaaagcacactcaagacatggggtggaaaggaagagaatattaccaaagctcaagaagcattccttgcaagatgcaaggccaattctgaggcaactctgggaaagtatggtggtggaagcaaagctgggttggcttctgagagtttgtatgagaagaactacaagtattaggcttccaagagtgtgtttgtttctctgtttaatctctgtttaattttcaatccatggtttttgattcagtcacgttgaggtacataggaaaacgtgagaattgagaaacaaacactgtaaatggacttgagaactgatctggggtgggggcattctggcatatatatatgatacagtctaagcatttgcttctgattaacatgtttattttttgggtta

SEQ ID NO: 1526 - DNA, 1391 bp, Gossypium hirsutum
atgtcttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaaggaaggtggtgtcctccctggcatcaaggtcgacaagggtaccgttgagcttaacggaaccaaccgcgagactttcacccagggtctggatggccttgcacagcgatgccagaagtactatgaagctggtgctcgctttgctaaatggcgtgctgtccttaagatcagtgctaatgagccaaccgagcttgcaatccaagaaaatgccaacgggctagctatgtatgctgccatctgccagcaatgtggccttgttccaatcgtcgaacctgaaattcttgttgacggatcacatgacattcaaaagtgtgctgcagtgacagagcgtgttcttgctacctgctacaaggctctaaatgaccaccatgtcatgcttgagggtactcttttgaagcctaacatggtgacccctggttcggactccccgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaactcagaagccactttgggtacatacaagggtgatgcagagctttgtgagggtgccgcagagagccttcatgtcaaggactacaaatattaagaaattaggcttgtggtcaaatatgtgatgtttagcagagtaaattccggtattgatattagggttctagtgtttttttcttcttcttttgagtttctgccgttgctcatcgactttagtctgtggaatcagacaaattacaaataaggtttgggagcctttgtgctcgttgagtatttttggttttctgtttatttcagtttaaaacaaaattctctgcttagttgagtgtaagcccgcattgtgggacaaaaatgaccaagtataagcccttattctgttggttatttcttattgatttgcttttcatgatt

SEQ ID NO: 1527 - DNA, 1389 bp, Arabidopsis thaliana
acgtaaaatcgtttccattatttctcacaatcatatcttctccgtcgccgccgcctcttttattcacaatgtcgtgcttcaaatccaaattcgccgatgagctcatcgccaatgccgcttacataggaacaccagggaaaggtattctcgctgctgatgaatccacaggaacaatcggaaaacgtttcgtaagcattaacgttgagaacgttgaatcaaacagacgtgctcttcgtgagctcttgttcaccactcctggagctctccaatacatcagtggtatcattctcttcgaagaaacactctaccagaaaactgcttcagggaaactatttgttgatgtaatgaaggaagctggagtgcttccaggtattaaagtcgataaaggaaccgttgagctcgctggtacaaatggtgaaaccacaaccactggtctcgacggacttggtgaccgttgcaagaagtactatgaagctggtgcacgttttgccaagtggcgtgctgttctcaaaatcggaaacaatgagccttctgagttagctatccatgagaatgcttatggtttagcgagatacgcagttatttgccaagagaacggtcttgttcccattgttgaaccagagattcttgttgatggatctcatgacattgagaaatgtgcttatgtcacggaacgagtccttgcggcttgttacaaggctcttagtgatcaccatgtgatcttagaaggaacactcttgaaaccaaacatggttactccaggttctgacagtggttctaaagttaaacccgaagtgatcgccaagcacacggtccgtgctttacaaaggactgttcctgcagcagttccagccgttgtgttcttgtctggaggacagagtgaggaagaagcaactgtgaatttaaacgccattaatcagctcaaagggaagaaaccatggagcttgacgttttcgtatggacgtgcgcttcaacagagtacactcaaggcttggggaggtaaagaggagaatgtggacaaggctcaaaaggcgttcttggctagagccaaggctaactctgaagcaacccttggtggctacaagggtgatgctcagttaggtgaaggtgcgtccgagagccttcacgtcaaagactacaaatattaaaaggttattttcggaatttcattattttttggagttttggttttattgtacagattatataataatttgttttggtgttctttttgtgggattagatgtttttagtactatacttgggcatatgatatcagccctcgaatatctaaattgtaaagcatttatgataaacccttatcgtgggaagattttgttgtaaattatgtatgtaagttcataatctaataaaaaagaaaattttatt

SEQ ID NO: 1528 - DNA, 1165 bp, Brassica oleracea
  misc_feature (16)..(18): n is a, c, g, or t
  misc_feature (243)..(243): n is a, c, g, or t
agaccatggcttcttnnncagcaaatacgccgatgagctgatcgctaacgctgcctacatcggcacacccggaaagggcatcctcgctgcagacgaatcaaccggcacaatcggaaagcgtctttcaagcatcaacgtagagaacgtcgagtctaacagacgcgctctacgtgagcttctcttcactactccaggcgcacttccttgtctaagtggcgtcatcctctttgaagaaactctatnccaaaaaagctccaaagggaccccttttgtggatattctgaaggaaggaggagtcttacctggcatcaaagtcgacaagggcaccgtttctctaccaggaaccaacggcgagaccaccacacagggtctcgacggtctcggcgagcgttgcaagaagtactacgaggccggtgctcgtttcgccaagtggcgcgcggtgctcaagatcggccccaacgagccatcagagttagccatccgcgagaacgcttacgggctcgctagatacgctgccatctgtcaggagaacggtcttgtccccatcgtggagcctgagattctcgttgacggttctcacgatattcagaagtgcgcggaggcgacagagcgtgtcttagcagcttgctacaaggccctgagcgatcaccatgtcatgctcgaaggaacgcttctgaaaccgaacatggtgactccgggatcagagagtggtaaagttgcgccggaggttgttgcggagtacactgtccgcgctcttcagaggacggtgcctgcggctgtcccggctgtggtgttcttgtcgggaggacagagcgaggaagaggcgacgaggaacctgaacgcgatgaatcagctgaagacgaagaagccttggtcgctttcgttttcgtttgggagggcgcttcagcagagcacgttgaagacttggggagggaaagaggagaatgtgaagaaggcgcaagaggcgttcttggttaggtgcaaggctaactctgaggctactcttggtgtttacaaaggtgatgctcagcttggtgaaggtgcggcagagagccttcacgttaaggactacaagtactgaaggatgagtttagtactcaaggatccgtagttttttcatatcatcgtttgtgttttgtgtttccccttaaaaagtaaaaaaacc

SEQ ID NO: 1529 - DNA, 1395 bp, Brassica napus
ctggaccctgcggaccggtccggaattccgggtcgagcacgcgtccgctacgtcgtgccctcttttttaaacaatgtcgtgcttcaaatccaaatacgccgatgagctcatcgccaatgctgcttacatcggttctccagggaaaggtattctcgccgctgatgaatccacagggaccatcgggaaacgtttcgcaagcattaacgtcgagaatgttgaattaaacagacgtgctttacgtgagctcttgttcaccactcctggagctctccaatacatcagtggtattatcctatttgaggaaactctctaccagaaaacagcttcaggtaaaccatttgttgatgtaatgaaggaagctaaagtccttcctggtatcaaagtcgataaaggaactgttgagctcgctggtacaaacggagaaaccacaaccattggcctcgacgggctcggagaccgttgcaagaaatactatgaagccggtgcacgttttgccaaatggcgtgccgttctcaaaatcggggccaacgagccttccgagttagccatccacgagaacgcttacggtctagcgagatatgccgtcatctgccaggagaacggtctcgtccccatcgtggaaccagagatcctcgtggacggatcccacgatattgagaaatgtgcttacgtcacggagcgtgtcctcgcagcttgttataaggctcttaatgatcaccatgcgatcttagaaggaacgctcttgaaaccaaacatggttactccaggctccgacagtaagtctagggcggaacccaaagtgatcgcagagcacacggtccgtgcattacagcgtactgtccccgcagcggttccagccgttgtgttcttgtctggaggacagagtgaggaacaagcaactgtgaatttaaacgccattaatcagctcaaaggtaagaaaccgtggagcttgacgttttcgtatggacgtgcgcttcagcagagtacactcaaggcttggggaggtaaagaggagaatgttgagaaggctcaaaaggcgttcttggctcgagccaaggctaactcggaggcaactactggtgcctacaaaggtgatgctcagctcggtgaaggtgcttctgagagccttcacgttaaagactacaaatactaaaaaagtatttggggatttaattaatttgttgaaaattttggtaattatgcgatattatataatcataaaacctaaccgtatgtaattatttgtttttgggtggtataatattatcctggtgtacataattttttttttttaccttatcactatttatgatgatgaaatccttctctaagggaaattttgttgtaatatatgctttgtaaacttaatttattgaaaagatgtaacttccatac

SEQ ID NO: 1530 - DNA, 1747 bp, Cicer arietinum
ttttaggacggcacgccatttagcaaaacgtgcaccagcttcgtagtacttggcacatcgtgcaccaaggccgtctagaccctgagtggtggtttctccgtcagttccggcgagctcaacggtacccttgtcaaccttgataccgggaagaacaccagcttcgttcaagacatcgacgaaaggcttgcctgcagctgtgctctggtagagggtctcctcaaagagaataactccactgagatactgaaggacattgggggcagtgaaaagaagctcacgaagagcacgcctgttggtttcgacgttctcgacattgatgctggctagacgcttaccgattgttcttaacctaacacctcttttcctttccaaatcaaataccttttcttcctcgatcatgtcgaacttcaagagcaagtaccatgatgaacttattgccaatgctgcctacatcggcacacccggaaagggtattcttgctgctgatgagtcaactggaacaatcggtaagcgtctagccagcatcaatgtcgagaacgtcgaaaccaacaggcgtgctcttcgtgagcttcttttcactgcccccaatgtccttcagtatctcagtggagttattctctttgaggagaccctctaccagagcacagctgcaggcaagcctttcgtcgatgtcttgaacgaagctggtgttcttcccggtatcaaggttgacaagggtaccgttgagctcgccggaactgacggagaaaccaccactcagggtctagacggccttggtgcacgatgtgccaagtactacgaagctggtgcacgttttgctaaatggcgtgccgtcctcaaaatcgggcccaacgaaccatccttgagcattctatccattgagaatgcatatggtttggcccgatacgccgtcatatgccaagagaacggacttgttcctattgtcgagcctgagatccttgttgacggatctcacgacattcacaagtgtgccgccatcaccgagcgtgtccttgcagcaacctacaaggccttgagtgaccaccatgtcctcctcgaaggaactctcttgaagcctaacatggtgacaccaggatccgattcaccaaaggttgcacccgaggttgttgctgagcacaccgttagagccttgcagcgaaccgtacctgccgcagttcccgccgtcgtcttcttgtctggtggacagagcgaggaagaggccactgtcaacctcaatgccatcaaccaagtgaagggtaagaagccatggacactttctttctcctttggaagggcacttcaacagagtacccttaaggcatggtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaagggtataacaactgaacattgtgagggttgaattttcttgttattgagtattgtggaataattgcttggagtttttctttttgttttctctctgtttgtttgatcatagctttagtctatttggtcaaaacccgagcaaaagggtggacataagacactattctaagtcaggttatttgtttattttgcacttatctttgttgcggtatttttatttttactctct

SEQ ID NO: 1531 - DNA, 1447 bp, Raphanus sativus
aggggaggcccattttcaaatggatattatatcataatcagaccgaccatcaccgtcgtgacgtctcttttttaaacaatgtcgtgcttcaaatccaaatacgccgatgagctcatcgccaatgccgcatacattggtactccagggaaaggtattctcgccgctgatgaatccacaggaaccataggaaaacgtttcgcaagcattaacgtcgagaacgttgaatcgaacagacgtgctctacgtgagcttttgttcaccactccaggagctctccaatacatcagtggtatcatcctctttgaggaaactctctaccagaaaacagcttcgggtaaaccatttgttgatgtaatgaagggagctggagtccttcctggtatcaaagtcgataaaggaactgtcgagctcgctggtacaaacggtgaaaccacaaccattggcctcgacgggctcggagaccgttgcaagaaatactatgaagccggtgcacgttttgccaaatggcgtgccgttctcaaaatcggagccaacgagccttccgagttagccatccacgagaacgcttacggtctagcgaggtatgccgtcatttgccaggagaacggtctcgtccccatcgtcgaaccagagatcctcgtggacggatctcatgatattgagaaatgtgcttacgtcacggaacttgtcctcgcagcttgttacaaggctcttaatgatcaccatgtgatcttagaaggaacactcttgaaaccgaacatggttactccaggttcggacagcaagtctagggctgaacccaaagtgatcgcagagcacacggtccgtgctttacagcgtactgtccccgctgcggttccagccgttgtgttcttgtctggaggacagagtgaggaacaagcaactgtgaatttaaacgctattaatcagttcaaaggtaagaaaccatggagcttgacgttttcgtatggacgtgcccttcagcagagtacgctcaaggcttggggaggtaaagaggagaatgttgagaaggctcaaaaggcgttcttggctagagccaaggctaactcggaggcaactactggttcctacaaaggtgatgctcagctcggtgaaggtgcttctgagagccttcacgttaaagactacaaatactaaaaaaagtattttggggatttaattaatttgttgaaaattttggtatttacgtaatattatttaatcataacctaaccgtctttaattaattgttttttcggctttttgggtggtatatatattatcctggtgtacataattttttgacattttcactattttgtaatgctgaaaaatcctctctaggggaaattttgttgtaataatgatatgctttgtaaacttaatttattgaaaaatatgtaacttacactaacatcttataaaaaataaacacgcgtgtttggta

SEQ ID NO: 1532 - DNA, 1321 bp, Cucumis melo
taaacgcagagctcctaaaaccctttcacttcactgctctctctctccttccaatttcttcaatcttcttctattttcaatcctcgtttccattccaaaatgtcttccttcaagagcaaatgagctcattgccaatgctgcctacattggcactcctgggaagggtatccttgctgctgatgaatcaactggtaccattggcaaacgtctagcgagtatcaatgttgagaatgttgaatcgaaccgacgcgcactccgggaacttctcttcctcactcccggtgcccttcagtatctcagtggagttatcttgtttgaggagactctctaccagaagacagctgcaggcaagccatttgttgatgtcttgaaggaaggtggtgtgttgcctggcatcaaggttgacaagggtactgttgaacttgctggtactaatggtgaaacaaccacccaaggtcttgatggccttgctcagcgctgccaaaagtactatgaagctggtgctaggttcgccaaatggcgtgcagtgctcaagatcggtcctactgagccgtcacaattgtctatcaacgagaatgcttatggattagctcggtatgctgctatctgccaggagaatggtcttgttcccattgttgagcctgagattctggttgatggatctcacagcattgataaatgtgctgaagtgaccgagcgtgttcttgctgcgtgttacaaggccctcaatgatcaccacgtcctcctcgaagggactctgttgaagcccaacatggttacccctggatctgaagctgccaaggttgccccagaggtgattgctgaatacactgttcgggctctacaacgtaccgtccctgctgcagttccagccatcgttttcttgtcaggcgggcagagtgaggaggaagcaaccctcaacctcaatgccatgaacaaactgaagggaaagaagccatggtcgttatctttctcgtttggacgtgcccttcagcagagtactctcaaggcatgggcaggaaaggaggagaatgttgagaaggcaagggctgctttcctcacaaggtgcaaggcgaactcggaggcaaccctcggaacatacaagggtgatgcaaacctcagcgagggtgcggcagaaagtcttcatgtcaaggattataaatactgaaaaggggttattttgctctttctattgttattatgttttgttaattaagcatgaggttagagcattctgacgtgttgatgaggttcatcagggacaacaataagccttttgaagaagctttttctttgcttttcttttcttttcttttctttt

SEQ ID NO: 1533 - DNA, 1361 bp, Senecio madagascariensis
ctcaaatttaacaaaaaaactcagaattaatcatgactgcctacaggggaaagtacgctgatgaacttatcgccaatgctacccacattggttcacccggaaagggtattctagctgctgatgaatcaactggcacaatcggaaagcgtctacaaagcatcaacgttgagaacaacgagtcaaacaggagagctctccgtgagcttcttttctgcactcctggtgctatgcagtaccttagtggagttattctttacgaagaaactctctaccaaaagaccgctgctggtaagccttttgttgatgtcatgaaggagaataatgtccttcccggaatcaaagttgacatgggctgtgtctcccttgccggaactgatggtgagaccactactcaaggtcttgatggtcttggtgctcgatgtgccaagtactatgaagctggtgctaggttcgctaagtggcgtgcagttttgaagattggtgctaatgaaccatctccgttatctatccatgaaaacgcttatggtttagcccgatatgccatgctttgccaagagaatggacttgtaccaattgttgagccagagatccttgttgacggatctcatgacatcaacaagtgtgctgaagtaactgaacgtgtgctagccgcttgctacaaggctcttaacgaccaccatgtgcttctcgagggtactcttttgaagcctaacatggttacccctggatctgactccaagaaggttgcacccgaagttattgctgagtacactgtgcgtgcccttcagcgaaccatgcctgcagctgtcccagcagtcgtgttcttgtctggtggtcagagtgaggaagaggcaactgttaacctcaatgccatgaaccagtacaagggaaagaagccatggagcctaactttctcgtttggacgtgcccttcaacagagcaccctcaaggcatgggctggaaaggaagagaatgtgaagaaggctcaagatgcattccttgctaggtgcaaggccaactctgaggcaacactcggaaaataccagggcggtgctgctggtgaaggtgccaccgagagcctccatgtcaaggactacaagtactaattctcgtctcaccaatttcctcatgggttattgtttctttgttaccctttcataaaagggatggatattatttatattttggttgaatgaggggtgtttaagcctcgggcatactttacgcctttttgtttttatttttatctttggttagttattttgtaccggtgaatgtaagcttgagaaacatcaagccatggttcaggttaatgataacttgaactgtctttaaaatttttataaatatgttcttataaa

SEQ ID NO: 1534 - DNA, 1758 bp, Glycine max
gctgatttagaaaactaaaaccgccatccaaattaggtcacccaaaattccaacggcaatccacagagacgcacccaaaaccaaaccataaccgaggtcgacgcttcgcgagtgcgcatcctaagacccacgtcttttttgttgtcgtggcctcaacgcaacatcattatcactgtcactataaaaaccctacttggctcttttcttcacttgttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtctatccatgagaacgcctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattttgctttttgttttcctagtgttccttttatgtcaattttagtaattcagtgtatttggtcaaacctgtgcaacagggaagggaatgtaactttgttttcttgaaagacaccaccgtgctgtgaatgaggctttgtgtttatttttgcgattatctgtctttgttttcatatttatgtctatcatcggtaatttcaacattgagcatgtcttgtttattgacaatggtttgaatataagataaaattatgcaccacatttagtaac

SEQ ID NO: 1535 - DNA, 1710 bp, Glycine max
caaaattccaacggcaatccacagagacgcacccaaaaccaaaccataaccgaggtcgacgcttcgcgagtgcgcatcctaagacccacgtcttttttgttgtcgtggcctcaacgcaacatcattatcactgtcactataaaaaccctacttggctcttttcttcacttgttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtctatccatgagaacgcctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattttgctttttgttttcctagtgttccttttatgtcaattttagtaattcagtgtatttggtcaaacctgtgcaacagggaagggaatgtaactttgttttcttgaaagacaccaccgtgctgtgaatgaggctttgtgtttatttttgcgattatctgtctttgttttcatatttatgtctatcatcggtaatttcaacattgagcatgtcttgtttattgacaatggtttgaatataagataaaattatgcaccacattt

SEQ ID NO: 1536 - DNA, 1648 bp, Lippia dulcis
caagtaatagcacatgtatgcttctaccttgtcagttactgacatcgaataactatcgtagtgtaatgtaaaaatactcagaaactttagtgacattctgccatacatttgctttcacaggctactatgttctttcttttatatatgacactgtgatggtggtttaaatttataatgtattcacttttgtatgtttcctttttctttctagatgaacttattgccaatgctgcgtacattggtacccctggtaagggtatcctcgcagctgatgagtcgactggcacaattgggaagcgtttatcgagcatcaatgttgagaatgttgaggaaaacagacgggctcttcgtgaacttcttttcactgcacctggtgcccttcagtacctcagtggaattatcctctttgaggaaaccctataccagaaaacagctgcaggcaaactctttgtcgatgtcatgaaagaagcaggtgttctccctggcatcaaggtcgacaagggcacagttgagctagccggcaccaatggcgagaccaccacccaaggcctcgacggccttgcccaacgctgccagcagtactacacagccggtgctcgttttgccaaatggagagccgtgcttaaaatcggccccaacgaaccgtcccaattagccatcaatgagaacgccaatggcttagcccgttatgccatcatctgccaagaaaacggccttgtcccaattgttgagcccgagatccttgtagacggaccccacgacatcaacaagtgcgctgatgtcaccgaacgcgtccttgccgcttgctacaaggcattaaatgaccatcacgtccttcttgagggaaccctattgaagcccaacatggtgaccccgggctctgactccgcaaaggtggctccagaggtgattgctgagtatacggttcgtgcactgcagaggaccatgccgccagctgtcccagctgtggttttcttgtctggtgggcagagtgaggaggaagctactgttaaccttaatgccatgaacaagcttaagacgaagaagccatggagtttgagcttctctttcgggagggcactgcaacagagcacccttaaggcgtgggccggaaaggaagagaatattcctaaggctcaggctgcgttgcttgcaaggtgtaaggcgaactcggaagctactcttggaacatatgaggggggtgctttgaatgagggtgcgtccgagagcctccatgttaaggattacaagtactaaggtgaaggttttgtattgtcttgatttggttttgtggaaacgagtaattggcgaaatagctgttcttttgagattgggttttcgtgttttttttcgtgttttaataaggttgagaaacattcggcactgtgagatggaatgcttgttcgtgctgttaacaggtggtgtttgtttaacgtccgaaacgctcgtccattgatgaattgattctaatttaacttcattttgtgcatttctattaaatttttaggcatcttatttgccctttttgacatatttctttaatcgatattgtctagtctatgactttcaacgaagttctagaaagagttgtcaacggacgttgttgtgtccgtagagaaactaaaaaaaccctattaccgctacggaa

SEQ ID NO: 1537 - DNA, 1614 bp, Trigonella foenum-graecum
gtaacgaaatccaatccaacggcagtccatagagacagataacaaaccaaccgaggtcgatacatccaatcgtagtacacacctaacattgttgtcttgttttccaatccatcatagtcactatataaaaccccaaaaccccactttatttctcactatttcttctcactatctcacaccttattcttaacctaccctcctttcggtactcttccaaaacaaccttcctcgatcatgtcgaacttcaagagcaagtaccatgatgagcttattgccaatgctgcctacatcggcacacccggaaagggtattcttgctgctgatgagtcaactggaacaattggaaagcgtctagctagcatcagtgttgagaatgttgaatccaacaggcgtgcacttcgcgagcttcttttcaccgcccctggtgtccttcagtacctcagtggagttatcctcttcgaggaaaccctctaccaaagcactgctgcaggcaagccttttgttgatgtcttgaacgaagctggtgtgcttcctggtatcaaggttgacaagggtaccgttgagcttgccgggactgatggagaaaccaccactcagggtcttgatggacttggtgcacgttgtgctaagtactacgaagctggtgcacgtttcgctaaatggcgtgccgtgcttaaaatcggccccaatgaaccatccgagcactctatccatgagaacgcctatggtttggcccgatatgccgtcatatgccaagagaatggacttgtaccaattgttgagcctgagatccttgttgatggatctcacgacattcaaaagtgtgctgccatcaccgagcgtgtccttgcagcttgctacaaggccttgagtgaccaccatgtcatcctcgaaggaactctcttgaagcctaacatggttacccccggatccgactctccaaaggttgcacccgaggttgtcgccgagcacactgtcagagctttgcagagaaccgtacctgctgcagttccagctgttgttttcttgtctggtggacagagtgaggaagaggccagtgtcaacctcaacgccattaaccaagtcaagggtaagaagccatggactctttccttctcttttggaagggcacttcaacagagtacccttaaggcatggtctggtaaagaagaaaatgtgaaggctgctcaagaagctttgttgacaagggctaaggctaactctgaggctactcttggaacttacaagggtaattctcaacttggtgctggtgcctcagagagtctccatgttaaggactacaagtattgatgagtcaaagttggtgtctcttttgaaaattagaaagagggtttattttactgttattgagtactgtggtttgacttgcgaaacagaataattggtttgagtttatctttttggtttctttttgttcctttgataatttcaggttcagtgtatttgatcaaacccgagcaaaagggttattataagacactatttttaagtgaagttctttgtttactctgcaattatgtggcttcgttaagtggtttgttatttatacccccatgcctaaattaattttgttttaacatgagtactttcaaa

SEQ ID NO: 1538 - DNA, 1312 bp, Pisum sativum
tttgtttcccgccatacaatatcaatttcaaagcatgtctgcctttgttggaaagtatgcagatgagcttatcaagaatgccaagtacatagctactcctggcaagggtatcttggcggctgatgagagcacagggaccattggcaagcgtctagcaagcatcaacgttgagaacatcgaggccaaccgtcaagctcttcgcgaacttcttttcacttctcctaatgcactccaatacctctctggtgtcatcctcttcgaggaaactctttaccagaagtcctcagaagggaagccttttgttgaaattctccaagagaacaatgtcatacccggcatcaaagttgacaagggtgttgttgaattggctggaacagatggtgaaacaacaacacaaggctttgactctcttggagctagatgccagcagtactacaaggctggagcgcgctttgccaagtggcgtgcagtcctcaagattggccccaatgagccctctgagttgtctatccagcaaaacgcacagggcttggctcgctacgccatcatttgccaggagaatggcctcgtgcctattgttgagcccgagattttaaccgatggatctcatgacatcgccaaatgcgctgctgttactgaaactgtgcttgcagcctgttacaaggcactgaatgatcaacatgtccttcttgaaggaactcttctcaagcccaacatggtcacccccggttctgatagcccaaaggtatcacctgaggtgattggtgagtacacagtcaatgcattgcgcagaactgtcccagctgcggtaccagggatagtttttctgtctggaggacaaagtgaagaacaagctacactgaacctgaatgcaatgaataagtttgatgttgtgaagccatggacactttcattctcatttgggagagcactgcagcaaagcacactcaagacatggtctggaaagaaagagaatgtgggcaaagctcaagatgtgtttctggcaagatgcaaggccaattctgaggctactttgggaaagtatggtggtggaagtggaactgggttggcttcagagagcttgcatgttaaggactataagtattaagcttctaaatggagagcttggggtggatggatgcattttagcatatgtattattatactttttaaattttttgcttttgattaacatgtttaattctgcatatatattttataaacatcatcgttcataactttataaacatatccgattggttaaacatgttgtttttcactcagacttagtgaagctcaaatacaagattgt

SEQ ID NO: 1539 - DNA, 1320 bp, Centaurea maculosa
  misc_feature (109)..(109): n is a, c, g, or t
  misc_feature (395)..(395): n is a, c, g, or t
  misc_feature (809)..(809): n is a, c, g, or t
  misc_feature (812)..(812): n is a, c, g, or t
  misc_feature (880)..(880): n is a, c, g, or t
  misc_feature (890)..(890): n is a, c, g, or t
  misc_feature (893)..(893): n is a, c, g, or t
ttggccggggactctttggatttaccattttttccacagttttcttcttctccaatcctctttttttctcagatccaaatctctctaaaatcaccatgtcttgctacanaggaaagtatgctgatgagcttattgccaatgctgcctacattggtacccctggaaagggtattctcgctgctgatgagtccaccggcacaatcgggaaacgtctagacagcatcaaagttgaaaatgttgaggaaaacaggagagctctccgtgagcttcttttctgcactcccggtgccctccagtacctcagtggagttatccttttcgaggaaactctctaccagaagactgctgcaggcaagccatttgttgatgtcatgaaggaggctggagtccttccnggtatcaaggtcgacaagggtaccgttgagctagccggaaccaatggcgagaccaccacccaaggtctcgacgatctcggcaaacgatgcgcccagtactacaaagccggtgccaggttcgccaagtggcgtgcggtcctaaagatcggcgccaacgagccatcccagctcgccatcaacgagaacgccaacggcttggcccgatacgccatcatctgccaggagaacggtctggtccccatcgtcgagcccgagatcctcgttgacggatcccacgacatcaacaagtgcgctgatgtcaccgagcgcgtcctcgccgcctgctacaaggccctcaacgaccaccacgtccttctcgagggtaccctcttgaagcctaacatggtcacccccgggtctgatgccccgaaggtngcncccgaggtcgtggccgagtacaccgtccgtgccctgcaacgaaccatgccgccagctgtccagcgtcntgtctgtcgnagncagagcgaggagcagccaccatccacctcaacgccatgaaccaatacaagggaaagaagccatggagcctatcgttctctttcggacgtgctctccagcagagcacccttaaagcgtggtccggaaaggtagagaacgtgaagaagctcagatgcgttccttaccagatgcaagccaactccgagctacccttgggacgtacaagggtccgggtgggttggtcgagggtgcttccgagagccttcacgttaagactacagtactgagtttcgatcgatcccggtttcggtttggtatctaccgaattgtgtttgttcttctgacatttgtttgaagagtgctttgtgcctgggaactattcatttctagctttgttttttatttgagtgttgtatgacatgtattatagctgaactctgccgtgagt

SEQ ID NO: 1540 - DNA, 1534 bp, Cedrus atlantica
agggagtgggtgtcgttattcggatctgtgtgtctgtgtttgtagtattttgttttatcagcccccaagctctagcagaaatgtcttgcttcgaaggaaaatatcgtgatgagctgattgccaatgcggcgtacatagctacacctggaaaaggaattcttgccgcagatgagagcactggcaccatcggaaagaggctggcgagcattaatgtggagaatattgagaccaacaggcgtctgctgagggagttcctcttcactgcccctaatgccttgcagtatttgagtggcgcaattctgtttgaagagactctctatcagaaaactgcagctgggaagccctttgttgatgtcctcaaggaaggaggagtcctgcccggcataaaagtggacaagggtaccgtggatcttgcaggaaccaaaggtgaaaccaccacccaaggtctggatggccttgcgcagagatgccagcaatactataatgcgggagcgaggtttgcaaaatggaggtctgttctgaagattgggattacggagccctctccacttgctattcaagaaaatgcaaatggccttgctcgttacgctatcatctgccaagagaatggtctggttcctattgttgagcctgaaattctggtggatgggcctcatgatattaaaacatgtgccgctgttacagagaaggtactggctgcctgttacaaggccctcaatgaccaccatgtcctcctcgagggcactctccttaaacccaacatggtaaccccgggttctgattctccgaaggtgacccctgaggttattgcagagcacacagtaagggctcttcagaggactgtgccccctgcagttcccggtatcatgtttctatccggtgggcagagtgaggaggaggccaccttgaatttgaatgccatgaacaagctgcagaccaagaagccctggaccttgtcattctccttcggccgggctcttcaggccagcaccttgaagacatgggctggaaagaatgagaatattcccgctgcacaggccgccctcttatctcgatgcaaggccaattccgaggccactttaggcaagtatgcaggtgactctgccaagggcaatggagtttctgagagccttcatgtcaaggactacaaatattgattgatggtcactgttatccatccatccatcagtgaaaatagagatccctgagaggagatattttcatttgaatttcagtttagtgggctcttagttgagtttgacagcttctgtcatttagttttggtcattggagttagagtatgttattttcaattgatgctgtagttgtattagaataatgagaggtatttaagcccccttgtttcagatattagtccttccaactgaaagttgttttctattaggtttaggtttgagtgggataataaatagttatcactataatatctcctattgtgtctttcctcaacctttttattaaatttggagaaagtgttggttacaatgaaagctgaaggtagccattgttatga

SEQ ID NO: 1541 - DNA, 1559 bp, Phaseolus coccineus
cattgttatcaccatcactatataaacccctcttatggccgggggtggttcactcacttcttcacaacctcaaacctacttttttttctccgctcaactacctcatcgtcttcttcctcctcctcgatcatgtctcacttcaagggcaagtaccatgatgagcttattgccaatgctgcttacattggcactcctggaaagggtattcttgctgctgatgagtcgacaggaacaattggtaagcgtttgtccagcatcaatgtggagaacgttgaatccaacaggcgtgctcttagggagctgcttttcactgctcctggtgctcttcaatacctcagtggagtcatcctctttgaggaaaccctctaccagagcacagcttcaggcaagccctttgttgagttgttgaaggagaatggtgtgcttactggtatcaaggttgacaagggcaccgtggagctagccgggaccgatcaggaaaccacaactcagggtctagatggccttggtcagcggtgtgccaagtactatgaagcaggtgcacgatttgccaaatggcgtgccgtgctgaagattggtcccaacgagccatctgagctctctatccatgagaatgcctatggtttggccagatatgctgtgatatgccaggaaaatgggctggttcccattgttgaaccggagatccttgttgatggatctcatgacattcacaagtgtgccgctgtcactgagcgtgtccttgcagcatgctacaaggctttgaatgatcaccatgttcttctcgagggaactcttttgaagccaaacatggttacacctggatctaaatctgccaaggtttctcctcaggtggttgctgaacacactgttagagccctgcagcgaactgtacctgctgcagttcctgccgtggttttcttgtctggtgggcagagtgaggaagaggcatccctcaacctcaatgccattaaccaggttaatgggaagaagccatggtcactctctttctcttttggaagggcacttcaacagagcactcttaaggcatggggtggaaaagaggagaatgtgaagaaggctcaagaagccttattggtaagagccaaggctaactcagaggcaactcttggaacctacaagggtagttcacaacttgatgatggtgccgaagagagcctctatgttgaaaactacaaatactgagaaaagttactgctctttattgagactagtgcgggtaggaatcggtattatgggttcttgctaatgagtattgtggttttactcctcccagaataatcgcatttgaaattttgctatttgttttttttagtgttccgcaatatcctttttagtttcagtgtattggtcaaacatgtgcaaaatggaggggatgttaaatttgtgttcttgaaagacaccacctttctgaacgaagctttgtgtttatttacaattctccgtctctttgttttcattctgcataatcatgaatgagattgataagttgaagggcttttgtgagtaatccattggatttgttttcttaacttttt

SEQ ID NO: 1542 - DNA, 1201 bp, Manihot esculenta
gcattttcgtcgtctgtctacccttcatcttatacacgcctcgtaagatttagccatgtcggcctttgttggaaaatatgcagatgagcttatcaggactgccaagtacattgccaccccagggaagggcattttggctgcagatgagagcacaggcactattggcaagcgtctcgccagtataagtgttgagaatgtggagtctaatcgccaagctctccgcgagctccttttcacctcccccaatgccctcccctatctttcaggtgtcatcctcttcgaagaaaccctctaccagaaaacctctgatggaaaaccatttgttgaagttctccaggaaaacaatgttgttcctgggatcaaagttgacaaagggactgttgaattagcaggcactaatggtgaaactacaacccaaggctttgactcgctgggtgctcgctgccagcagtactataaggctggtgctagattcgccaagtggcgggctgtcctgaagattggtcctactgagccctctgaattggcaatacaacagaatgcacagggcttggctcgttatgccatcatttgtcaagagaatgggctggtgcccattgttgaaccggaggtcttgaccgatggtcctcatgacatcaagaagtgtgcttatgtgacagagattgttctcgcagcagtttacaaggctctgaatgatcaacatgttcttcttgaaggcacactccttaagcctaacatggttactcctggttctgatagcccaaaggtagcagcagaggtaattgctgagtacacagttactgcactacgccgaactgttccaccagccgttccaggcattgtgtttttgtccggtggacagagtgaggaggaggcgacattgaaccttaatgcaatgaacaagcttccagtgttaaaaccatggacattatccttctccttcgggcgagctctgcaacaaagtacactgaaaatatgggctggaaagaaggagaatattgagaaagctcagaaagcattcttagaaaggtgcactgccaattctgaggcaactcttggaaagtataccggaggaagttctggtggattggcttctgagagtttgtatgttaagggatacaagtactagagttggggataatatttgtgcttgtaaaattgttaacgcttctctctaatcatgctaaatttcttttgatac

SEQ ID NO: 1543 - DNA, 1326 bp, Gossypium hirsutum
ccttccaaacagacactctcaactttcttttgttcttcattttcctttcaatcatgtcttgcttcattagcaaatacgccgatgagctagctaaaaacgctgcctatatcggcacacctgggaagggaatccttgcggctgatgaatccaccggcacaataggcaagcgtcttgcaagcattaatgtagaaaacgttgaagaaaacaggcgagctcttcgtgagctcctcttcactgctcccggtgctctccagttcatcagtggtgttatattcttcgaggaaacactctaccaaaaaactgcttctggcaagctttttgttgatgtgttgaaagaatctggtgtcctccctggcatcaaggttgacaccggcaccgttgtgcttaatggaaccaatgacgagactttcacccagggtcttgatggccttgcccagcgttgccaaaagtactacgaagctggtgctcggtttgccaaatggcgtgctgtacttaagatcggcactattgaaccaaccgagcttgcaatccaagaaaacgccaatggcttagccatgtattccgccatctgccaacaatgtggcttagtccccattgtcgaacccgaaatccttgttgatggaccacacgacattaacaagtgtgctgcggtaaccgagcgtgtcctcgcagcttgctacaaagctctaaacgaccaccatgtgatgctcgaaggtacattgttaaaacccaacatggtgacacccggttccgattccccaaaagttgcacccgaggttattgccgaacacacggttcgtgccttacaacgaaccatcccacctgcagtccctgcagtagtgttcttatctggtggacaaagtgaagaagaggctaccattaacctcaatgccatgaacaagctcaagaccaagaaaccatggtcactgtcattctcatttggacgagctcttcaacagagcactctcaaggcctggggtgggaaagcggagaatctggggaaggcccaagaggctttcctcgttaggtgcaaggctaactccgaggcaactcttggtacctataaaggtgatgcaaagcttggtgaaggtgctgctgagagccttcacgttaaggactataaatactgagaatttgggcctgtggtctaatgtgtcatgttttgaagactaatttttggcatttatttctttttgggggtgggggttttctgtcgtttcccatcgaattttggggtgaaattaaacaaatctgcatataggagcatttgtgctatttaagtgtggactcttaattttgttaaatatatacctatactaaattttg

SEQ ID NO: 1544 - DNA, 1648 bp, Marchantia polymorpha
ctcctccacatcgactttcgtctcgggttcgcttgtcctggcggggccgtgagtgcgttatccttgtcgtgtgcatctagttgaaagtgttggaggccccggatcagatcaggctcagctccatctccagcttcagcgagtcggcgaatcggtcgcgggtgtgaataaggtctcgtgcgaaggagtctgttggcagtgcgcgagagttctgcgatcctggtcatttttgctcgagaggttttggctgcgttgtttggtcgatcgacggacgggtgaagaaaaagcttcgtcaacatgtcagcctacgagggaaagtatgctgaggagttgaagaagaccgcggcgtacatcgccactcccgggaagggtattttggccgccgatgagagcacagggacgatcggcaagaggttgtcgagcatcaaggtagagaatgtggaggccaacaggcaggcgctgaggcagctgctgttcaccgcccccgacacgcaccagtacctgagcggagtgatccttttcgaggagactctgtaccagaagaccgatgacggtgttccattcaccaagctgttgttggatggtggtgtcattcccggaatcaaggtcgacaagggtgtggtcgagttggctggaaccgacggcgagacaaccacgcagggtcttgatggcctcggtgacaggtgcaagaagtactacgaggctggcgcccgatttgccaagtggagggctgttttgaagatcggcgccaatgagccttcggagctctcgatccagcaaaatgcccagggtctggcccgctacgccatgatctgccaggagaatggactcgtccccatcgtcgagcccgagattttggtcgatggtactcactccatcgagaggtgcgcgtatgtcaccgagatggttctcgccgcatgctacaaggctttgaatgagcaacacgtgctcttggagggtaccctgctcaagcccaacatggtcacccccggatccgaagccaagaaggttacccccgaggtgattgccaagtacaccgtgcaggcacttcagagaacggtgcccccagctgtgcccggtatcgtcttcctttccggaggccagagcgaggaggaggctactttgaacctgaacgccatgaaccaactagacgccaagaagccatggacactgtcattttccttcggacgcgccttgcaacagagtgtgctcaagacctggtccggcaaggcggaaaacatcgacgcggcgcagaaggctttccacaagaggtgcaaggcaaattcagaggcggttctcggaacttacaagggtgatgctgccggaggtctgggtgatgaaagccttcacgtgaaggattacaaatattgagttgttgttacttgtgtataggagcggattatataacgcaagcttgtctctagtggggcagaactgcgaatcattcaatggcgcctggggtagaacttaagaagtaagacgagaggaacagaggatgtaatttacaacagggttccccgtgaaggcttccccgccagtagaaagagtcaattgtgaattctaaatcccatgttgaataagagccaccatgtactgatgccctttcatcaacagtttttcgttagcttggcttttgattttaaaaaaaaaa

SEQ ID NO: 1545 - DNA, 1534 bp, Quercus alba
cacttttcgtcctgttatctatatatccctttttatccaaagccaataccaactgatagcttgtaaccatgtcggcctttgtaggaaagtatgcagaggagctcatcaagaatgcgaggtacattgccacacctggcaagggaattttggcagctgatgagagcactggcactattggcaagcgtctagctagcattaacgtggagaacatcgagtcgaatcgccaagctcttcgcgagctcctcttcacttctcccaatgccctcccctacctctctggtgtcatcctctttgaggagaccctttaccaaaagacttcagatggtaagccttttgttgaagtccttaaagaaaacaatgtcattcctggcatcaaagttgacaagggcacggttgagttagctggtacaaatggtgaaaccaccactcaaggctttgactcacttggtgcaaggtgccagcagtactataaggccggtgcacgctttgccaagtggcgtgccgtgctcaagattggtcctaatgagccctctgaattgtcaatccaacaaaatgctcaaggcttggctcgctacgcaatcatttgtcaggagaatggactggtgccaattgttgagcctgagattttaactgatggtgctcatgacattaagaaatgtgctgctgccactgagattgtgcttgcggcagtgtacaaggcactgaatgatcagcatgttcttcttgaaggcaccctgctaaagcccaacatggttacaccaggctctgatagcccaaaggtaacacctgaggtgatagctgagtacacagtcacagcactccgccgaactgtcccggctgcagtgccagggattgtgttcttgtctggtgggcaaagtgaggaagaggcaacactcaatcttaatgcaatgaacaggttggaggtgctgaagccatggactctttctttctcatttgggcgagctttgcaacaaagcacactcaagacatgggctggaaagaaggagaacgttgggaaagctcaacaggtgttcttggtgaggtgcaaggctaattctgagtccactcttggaaagtattctggtggaggtgctggtggtttggcttctgagagtttgtttgtcaagggttacaagtactaggcctttaatttctagagtggcaaccatcatatatctaatgcaattgtaccttccttctttacctgcttagttttggtacatattctacaatgggtggcatattatcgatgcttcaatattgtactgttaatttcccatgtcctgagtttgcctctcttgtctcactaagaacctagccttttgccattagaaattccaaaattgtgactaagagggtctaagatgaacaattaagaaacccaagaggggccaagcctttatcttagcccatcaaaaaatgtgtattgctaattcaaagatcctttcaagaaattcaatttcactacccaatgtttttcttatagtattgggagcaacaagattactcatgtaattaatgatggtataccaat

SEQ ID NO: 1546 - DNA, 1407 bp, Helianthus annuus
taggcagcattggcaataagctcatcagcgtactttccattcaccatcatcattttttaaatctaacaatcatgtcttgctacaagggaaagtacgctgatgagcttattgccaatgctgcctacattggtacacccggcaagggtattcttgctgctgatgagtccactgccactatcggaaagcgcctttccagcatcaatgtcgagaacaacgagtcaaacaggcgagccctacgtgagcttctattctgcactcctggtgcccttcaatacatcagtggaatcatcctctttgaggagactctctaccagaagactgctgcaggtaagccgtttgttgagctaatgaaggaggctaaggtccttcctggaatcaaggttgacaagggtgttgtcgagcttgctggaacaaacggcgagacgactaccacaggtcttgatggtcttggccagcggtgcgctcagtactatgaagccggtgctaggttcgccaagtggcgtgccgttctcaagattggccccaacgagccatccccactttccattatggaaaatgcttatgggttggcccgatatgcgatcatatgccaagagaacggtctagtccccattgtcgagccagagatccttgttgatggacctcatgacatcaacaagtgtgctgatgtaactgaacgcgtcctggctgcatgctacaaggctcttaatgaccataaagtgcttcttgagggtacccttttgaaacccaacatggtcacccctggatctgacgccaagaaggttgcgcctgaggtggtgggtgagtacactgttcgtgcccttcaacgaaccatgcctgcagcggtcccagccgttgtgttcttgtctggtggtcaaagcgaggaggaggcctcggtcaacctcaatgccattaaccagtacaagggtaagaagccatggagcctaaccttctcgtatggacgggccctacagcagagcaccctcaaggcctgggccggtaaggaagagaatgtgaagaaggcgcaggaggtgttccttggtcgttgcaaggccaattctgaggcgagtgaagggaaatacaagggtggtgctgctggcgagggtgctaacgagagccttcacgtcaaagactacaaatactgatttgtcacgggtacaaacatatctgatatctcgtgggcttaagcctcgggtcatatacgttttggttttttatttgtctagtgttagtaacgatgcctaaaaataagcccgaaaagtgttgggcattggtcgaggataatgataacccgacccgttttaaacttcttttttatttttttttctttttatggtctgtacatattcacaaattgtttaaccaaccatgtaatcacaactttttgtgaattattgatatccaaaa

SEQ ID NO: 1547 - DNA, 1395 bp, Ipomoea batatas
ataccgctttgcactacgttttcttcgctcttccaaatctctttcatcgctaagctcttctccaaaaacccaccatgtcttgctacagaggaaaatacgccgatgagctcattgctaatgctacctacattggcacccctggaaagggtatccttgctgctgacgagtccaccggtacaattggcaagcgtctagcaagcatcaatgttgagaatgttgaggaaaataggcgggctcttcgcgagttgcttttcacaactcctggtgctcttcagtatctcagtggagttatcttgtttgaggaaaccctttaccagaagactgcatgtggcaagcccttcgttgagctcctgaaggagggtggagtccttcccgggatcaaggttgacaagggtaccgttgagcttcctggaaccaagggcgagactacaactcagggtctcgatggcctagctgagcgctgcaagaagtattacgaggctggtgctaggtttgctaaatggcgagctgtactgaagattggacccaatgagccatcacagcttgctatcaatgagaatgccaatggcctagcccgctatgcaattatctgccagcagaatggtcttgtacccattgttgagcccgagatccttgtcgatggacctcatgacattacaaatgtgcagatgtaacggagcgcgttcttgctgcccgctacaggcctcaacgacaccatgtcctccttgagggtacctggtaagccacatggtcactcctggatccgactctgccaggtgcaccagaggtggtagccgaatacactgtccgtgccttgcaacgaaccatgccacctgcagtccccgctgtggtgttcttgtccggtggccagagcgaggaggaggccaccgtgaacctcaatgccatgaacaagctaaagaccaagaagccatggagcctttccttctcctttggacgtgcccttcagcaaagcaccctcaaggcgtgggccgggaaggaggagaatgtcagaaggctcaggacgctctccttgcaaggtgcaaagcgaattccgaggcaacccttggaacctatgctggttcagctaacctctgcgagggcgcttctgagagccttcacgtcaaggattacaagtactaagcaagttttggtttcctagattttttgtttgattaagaggcttgtcagtaatgcttttccaaaacaggatctattgctctctagtttttaggcttttggggggatttttctgtctaattttccggtttggttaaatttttttaaacaataagtctcaaagacatgaactttttttttttccctgtattttaatggctatttagctaatatattgagtttttctgtattcaaatgaaaatttagcatcttttacgg

SEQ ID NO: 1548 - DNA, 1268 bp, Lotus japonicus
ggctaaactcagttttcgtgctgtcgtctgttatctgcttcccgccatccaataccttttgaaccatgtctgcctttgttggaaagtatgcagatgagcttataaagaatgccaagtacatagccacccctggcaagggaatcttggcagcagatgagagcacaggcaccattggcaagcgtctagccagcatcaatgtggagaacattgaggccaatcgccaagcactgcgtgagcttctcttcacttcccctggtgccctgcagtacctctctggtgtcatcctctttgaggaaactctctaccagaacagctctgagggaaagccttttgttgagtttctccaggagaacaatgtcatcccaggcatcaaagtggacaagggtgttgttgaattggctggaacaaatggcgagaccaccacacaaggctttgactctcttggagcaaggtgccagcagtattacaaggctggtgcaaggtttgccaagtggcgcgcggtgctcaagattgggcccactgagccctctgagctgtccatccagcagaatgctcagggcttggcccgctatgccatcatttgccaggagaatgggcttgtgcccattgttgagcctgagattttaactgatggggatcatgacattgccaaatgtgctgctgttactgaaactgtgcttgcagctgtttacaaggccctgaatgagcagcatgttcttcttgaaggaacccttctcaagcccaacatggttacccctggctctgatagcccaaaggtaactcctgaggtgattgctgaacacacagtcactgcactccgcagaactgtcccagctgcagtgccagggattgtgtttctgtctggtggacagagtgaagaacaagccactctcaatctcaatgcaatgaacaagctggaggtgttgaagccatgggccctctcattctcatttgggcgagcactgcagcaaagcacactcaagacatgggctgggaagaaagagagtgtgaccaaagctcaagaggtatttctggcaaggtgcaaggccaattctgaggctactcttgggaagtatggtggtggaagtgggagtggtttggcttctgagaatttgtatgtcaaggactacaagtattaggcttctaaatgaagctggggtgggtgcattttagtcctatgtatggtgcagcataagctttttcttctgattaacatgctttattttgggtacatattcttataaaataccactttataaccttatact

SEQ ID NO: 1549 - DNA, 1435 bp, Cajanus cajan
gggggtgctgtcatctgttatctgtttcccgccatccaataccatttttcaaagcttgaaccatgtctgccttcgttggaaagtacgcagatgagcttatcaagaatgccaagtacatagccacacctgggaagggaatcttggcagcagatgagagcactggcaccattggaaagcgtttagccagcattaacgttgagaacattgaggccaaccgccaagcccttcgccagcttctcttcacctcaccaaacgccctccaatacctctccggtgtcatcctctttgaggaaactctgtaccagaaaaccagtgatggaaagccttttgttgaggtgcttgaagagaacaatgtgatcccaggcatcaaagtggacaagggtgttgttgagttggctggcacaaatggggagaccaccacacaaggctttgactctcttggagctcggtgccagcagtactacaaggccggtgcacgctttgccaagtggcgtgcagttctcaaaattggccccaatgagccctctgagctttccatccagcaaaatgcacagggcttggcacgctatgccatcatttgccaggagaatggccttgtgcccattgttgagcctgagattctcactgatggggctcatgacattgtcaaatgtgctgctgtcactgaaactgtgcttgcagctgtttacaaggcactcaatgagcaccatgtccttcttgaaggaacccttctcaagccaaacatggtcactcctggctcagatagcccaaaggtagcacctgaggtgattgctgagtacacagttcaagcactccgcaggactgtcccagctgcggtgccagggattgtgtttctgtctggtggacaaagtgaagaggaagctacgctgaacctgaatgcaatgaacaagttgggggtgttgaagccatggactctctcattctcatttgggcgagcactgcagcaaagcacactcaagacatggggtggaaagaaggagaatattggcaaagctcaagagtcatttctggcaagatgcaaggccaattcagaggctactctggggaagtatgttggtggaagtggaactggcttggcttctgagagtttgtatgtcaaggactacaagtattaggcttctaaatggacttggggactgatttggggtgactgcattctggtatatatatatgtatgatacagcctaagtaagcatttgcttctgattaacatgcttatttttgggttacatgtttttcaaatactggttcgtgttataggagctaatttaatgtcaaatgatgatggtgtaccactaaaaaataattgttagatgaaggctggtatatatattgtcataaacagtaatatagataattaaatgtgaattcgtatagttaattttctaaacaaaaaaaaaagtaaaaactctag

SEQ ID NO: 1550 - DNA, 1494 bp, Gossypium hirsutum
ccctcttccttttccactcgctctcttttccttgtcaccaaaaaacatctttctgttcaattcaatcctcctttttctattcaaccataatgtcttgcttcattagcaaatacgccgatgagttggctaaaaacgctgcttacattggcacccctggaaagggtatccttgctgctgatgaatccacatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgcttcggcaagcccttcgttgatgttttgaaggaaggtggtgtcctccctggcatcaaggtcgacaagggtaccgttgagcttaacggaaccaggcgagactttcacccagggtctggatggccttgcacagcgatgccagaagtactatgaagctggtgctcgctttgctaaatggcgtgctgtccttaagatcagtgctaatgagccaaccgtgcaatccaagaaaatgccaacgggctagctatgtatgctgccatctgccagcaatgtggccttgttccaatcgtcgaacctgaaattcttgttgacggatcacatgacattcaaaagtgtgctgcagtgacagagcgtgttcttgctgcctgctacaaggctctaaatgaccaccatgtcatgcttgagggtactcttttgaagcctaacatggtgacccctggttcggactccccgaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaactcagaagccactttgggtacatacaagggtgatgcagagctttgtgagggtgccgcagagagccttcatgtcaaggactacaaatattaagaaattaggcttgtggtcaaatatgtgatgtttagcagagtaaattccggtattgatattagggttctagtgtttttttcttcttcttttgagtttctgccgttgctcatcgactttagtctgtggaatcagacaaattacaaataaggtttgggagcctttgtgctcgttgagtatttttggttttctgtttatttcagtttaaaacaaaattctctgcttagttgagtgtaagcccgcattgtgggacaaaaatgaccaagtataagcccttattctgttggttatttcttattgatttgcttttcatgattcatcaatcgtaatattacatttggaggcc

SEQ ID NO: 1551 - DNA, 1172 bp, Pisum sativum
atgtcgcacttcaagagcaagtaccatgatgagcttattgccaatgctgcctatattggcacacccggtaagggtattcttgctgctgatgagtcaactggaacaatcggtaagcgtctagcgagcatcaatgttgagaatgttgaatccaacagacaggctcttcgtgagcttcttttcactgctcctggtgttcttcagtacctcagtggagttatcctctttgaggaaaccctctaccaaaaaacagctgcaggcaagccttttgttgatgttttgaacgaagctggtgttcttcctggtatcaaggttgacaagggtaccgtcgaacttgctggaactgatggagaaaccaccactcagggtcttgatggtcttggtgcacgctgtgcaaagtactacgaagccggtgcacgatttgctaaatggcgtgctgtgcttaaaatcggtgccaacgaaccatcagagcactctatccatgagaatgcttacggattggcccgttatgccgtcatatgccaagagaacggacttgtccccattgttgaacctgagatccttgttgatggttcacacgatattctcaagtgtgctgccattaccgagcgtgtccttgccgcaacttacaaggccttgagtgatcatcatgtcatccttgaaggaactctcttgaagccaaacatggtgacacccggatctgatgcaccaaaggttgcacctgaggttattgccgagcacaccgttagagctctgcagagaaccgtccctgccgcagttccagctgttgttttcttgtctggtggacagagtgaagaagaggccagtgttaacctcaatgccatcaaccaaatcaaaggtaagaagccatggactctttccttctctttcggaagggcacttcaacagagtacccttaaggcatggggtggaaagacagaaaatgtgaaggcagctcaagatgctttgttgacaagagctaaggctaattctgaggctactcttggaacttacaagggtgcctcaaaccttggtgctggtgcctcggagagtcttcatgttaaggactacaaatattgatcaatgctggtttcttctcccttaaaagactagaagagggttgaatttcttgtttttgagtatagtggggtttactcacgacaaaataattgggt

SEQ ID NO: 1552 - DNA, 1292 bp, Sciadopitys verticillata
ttttgacaaaatgtctgcatactgcggaaaatacatagaggagctcatgcagactgccaaatacattgcgacacctggcaagggtattcttgcagcagatgagagtactggaactattggcaaacgtctggcaagcatcaatgttgagaatgtagaggccaatcgtcaggtacttcgagaattactcttcacaagtcctggttgtcttccgtatttaagtggagttattctttttgaggaaactctttaccagaaaacagcaagtggcaagccttttgttgaggtgcttcaggaaggtggagttgtacctggtatcaaggtggataagggaacagttgagttggctggtacaaatggcgaaacaacaacacagggacttgatgggcttgctgcaagatgccaacagtattacaaagctggtgcaaggtttgccaagtggagggcagtgctaaaaattggcccaaatgaaccctcagagcttgcgattcaacagaatgctcatggcttggctcgttatgcaataatatgccaagagaatggcctagttccaatagtagaacctgagattttaactgatggacctcatgatatcaaacaatgtgctgaagttactgaaaaggttcttgcagcatgctataaagccttgaatgatcaccatgtccttttggaaggcactctgctgaaaccaaacatggtaactactggatcagatggtcccaaagtccctccagaggtaatagcggagtacactgtaagggcgttgcagagaacggttccagttgcagttcctggaattgtttttctctctggtgggcagagtgaagaggaagccactttgaacttgaatgcaataaataaactcaacacaatcaagccttggacactgtcattttcctttgggcgagcactgcagcagagcactcttaagacatggggtgggaaaaaggacaatttgggagctgcacagaaggcattccttgttcgttgcaaggccaattcggaagcaactctgggaaaatatggtggaggtgctggtgtcgggcttgccactgaaagccttcatgttaaagattacaagtactgaacgtgtagcaacttgacctgcagtgtttactaattttacaaatcgctttctccattgagctacctactccatgttgattgcactatgaagaaacatagcaatctattattgaaattttaactgtaatgttatctgcaagtactaggtaagtaggtaatacgaagaatatattattagagaagagataaatttgaaagttgatcagttt

SEQ ID NO: 1553 - DNA, 1116 bp, Ricinus communis
tctatctaagccctccctatccaatatcctaaagctttagccatgtcggcctttgttggcaaatatgcagaggagctgatcaagactgccaagtacattgccactccagggaagggcattttggcagcagatgagagcacaggaaccattggcaagcgtttagccagcataaacgttgagaatgttgagtcgaaccgccaagcactccgcgagctccttttcacctcccccaatgccctctcccacctttcaggtgttatcctctttgaagaaactctctaccagaaaacctctgatgggaaaccattcgttgaagtcctccaagaaaacaatgttgttcctggtatcaaagttgacaagggcacggttgaattagcaggcacgaatggtgaaactactactcaaggctttgactcgcttggcgctcgctgccagcagtactacaaggcaggtgcccgattcgccaagtggcgtgctgtccttaagattggtccgactgagccttctgaattggcaatccagcagaatgctcagggcttggctcgttatgccattatttgtcaggaaaatggactggtgccaattgtggagcctgagatcttgaccgacggtcctcatgatatcaagaagtgtgctgctatgactgaaattgtgcttgcagcagtttacaaggcactgaatgatcaacatgtccttcttgaagggactctcctcaagcctaacatggttactcctggctctgatagcccaaaggtaacaccagagatgattgccgagtacactgttactgcactacgccggacagttccaccagctgttccagggattgtgtttctgtcaggtggacaaagtgaagaggaggcaaccctgaatctcaatgcaatgaacaagcttccagtgttgaaaccatggacactgtccttctccttcggacgagcattgcaacaaagcacactcaaaatatgggcaggaaagaaagagaatatcgagaaagctcaggaagtattcttggtgaggtgcaagagcaattctgaagcaactcttgggaagtacactggaggaggtgctagtgggttggcttctgagagcttgtacgttaagggatacaagtactag

SEQ ID NO: 1554 - DNA, 1572 bp, Picea glauca
aaattagcttactcactaaggttattgtattgtgcgctatttggatatctgtgtgcggtgttttgtactgtttcgtttgttcagtccccaagctcttgcagaaatgtcttgttttgaaggaaaataccgtgatgagctgattgccaatgcggcgtacatagctacacctgggaagggaattctagctgcagatgagagcactggaaccatcggaaagcggttggcgagcatcaatgtggagaatattgagaccaacaggcgtcagctgagggagttcctcttcactgcccctaatgccgtgcagtatttgtgtggtgcaattctgtttgaagagactctctatcagaaaagtgcagctgggaagccctttgttgatatcctcaacgaaggaggggtactgcccggcataaaagtagacaaaggcacagtggatcttgcgggaaccaaaggtgaaaccaccacccaaggcctggatggccttgcacagaggtgccaacaatactataatgccggagcaaggtttgcaaaatggagggctgttctaaagattggaactacggagccctccccacttgctattcaggaaaatgcaaatggccttgctcgttatgctatcatttgccaagagaatggtctagttcccattgttgagcctgaaattttggtggatgggcctcatgatattaaaacctgtgcagctattacagagagggtattagctgcctgttacaaggccctcaatgaccaccatgtcctcctcgagggcacactccttaaacccaacatggtaaccccaggttctgatgctcccaaggttacccctgaggttattgcagagtacacaataagggctcttcagaggactgtgccccctgcagtgcccggcatcatgtttctatcgggtgggcagagtgaggaggaagccaccttgaacttgaatgccatgaacaagctgcagaccaagaagccctggaccttgtcattctcctttggccgggctcttcaggccagcactttgaagacatgggctggaaagactgagaatatccctgcggcacaggctgctttcttatctcgctgcaaggccaattctgaggccactttgggcaagtatgcaggtgattcttctaagggcaatggagtttccgagagccttcatgtgaaggactataaatattgattcatgatcacttgctatccatccatgcatccatcagtgaaaatgagaaccccagagaggagacattttcatttgaatttcattttagtgggttgttaggtgagtttgacagcttctttctcattcattctgcatatcttatgatgtgttgaagagaatgaatgaattgtttagttttggcattagaattagagagaataatgatagaggtatttacttctcgtttcagataacagttcttctaactggaagttgtcttttttcaactttgaatgggataataagtagtaaaatatacaatgtttggcattttgaaatagtttgtgtctgtaaattcgcctcaacctttttattcactttgaagaagacagtttcactgaaaactgaagtag

SEQ ID NO: 1555 - DNA, 1314 bp, Tragopogon dubius
tactcagcatcactctcactctctccctcactcgtaagccatgtcagccttcgtcggaaagtacgccgatgaattgatcaagaatgccaagtacatcgccactccgggaaagggtatattggctgcagatgagagcaccggaaccatcggaaaacgtctctctagcatcaacgtcgagaacgttgagtcaaaccgccaagcccttcgtgaactcctctttaccgctccaaacgcagtaacttacctctccggtgtcattctctttgaggaaaccctttaccagaaaaccgccgccgggaagcctttcgttgatgttcttcttgaagccaatgtccttccggggattaaagtcgataagggtgtggtagatctttccggcaccaatggtgagaccaccactcaagggttagacggacttggtgctcgttgtgctaagtactacgaggccggtgcccggttcgctaagtggcgtgcagtccttaagattggtgccactgaaccatcggagttgtctattcaacagaacgcccaagggttagctcgctatgcaatcatttgtcaagagaatggacttgtacccattgttgagccggagatattgaccgacgggagccatgacatcaagaaatgcgcgtacgccaccgagatggtgttggccgcggtttacaaggcgctcaacgagcaacatgtgcttcttgaaggaaccctcttgaaacctaatatggttacacctggctctgatagccctaaggtgacaccggaagtgattgctgaatacaccgtaacagcactacgcaggacggtgccagcggcggtgccgggaattgtgtttctgtcgggtgggcaaagtgaagaagaggcgacggtgaaccttaacgcgatgaacaaactggaggtgttgaagccatggacgctgacgttttcatttgggcgagcactgcagtcgagcacccttaaaacatgggcggggaaggaggagaatgtggcggcggcgcaggctgtgttcttggcacggtgcaaggctaactcggaggcgactcttgggaagtacgccggtgatgacgcgggtggtttggcttcagagagtctgtacgtgaagggatacaaatactaattaaccaagctacgcatgaagtagtgatcaaatgagttggtgggaaatggtgttattttaattgttatgttatgttcatattcttacattacgatctatacgttgttacttgtctactctctatacatatcgattgttcttcctagctagtctgtcatttatattaatttctcttatggtgatcaacaaggaagtatggc

SEQ ID NO: 1556 - DNA, 1263 bp, Medicago truncatula
gtgctgtcgtctattatctgtttgtttcccgccatccaatttcaaagcatgtctgcctttgttggaaagtatgcagatgagcttatcaagaatgccaagtatatagccacccctggcaagggtatcttggcagcagatgagagcactggaactattggcaagcgtctagcaagcatcaacgttgagaacattgaggctaaccgtcaagccctccgtgaacttctcttcacctctcccaatgcactccaatacctctccggtgtcatcctctttgaggaaactctttaccagaattcctccgaggggaagccttttgttgaaatcctccaagagaacaatgtcataccaggcatcaaagttgacaagggtgttattgaattagctggaacaaatggtgaaacaacaacacaaggttttgactcccttggagctagatgccagcagtattacaaagctggagcgcggtttgccaagtggcgtgcggtcctcaagattggtcccaatgagccctctgagttgtctatccagcaaaatgcacagggcttggctcgctacgccatcatttgccaggagaatggccttgtgcctattgttgagcctgagattttaaccgatggatctcatgacatcgccaaatgcgccgctgtcactgaaactgtacttgcagctgtttacaaggcactgaatgatcagcatgtccttcttgaaggaactcttctcaagcctaacatggttaccccaggttctgatagtccaaaggtaacacctgaggtgattggtgagtacacagttactgcgttacgcagaactgtcccagccgcggtaccaggggttgtatttctgtcaggtggacaaagtgaagaacaggctacactaaacctcgatgcaatgaacaagctagatgttgtgaagccatggacactttcattctcatttgggagagcactgcagcaaagcacactcaagacatgggctggaaagaaagagaatgttggcaaagctcaagaggtatttctggcaagatgcaaggccaattctgaggctactcttgggaaatatggtggtggaagtggaactgggttggcttctgagagtttatatgttaaggactataagtattagccttctaaatgaagaggttggggattgatttcaggtggatgcattttacatatgtaatattatactgcttaaagcttttgcttctgattaacatgtttaattctgcatatatatatttataaatataaatatcatcagttc

SEQ ID NO: 1557 - DNA, 1494 bp, Glycine max
gtgctgtcgtgtgttatctgtttcccgccatatatccaataagctttaaccatgtctgcctttgttggaaagtacgcagatgagcttatcaagaatgccaagtacatagccacaccagggaaggggatcctggcagcagatgagagcacgggcaccatcgggaagcgcctagcgagcattaacgttgagaacattgaggccaaccgccaagcccttcgcgagcttctcttcaccgctccaaatgccctccaatacctctctggtgtcatcctctttgaggaaactctttaccagaagacctctgatgggaagcctttcgttgaggtccttcaagagaacaatgtcatcccaggcatcaaagtggacaagggtgttgttgagttggctggcacaaacggtgaaaccaccactcagggcttcgactctctcggagctcggtgccagcagtactacaaggctggtgcacgctttgcaaagtggcgtgcagttctcaaaattggcccaactgagccctctcagttgtccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccacctgaggtgattgctgagtacacagttcaagcactccgcaggactgtcccagctgcggtgccaggggttgtgtttctgtctggtgggcaaagtgaagaagaagctaccctcaacctgaatgcaatgaacaagtcggagctgttgaagccatggactctctcattctcattcgggcgagcactgcaacaaagcacactcaagacatggggtggaaagaaggagaatgttgccaaagctcaagaggcatttctggcaagatgcaaggccaattctgatgctactctgggaaagtatgttggtggaagcggaagtggcttgacttctgagagtttgtatgtcaagaactacaattattaaacttctaagagtgtgtttgtttctccttttaaaatccatttaaacgtcaatccatgcttttggttcagtcacgttgaggtgcataagaaagcgtgacaagggagaaacaaacatactctaaatggacttggggactgatttgggctaagtgcattgtggcagatgtatgatacagcctaaggatttgcttctgattaacatgcttatttttgggttacatattttttacaaacatcagttattatgttataggagccaattttaatgtcaaatggtgatagcgtaccactcaaataattgttagagggaggctggtatatattgtcagaaacagtaatatactttataaaatgtgtaattacttaacac

SEQ ID NO: 1558 - DNA, 1322 bp, Glycine max
gtttcccgccatatatccaataagctttaaccatgtctgcctttgttggaaagtacgcagatgagcttatcaagaatgccaagtacatagccacaccagggaaggggatcctggcagcagatgagagcacgggcaccatcgggaagcgcctagcgagcattaacgttgagaacattgaggccaaccgccaagcccttcgcgagcttctcttcaccgctccaaatgccctccaatacctctctggtgtcatcctctttgaggaaactctttaccagaagacctctgatgggaagcctttcgttgaggtccttcaagagaacaatgtcatcccaggcatcaaagtggacaagggtgttgttgagttggctggcacaaacggtgaaaccaccactcagggcttcgactctctcggagctcggtgccagcagtactacaaggctggtgcacgctttgcaaagtggcgtgcagttctcaaaattggcccaactgagccctctcagttgtccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccacctgaggtgattgctgagtacacagttcaagcactccgcaggactgtcccagctgcggtgccaggggttgtgtttctgtctggtgggcaaagtgaagaagaagctaccctcaacctgaatgcaatgaacaagtcggagctgttgaagccatggactctctcattctcattcgggcgagcactgcaacaaagcacactcaagacatggggtggaaagaaggagaatgttgccaaagctcaagaggcatttctggcaagatgcaaggccaattctgatgctactctgggaaagtatgttggtggaagcggaagtggcttgacttctgagagtttgtatgtcaagaactacaattattaggcttccaagactgtgtttgtttctctgtttaaactctgtttaattttcaatccatggttttggttcagtcacgttgaggtacataggaaaacgtgagaattgagaaacaaacaactgtaaatggacttgagaactgatctggggtgggggcattctggcatatatatgatacagtctaagcatttgcttctgattaacatgcttatttttgggtta

SEQ ID NO: 1559 - DNA, 1494 bp, Glycine max
tcgtgctgttgtctgttatctgtttcccgccatatatccaataagctttaaccatgtctgcctttgttggaaagtacgcagatgagcttatcaagaatgccaagtacatagccacacctgggaagggcatcttggcagcagatgagagcactggcaccattgggaagcgcctatcgagcattaacgttgagaacattgaggccaaccgccaagctcttcgcgagcttctcttcaccgctccagatgccctccaatacctctctggtgtcatcctctttgaggaaactctttaccagaaaacctccgatgggaagccttttgttgaggtccttcaagagaacaatgtcatcccaggcatcaaagtggacaagggtgttgttgagttggctggcacaaatggtgaaaccaccactcagggattcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccaccagaggtgattgctgagtacacagttcaagcactccgcaggactgtcccagctgcggtgccaggggttgtgtttctgtctggtgggcaaagtgaagaagaagctaccctcaacctgaatgcaatgaacaagttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaagtattaaacttctaaagagtgtgtttgtttctccttttgaaaacgtcaatccatgcttttggttcagtcacgttgaggtctataagaaagtatgacaatggagaaacaagcatactctaaatggacttggggactgattcggggtggtctggcatatgtatgatacagcctaagaagcatttgcttctgattaacatgcttatttttgggttacatacttttacaaatatcagttattatgttataggagccaattttaatgtcaaatggtgatggtgcgtaccactaaaaaataattgttggagtgaggctggtatatattgtcagaaacagtaatattatactttataaaatgtgcaattacttaacacagg

SEQ ID NO: 1560 - DNA, 1457 bp, Glycine max
ggctgaactcctttttcgtgctgttgtctgttatctgtttcccgccatatatccaataagctttaaccatgtctgcctttgttggaaagtacgcagatgagcttatcaagaatgccaagtacatagccacacctgggaagggcatcttggcagcagatgagagcactggcaccattgggaagcgcctatcgagcattaacgttgagaacattgaggccaaccgccaagctcttcgcgagcttctcttcaccgctccagatgccctccaatacctctctggtgtcatcctctttgaggaaactctttaccagaaaacctccgatgggaagccttttgttgaggtccttcaagagaacaatgtcatcccaggcatcaaagtggacaagggtgttgttgagttggctggcacaaatggtgaaaccaccactcagggattcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccaccagaggtgattgctgagtacacagttcaagcactccgcaggactgtcccagctgcggtgccaggggttgtgtttctgtctggtgggcaaagtgaagaagaagctaccctcaacctgaatgcaatgaacaagttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaagtattaaacttctaaagagtgtgtttgtttctccttttgaaaacgtcaatccatgcttttggttcagtcacgttgaggtctataagaaagtatgacaatggagaaacaagcatactctaaatggacttggggactgattcggggtggtctggcatatgtatgatacagcctaagaagcatttgcttctgattaacatgcttatttttgggttacatatttttacaaatatcagttattatgttataggagccaattttaatgtcaaatggtgatggtgcgtaccactaaaaaataattgttggagtgaggctggtatatatt

SEQ ID NO: 1561 - DNA, 1176 bp, Salvia sclarea
ctactagaccttggctgtcactcaacatcttcctccaaagtctcatctctgtctctgtatctctctctcgtttcttcccttttcttctcttcacatattgaatctgcaactatgactgcctaccgcggaaagtacgctgatgagcttattgccaatgctgcatacattggtactcctgggaagggtattcttgctgctgatgaatctactggaaccattggcaagcgtttatcgagcatcaatgttgagaacattgaggctaacaggagggctctacgtgaacttcttttctgcgctcctggtgcccttcaatacctgagtggtgtgatcctttttgaggaaactctgtaccagaaaactgctgcaggcaagccttttgtagatgtattgaatgagggcggtgttcttcctggtatcaaggtcgacaagggtaccgttgagcttgctggaaccaatggtgagactaccacccaaggtcttgatggcctggcccagcgttgccaacaatactatgctgctggtgctcgttttgctaaatggagagctgtgctgaagattggtgccaatgagccatcacagcttgctatcaacgacaatgccaatggtctggcacgttatgccatcatctgccaggagaatggcttggtaccaattgttgagcccgagatccttgtggatggctcccacgacatcaacaagtgtgctgaggtgacagagcgtgttcttgctgcttgctacaaggccctcaacgaccaccacgtactgttggagggaacattgttgaagcccaacatggtcacacccggctctgatgctcccaaggttacccccgaggtggttgccgagtacaccgtccgtgccttgcaacgaacaatgccccctgcagtcccggctgttgtctttttgtctggtggacagagtgaggaagaggccacccgcaacctcaacgccatgaacaagctgaaggcaaagaagccatggaccctctctttctcgttcggacgtgctctacagcagagcaccctaaaggcatgggccggcaaagaggagatgtcggaaggctcatgctgcattgcttacagtgcaagccactcagaagcaacactcggacctacaggtgacagcgctttgggcgagggtgccgatggagagcctccacgtagactacagtactaa

SEQ ID NO: 1562 - DNA, 1730 bp, Pinus pinaster
gggatgatgttggtaaccaagccaagtaagcaacattaccactgcaacaactatcctaccgcctttgccacgtcagcactttgatacagtcggcaagttggacgatgctttcggggtagaagttgataggcatcttggtggcatcaatttataaattagcatcactcactcactcaggttattgtattagtgtgcgatttggttatctgcggcgattttttgtagtgttttgtttgatcattcctcaagctcttgtagaaatgtcttgcttcgaaggaaaataccgcgatgagctaatcgccaatgcggcgtacatagcaacacccggtaagggaattctagctgcagatgagagcactggaaccatcggaaagcggttggcgagcatcaatgtggaaaatattgagagcaacaggcgtctgttgagggagttcctcttcactgcccctaatgccttgcagtatttgagtggtgcaattctgtttgaagagactctctatcagaaaactgcagctgggaagccctttgttgatgtcctcaacgaaggaggggtcctgccgggcataaaagtagacaaaggaacagtggatcttgcgggaaccaaaggtgaaaccactacccagggcctggatggccttgcacagagatgccagcaatactataatgccggagcaaggtttgcaaaatggaggtccgttctgaagatcggaactacggagccctccccacttgctattcaggaaaatgcaaatggccttgctcgttatgctatcatctgccaagagaatggtttagttcctattgttgagccggaaattctggtagatgggtctcatgatattgaaacctgtgcggctgttacagagagggttttagctgcctgttacaaggccctcaatgaccaccatgttctcctcgagggaacactccttaagcccaacatggtaacaccaggttctgattctcccaaggttacccctgaggttattgcagaatacacagtaagggctcttcagaggactgtgccacctgcagtgcccggcataatgtttctatccggtgggcagagtgaggaggaggccaccttgaacttgaatgccatgaacaagctgcagaccaagaagccctggactttgtcattctcctttggccgggctcttcaggccagcactttgaagacatgggctggaaaggatgagaatattcctgcggctcaggctgccttgttatctcgatgcaaggcgaattctgatgccactttgggcaagtatgcaggtgattctgctaagggcaatggtgtttctgagagccttcatgtcaaggactataagtattgattgatgaccacctgctatccatccatcttcagtgaaaagatagaccccagagatgagatattttcatttgaatttcatgttagtgggttgttaggcgagtttgacattttctttctcattcattctgcatatcctatgatgtgttgaagagaatgaatgcatggattagttttgacgttggaattatattgttttcaattgctgttttagttttattagaataatgatccgaggtatttaaaccttgtttcagataacagttcttctaactggaagttgttttcatttaagaataagtagcaaaatatatgtttggcgttctgaaatagtttatgtttataaattggttctaacctttatattaacttagacaaagatacggtttcaagagat

SEQ ID NO: 1563 - DNA, 1171 bp, Platanus occidentalis
ttattatctgcaaccatgtcggccttcataggaaagtacgcagatgagctgatcaagaatgccaagtacatagccacccccggcaagggcattctcgctgccgatgagagcaccggcaccatcggcaagcgtctggccagcatcaacgtcgagaacatcgaatccaaccgccaagcccttcgcgagctcctcttcacctgccccaacgccctccccttcctctcaggagtcatcctcttcgaggagaccctctatcagaacacctccgacggcaagccattcgtggaagtccttcaagaaaacaatgtcatcccaggtatcaaggtcgacaagggcaccgtcgacctcgctggcaccaatggtgagaccacaacccaagggttcgactcacttggcgcacgttgtcagcaatattacaaggctggagcacgctttgccaagtggcgtgctgtccttaagattggccccaccgagccatccgagttggcaattcaacaaaacgcacagggattggctcgttatgcaatcatctgtcaggagaatggacttgttccaatagttgagccggaggttctaactgatggcagtcatgacataaagaaatgtgcagctgttacggagactgtgctggctgctgtgtacaaggcactgaatgatcaacatgtccttctggaaggaaccctcttgaagcccaatatggtcactcctggctctgatagcccaaaggtaactccagaggtgattgcagaatacaccgttgcggcattgcgtcggactgttccgccggcggtgcccggaattgtgttcctgtcaggcgggcagagcgaggcggaggcaacattgaatttgaatgccatgaataagttggatgtggtgaagccgtggacactttcattctcatttgggcgagctctgcagcaaagcacactcaagacatgggctgggaagaaggagaatgtggccattgctcagggggcattcttggcaaggtgcaaggcgaactcagaggccacacttgggaagtatacaggtggtagcgatggtgggttggcttccgagagcttgcatgttaagggatacaagtattaattaagctatatgaagggataccaaagtgaaatgtgtccgaatttctactcttcttcaccgtgcttattttagagtaaatatt

SEQ ID NO: 1564 - DNA, 1558 bp, Pseudotsuga menziesii
atttggctttgtgtatcgacgttttcaagtgttttgttttatcagtcccgaatcttctgcagaaatgtcttgcttcgaaggaaaataccatgatgagcttattgccaatgcgtcgtacatagctacaccggggaagggaattctagctgcagatgagagcactggaaccatcggaaagcggctatcgagcataaacgtggagaatattgagagcaacagacgtcagctgagggagttcctcttcactgcccctaatgccttgcagtatttgtgtggtgcaattctgtttgaagagaccctctatcagaaaactgcagctgggaagccctttgttgatgtcctcaacgaaggaggggtcctgcctggcataaaagtagacaagggcacagtggatcttgcgggaaccaatggtgaaaccaccacccaaggcctggatggccttgcacagagatgccagcaatactataaagctggagcgaggtttgcaaaatggagggctgttctgaagattggacctacagagccctccccacttgctattcaggaaaatgcaaatggccttgctcgttatgctatcatttgccaagagaatggtctggttcccattgttgagcctgaaattctggtggatgggcctcatgatattaaaacttgtgcagctattacagagaaggtactggctgcctgttacaaggccctcaatgatcaccatgtcctcctcgagggcacactccttaaacccaacatggtaaccccgggttctgatgcccccaaagttacccctgaggttatcgcagagcacacagtaaaggctcttcagaggactgtgccccctgcagtgcccggaattatgtttctatccggtgggcagagtgaggaggaggccaccttgaacttgaatgccatgaacaagttgcagaccaagaagccctggaccttgtcattctccttcggccgggctcttcaggccagtaccttgaagacatggggtggaaaggatgggaatattcccgtagcacaggctgctttcttatctcgatgcaaggccaactccgaggcaactctgggcaagtatgcaggtgattcttccaagggaaacggagtttctgagagtcttcatgtcaaggactataaatattaattgatgatcagtgctatccatccatctatcggtgaaaagagagaccccagagagagatattttcatttgaatttcaatttattagtgggttgttagctgagtttgacagctgcttctcattcaaactgcatatccgtttagttttggcattggaattagattattttcaattgctgctttagttctgttagaataaagataaaagaggtatttaagcctctggtttcagctaacatttcttctctttaagctttgagtgggataataaatagtagaatataccatgtttcgcatctgtgaatggtttttatcactgtaagatccccctctggactctcctcaacccctttattaactttggagaagacagaacttcaatgagaactgaaggtagaatctagttaatattacgatggt

SEQ ID NO: 1565 - DNA, 1437 bp, Phaseolus coccineus
ctcttatctgtttcccgccataccattttcaaagctttattaaccatgtctgcgtttgttggcaagtatgcagatgagcttatcaagaatgctaagtacatagccacaccagggaagggtattttggcagcagatgagagcactggcaccattggaaagcgtctagccagcattaacgttgagaacattgaggcaaaccgccaagcccttcgagagcttctcttcaccgctccaaatgccctccaatacctctctggtgtcatcctctttgaggaaaccctttaccagaaaacctctgatgggaagccttttgttgaggtccttaacgagaacaatgtgatcccaggcatcaaggtggacaagggtgttgttgagttggctgccacaaacggtgaaaccaccacacagggctttgactctcttggagctcggtgccagcagtactacaaggcaggggcacgctttgcaaagtggcgtgcagttctcaaaattggccccaatgagccctctgagctttccatccagcagaatgcacagggtttggctcgctatgccatcatctgccaggagaatggccttgtacccattgttgagcctgagattcttactgatggagcccatgacatagccaaatgtgctgctgttactgagattgtgcttgcagctgtttacaaagctctcaatgatcaccatgttcttcttgaaggaactcttctcaaacccaacatggtcactccaggctctgatagccccaaggtagcacctgaggtgattgctgagtacacagttcaggcacttcgcaggactgtcccagctgcggtgccagggattgtgttcctgtctggtggacaaagtgaagaagaagctaccctgaacctcaatgcaatgaacaagttggaggtgttgaagccatggactctctcattctcatttgggagggcactgcagcaaagcacactcaagacatggggtggaaaggaagagaatgttgccaaagctcaagaagcattccttgcaagatgcaaggccaattctgaggcaactctggggaagcatgttggtgaaagccaaactgggttggcttctgagagtttgtatgagaaaaactacaaatattaggcttccaagactgtgtttgtttctctgtttaaatgtgaatccatggtaacaaacacactgtaaacagacttggggtgggggcattctggcatatatatgatacagtctaagcatttgcttctgattaacaggttttattttttgggttacatattttacaaatatcagtttacattataggagctaaattttgcaattaccattatatggcaaagttactgtctgcacttattttgaattcttgtgtaatttgtaagaactttttggcgctgaactcgaatcccgtgtaacttgtaaataacatgttgaattaaacag

SEQ ID NO: 1566 - DNA, 1451 bp, Quercus alba
cacttttcgtcctgttatctatatatatccctttttatccaaagccaatatcaactgatagcttgtaaccatgtcggcctttgtaggaaagtatgcagaggagcttatcaagaatgcgaggtacattgccacacctggcaagggaattttggcagctgatgagagcactggcaccattggcaagcgtctagctagcattaatgtggagaacattgagtcgaaccgccaagctcttcgcgagctcctcttcacttctcccaatgccctcccctacctctctggtgtcatcctctttgaggagaccctttaccaaaaggcttcagatggtaagccttttgttgaagtccttcaagaaaacaatgtcattcctggcatcaaagttgacaagggcacggttgagttagctggtacaaatggtgaaaccaccacacaaggcttggactcacttggtgcaaggtgccagcagtactacaaggccggtgcacgctttgccaagtggcgtgccgtgctcaagattggtcctactgagccatctgaattgtcaatccaacaaaatgctcaaggcttggctcgctatgcaatcatttgtcaggagaatggactggtgccaattgttgagcctgagattttaactgatggtgctcatgacattaagaaatgtgctgctgccactgagattgtgcttgcggcagtgtacaaggcactgaatgatcagcatgttcttcttgaaggcaccctgctaaagcccaacatggttacaccaggctctaatagcccaaaggtaacacctgaggtgatagctgagtacacagtcacagcactccgccgaactgtcccggctgcagtgccagggattgtgttcttgtctggtgggcaaagtgaggaagaggcaacactcaatcttaatgcaatgaacaggttggaggtgctgaagccatggactctttctttctcatttgggcgagctttgcaacaaagcacactcaagacatgggctggaaagaaggagaacgttgggaaagctcaacaggtgttcttggtgaggtgcaaggctaattctgaggccactcttggaaagtattctggtggaggtgctggtggtttggcttctgagagtttgtttgtcaagggttacaagtactaggcctttaatttctagagtggcaactatcatatatctaatgcaattgtaccttccttctttacctgcttagttttggtacatattctacaatgggtggcatattatcgatgcttaaatattgtactgttaatttcccatgtcctgagtttgcctcactaagaacctagccttttgccattagaaattccaaaattgtgactaagagggtctaagatgaacaattaagaaacccaagagggccaagcctttatcttagcccatcaaaaaatgtgtattgctaattcaaagatcctttcaagaaattcaa

SEQ ID NO: 1567 - DNA, 1326 bp, Distylium racemosum
tgctgtttgatttggtggagagatccttgtttttggtggagctctcaagttcttcttgcaacatgtcgtgcttcaaagggaaataccatgacgagctaatcgccaacgcggcctacatcgcaacccctggcaagggcatcctggcggcggacgagagcacgggcaccatcggcaagcgcctcgcctccatcaacgtcgagaacgtggagtccaaccggcgcgctctccgcgaactcctcttcaccaccccgggcgccctccccctcatcagcggcgtcatcctcttcgaagaaaccctcttccagaaatcctccaacggcacgcccttcgtcgacattctgaaggccgccggtgtcctcccgggcatcaaggtcgacaagggcaccgtcgacctccccggcaccaactccgagactaccacccagggcctcgacggcctgggccagcgctgccagcagtactatgccgccggggcccgtttcgccaagtggcgcgctgtcctcaagatcggccccaacgagccatccgagctggcaatccacgagaacgcccacggcctcgcgcggtacgccgtcatctgccaggagaacgggctggtgcctatcgtggagccggagatcctagtcgacggcccccactccattgacgtgtgtgccgacgtcaccgagcgcgtcatcgccgcctgttacaaggcgcttaacgaccaccacgtgttgctggagggcaccctcctcaagcccaacatggtgacgcccggctccgacgcccccaaggtgagccccgacgttattgcggagtataccgtgcgggctcttaggcggacggtgccgccggccgtgccgggtatcatgttcctgtctggcgggcagagcgaagaggaggcgacgctgaatttgaacgccatgaacaagctcaaggtgctgaagccgtggacgctgtcgttctcgttcgggcgagccctccaggccagcacgctcaagacgtgggcggggaaggcggacaacgtggcgaaggcgcaggcggcgttcctatcgcggtgcaaggccaactcggctgccacgctgggcgcttacaagggcgacgctgctgccgtggcgggcgcgtcggagagcctccacgtcaaggactacaaatactgagggcggactttttcaaaatttattttcggaattacgtgtcgttgttgtcaaaatttaataagcgattgcagaacttttaggtgatgatgaggttaaaatttggagttatattacattttaatttaatttttggtaatgggagaactaatgttcatgttgtctaacatttaccttttccttggctttg

SEQ ID NO: 1568 - DNA, 1269 bp, Eucalyptus grandis
gccacgtccgtgttctttgatctgattccgtgtcgcttcgcagacgagctcatcgccaatgccgcctacatcggcactccgggcaaggggatcctcgccgccgacgagtccaccggcaccatcggcaagcggttcgcggccatcaacgtcgagaacgtcgagaccaaccgccgcacctaccgcgagctccttttctgcacccccggagccctccagtgcctgagcggcgccatcctcttcgaggagacgctgttccagaagaccgccgacggcaagcccttcgtcgaggtcctccaggagggcggcgtcctccccggcatcaaggtcgacaagggcaccgtcgagctcgccgggaccaacggcgagaccaccactcaggggctcgacggcctcgcccagcgctgccagcagtactacgccgccggagcccgcttcgccaagtggcgcgccgtcctgaagatcggcgcggccgagcccagccagctcgcgatcaatgagaacgccaacggcctggctcgctacgccatcatctgccaggagaacggcctggtcccgatcgtcgagcccgagatcctcgtcgacggcgaccatgacatcgaccgcagcgccgacgttacggagcgtgtgctcgcggcttgctacaaggcgctcaatgatcaccacgtgctcctggaagggacgcttctgaagccgaacatggtgactcccggatcggattccgccaaggtgccgccggaggtagtggcggagtacaccgtcagggctctgcagcggacggtgccacctgcggtcccgggtatagtgttcctctccggagggcaaagcgaggaggaggcaacggtgcatcttaacgcgatgaacaaaattgaaggtaaaaaaccatggacgctcacgttctcttatggaagagcgcttcagcagagcaccctgaaggcgtgggccgggaaggaggagaatgtggagaaggcgagggaggcttttctggcgaggtgcaaggccaactctgaggctactttgggggcttacagcggcgatgctggttcggtcgaaggtgcttcagagagtctccatgtgaaggattacaagtattgagtaccgagtacgagtgattttattgcttctctttttgttcgttctgttcctaatagttgcttcagaaacaccgactgttgggcaagcagatcatagtcaattgtccaatttttgtttactgatgaattgcatttcatggtgagtttccatagagcctcatgtaagaattgaggtttc

SEQ ID NO: 1569 - DNA, 1713 bp, Gnetum gnemon
gattttcgtcaccgataattgcagagtggataagaagtcagcggtgcagtttgggagtaggatttgtacgtgttctcttagccacgccgtcgccaaattgaatgacatagatagataatagataatgacaagtaattctcagccgttgttttctgaaaactagccacgtcagcgtgccctagagcctgtaaatagccccgtattcgtcgttcactttttgtagctgctgctgctgatcggtgttagttcgatccggtccggttcggttcgccttctgcttcttctcctgtaaaaatggcttgctccaagggcaaataccacgatgaattgatcaagaacgcgagctacattgcgaccccggggaagggcatcctggcagcggacgagagcacggggaccatcgggaagcggctatcgagcatcagcgtggagaacaacgagacaaacaggcgcgccctcagggagcttctcttcaccactcccaacgcgctgcagtatctcagcggagtcatactgttcgaggaaacgctctaccagaagagcaaggacggcaagccgttcgtggacatactgaaagaagggggagtgcttccagggatcaaggtggacaagggcactgtggaactgtcgggcaccaatggcgagacgagcacgcagggtctggacggcctggccaagcgctgccaggactattacgcggccggtgctcgctttgccaagtggagagccgtgctcaaaatcggagccaaggagccttcggagctttcaatccaggagaacgctcagggtttagccaggtacgccagcatctgccaggagaacggcctggttcccattgtggaacctgagatcctggtcgacggatctcatgacatcgaaacctgcgcatatgtgactgagagggttcttgcggcctgttacaaggccctgaacgaccaccatgtcttccttgaaggaactcttctcaaacccaacatggtgacccctggtgccgatgctcccaaggtctctgcagatgtcattgcacagtacactgtgaggacccttcagaggactgttcccgctgctgttcctggcatcatgtttctgtctggcgggcagagtgaggaggaggccacttcgaatctcaacgccatgaacaagctccagaccaagaagccatggactctgtctttctccttcggcagggctctgcaagcttctaccctcaagaagtgggctggcaaggacgacaatgttgctgctgcccaggctgcgtttctcagccgctgcaaggccaattcccaggccaccattggtacctatgttggtgcctcctccattgcttctgctgcatccgagagcctctatgtcaaggactacaagtactgatgatatttcaatctttggttagatttcttgcacccttaataaatacataggattccctttccgcttccctgccctctttcccatagctttctcagaggttcatttacagttgcaagcaactttaacttccggctcctgatgtttaaaatttttgtttgggtttttatcatatgaacttgaatctctcgtaatcataataataattagaatagtagttgcaagttcctgttatttggattggattgctgtcataataacagataattgctttagttttatcggtcaacctcaaggttcgattgaattttgagaaatgaatgtttgaaacctgtcgtttgtaac

SEQ ID NO: 1570 - DNA, 1579 bp, Eucalyptus grandis
tggacgagcgacacgtggcgagggagggatcactcgtcgctttatccgaggatgataaccttcgcagggataatagctcgacacgtgtcggggggtgacacggtggattctgctagtatattccctccccaagcgccgacttctctctgtataagatttgtagggcaatgagagtttgcttcagacctttctccctctatccgcttcttcctcgaagctaacaaaccatgtctgccttcgtgggaaagtatgcagatgagctcatcaagaccgccaagtacatcgccacccccggcaagggaattctggctgcggacgagagcactggcaccattggcaagcgcctagccggcatcaacgttgagaacatcgagtcgaaccgccaggctctccgtgagctcctcttcacctgccccaatgccctgccctacctctccggtgtcatcctctttgaggagactctctaccagaagacgtccgaggggaagccgttcgtcgaggtcctccaagagaacaatgtcatccccggcatcaaagtggacaagggtactgtcgaattggccgggacgaatggcgagaccaccacccagggatttgattcgctcggcgcccggtgccagcagtactataaggcaggtgcgaggttcgccaagtggcgtgcggtcctcaagattgggcctaccgagccttcggaactgtccatccagcagaacgcgcagggtctggcccgttatgccataatttgccaggagaatgggctcgtgccaattgtggagccggagatacttaccgacgggagtcacgacatcaagaaatgtgccgccgctaccgaaaccgtgctcgcagctgtttacaaggcgttgaatgatcagcatgttcttcttgaaggcacacttctgaagcccaacatggtcactccaggttctgacagccccaaggtgccgcctgaggtgatagctgagtacacagtgacggcactccgccggactgtgccaccagcagtcccggggatcgtgttcctgtccggggggcagagcgaggaagaggcgaccctgaacctgaatgcgatgaacaagctggacgtgctgaaaccatggacgctctccttctcattcgggcgggctctccaatcgagcaccctcaagacatggggtgggaagaaggagaacattggcaaggcccaggaggggttcctggcaaggtgcttggccaactccgaggccactctgggcaagtacaccggagggaccgctggcgggttggcctctgagagcttgtttgtgaagggatacaagtactagaaggagagagagagagagagagagagagagagagagtcatgctgggtggttcactgattaatcaaaatcaaattaattgtgtattgcaatactttatatctttttcttttattatttcctccctttctatgcttactttcagtacatactctgaacccaaagcactgtttactctctccagtctctaccaattatattataacttgttctaagtactttgaacttttagaggagttttaaccatggatatgcagtgtcttgtctggataatccatctg

SEQ ID NO: 1571 - DNA, 1346 bp, Eucalyptus grandis
  misc_feature (930)..(930): n is a, c, g, or t
  misc_feature (1329)..(1329): n is a, c, g, or t
agtttcggtccggaattccgggatgcttcttcctcgaacttacaaaccatgtctgccttcgtgggaaagtatgcagatgagctcatcaagaccgccaagtacatcgccacccccggcaagggaattctggctgcggacgagagcactggcaccattggcaagcgcctagccggcatcaacgttgagaacatcgagtcgaaccgccaggctctccgtgagctcctcttcacctgccccaatgccctgccctacctctccggtgtcatcctctttgaggagactctctaccagaagacgtccgaggggaagccgttcgtcgaggtcctccaagagaacaatgtcatccccggcatcaaagtggacaagggtacagtcgaattggccgggacgaatggcgagaccaccacccagggatttgattcgctcggcgcccggtgccagcagtactataaggcaggtgcgaggttcgccaagtggcgtgcggtcctcaagattgggcctaccgagccttcggaactgtccatccagcagaacgcgcagggtctggcccgttatgccataatttgccaggagaatgggctcgtgccaattgtggagccggagatacttaccgacgggagtcacgacatcaagaaatgtgccgccgctaccgaaaccgtgctcgcagctgtttacaaggcgttgaatgatcagcatgttcttcttgaaggcacacttctgaagcccaacatggtcactccaggttctgacagccccaaggtgccgcctgaggtgatagccgagtacacagtgacggcgctccgccggactgtgccaccggcggtcccggggatcgtgttcctgtccggggggcagagcgaggaagaggcgaccctgaacctgaatgcgatgaacaagctggacgtgctgaaaccatggacgctctccttntcattcgggcgggcgctccaatcgagcaccctcaagacatggggaggaaagaaggagaacattggcaaggcccaggaggggttcctggcaaggtgcttggccaactccgaggccactctgggcaagtacaccggagggaccgctggcgggttggcctctgagagcttgtttgtgaagggatacaagtactagaaggagagagagagtcatgctgggtggttcactgattaatcaaaatcaaattaattgtgtattgcaatactttatatctttttcttttattatttcctccctttctatgcttactttcagtacatactctgaacccaaagcactgttcacgctctccagtctcaaccaattatattataacttgttctaagtactttgaacttttanaggagttttgactatgg

SEQ ID NO: 1572 - DNA, 1326 bp, Vitis vinifera
ccctctcactatctaacgttatcatcataagctgaaaccatgtcggcctttgtaggaaagtatgcagatgaactgatcaagaacgccaagtacattgccacccctggaaagggcattttggcagcagatgagagcactggcaccattggcaagcgtctttctagcattaaggttgacaacaatgaacccaaccgccaagcccttcgcgagctcctcttcacctctcccaatgccttgtcctacctatctggtgtcatcctctttgaggagaccctctaccaaaatacacgtgatggcaaaccttttgtggaagtcctccaggaaaacaatgtcatcccgggcatcaaagttgataagggtaccgtcgagttagccggcacaaacggtgagaccacaactcaaggcttcgactctcttggagctcgttgccagcagtactacaaggcaggagctcgttttgccaagtggcgttccgtcctcaagattggccccaccgaaccatctgagttgtcaatccagcaaaacgcgcagggcctggctcgttacgcaatcatctgtcaggagaatgggcttgtgccgattgttgagccggagatcttaaccgatggggatcatgacatcaagaaatgtgcagctgtcactgaaacagtgcttgcagcagtttacaaggcgctgaatgatcaccatgttcttctggagggaactctcctaaagcctaacatggtcacaccaggctctgctggaccaaaggtatcatctgaggtgattgctgagtacacagtggcggcattgcgcagaaccgtgccgcctgcagtgccagggattgtgttcttgtcaggtgggcagagcgaggaagaggcgacactcaacttaaatgctatgaataagttggaggtgttgaagccgtggacgctttcattctcctttgggcgagctttgcagcaaagcacactcaagacatggagcggaaagacggagaatgtggggaaagcgcagggtgcattcttgggaaggtgcaaggccaattcggaggccactcttggaaagtatgaaggtggaaccggtggtgggttggcttctgagagcttgtatgtgaaggggtacaagtactaatcaacatgtggggaatgggaattaattatgaaatgtatggtgtaaacttactaattctctctttaccattcatgcttataattttcagtacatattcaagagatgtttaattgttatacatttgcatcacgtacatgatgatgatattaatttgggagaattgggctttagacccatttgactttgataattaataaaaagtccttcaaacac

SEQ ID NO: 1573 - DNA, 1257 bp, Helianthus annuus
cgggggtcttaaactcaccatctcccttacaacttacaagccatgtcggccttcgtcggaaagtatgccgatgagttgattaagaatgccaagtacatcgccacaccaggcaagggtatattagcggctgacgagagcaccggaaccattggaaagcgtctctcgagcatcaacgttgagaacatcgagtcgaaccgccaagctcttcgtgaactgctgttcaccgcaccaaacgcgctaccttacctctcgggtgtcattctttttgaagaaaccctatatcaaaaaactgctgatgggaaaccttttgttgatgtcctcctagaggccaatgtccttccgggtattaaggttgataagggtgtggttgaccttgctggcaccaacggtgagaccaccactcaagggtttgacgggcttggtgcccgttgtgcagccttttacaaggctggtgcacggttcgccaagtggcgagctgtgcttaagattggagcgactgaaccctctgagctttctatccaacagaacgctcaggggttggctcgctacgcaatcatttgtcaagagaatgggcttgtgcccatagttgagccagagatattgaccgatgggagccatgatatcaagaaatgtgcttatgcatccgagatggtgttggctgcggtttacaaagcgctcaacgagcaacatgtgcttcttgaaggaaccctcttgaaaccgaatatggtgacacccggatctgatagccctaaggtgacaccagaagagattgctgaatataccgtgacaacactacgtaggacagtgccagcagcggtaccaggagtcgtgtttttgtcgggtgggcaaagcgaggaagaggcgacagtgaacctgaatgcgatgaacaagctggatgtgttgaaaccatggacactatcattctcgtttggacgcgcattgcaagcaagcaccctgaagatatggggcggtaagaaggagaacgtggcagcggcgcaagccaacttcttggcgaggtgcaaagctaactccgaggcgactctcggaaaatacggtggagatggtgccggtggtttagcctccgagagcttgtatgtgaaaggatacaaatactaactaagctacccaagaagtagtgaaaataaatgtggcatattatcgtgttaagtgcattatatgttcatatccttacattacgattcatactttgtaacttcactcctctccctttatgtatttatataatgatctttattc

SEQ ID NO: 1574 - DNA, 1343 bp, Helianthus annuus
cgcagagtacacggggatcatttccttcctctctccctccattcaccattatcattttttaaatctaacaatcatgtcttgctacaagggaaagtatgctgatgagcttattgccaatgctgcctacatcggtacacccgggaagggtattcttgctgctgatgagtccactgccacgatcggaaagcgcctttccagcatcaatgtcgagaacaacgagtccaacaggcgagccctacgtgagcttcttttctgcactcctggtgcccttcaatacatcagtggaatcatcctttttgaggagactctctaccagaagactgctgcaggtaagccctttgttgagctaatgaaggaggctaaggtcctccctggaatcaaggttgacaagggtgttgtcgagcttgctggaaccaacggcgagacaaccaccacaggtcttgatggtcttggccagcggtgcgctaagtactatgaagccggtgctaggttcgccaagtggcgtgccgttctcaagattggcgccaacgagccatccccgcttgccattatggaaaacgctcatgggttggcccgatatgcgatcatatgccaagagaacggtctagttcccattgtcgagccagagatccttgttgatggacctcatgacatcaacaagtgtgctgatgtaaccgagcgtgttctggctgaatgctacaaggctcttaatgaccataaagtgcttcttgagggtacccttttgaaacccaacatggtgacccctggatctgacgccaagaaggttgcacctgaagtggtgggtgagtacactgtccgtgcccttcaaagaaccatgcctccagcggtcccagccgtggtgttcttgtctggtggtcaaagcgaggaggaggcctcggtcaacctcaatgccattaaccagtacaagggtaagaagccatggagtctaaccttctcgtatggacgggccctacagcagagcacccttaaggcatgggccggtaaggaagagaatgtgaagaaggcacaggaggtgttccttggtcgctgcaaggccaattctgaggcgagtgaagggaaatataagggtggtgctgctggcgagggtgctaacgagagccttcacgtcaaggactacaagtactgatttgtcacgggtataaacatatctgatatctcgttggcttaagcctcgggtcatatatgttttggttttttatttcggtctagtgtaacgatgtctaaaaataagcccgacaagcgttgggcattggtcgaggatgatgataactcgacccgttttaaacttctatttatttttttttctttttatggtctataca

SEQ ID NO: 1575 - DNA, 1841 bp, Abies balsamea
gtttatcagtccctaatctcttgcagaatgtcttgcttccaaggaaaatatcatgatgagctgattgctaatgcggcgtacatagctacacctgggaagggaattctagctgctgatgagagcactggaaccatcggaaagcggctggcgagcatcaatgtggagaatattgagaccaacaggcgtctgttgagggagttcctcttcactgctcctaatgctttgcagtatttgagtggtgcaattctgtttgaagagactctctatcagaaaactgcagctgggaagccttttgttgatgtcctcaaggaaggaggggtcctgcccggcataaaagtagacaagggcacggtggatcttgcgggaaccaatggtgaaaccaccacccaaggcctggatggtcttgcgcagagatgccaacaatactataatgccggagcaaggtttgctaaatggaggtctgttctgaagattggaattacggagccctccccacttgctattcaggaaaatgcaaatggccttgctcgttatgctatcatttgccaagagaatggtctggttcctattgttgagcctgaaattttggtcgatgggcctcatgatattaaaacctgtgcagctgttacagagaaggtattggctgcctgttacaaggccctcaatgaccaccatgtcctcctcgagggcactctccttaaacccaacatggtaaccccgggttctgattctcccaaggttgctcctgaggttattgcagagcacacagtaagggctcttcagaggactgtgccccctgcagtgcccggcatcatgtttctatccggtgggcagagtgaggagcaggccaccttgaacttgaatgccattaacaaactgcagaccaagaagccatggaccttgtcattctccttcggccgggctcttcaggccagcaccttgaagacatgggctggaaaggatgggaatatccccgctgcacaggctgccttattatctcgatgcaaagcgaattccgaggccactttggccaagtatgcaggtgattcttctaagggcaatggtgtttctgagagccttcatgtcaaggactacaaatattgattgattatcactgctatccatccttccatcggtgaaagagaggagacatttgaatttgaatttcagattagtgggctgtggtgaagagaatgaatggttaggtgtttttggtgaatgaatggtttaggtttttcggcattggagtgaaaagagtatattactttcaattgctgatgtagtttattagaataatgagaggtatttaagctcccttgtttcagataacagttcttccaactggaagctgttttctattagtttttaagtgggataataaatagtggaatataccaatgtttggtattttgaaataatgttaatcattataaagacttctttcagtctcttcaaccctcgttaactttggacattgacaactgaatgtagctggttttatgatggtggttttcctttccactcaagtcattatggtcatatttcttatagcttcctggttcggtgactgctcattggcatggtaaggatatcaaatatgtatgaaaaaaattgcaattccccaaaggtctgttcaatatgggtctgtgttaaaagtatttaggtcatattcctggttagcctcctggttcggtgaaatgcttcaatgggatggaaagatatgaaatatgctttcttttgaagttctttttcttcgaggaaaaataaaactttacaggaacttttcctgacatgctgttcagtatgggtctatacttactcgtgattagttcacatgtttc

SEQ ID NO: 1576 - DNA, 1351 bp, Gossypium hirsutum
aaaacgctgcttacattggcacccctggaaagggtatccttgctgctgatgaatccaccggcaccatcggcaagcgtctttcaagcattaatgtagaaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaaggaaggtggtgtcctccctggcatcaaggtcgacaagggtaccgttgagcttaatggaaccaacggcgagactttcacccagggtctggatggccttgcacagcgatgccagaagtactatgaagctggtgctcgctttgctaaatggcgtgctgtccttaagatcagtgctaatgagcctaccgagcttgcagtccaagaaaatgccaacgggctagctatgtatgctgccatctgccagcaatgtggccttgtcccaatcgtcgaacctgaaattcttgttgacggatctcatgacattcaaaagtgtgctgcagtgacagagcgtgttcttgctgcctgctacaaggctctaaatgaccaccatgtcatgcttgagggtactcttttgaagcctaacatggtgacccctggttcggactccccgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatactttgctcgttaggtgcaaggctaactcagaagccactttgggtacatacaagggtgatgcagagctttgtgagggtgctgcagagagccttcatgtcaaggactacaaatattaagaaattaggcttgtggtcaaatatgtgatgcttagcagagtaaattctggtattgatattagggttctagtgtttttttcttcttcttttgagtttctgccgttgctcatcgaatttagtctgtggaatcagacaaattacaaataaggtttgggagcctttgtgctcgttgagtatttttggttttctgtttatttcattttaaaacaaaattctctgcttagttgagtgtaagcccgcattgtgggacaaaaatgaccaagtataagcccttattctgttggttatttcttattgatttgcttttcatgatt

SEQ ID NO: 1577 - DNA, 1784 bp, Podocarpus macrophillus
tggaaatagactcgtcactcgtttcattatccgaatcctagcctgcgcgattgacacgtgtacaatcgcccgccgttacttctgcgtcccgacgcatcgcatcggaatctaaaatcccggccggaatattcttccgcatatttatccggccactggcctttttaaaggcgtccgcattgcttgtatccattggagggtttcatccacgcttcttgacgcgaattggcaagcgaagagatatctcacaaaatgtcggcattctgcggaaaatacacagaggagctcattaggactgccaagtacattgcaacccctggcaaaggtattcttgcagcagatgagagtactggtactattggcaaacggctagcaagtatcaatgttgacaatgtagaagccaatcgtcagacactcagagaactactctttacatgtcctggtgctcttcaatgcctcagtggtgtcatacttttcgaagaaactctttatcagaaaacaaaaagtgggaagccttttgttgaggtgcttcaggaaggaggagtagtacctggtatcaaggttgataagggtacagttgatttggctggtacgaacggggaaacaactacgcaaggacttgatgggcttgctcagagatgccagcaatattacaaagctggtgcgaggtttgctaagtggagggcagtgctcaaaattggcctaactgagccttcagagctttcaatccagcagaatgctcacggtttagctcgttacgcaataatttgccaagagaatgggctagttccaattgtggaacctgaggttttgacagatggatctcatgatatcaaaaaatgtgctgaggttactgagaaggtccttgcagcagtctataaagctttgaatgatcatgatgtccttttggaggggtctcttttgaaaccaaacatggtaacccctggttcagatggccccaaggttggtccagaggtcatagccgagaacactgtaaaggcattgcagagaactgttcctgttgcagttcctggcattgttttcctttctggtgggcagagtgaagaagaagccacgttgaatttgaatgccatgaataagttggaaactatcaagccatggactttgtcattttcgtttgggcgtgcactgcagcagagtaccctgaagacatgggttgggaaagaggagaatgttgaagctgcacagaaggcatttcttgttcgatgcaaggctaattctgaagcaactctgggaaaatacgctggtggtgctggtgctggtgctgcctccgaaagcctttacgtgaaaggctataaatattgatcctgttctgctttgtctccgcactttttacaaattttacttgttcctttctgcattgagctattgattacatgtcgataaacctatataaaaacttggcagtctgttattgaaattttaactacaatgttttcataaattactacgtaagttcgtaatgtatggatctcttccatgaaggtggatatttattatttccttaacgttgtcttcttatgcttaagtactggaacagaaacttccttcacaacgataggagatgaacccttctgaaaaatcgatttttttgtttggctcatatgcgatatatgtggaggaaaacgcatttcctgaagatattgaggaatataattagcatttttctcttggtagttagaagatgatggggatttgtgacatttttactgatgtacatgagtgtaatttagaagaaattggtgatgtatttatcttttccgtcg

SEQ ID NO: 1578 - DNA, 1327 bp, Trifolium pratense
gtttgtttcccgccatccaatatcaatttcaaagaatgtctgcctttgttggaaagtatgcagatgagcttatcaagaatgccaagtacatagccacccctggcaagggtatcttggcagctgatgagagcactggcaccattggcaagcgtctatcaagcatcaacgttgagaatatcgaggccaaccgtcaagcccttcgtgaacttctcttcacttctcccaatgcactccaatacctctccggcgtcatcctctttgaggaaactctttaccagaactcctctgatgggaagccttttgttgaaatccttcaagagaacaatgtcataccaggcatcaaagttgacaagggtgttgttgaattggccggaacaaatggtgaaacaacaacacaaggctttgactctcttggagctagatgccaacagtactacaaggctggagcgcgatttgccaagtggcgtgcggtactcaagattggccctaatgagccctctgagttgtctatccagcaaaatgcacagggcttggctcgttatgccatcatttgccaggagaatggccttgtgcctattgttgagcctgagattttaacagatgggtctcacgacatcgccaaatgcgctgctgttactgaaaccgtgcttgcagccgtctacaaggcactgaatgatcaacatgtccttcttgaaggaactcttctcaagcccaacatggttacccccggttctgacagcccaaaggtatcacctgaggtgattggtgagtacacagttaatgcgttacgcagaactgtcccaccagcagtaccagggattgtatttctgtcaggtggacaaagtgaagaacaggctacactgaacctcgatgcaatgaacaaactagatgttgtgaagccatggactctttcattctcatttgggagggcactgcagcaaagcacactcaagacatgggctggaaagaaagaaaatgttggcaaagctcaagaggtgtttctgacaagatgcaagtccaattctgaggctactcttggaaagtatggtggtgggagtggaactgggttggcttctgagagtttatatgttaaggattacaagtattaggcttctagtttggagcttgggtggatgcattttagcatatgtatatgtattattatactgcttaaagcttttgcttttgattaacatgtttaattctgcatatatatattttataaatatcatcctttcataatttcacaggagctaattgtaatgttaaatggtgatgaaatgtcttgctaagtttagaaaaaatatctatgatttgttgaaaaaaa

SEQ ID NO: 1579 - DNA, 1233 bp, Vigna unguiculata
caacacactacgcaaaccattctcacaagcctaaaaaagccaccatgtcttgcttcaagagcaaataccaagatgagctgatcgccaatgctgcatacattggaacccctggaaagggtatccttgcagctgatgaatcaacgggcaccattggaaagcgtctatcgagcatcagcgtggagaataatgaaacaaacagacgcgttcttcgtgagcttctgttcactgccccgggttgcgctgaatgtctcagcggtgtcatattgtttgaggaaaccctctaccaaaagacagccacaggagtacccttcgtggacgtgatgaagaaaggagggattcttccgggcataaaggtggacaagggcacggtggagctagccggaacaaacggcgaaaccaccacccaaggcttggacgacctcgcccagcgctgccagaagtactacgaagcgggtgcgaggttcgcgaagtggagggcagttctcaagattggcccaaccgagccctcaccgctggctatccacgagaacgcgtacgggctggcccgttacgccgccatttgccaggagaacggcctggtccccatcgtggagcccgagatcctttccgacgggccgcacgagatcgagaagtgcgctgacgtgaccgaacgcgtgctggcggcctgctacaaggcgctgagcgaccaccacgtgcttctggaggggactctgctgaagcccaacatggtgactcctgggtcggacggtaagcgcgtggggtcggaggtgatcgccgagcacaccgtgagggcgttgttgcggaccgtcccaccggcggttccggcgatcgtgttcctgtcggggggtcagagtgaagaggaggcgacggtgaacctgaacgcgatgaacatgctgaagggtaagaagccatggtcgttgactttctcgtacggaagggctctgcaacagagcactctgaaagcttggagtgggaaggatgagaacattaagaaggcacaggaagcgttgcttgtgaggtgcaaggccaattctcaggccactctcggctcttacaagggcgatgccaagggcgatggcgcctctgagtctcttcacgttaaggattataagtactgagacagaatacgctctaagcccgcgtagacctgcctttgtttttcttccattccatggctttttttttcttaaaaaaatatattttaactaataaattttgaaaattttctcttca

SEQ ID NO: 1580 - DNA, 1260 bp, Lactuca sativa
gtcttgtactcagcatcaccctcaccatctccctcattagtaagccatgtcagccttcgtcggaaagtacgccgatgagttgatcaagaatgccaagtacatcgccacaccggggaagggtatattggctgcagatgagagcaccggaaccatcgggaaacgtctgtcgagcatcaacgttgagaatgtcgagtcaaaccgtcaagccctccgtgaacttctcttcactgctccaaacgcagtgacttacctctccggtgtcattctcttcgaggaaaccctttaccagaaaaccgccgacgggaagccttttgttgacgttctccttgaggccaatgtccttccggggattaaagtcgataagggtgtggttgacctctccggcacaaatggtgagaccaccactcaagggttagatgggcttggtgctcgttgtgccaagtactacgaagctggtgcccggtttgcgaaatggcgtgcagtgcttaagattggagcgactgaaccctcggagctgtctatccaacagaacgcccaagggttggctcgctatgcaatcatttgtcaagagaatggtcttgtaccaattgttgagccggagatattgaccgacggaagccatgatatcaagaaatgcgcgtatgcaaccgagatggtgctagctgcggtttacaaggctctcaatgagcaacacgtgcttcttgaaggaaccctcttgaaacctaacatggttacacccggctctgatagccctaaggtgacaccggaggtgattgctgaatacaccgtcacagccctacgtaggacggtgccggcagccgtgccaggaattgtgtttctgtcgggtggtcaaagcgaggaacaggcgacagtgaacttgaacgcgatgaacaagttggaggtgttgaagccatggacgctgacgttctcatttgggcgagcactgcaatcgagcaccctgaagacatggggcggcaaaaaggagaatgtggcggccgcacaggcggtgttcttggcacggtgcaaggcaaactccgacgccactctcgggaagtacgagggagagggcgccggtggtttggcttcagagagtctgtacgtgaagggatacaaatattaaccaaagctatgcacgaagtagtgaaaagagttgggggataatcgtgttattttaattgttttgtgcatcgatattatgttcatatccttacattacagcccatactttgttactacctactctctatacatatggattgt

SEQ ID NO: 1581 - DNA, 1531 bp, Quercus alba
tttcgtcctgttatctatatatatccctttttatccaaagccaatatcaactgatagcttgtaaccatgtcggcctttgtaggaaagtatgcagaggagcttatcaagaatgcgaggtacattgccacacctggcaagggaattttggcagctgatgagagcactggcaccattggcaagcgtctagctagcattaatgtggagaacattgagtcgaaccgccaagctcttcgcgagctcctcttcacttctcccaatgccctcccctacctctctggtgtcatcctctttgaggagaccctttaccaaaaggcttcagatggtaagccttttgttgaagtccttcaagaaaacaatgtcattcctggcatcaaagttgacaagggcacggttgagttagctggtacaaatggtgaaaccaccacacaaggcttggactcacttggtgcaaggtgccagcagtactacaaggccggtgcacgctttgccaagtggcgtgccgtgctcaagattggtcctaatgagccatctgaattgtcaatccaacaaaatgctcaaggcttggctcgctatgcaatcatttgtcaggagaatggactggtgccaattgttgagcctgagattttaactgatggtgctcatgacattaagaaatgtgctgctgccactgagattgtgcttgcggcagtgtacaaggcactgaatgatcagcatgttcttcttgaaggcaccctgctaaagcccaacatggttacaccaggctctaatagcccaaaggtaacacctgaggtgatagctgagtacacagtcacagcactccgccgaactgtcccggctgcagtgccagggattgtgttcttgtctggtgggcaaagtgaggaagaggcaacactcaatcttaatgcaatgaacaggttggaggtgctgaagccatggactctttctttctcatttgggcgagctttgcaacaaagcacactcaagacatgggctggaaagaaggagaacgttgggaaagctcaacaggtgttcttggtgaggtgcaaggctaattctgagtccactcttggaaagtattctggtggaggtgctggtggtttggcttctgagagtttgtttgtcaagggttacaagtactaggcctttaatttctagagtggcaaccatcatatatctaatgcaattgtaccttccttctttacctgcttagttttggtacatattctacaatgggtggcatattatcgatgcttcaatattgtactgttaatttcccatgtcctgagtttgcctctcttgtctcactaagaacctagccttttgccattagaaattccaaaattgtgactaagagggtctaagatgaacaattaagaaacccaagagggccaagcctttatcttagcccatcaaaaaatgtgtattgctaattcaaagatcctttcaagaaattcaatttcactacccaatgtttttcttatagtattgggagcaacaagattactcatgtaattaatgatggtataccaat

SEQ ID NO: 1582 - DNA, 1337 bp, Arachis hypogaea
aacacttttgaagcttgaaacattgtacaatgtctgcctttgttggaaagtatgcagatgagcttatcaagaatgccaagtacatagccacaccagggaagggaatcttagcagcagatgagagcacaggcaccattggcaagcggcttgcaagcatcaatgttgagaacattgaggccaaccgccaagcgctgcgcgagctcctcttcacctccccaaatgccctcccatacctctctggcgtcatcctcttcgaggagactctctaccaaaagacttctgatggaaagccttttgttgaggtcctccaagagaacaatgtcatcccaggcatcaaggtggacaagggtgttgtggaattggccggaacaaatggcgaaaccaccactcaaggctttgactctcttggtgcaaggtgccagcaatactacaaggccggcgcacgatttgccaagtggcgtgccgtgctgaagataggcccaaccgagccttctgagctgtccatccagcagaatgcgcagggattggctcgctacgccataatttgtcaggagaatgggcttgtccccattgttgagcctgagattctgactgatgggaatcatgacatagctaagtgtgctgctgttactgaaactgttcttgctgctgtttacaaggcactcaatgatcatcatgttcttcttgagggaaccctcctcaagcccaacatggttacccctggctctgatagcccaaaggttcccccagcagtgattgctgagcacacagtcactgcactgcgcagaaccgtcccatcggcggttccagggattgtgttcttgtctggtggacaaagtgaagaagaggctacattgaaccttgatgcaatgaacaagttggaggtgctgaagccatggactctgtcattctcatttggaagagcactgcagcaaagcacactcaaatcatgggccgggaagaaggacaacatcacgaaagcccaagtggcgttcttggctcggtgcaaggcgaattcggaggctactcttggcaagtatggtggtggaagtggaactggtttggcttctgagagcttgtttgtaaagggctacaagtattagttagcctcaaagtggagtttggagattgatttgaaatgtgtatgatgctgctacttaagcctttttcttctgattaacttgttttattttttggatacatacatacatatgttataaatttcaaagtttatatatttataggagctgattgtaagtaatggccaatgtgatgatctacctctcagaacaataaagtgccacattttcatgtaaaaatttgaaatctaaacaagt

SEQ ID NO: 1583 - DNA, 1179 bp, Prunus persica
tttgattttgcactttggtccactgttatccaataccatcctatatctccaaccatgtcagcctttgttggcaaatatgctgaggagcttataaagaatgccaagtacattgccaccccagggaagggcatattggcagcagatgagagcacgggcaccattggcaagcgtctatccagcatcaatgtcgagaacatcgagtccaaccgccaagcactccgtgaacttctcttcacctcccccaatgccctaacctacctctcaggtgtcattctcttcgaggagaccttgtaccagaagaccactgatggcaaacccttcgtcgaagtcctccaggaaaacaatgtcattccaggtatcaaagttgacaagggtaccgttgagttagctggaacaaatggagaaactacaactcagggctttgactctctgggagctaggtgcgcacagtactacaaggccggtgcccggtttgccaagtggcgcgccgtgctcaagattggacccactgagccctctgaattatctattcagcagaatgcacaggggttggctcgctatgccatcatctgccaggagaatggactggtgccaattgttgagccagagattttgactgatggggaccatgacatcaagaaaaatgcagctgtcactgaaactgtgcttgcagcagtttacaaggctctcaatgagcatcatgttcttcttgaaggcacactccttaagcccaacatggtcacaccaggctctgacagcccaaaggttacacccgaggtgattgctgagtacacagtgactgcactgcgccggacagtcccagcagcagtgcccgggattgtgtttctgtccggaggacagagtgaggaggaggcaacgctgaatctggatgcaatgaacaagttggatgtgttgaagccatggactctttcgttctcgtttgggcgagctttgcaagcaagcacacttaagacttggggtgggaagaaggagaatgttgggaaagctcaggagaatttcttgacaaggtgcaaggctaactcagacgccactcttggaaagtacggtggaggaagtgctgatggattggcttctgagagtttgtttgttaagggatacaagtactagttgtagtactagacctttgactatatgggggtttgggaatgggacttgtat

SEQ ID NO: 1584 - DNA, 4359 bp, Taxus baccata
cctattcgtaatatttattttgctttttaatttaattactttaatgcaccgggttataactgtacatatctgtgtgtgtatgctcctagttttggtcttgctataggactaagaataatgcaatatggttgtcaggtggcaaagatagtcggcagaattaacgtgatgagttcaatttacatgaaatgtagattattgaggactgataaaattaaggtttttgattaatgagttggtatggtttatggtttggtgggcaattgatgaatattgaagatagtttgcttgcattccagtgtttttttaaagaattttattatttgtacgtttagtcaaactggaatgtggttttcttaatttagaattaatgtagtaaatccctgtgtttagctttttctgccttctttgtttttataatgttaattgtaccgagcctacagtgaactgaaaatagtaagtgcctcactgaactccaggtctggtcttctggtacaaattaaaatgataatagtatagataagaatatattcttatgcttagatttgaattccagaagctgatggccttgcactgctacctcaagaggtaaggaattttctgaaatgaagactaaaacttgcgatagtgtatgtggaaaccttcattagactcgaatggtattttagatttactccattaaatgatacgttcattgctttatctttatttttcttgaatatcgagtagaagcctgctaattgttgtaaggaggcggttagcatttcacagtgtttgcaacagcacataatatttaacattagctgcaaatccagataactaatgataacagcaaagcatcatggattcataaaaacccaactcttccgctatgtcattaaaagccaactccgctgctacaattaacaaaccttgtttgtattagtggttgtttgaagtttgattagcttggaaaactattttgaatttgctctgtcgaaagctctcttcatcgtcgttttttttaaggtgtttagaagaaaaaccagagtagaactcaaagcccaaatcccagaagtgtggcttgaggagggttgttagaaaataacacccacaagtgttctggtaaccgaaccagtagaactcaaagcccaaatcccaaaagtgtggcttgaggagggttgttagaagaaaacacccacaagtgtcctggtaacccaagtggtagggcaccccagcgtgccgagcagagttgttagaagaaagaaggtcgcaccctattacacaaatggttagttaacccaagtagcagggcaccctagcatgccaaacagacaggattgttggaggcaaacaggccacatcctaaaccacaaatggaccggcaactcaagtggtatgtcatctcagcatgccgggcattgtcataggaaagtcctagtttcaagaaccagctgttccatggaaattggtttttttttggtatgataaagaatctttgttaacttctgattagttcaccggatcttcccttctcccttttagcgtctttcctttgcttcttgtaatgaaacaaattaggatgattttcatataacaatcaagacccaggtttgatcttttgggtacagtgcatagttaccctaagtcttggggatggaggtacggagggacagggttttcaggatggcaaaaaaaattcccaaattttggggacagccattaaaaatatatataaaattaatattttaattgtattcaataaaacttagggatttaaactgtgtttaatgtatcttaggtactttcaagatcataatttaatgatcttggtaaaaataacagttaaaaagttaaaatatcagaaaactgttgaaaagattttaaaaaatagggggtgcccctctgagtccccaagtccctgaaacattcagaacatctgggacgtcgccgaaatttatgggacacatccacatgtaacactcatacagtgccattgttttaaaaggttggacgtaatttcattggtccataaggttagaggtgatctcattgttctaaaaggttggaggtaatcttattagctatgataccacatggtgtgtgatggagtatattttaaaattgattggaacatttgggtactttagagtgctttaggctacttgtgttatatggttaggatttctgttcaagcttccatctgttcttcagccaagcttagaattggacatagttgtaggtaatcatggttaactatgataccacactggtgtgtgatgagtatatttttgaaatcgagcagaacattctgtgacttgagagtacttcaggttacttgtattatatgtttaggatttctgtggaagattccatctgttttgcagccaagcttaaaattgggcatggtgtcctaacaggagtggattagcatctgagccgtggcattacaagctgatttttggcttagaattagttagctggtgtcacttgttctttacaatttcgttcattagaatgatgtacacgatacacagtttttactttttagtgcttcaagatttttgctagagtacaatgtgacaaggagactgtcttgttgtttcatatttgtctcgagcacagtatggttggggtttatttgaagtaccagagtgccaacagtgttcaatgggtcaatgggtctttgtgaagtgtttgaattcacctgtctttgtaaataataaacatcaatgcaattcttcttgtgccggatatctgcgtgcataaaacattcaatttgagaagatatgatacctgatatctcaggtttttgacttacgtaatttattatgagtaaaaaacttccttaccatttcattccaagcctctctgtagttctactgtattttgaagaccccagttttgtattatggttaaggacatatccacgagtatggagttatgagttccataatcaatgttctcaatactgctttcttctctgtagaaatggtgggcaaccctatattcataatttctagttccctaacagggttaatgactgaaataaaatttccttctctacaatgtagaggagctcattcagactgccaagtacattgcaacccctggaaagggtatccttgcagcagatgagagtactggcactattgggaaacgtttggcaagcatcaatgttgagaatgtagaggccaatcgccaggcgcttcgagaattactcttcacttgtccaggtgcccttcagtatctaagtggagtgatattttttgaagaaactctttaccagaaaacaacaagtggcaagccctttgttgaggtgcttcaggaaggaggtgtagtacctggtatcaaagtggataagggaacagttgatttggctggtacaaatggggaaacaacaacacagggacttgatgggcttgcagggagatgccaacagtattacaaagctggtgcaaggtttgctaagtggagggcggttctaaaaattggcccaactgaaccctcggagctttcaattcaacagaatgctcatggcttagcccgctatgcaataatttgccaagagaatggcctggttccaattgtagaacccgaggttctaactgacggacctcatgatatcaaaaaatgtgctgaagttactgaaaaagttcttgcagcttgctataaagctttgaatgatcatcatgtccttttggagggaacactgctgaaacccaacatggtaactcctggtttagatggtcctaaggtcactccagaggtaatagccgagtacactgtaaaggcattgcagagaactgttccagttgcagttcctggcattgttttcctctctggtgggcaaagtgaagaagaagccaccaagaacttgaacgcaatgaataaactgaacactatcaagccatggacattgtcattttcctttgggcgagcactgcagcagagtacccttaagacatgggctgggaaaaaggagaatcttgaagctgcacagaaggcattgcttgttcgctgcaaggccaattctgaagcaaccttgggaaaatatagtggagatgctggtgttgggcttgctactgaaagtcttcatgttaagaattacaaatattgatcttgcggtggttcaactgtgcagcaccaactaattttacttgtagctttctccattgttacccactgcatgtcgatagcattatgtataaacatggcagcctattatggcaagttttaacttcgattttatctgcaagtactaggtaagtaggtgatataagtgatgtagaagagataaatttgaacgtcgatcattttttgtttcctttagttgtattcttctgctgtttcagaaattaaaaaagattgttctttcaaacg

SEQ ID NO: 1585 - DNA, 2038 bp, Triticum aestivum
gagagcctccgcgccaacctccacgaacccaccctccctaccctcgccatggaaatcggctcggtgccttcccaggacgaagatgcggcggccgccacgccgcgggaggccaccctgggccgccacctcgcgcgccgcctggccgaggtgggcgcacgcgacgtcttcgccgtgccgggggacttcaacctgacgctcctcgacgagctcgaggccgagcagccgtccggcggcggggtgcggctcgtcgggtgctgcaacgagctgaacgccgcctacgccgccgacggctacgcccgcgcgcgcgcaggcggcgtcggcgcctgcgtggtcaccttcaccgtcggagcgctcagcgccatcaacgccgtcgccggcgctttcagcgagaacctccccgtcgtctgcatctccgggggccccaacagcaacgactacggcagcaaccggatcctgcaccacaccatcggcctccccgatttctcgcaggagctccggtgcttccagaacgtcacctgctaccaggcagtggtgaacaacttggaggatgcacatgaacagattgacactgccatctccactgcactgaaggagagcaaacctgtttacatcagcatctgctgcgacctcccttcaatccctcatcccacatttggccaccatcctgtccctttctttctctccccaagactgtcaaaccagatgagcctggaagcagcggtggaagccgctgcggctttcttgaacaaatcggtcaagccggtccttattggcggagcaaagatgagggtggccaaagcgcgcaaagccttcgtagagctggccgatgcatgcggttatccgttcgcggtgatgccttctgccaaggggcttgtgccagaacaccaccctagattcatcggcacatactggggtattgtgagcactccattctgtggagagattgtggagtcagctgatgcctatttgtttgctggcccgatgtttaacgaccacacctcggttggatactcacttctactcaacaaggagaaggccatcattgtccagccggatcgagtcgtgattgggaatgggcctgcatttgggtgtgttctgatgaaggacttcctgcgtgcacttgctacccggctcaagaagaacacggctgcgtgcgagatccatagccggatttttgtgcctgagggcgaaccccgtccctctgagcctggagagcctttgagagtgaatgtatttttcaagcatattcagaaaatgttgtctggcaactcggctgttatagcagagactggggactcatggtttaactgccagaagctaaaactaccagaaggctgtgggtatgaatgccagctgcaatatggatcaattggctggtcggtcggggctactctgggatatgcgcaggcttctaaggataagcgagtcatttccctcattggagatggcagctttcaggtgacggcacaggaagtgtcgacgatgctccggtggggacagaacaacattatctttctcataaacaatgggggctacaccatcgaggtgaagatccatgacggtccttacaacgtcatcaagaactggaactacaccagcttggtggaagcattccataatggcgagggcaaatgctatactgcaaaggttcgaacggaggaggaactggaggaagcaattgaggcatccctaggacctcacaaggacagcctgtgctttatagaggtaattgtgcacaaggatgacaccagtaaggagctccttgtgtggggagctaggcttttcgccgcaaataaccgcccgccgaatcctcagtgaacgcaccgggtctctacaagatgctcatccagcttaacgaggtcatctgaaagttcagatgtgctgaactctgaataaaccctccatttgagtccattgctgccgcaggtgctcatggttactgtacgtaggtgttctcagttcaggaactggtacttgtatcacctaaataaatctgaaatcgatgctgtggccagctaaagacgctcttggtttcgtc

SEQ ID NO: 1586 - DNA, 1089 bp, Triticum aestivum
cgacccacgcttccgcactgccaacaaaagtcccactgccattgtctgcaatggcgtctcggcctttcccacgggagtcccctcgctcccggcctcctagctctagctctctctccgcctccgttcaaatgggatcctcgcctgcgccttcgccttcgccttcgacttcgccgccgatgccgatgatagggagggccggcaacctcaccgtcttcatcacgccgccgtcgccggccagcaccccgcgctcctcgcgcccgtccgactccccaaggccggacttctccacccctacctcccgcacgggtacggcaccgcctccgccgcagaagagcgctagcccgcccgcgccgccggtcaagttctcgccccctgcaccgcccgtgaaggtgtccctgcctcctgtgcaggtgcccccgccgcagtacggaaaggcttctgcggggggcaagcacgacggatcggcgttcggcttcttatgggacgccgtcgcgcgcgtgcaggaagcgcacgcgagcctggacgagtacgtcgccaactggttcggattggatcagtctaagtaccagtgggctctcaacgactactacgataccaccggcaaggaagtggaatatggcaaagctgggaagccaaaggagcttactactactactactactactaaagtgcagaaagtttagaagcaacttcatttcaggttgtgtgtgtagtgaagcgaagttctatttgttagatcttgtcattggggcttcaagagtttttgcctctttatctacctgatgaagtaggatctacatttgacacaaggggtacttggatcatggagagtctgaagttattgttttttgttggctcctttcagggactgctgtaatctgagacgcaaattgcgtatttgcagtggctaaatgttgcagttcaacatcttatcacattgtcttccattgcatatcgattgcacggcataaatttccctcatcatttcactttacccttgctgggtctggatcccctcggcgggcgagtgatcggatctcattgcatatatttgtcctaaatgaccctttttagtgctcaaaaaaaaaa

SEQ ID NO: 1587 - DNA, 923 bp, Triticum aestivum
  misc_feature (388)..(388): n is a, c, g, or t
cggcacgagaaaacctccactgccattgtctgcaatggcgtctcggcctttcccacgggagtcccctcgctcccggcctcctagctctagctctctctccgcctccgttcaaatgggatcctcgcctgcgccttcgccttcgccttcgacttcgccgccgatgccgatgatagggagggccggcaacctcaccgtcttcatcacgccgccgtcgccggccagcaccccgcgctcctcgcgcccgtccgactccccaaggccggacttctccacccctacctcccgcacgggtacggcaccgcctccggcgcagaagagcgctagcccgcccgcgccgccggtcaagttctcgccccctgcaccgcccgtgaaggtgtccctgcctccngtgcaggtgcccccgccgcagtacggaaaggcttctgcggggggcaagcacgacggatcggtgttcggcttcttatgggacgccgtcgcgcgcgtgcaggaagcgcacgcgagcctggacgagtacgtcgccaactggttcggattggatcagtctaagtaccagtgggctctcaacgactactacgataccaccggcaaggaagtggaatatggcaaagctgggaagccaaaggagcttactactactactactactactaataaagtgcagaaagtttagaagcaaacttcattccaggttgtgtgtgtagtgaagcgaagttctatttgttagatcttgtcattggggcttcaagagtttttgcctctttatctacctgatgaagtagggtctacatttgacacaaggggcacttggatcatcgagagtctgaagttattgttttttgttggctcctttcagggtctgctgtaatctgagacgcaaattgcgtatttgcagtggctaaatgttgcagttcaacatcttatca

SEQ ID NO: 1588 - DNA, 855 bp, Pseudoroegneria spicata
gcaatggcgtctcggcctttcccacgggagccctctcgctctcggcctcctagctctagctctctctccgcctccgttcaaatgggctcctcgcctgcgccttcgacttcgccgccgatgcccatgatagggagggccggcaacctcaccgtcttcatcacgccgccgtcgccggccagcaccccgcgctcctcgcgcccgtccgactccccaaggccggacttctccacccctaccccccgcacgggcacggcactgcctccgccgcagaagagcgctagcccgcccgcgccgccggtcaagttctcgccccctgcaccgcccgtgaaggtgtccctgcctcctgtgcaggtgcccccgccgcagtacggaaaggcttctaccgggggcaagcacgacggatcggcgttcggcttcttatgggacgccgtcgcgcgcgtgcaggaagcgcacgcgagcctggacgagtacgtcgccaactggttcggattggatcagtctaagtaccagtgggctctcaacgactactacgataccaccggcaaggaagtggaatatggcaaagctgggaagccgaaggagcttactactactactaaagtgcagaaagtttagaagcaacttcattccaggttgtgtgtgtagtcaagcgaagttccatttgttagatcttgtcattggggcttcaagagtttttgcctctttatctgcctgatgaagtacgatctacatttgacacaagggccacttgatcatggagagtctgaagttattgttttttgttggctcctttcagggtctgctgtaatctgagacgcaaattgcgtatttgcagtggttaaatgttgcagttca

SEQ ID NO: 1589 - DNA, 1088 bp, Triticum aestivum
  misc_feature (32)..(32): n is a, c, g, or t
cgacccacgcttccgcactgccaacaaaagtnccactgccattgtctgcaatggctctcggcctttcccacgggagtcccctctctcccggcctcctagctctagctctctctccgcctccgttcaaatgggatcctcgcctgcgccttcgccttcgccttcaacttcgccgccgatgcccatgatagggagggccggcaacctcaccgtcttcatcacgccgccgtcgccggccagcaccccgcgctcctcgcgcccgtccgactccccaaggccggacttctccacccctaactcccgcacgggcacggcaccgcctccgccgcagaagagcgctagcccacccgcgccgccggtcaagttctcgtcccctccaccacccgtgaaggtgtccctgcctcctgtgcaggtgcccccgccgcagtacggaaaggcttctgcggggggcaagcacgacggatcggcgttcggcttcttatgggacgccgttgcgcgcgtgcaggaagcgcacacgagcctggacgagtacgtcgccaactggttcggattggatcagtccaagtaccagtgggctctcaacgactactacgataccaccggcaaggaagtggaatatggcaaagctgggaagccaaaggagcttactactactactactactactaaagtgcagaaagtttagaagcaacttcatttcaggttgtgtgtgtagtgaagcgaagttctatttgttagatcttgtcattggggcttcaagagtttttgcctctttatctacctgatgaagtaggatctacatttgacacaaggggtacttggatcatggagagtctgaagttattgttttttgttggctcctttcagggactgctgtaatctgagacgcaaattgcgtatttgcagtggctaaatgttgcagttcaacatcttatcacattgtcttccattgcatatcgattgcacggcataaatttccctcatcatttcactttacccttgctgggtctggatcccctcggcgggcgagtgatcggatctcattgcatatatttgtcctaaatgaccctttttagtgctcaaaaaaaaaa

SEQ ID NO: 1590 - DNA, 1039 bp, Brachypodium distachyon
atgggctcctcctccccgtcgccctcgccaccgccgccgccgccgccgatgatagggagggcgggcaacctcactgtcttcatcacgccgccgtcacctgcaagtaccccgcgctcctcgcggccgtccgagtccccgaggtcggatttgtccacccctgcctcccgcacggcgcccgcgccgccggtctcgccgtcgccgcagaaaagggcgagtccgcccccgtcaccggtcaagttctctccccctgcgctccccgtgaaggtcttcccgtcaccggtgcaggtacccccagcgcagtacgaaaaggcttctgcgggggacaagcacgacggatcggctttcgccttcttctgggatgccgtcgcgcgcgtgcaggaagcgcacgcaagcctggacgagtacgtcgcgaactggttcggattggatcagtccaagtaccagtgggcgctcaacgactactacgagaacaccggcaaggaagtggaatgtggcaaagctgggaaaccaaaggagcttcttactactaaagtgcagaaagtttaaaagcaatttattcccatgttgatgtgtgtagctaagcgaatgcatgaaatattattagatgttctttttggggcttcaagggtgctgtctctttatctgcctgaagtagtatgatcttgcacacaaggcgccaaggcagcagttggatcacggagagagcctcaagttgatttttgttcgctcctttcgggtctgctgtaatcgtacctaaggttgtgtggaacgcaaattgccgtgtttgcagtggctagttattgcggttcttgacatgcctgaatccctgatcaccgtgtcttgaaattgaaatggctaattgctctggttcttaacatccttgatcaccgtgtcctgcctgcagttgtggtttttcttttcttccgagaataagcagtggtagattgcacgccatgatctatggggcggagccaggatttgaacatagagagggcaaaaaagatagtatcacacaagttgttggcggtgtttttctgtt

SEQ ID NO: 1591 - DNA, 1111 bp, Triticum aestivum
acggcgacccacgcgtaccgtgcttatccgcgttctcgttttccatagcaacccgttacccaaccatagcctgcgggctggttgcgcaatggcggcgggtcccttcgcgctccgcctagggccgcgcctcgcggcgccgacggtggcgagtgcgacgaggggaggaggacgaggaagtggtcgccctacggcgagccgagcgctggtgtcaaagaagccaaacaaggaccaccgtttgtggattaggaaggattcggctgggtcagggaagaaggctctttgtcttgttaatactgtttcaaaactaccgaatgaaaaagaagctgtttatggtgcattggataggtggaccgcttttgagtctgaatttccaattatagcagcggctaaagctttggagatgttgaaaaagcgaagaaaatggctacagattatccaggtaaccaagtggctgatgagtaaaggtcaggtgctgacatggacaacgtacgatacactgctgttggctctttctatggatggaagagtagatgaggctgagtcaatttggaatactatcttagaaacttatacacgctcagtgcccaagaagttgttctctcggatgatccagatttacaacacgcgccatcttccagacaaagttttggagatatatgctgacatggaggaattgggcgtgcgtccagacgaggatacaacaagaagagtcggacgagcatttgcgtcttcaggccaggaagataagcagaagcctgtccttgaaaaatacttgaagaagtggaagtacatccatttcaacggcgagcgcgttcgggtgcggagggcaggacctttggcctagcaaacgtcctctggatagcttggggcaaacaatgcgagtgtcgccttgtctggacatatgtgattgctattgttcttccgaggtcctatgcgagcatgtcagatggaacgaggtgtcgaaattgtaatgctctcgctctctagacaaatggacaatatcatagtacagggttgagaactgccattgctaatgatgttggtacccaaacatgtgtaagttgtgatatttcagacaggttgctgtcgtccttcggcaccatgtgcagga

SEQ ID NO: 1592 - DNA, 1205 bp, Triticum aestivum
  misc_feature (28)..(28): n is a, c, g, or t
acggcgacccacgcgtaccgtgcttatncgcgttctcgttttccatagcaacccgttacccaaccatagcctgcgggctggttgcgcaatggcggcgggtcccttcgcgctccgcctagggccgcgcctcgcggcgccgacggtggcgagtgcgacgaggggaggaggacgaggaagtggtcgccctacggcgagccgagcgctggtgtcaaagaagccaaacaaggaccaccgtttgtggattaggaaggattcggctgggtcagggaagaaggctctttgtcttgttaatactgtttcaaaactaccgaatgaaaaagaagctgtttatggtgcattggataggtggaccgcttttgagtctgaatttccaattatagcagcggctaaagctttggagatgttgaaaaagcgaagaaaatggctacagattatccaggtaaccaagtggctgatgagtaaaggtcaggtgctgacatggacaacgtacgatacactgctgttggctctttctatggatggaagagtagatgaggctgagtcaatttggaatactatcttagaaacttatacacgctcagtgcccaagaagttgttctctcggatgatccagatttacaacacgcgccatcttccagacaaagttttggagatatatgctgacatggaggaattgggcgtgcgtccagacgaggatacaacaagaagaatcggacgagcatttgcaacttcaggccaggaacataagcagaagcctgtccttgaaaaacacttgaagaagtggaagtacatccatttcaatggtgagcgtgttcgtgtgcggagggcaggacctttggcctagcaaacgtcctctggataggttcggatgaacaatggagtgtcgcctcgcctggacgtatgtgattgctattgttcttccgaggtcctatgcgagcatgtcaggtagaacaaggtgtcgaaattgtaatgctctctagacaaatggataatatcatagtgcagggttgagaactggcattactaatgatgttggtatccaaacatgtgtaagttgtgatgtttcagacaggttgctgtcgtcttcggcaccatgtgcaggaacaaagttttgacgaaccaagtttgttaattaaccgctacggcgtgtgacatgacagtacagtcctgctcctgatgaagggtgcagttagccaaaaaaaaaa

SEQ ID NO: 1593 - DNA, 1166 bp, Oryza sativa
gccgcgagctccgcttatctcaattctccgccgttgtgctgctcacccccaccgaggagtgcggccatggcgggagccttctccctccgcctgggaccgcgcatcgcggggacgccaccgccgccggcgagcgcgacgaagggcgagggaagaggagggggccgtcctaccggcagccgagctctggtgtcaaagaagccaaacaaggagcatcatttatggataaggaaggattcagctgggtcagggaaaaaggctcttcatcttgttaatactgtttcaaagttaccaaatgagaaagaagctgtttatggtgcattggataagtggactgcctttgagcccgaattccctactattgcagcagcaaaagctttggaaatgttgaaaaggcggagacaatggctgagaatcatccaggtagccaagtggttgatgagcaaaggccaggtgctgacatggacaacgtatgatacactactgttggctctttttatggatggaaggatagatgaggctgagtcgatttggaataatatcatacaaactcatacacgttcagtacccaagaggttgttttcccggatgatcctgatatatgacacccgccattgtccagacaaggttttggaggtgatatatgctgacatggaggagctaggggtgcatccagacgaggatacaacaagaaggatcggaagagcatttgtgactttaggccaggaagataaagaaaagattgtcctcgagaaatacttgaagaagtacaagtacatgcatttcaatggtgagcgcgttcgggtgcgaaggggaggacctttgacatagtaagcattctcccaatgtcaacgcttgaagccttgaaccatgtaatgatgagacgacctagaaggacacaccttcaatgtatttagcagttactgaccctggtcctttgtgattactgtctttcctgaggctgtacaaagatttctgtcgttcctcttatgtgaaagcatggttagattgtactgctttgtaggcaaatgaacagtggactcaatacagttactaactagatactggtttagttaatggaaagcattgtgatgctccaaacaagtaagatgtgattctccaatgggtatttggaacaccagtgtaatgaccatttccccttgtttctg

SEQ ID NO: 1594 - DNA, 2545 bp, Pennisetum glaucum
cgccgaggaggacgagggccaccacactccggcgcacagggaccacgatcgccgcaccatgcccatcccgccggggctcccgccgctccacacaggccgagagggtaggccagtgatttctccaggttcaactaaaagagttggagctattgttagaccgactacaccaaagtctcctgtccctattgtcagcgcgtttgagaggattgaagattcagatgaggaagaggaccttgttccagatgccaagaatgatgccgcttacttggcctcaaatggtgctgttgcatcagagcttcttccagataaaacaagccagaatggggagttaaaagcagtaccatcaacacagatgattaggtcccatagtgcaactggtagtctgcatgcgccccagcttaacccaatagcagctgatatactccgaaaggagcctgaacatgaaaccttcagtaagatcaacatcacagctgttgagactccttcttctgatgaaattgaagcatacaaagttcttcagaaatgtcttgagctgcgtgagaggtacatattcagagaagaagttgctccttgggagaaggagatcataactgatcctagtactccaaaacctaacccaaatcctttcaattatgaacatcaggctaaaactgatcaccattttgagatggttgatggtgtcgttcatgtataccccaataaagattctaaagaaagactctatcctgttgctgatgcaactactttctttaccgacatgcactacatcctccgtgtgttggctgctggggatatccgaactgtgtgccaccatcgtttaaatcttctagagcaaaaatttaaccttcatctgatggtcaatgcggatagagaactgcttgctcagaaagctgcaccacaccgggacttctacaacgttcggaaggttgatactcatgttcatcactcagcatgcatgaaccagaagcatttgttgagatttatcaagtcaaagttgaggaaggaacctgacgaggttgtgatctttagagatggtacctatttgactcttaaggaggtttttgagagtttggacttgactgggtatgacctcaatgttgatctcttagatgtccatgctgataagagcacatttcatcgttttgacaagttcaatctgaaatacaatccttgtggccaatctcgcctgagggagatcttcttaaaacaggataatcttattcaaggtcgcttccttgctgagctcacaaaagaagtgttttctgaccttgaagcaagtaaatatcagatggctgagtatcggatatctatctatgggaggaagaaaagtgaatgggaccagatggcaagttggatagtgaacaatgaattatacagtgagaatgttgtttggttaattcagattcctcggatatacaatgtatacagggagatgggcacaatcaattcgttccaaaaccttcttgacaatatctttctccctctgtacgaagtaactattgaccctgcttcgcatcctcagctgcatgttttcttagaacaggttgttgggttggatttggtggatgatgaaagcaaaccagaaagacgcccaacaaaacatatgccaacacctgagcaatggactaatgttttcaacccagcctatgcatattatgtgtactattgttatgccaatctgtacacactgaacaagcttcgtgagtccaagggcatgacaacaatcaaacttcgcccacactgtggggaggctggcgatattgaccatcttgctgcagcatttcttacttctcataacattgctcatggggttaatctaaggaaatcccctgttcttcagtacctctattatcttgctcagattggtctcgcaatgtctcctttaagtaacaattcattgtttattgactatcaccggaaccctttccctacatttttcttaagaggacttaacgtgtccctctcgactgatgacccattacaaattcacctgacaaaggaacctttggttgaagaatacagtatagctgcttcgctttggaagctgagttcatgtgacttgtgtgaaattgctaggaattctgtgtaccagtccggtttctctcacaggctgaagtctcactggatcgggaggaactactacagaagaggtcctgagggcaatgacatccaccagacaaatgttcctcacatcagggttgaattccgacacacgatttggaaagaagaaatggagctaatacatttaagaaatgttaaactagcggaagaaattgacaggtgaagatttagtctggcgccctgtcgtccagacggccggggttgcaagggaggagagaaagggtgtcttgagtatgatccgatgaactcgtattctgcagagtggcggaataggattatgcgatgatagcaccaagcatggcctcctcctcctatacatgtatactttgtcccgtgtggtgttactgaatgtggtagcagtacattgaataaggaagttgaatttgtagttacactatattgctatatatttggtgcgtttgtg

SEQ ID NO: 1595 - DNA, 2857 bp, Triticum aestivum
cccaccccccgcctcgccgccatggagccctccccgtcctacgcgctccacctggccgtcgcggcgctcgtcggcgccaccttcgccgccgcgtccgcctactacatgcaccgcaagaccctcgaccagctgctccgcttcgcccgctccctcgaccgcgaccaccgccgccgcgcccgcctgctccccgacggcgccgaggacagcgaccgcgacagggaggaaggggaggaggaggacgacggccctcccccgcacagggaccacgatcgccgcaccctccccatcccgccggggctcccgccgctccacaccggccgagagggcaagcccactatatctccagctgcgaacaaaagagttgggtctctggttagaccaacgacaccaaaatcctctgttcctgcagtcagcacatttgagagcatcgaagattcagatgaggatgttgatcttgagccagattccaaaaatgatgatgctgtctacgttggcacaaatggggctattggatcagacccggttcctgttaaagcggatcagaatggggacataccagcaacgagcatgattagatctcacagtgcaactggtagtctccatgggatccagctaaatccagtagccgctgatatacttcgaaaggaacctgagcatgaaactttcagtaggatcaatattacagctgttgaaactccttctcatgatgaaattgaagcgtacaaagttcttcaaaaatgtcttgagctacgagagaagtacatcttcagagaagaagttgctccatgggagaaggaaataataactgatcctagtacccccaaacctaacccaaacccgttcaactatgaacatcagaccaaaactgaacatcacttcgaaatggttgatggtgttgttcatctgtaccccagtaaagattctaaagaaagactgtatcctgttgctgatgctaccaccttctttactgatatgcattatatccttcgtgtattggctgctggggatatccgaacagtctgtcatcaccgtttaaatcttctagagcaaaaatttaatcttcatttgatggtcaatgccgatagagagctgcttgcccagaaagctgcaccacacagggacttctacaatgttaggaaggttgatactcatgttcatcactctgcatgcatgaaccagaagcatcttttgaggtttattaagtcaaaattgaagaaagaaccagatgaggttgtgatttttagagatgggacctatttgactcttaaggaggtgttcgagagtttggacttgactgggtatgacctcaatgttgatctcttggacgtgcatgctgataagagtacatttcaccgttttgacaagttcaatctgaaatataatccatgtggccagtctcgcctcagggagatctttcttaagcaggacaaccttattcaaggtcgcttcctcgctgaattaactaaagaagtgtttgctgaccttgaagcaagcaaatatcagatggccgagtatcgaatatctatttatgggagaaagaaaagtgagtgggatcagatggcaagttggatagtgaataacgaattgtacagcgagaatgttgtttggttaatccagattcctcggatttacaatgtatacagggagatgggcacgattaattcattccagaacctccttgacaacatatttcttccactttttgaagtaactgttgatccttcttcacatcctcagctgcacgttttcttagaacaggttgttggtttagatttggtggatgatgaaagcaaaccagaaaggcgcccaacaaaacacatgccgactcctgagcaatggactaatgttttcaatccagcgtatgcatattatgtatactattgctatgctaacctctacacactgaacaagcttcgtgactccaagggcatgacaacaatcaaacttcgtccacactgtggagaggctggcgatattgatcatcttgctgcagcatttctcacttctcacaatattgctcacggggtgaatctaaagaagtcccctgtcctccagtacttgtattatcttgctcagattggtcttgcaatgtctcctttgagcaacaactcgttgtttattgactaccaccggaacccgttcccaacatttttcttaagaggcctgaatgtttctctctcaactgacgaccctttgcaaattcacctaacaaaagaacctttggttgaagaatacagtgttgctgcttcgctgtggaagcttagctcttgtgacttgtgtgaaatagccaggaattctgtgtaccagtctggtttctctcataggctgaagtcacactggattggtagaaactactataaaagaggtcccgacggcaatgacatccaccagacaaatgttccccacattaggattgaattccggcacaacatttggaaagacgagatggagctgatacatttcggaaatgttaagctaccagaagaaaccgacagatgaagatgttgcggcagttttcaaaggagcccacgcgttccaggcatcgcaccccattttctgggctttgggagaaggaagcaaacctattatgcaatccgtgaaagagaagaaaagtgcccgagtaccttttcgatgagtcttttactcctgttgcttgtataggcaaatgttagcatggaaggatgaggaggaagacgctctaggatttcagtggaacatagtacatcagatctgtcgtcgctcgctcgctcgatacatcaaattagtgaccttgagaataaacttgtatctttgcttttatccagatatcttttacagcatgttaaatctgatattgttagtactatttgttagagat

SEQ ID NO: 1596 - DNA, 2821 bp, Setaria italica
agattcagatgaggaggaggatcttgttccagatgccaagaatgatgctgcttacttggcctcaaatggtgctgttgcatcagagctccttccagataaaacaagccagaatggggagttaaaagcagtaccatcaacacagatgattagatcccatagtgcaactggtagtctgcatgtgccccagcttaacccaatagcagctgatatactccgaaaggagcctgaacatgaaacctttagtaagatcaacatcacagctgttgagactccttcttccgatgaaattgaagcatataaagttcttcagaaatgtcttgagctgcgtgagaggtacatattcagagaagaagttgctccttgggagaaggagattataactgatcctagtactccaaaacctaacccaaatcctttcaattatgaacatcaggctaaaactgaacaccattttgagatggttgatggtgtcgttcatgtataccccaataaagattctaaagaaagactctatcctgttgctgatgcaactactttctttactgatatgcactacatcctccgtgtgttggctgctggggatattcgaactgtgtgccaccaccgtttaaatcttctagagcaaaaatttaatcttcatctgatggtcaatgcggatagagaactgcttgctcagaaagctgcaccacaccgggacttctacaatgttcggaaggttgatactcacgttcatcactcggcatgcatgaaccagaagcatttgttgagatttatcaagtcaaagttgaggaaggaacctgacgaggttgtaatctttagagatggtacctatttgactcttaaggaggtttttgagagtttggacttgactgggtatgacctcaatgttgatctcttagatgtccatgctgataagagcacatttcatcgttttgacaagttcaatctaaaatacaatccgtgtggccaatctcgcctgagggagatcttcttaaaacaggataatcttattcaaggtcgcttccttgctgagctcacaaaagaagtgttttctgaccttgaagcaagtaaatatcagatggctgagtatcggatatctatctatgggaggaagaaaagtgaatgggaccagatggcaagttggatagtgaacaatgaattatacagtgagaatgttgtttggttaattcagattcctcggatatacaacatatacagagagatgggcacaatcaattcgttccaaaaccttcttgacaatatttttctccctctttacgaagtaactattgaccctgcttcgcatcctcagctgcacgttttcttagaacaggttgttgggttggatttggtggatgatgaaagcaaaccagaaagacgcccaacaaaacatatgccaacacctgagcaatggactaatgttttcaacccagcctatgcatattatgtgtactattgttatgccaatctgtacacactgaacaagcttcgtgagtccaagggcatgacaacaatcaaactccgtccacactgtggcgaggctggcgatattgaccatcttgctgcagcatttcttacttctcataacattgctcatggggttaatctaaggaaatcccctgttcttcagtacctgtactatcttgctcagattggtctcgcaatgtctcctttaagtaacaactcgttgtttattgactatcaccggaatcctttccctacatttttcttaagaggacttaacgtatctctctcaactgatgaccctttacaaattcacctgacgaaggaacctttggttgaagaatacagtatcgctgcttcgctatggaagttgagttcatgtgacttgtgtgaaattgctaggaattctgtgtaccagtccggtttctctcacaggctgaagtctcactggatcgggagaaactactacagaaggggtcctgagggcaatgacattcaccagacaaatgttcctcacatcagggttgaatttcgacacacgatttggaaagaagaaatggagctaatacatttaagaaatgtcaaactaccggaagaaattgaccggtgaagatttactctgatgccttggcatcctgtccagactggcgcatagttccatggttggaaaccttgctagaagaagcaagtctgtgcagcctgcccggggttgcaagggaggagaaaaaggtgtcgagctgatcctactttccgttgcttacccgcagagtggctgaataggatcatgcgatgatagccccaaggcctcctagatacttggtccggtgtgacactgaaggtggtagcacattgaataagaaagttagaagttacattattggaatgtgaccttgttggattcgatgtacgtaattatattggtgcgtcggtttgtgtatgtacctgttacgttttacgtgctgcggtggttgtttctttctctaacaaaagaattgttaattacttgctactttacagaaagaagaactagcagctagggagagtagagtgaatggtgaagggaaactagaagctttagctagtgggatgtgggggtaagaggaggagcggagacgatgcgggcgtagatgaagtggttccatgtgtctggcagtcccgggaggcaccagtggatgcagtctgcgtaggtcttggggtctgcctgctgctccggggtgagcagcttcccctggcgcagcgtgtgcacggaggtgtgggcgtccttgcggagctcggagagggcggtgatgtcgacgaggtggacggggacgcggcggaggtgccgcgccagcaccccgcgcgccacgccgtgcagccg

SEQ ID NO: 1597 - DNA, 3029 bp, Triticum aestivum
  misc_feature (88)..(89): n is a, c, g, or t
  misc_feature (128)..(128): n is a, c, g, or t
  misc_feature (179)..(179): n is a, c, g, or t
  misc_feature (207)..(208): n is a, c, g, or t
  misc_feature (213)..(213): n is a, c, g, or t
  misc_feature (221)..(221): n is a, c, g, or t
  misc_feature (223)..(224): n is a, c, g, or t
  misc_feature (233)..(233): n is a, c, g, or t
  misc_feature (255)..(255): n is a, c, g, or t
  misc_feature (299)..(299): n is a, c, g, or t
  misc_feature (590)..(590): n is a, c, g, or t
  misc_feature (623)..(623): n is a, c, g, or t
  misc_feature (875)..(875): n is a, c, g, or t
  misc_feature (934)..(934): n is a, c, g, or t
  misc_feature (1013)..(1013): n is a, c, g, or t
  misc_feature (1205)..(1205): n is a, c, g, or t
  misc_feature (1207)..(1207): n is a, c, g, or t
  misc_feature (1505)..(1505): n is a, c, g, or t
  misc_feature (1577)..(1577): n is a, c, g, or t
cccaccccccgcctcgccgccatggagccctccccgtcctacgcgctccacctggccgtcgcggcgctcgtcggcgccaccttcgccnncgcgtccgctacatgcaccgcaagaccctcgaccagctnctccgcttcgcccgctccctcgaccgcgaccaccgccgccgcgcccgcctnctccccgacggcgccgaggacagcgacnncgacngggaggangnngaggaggangacgacggccctcccccgcacngggaccacgatcgccgcaccctccccatcccgccggggctcccnccgctccacaccggccgagagggcaagcccactatatctccagctgcgaacaaaagagttgggtctctggttagaccaacgacaccaaaatcctctgttcctgcagtcagcacatttgagagcatcgaagattcagatgaggatgttgatcttgagccagattccaaaaatgatgatgctgtctacgttggcacaaatggggctattggatcagacccggttcctgttaaagcggatcagaatggggacataccagcaacgagcatgattagatctcacagtgcaactggnagtctccatgggatccagctaaatccagtagcngctgatatacttcgaaaggaacctgagcatgaaactttcagtaggatcaatattacagctgttgaaactccttctcatgatgaaattgaagcgtacaaagttcttcaaaaatgtcttgagctacgagagaagtacatcttcagagaagaagttgctccatgggagaaggaaataataactgatcctagtacccccaaacctaacccaaacccgttcaactatgaacatcagaccaaaactgaacatcacttngaaatggttgatggtgttgttcatctgtaccccagtaaagattctaaagaaagactgtntcctgttgctgatgctaccaccttctttactgatatgcattatatccttcgtgtattggctgctggggatatccgaacngtctgtcatcaccgtttaaatcttctagagcaaaaatttaatcttcatttgatggtcaatgccgatagagagctgcttgcccagaaagctgcaccacacagggacttctacaatgttaggaaggttgatactcatgttcatcactctgcatgcatgaaccagaagcatcttttgaggtttattaagtcaaantngaagaaagaaccagatgaggttgtgatttttagagatgggacctatttgactcttaaggaggtgttcgagagtttggacttgactgggtatgacctcaatgttgatctcttggacgtgcatgctgataagagtacatttcaccgttttgacaagttcaatctgaaatataatccatgtggccagtctcgcctcagggagatctttcttaagcaggacaaccttattcaaggtcgcttcctcgctgaattaactaaagaagtgtttgctgaccttgaagcaagcaaatatcagatggcngagtatcgaatatctatttatgggagaaagaaaagtgagtgggatcagatggcaagttggatagtgaataangaattgtacagcgagaatgttgtttggttaatccagattcctcggatttacaatgtatacagggagatgggcacgattaattcattccagaacctccttgacaacatatttcttccactttttgaagtaactgttgatccttcttcacatcctcagctgcacgttttcttagaacaggttgttggtttagatttggtggatgatgaaagcaaaccagaaaggcgcccaacaaaacacatgccgactcctgagcaatggactaatgttttcaatccagcgtatgcatattatgtatactattgctatgctaacctctacacactgaacaagcttcgtgactccaagggcatgacaacaatcaaacttcgtccacactgtggagaggctggcgatattgatcatcttgctgcagcatttctcacttctcacaatattgctcacggggtgaatctaaagaagtcccctgtcctccagtacttgtattatcttgctcagattggtcttgcaatgtctcctttgagcaacaactcgttgtttattgactaccacaggaacccgttcccaacatttttcttaagaggcctgaatgtttctctctcaactgacgaccctttacaaattcacctaacaaaagaacctttggttgaagaatacagtgttgctgcttcgctgtggaagcttagctcttgtgacttgtgtgaaatagccaggaattctgtgtaccagtctggtttctctcataggctgaagtcacactggattggtagaaactactataaaagaggtcccgacggcaatgacatccaccagacaaatgttcctcacattaggattgaattccgacacaacatttggaaagacgagatggagctgatacattttggaaatgttaagctaccagaagaaactgatagatgaagatcttgcggcagttttgaaagccctgcacttcaggcattgcatccggttttctggctttcggagaagaagcaaccctgtgctggtctgtgaaagagaagaaaagtgcccaagtaccttttcgatgagtcttttactcctgttgcttgtataggcaaatattagcatggaaggataaggagaagacactctaggatttcagtggaatatactgcatcaggcgtatcgttgctcactcggtacattagttagtgaccttccttggaataaaattgtatcttttgctttcattatgcagacattttgcagcgtgttaaatctgatatttatttgtgtcggctcggtcatttatatcctaatattcgacatcatatcactgtagctgtatcagtttttttagaaccccgcatatgttttgtgtcggttagcgttatttcctttggtgcatgtggtgtaggccctgccactgtttggccacgccgtgcctcctgcgagcagaagattcaactggaccgctttgaacaaaaaaaaaaa

SEQ ID NO: 1598 - DNA, 2869 bp, Brachypodium distachyon
cggcgctaccggcggccatggagtcctccgcctacgcgctccacctggccgtggcggcgctcgtgggggcctccttcgccgccgcctccgcctactacatgcaccgcaagacgctcgaccagctcctccgcttcgcccgctccctcgaccagcgcgaccacaaccgccgccgccgcggccaccacctccgcgcccacctgctccccgacgaggacgacagcgatttggaccaggcggaagcggacgaggacgactccccgcccgccagggaccacgatcgccgcttcctgcccatcccgccgggcctcccgccgctccacaccggccgagagggcaagccgactatttcgccagcatcgaacaaaagaatcgggtctctggttagacctaccacaccgaaatcctctgttcctactgtcagtgcgttcgagagcatcgaagattcagatgaggatgctgaacttgtccaggattccaagaatgatgctgtttacttgggcacaaatggagctaatggatcagaccccattcctgataaagccactcagaatggggacataaaaccagtaccatcatcaaacatgattagatctcacagtgcaaccggcagtctgcatggggtccagctcaatccagtagctgctgatatactgagaaaggaacctgaacatgaaactttcagcaggatcaatattacagctgttgagactccttctcatgacgaagctgaagcatacaaagttcttcagaaatgtcttgagctacgagagaaatacatattcagagaagaagttgctccatgggagaaggaaatcataactgatcccagtacccccaaacctaacccgaatccgttcaattacgaacatcagactaaaactgaacatcattttgaaatggttgatggcgttgttcatctataccccaataaagattctaaagaaagattatatcctgttgctgacgcaactaccttttttactgatatgcactatatacttcgtgtattggctgctggagatatccgaaccgtgtgtcatcaccgtttaaatcttctagagcaaaaatttaatcttcatctgatggtcaatgcggatagagagctgcttgctcagaaagctgcacctcatcgggacttctacaatgtcaggaaagttgatactcatgttcatcactcggcatgcatgaaccaaaagcatcttctgaggtttattaagtcgaagttgaggaaagaacctgatgaggttgtaatttttagagatgggacctatttgactcttaaggaggttttcgagagtttggacttgaccgggtatgacctcaatgttgatctcttagacgtgcatgcagataagagtacatttcaccgttttgacaagttcaatctgaaatataacccgtgtggccagtctcgcctgagggagatctttcttaagcaggacaaccttattcaaggtcgcttccttgctgagttaactaaagaagtgtttgctgaccttgaagcaagcaaatatcagatggccgagtatcggatatctatttacgggagaaagaaaagcgagtgggatcagatggcaagttggatagttaacaacgaattgtacagcgataacgtcgtttggttaattcagattcctcggatatacaatgtatacagggaaatgggcaccattaattcattccagaatctccttgacaatatctttcttcctctttttgaagtaactgttgatcctgcttcacatcctcagctgcatgttttcttagaacaggttgttgggttggatttggtggatgatgaaagcaaaccagaaaggcgcccaacaaaacacatgccgacacctgagcaatggactaatgttttcaatccagcatatgcatattatgtctactattgttatgctaacctgtatacactgaacaagcttcgtgactccaagggcatgacaacaatcaaacttcgtccacactgtggggaggctggcgacattgaccatcttgctgcagcatttctcacttctcacaatattgctcatggggtgaatctaaagaaatcccctgtactccagtacttgtattatcttgctcagattggtcttgcaatgtctccattgagcaacaactcattgtttattgactatcaccggaaccctttcccaacatttttcctaaggggccttaatgtttctctctcaactgatgaccctttgcaaattcacttaacaaaagaacctttggttgaagaatacagtgttgctgcctcgctgtggaagcttagttcatgtgacctgtgtgaaatagctaggaattctgtttaccagtctggtttctcgcataggctgaagtctcactggattggtaggaactactatagaagaggtcccgacggcaatgacatccaccagacaaatgttcctcacataaggattgaattccgacacactatttggaaagaagaaatggagctaatacatttagggaatgttaaaataccagaagaaaccgatagatgaagattttgcaacaatttccaaagcccttgtatcctttgataggctggcacgttggcgttccggcattgcatcccatcccatcacattttttttctgccttacagaggagaagcaagcctatgcggcctgtaagagagaagaaaaggactggactgcttttcgatgagtctcttatagttgttacttgtataggcaaattataagtatgggatcgatgaacgttgtatgattttgatgaaatacacattacatgtgttgttgggatgctgacctcatacattaaagaccccgcttaaaattgaaatgaacgctggcttctatccagatcttccatgacatggaagttatttatgttt

SEQ ID NO: 1599 - DNA, 2853 bp, Zea mays
ttttctgcattcgacgccgccgcaggcccgcagccagctcgagcccaaaggagagaacccaggttggcggcggcgctccggcggcgatggactccccctacgctctccacctcgccatcgccgcgctcgtcggcgcctccttcgccgccgcctccgcctactacatgcaccgcaagaccctcgaccagcttctccgtttcgcccgcgaccagcagcgccgccgcaaccgcctcctccccgaaggcgacgaactggaggacggcgaagaggaccctccgccgcactgggatcatgatcgccgcaccctgcccatcccgccgggcctcccgccgctccacaccggccgagagggttgtaggccagttgtttctccaggttcgactaaaagagttggacctattgttagaccgactacacccaaatcctctgtccccactatcagtgcatttgatagaattgaagattcagatgacgaggaggatcttgtcccagatgccaagaatgatactgcttacttgaccccaaatggtgctattggatcagatctcacagataaagcgagccagaatggggaattaacatcagcaccatcaacgcagatgattagatcccatagtgcaactggcagcctgcatgtaccccagcttaacccaatagcagctgatatacttcgaaaggagcctgaacatgaaaccttcagtaaaatcaatatcacagctgttgagactccttctcctgatgaaattgaggcatacaaagttcttcagaaatgccttgagctgcgtcagaggtacatattcagagaagaagttgctccttgggaaaaagagatcataactgatcctagtactccaaagcctaatccaaatccgttcagttatgaacatcaggctaaaaccgatcaccatttcgaaatggttgatggcgtcattcatgtgtaccccaataaagattctaaagaaagactctatccagttgccgatgcaactaccttctttactgatatgcactacgtccttcgtgtgttggctgctggggatatccgaaccgtgtgtcatcaccgtttaaatcttctagagcaaaaatttaatcttcacttgatggtcaatacggatagagaactgcttgctcagaaagctgcacctcaccgggacttctacaatgttaggaaggttgatactcatgttcatcactcagcatgcatgaaccagaagcacctgttgagatttatcaagtctaagttgaggaaggaacctgatgaggttgtaatctttagagatgggacctatttgactcttaaggaggtttttgagagtttggatttgacagggtatgacctcaatgttgatctcttagatgttcatgctgataagagtacatttcatcgttttgacaagttcaatctgaaatataatccatgtggtcaatctcgcctgagggagatatttttaaagcaggataatcttattcaaggtcgcttccttgctgagctgacaaaagaagtattttctgaccttgaagcaagtaaatatcagatggctgagtatcggatatctatttatgggaggaagaaaagcgaatgggaccaaatggcaagttggatagtgaacaatgaattatatagcgagaatgttgtttggttaattcagattcctcggatatacaatgtatacagggagatgggcacaatcaattctttccaaaacctccttgacaatatttttctccctctttatgaagtaactgttgacccagcttcacatcctcagctccatgttttcttaaaacaggttgttgggttggatttggtggatgatgaaagcaaacctgaaagacgcccaacaaaacacatgccaacacctgagcaatggactaatattttcaatccagcctatgcgtattatgtgtactattgctatgccaatctgtatacactgaacaagcttcgtgagtccaagggcatgacaacaatcaaacttcgtccacactgtggggaggctggtgatatcgatcaccttgctgcagcatttcttacttcacataacattgctcatggggtgaacctaaagaaatcccctgtacttcagtacctgtattatcttgctcagattggtctagcaatgtctcccttaagtaacaactcactgtttatcgactatcatcggaaccctttcccaacatttttcttaaggggtcttaacgtgtctctttcgactgacgaccctctacaaattcacctgacgaaggaacctttggttgaagaatacagtgttgctgcttcactttggaagctgagctcatgtgacttgtgtgaaatcgctagaaattctgtctaccagtccggattctctcacaggctcaagtctcactggatcgggagaaactactacagaaggggtccggagggcaatgacatccaccagacaaatgttcctcacatcagggttgaatttcgacacactatctggaaagaagaaatggagctgatacattttggaaatgttaacctacccgaagaagttgacaggtgaagagcaggggaattgcagtgaagtctggcggtggcggcaaggggacgagagaatgtgtcaacacgagagactcgtttgcttgcagaggaggtatcatgacaatggatgtcgccaagtcctccgtgtcgaccatatatatatgaagaataataagaaaacacaaatacccaagtatttagaagcgttgaatccagatgtggcatgaggtcggagccaacgtgtacttgcatacgttacgtttatatacatgtactgctctgctgtaatggtgtttcgacgaatgtgtcttgtcattaatgttttgttaggctcgttccaggct

SEQ ID NO: 1600 - DNA, 3013 bp, Sorghum bicolor
cgccgccgcctcatcaaatcacaagccccagcccgtcccgtcagccaacccgagcccaagccccaaggttggcggcggcggcgcggcgccatggagtccccctacgctctccacctcgccctcgccgcgctcgtcggcgcctccttcgccgctgcctccgcctactacatgcaccgcaagaccctcgaccagcttctccgcttcgcccgcgaccaacagcgccgccgcaaccgcctcctccccgacgccgacgaactcgagggcggcgaagacgacgaggactatcctccggcgcacagggaccacgatcgccgcaccctgcccatcccgccgggcctaccgccgctccacaccggccgagagggtggtaggccagtcatttctccaggttcgactaaaagagttggacctattgttagaccgactacacccaaatcctctgtccccactgtcagtgcatttgatagaattgaagattcagatgacgaggaggatcttgtcccagatgccaagaatgatactgcttacttggccccaaatggtgctgttggatcagatctcacagataaagcgagccaaaatggggaattaaaatcagcaccatcaacgcagatgattagatcccatagtgcaactggcagtctgcatgcaccccagcttaacccaatagcagctgatatacttcgaaaggaacctgaacatgaaaccttcagtaaaatcaacatcacagctgttgagactccttctcctgatgaaatcgaagcatacaaggttcttcagaaatgccttgagctgcgtgagaggtacatattcagagaagaagttgctccttgggaaaaggagatcataactgatcctagtaccccaaaacctaacccaaatccgttcaattatgaacatcaggctaaaactgatcaccattttgaaatggttgatggtgtcattcatgtgtatcccaataaacattctaaagaaagactctatccagttgccgatgcaactaccttctttactgatatgcactacatccttcgtgtgttggctgctggggatatccgaactgtgtgtcatcaccgtctaaatcttctagagcaaaaatttaatcttcatttgatggttaatacggatagagaactgcttgctcagaaagctgcacctcaccgggacttctacaacgttaggaaggttgatactcatgttcatcactcagcatgcatgaaccagaagcacctgttgagatttatcaagtctaagttgaggaaggaacctaatgaggttgtaatctttagagatgggacctacttgactcttaaggaggtttttgagagtttggacttgacagggtatgatctcaatgttgatctcttagatgtccatgctgataagagtacatttcatcgtttcgacaagttcaatctgaaatataatccatgtggtcaatctcgcctgagggagatctttttaaaacaggataatcttatccaaggtcgcttccttgctgagctgacaaaagaagtattttctgaccttgaagcaagtaaatatcagatggctgagtatcggatatctatttatgggaggaagaaaagtgaatgggaccaaatggcaagttggatagtgaacaatgaattatatagcgagaatgttgtttggttaattcagattcctcggatatacaatgtatacagggagatgggcacaatcaattcattccaaaacctccttgacaatatttttctccctctttatgaagtaactgttgacccagcttcacatcctcagctccatgttttcttagaacaggttgttgggttggatttggtggatgatgaaagcaaacctgaaagacgcccaacaaaacatatgccaacacctgagcaatggactaatgttttcaatccagcctatgcatattatgtgtactattgctatgccaatctgtatacactgaacaagcttcgtgagtccaagggcatgacaacaatcaaactgcgtccacactgtggggaggctggtgatatcgatcaccttgctgcagcatttcttacttcacataatattgctcatggggtgaacctaaagaaatcccctgtacttcagtatttgtactatcttgctcagattggtcttgcaatgtctcccttaagtaacaactcactgtttatcgactatcatcggaaccctttcccaacatttttcttgagaggtcttaacgtgtctctttcaactgacgaccctctacaaattcacctgacaaaggaacctttggttgaagaatacagtattgctgcttcactttggaagctgagctcatgtgacctgtgtgaaatcgctagaaattctgtctaccagtctggcttctctcacaggctcaagtctcactggattgggagaaactactacagaaggggtccggagggcaatgacatccaccagacaaatgttcctcacatcagggttgaatttcgacacactatctggaaagaagaaatggagctgatacattttggaaatgttaaactacccgaagaaattgacaggtgaagaagagtagggaattgtgatggcgtggcagtgaagtctggcagtggctgtaactgtaagggaggagaaaaggtgtcaacatgatcctgccttcgatgaatctcttgtttgcagaggtattatggctgatgtcgccaagtcatactagtatactcactccgtgcctaggccacaccatatatgaagaataagccggaaagcacctagtatttagaagcgttgaatccagatgtgccatgaggtgggaggcaacgcatcatgtactttcgttacgtttatatacgtgtactgctgtaatggtggatcgacgaatgtctgtcatctagtgttttgttagccaaattgcatggtaaattaattagttatccagaaaaaaacttatgctttatactaatgatgaataaaaggaaatctttaatggggaaagaagtgagaatgcgcatcgtgtaaatagaatgaaataggtgtt

SEQ ID NO: 1601 - DNA, 3138 bp, Hordeum vulgare
agaggtaggtggttggtcgatccaaggacgcactgcggatggtggctattttcagtagtattggaatgcattccgtccctgagatgtagcactactgcactagtagtatattctgcaagttgtgacgcgcgctacagcctaccgcagccgctccggcttaaatagaggggcaggcctgagagcgcagagagcagagagcagagagcagagcggagcatagacaccgagaagaatgagggtggcggtggttggcggcggggtgagcgggctggcggcggcgcatgagctcaccgccagcgggggagacggcgtgcgagtgaccctgtacgaggaggaggccagcctcggcgggcacgccaggacggtggccgtcgatgacggcgccggctgcgtcaagctcgacctcggcttcatggtcttcaaccaggttacatatccgcgaatgatggaatggttagaaggacacggggttgagatggagaggtcagacatgtctttctctgtgagcacacaatctaaaggaggcggtggaggatgtgagtggggaaatggtaacggtatatcgagcctcttggcgcaaaaaactaacatactgaaacccagtttttggcgcatggtctgtgagatactcaagttcaggaacaatgctctgacgtacctggaggaccatgaacgtaaccctgatctggatcgtaatgagacactggggcagttcattcagtcgcatggatattccctatcgtttcaagaggcttatcttattccagtctgcacaggcacgtggtcatgttcatcacaagatgttttgagcctgtctgctttcttggtgctgtcattttgccgtaaccatggccttcttcagctgtttcgtcactcccagttgcccactgtcaagcctagttcgcagtcctatgtaaacaaggtaaaaggagaattggagagcattggctgtcgaattaaaaccagttgtcgggtcaaatctgtttcaagtcttgatggagctggctacagagtcttggagaatgatggttcagtggaaacatacgacagtgtcatctttggggtccatgcatccaatgctctcaaattattaggagctgaagcatcacatcacgaacgaagaattctaggtgcctgtcagtatgtccaaagagatatatacctccactgcgatcaaaatttgatgccccgaaaatcatcagcatggagtgcgtggaatttccttgggacaactagtaggggtttttctattacttactggctaaaccaaattcagaaatttgaatcgggcaggcctttcctggtgacactcaatcccccttgtgttccggatcatgtactacttaaatggaatacaagccttcctgttccgtctgtggccgcggcgaaggcttatcttcagcttcatcagatccagggaaagaggggaatatggttctgtggggcatatcaaggtcatggcttccatgaagacggattaaagtctgggaaagcagcggctcaaggtttgcttggaaagaaatgtgagcttctgctgaacccaaagaatatgattccatcatggattgaggctggggcacgccttctagttgcaagatttttcaaccaatacatatccattggtaacttgatattggtcgaagaaggaggtagtgtgttcagctttggtaaagcttgcgacaaatgctgtgtaaaatctgtcatccaagttcatgaccccttgttttattggaaggttgcaatagaaggaggcatgggcttggcagaatcctatattgacggttgtttctctgttcttgacaagagagaaggccttctaaatcttatcctgattctcattgctaacagagacgagcgtaggaaccgccgcattgccagaaaagggttttggttgtcacccttccatgtaatagctcaattggcatatgctaaacactttttgcgccaggcaacaaggaagaacactgcaacacaaactcgtcgaaacatctctgagcactatgatcttagtaacgactttttttcgctttttctggataaatcgatgacttactcctgtgcagttttcaaggagaacgaaagcttagaagcagcccaacaacgtaaacttagccttctaatcaataaggctaaagtcaagagggagcatcatgttcttgatatcggtagcggctggggaagtttagcaatagaaacagttaagcaaactggctgcaaatacactggagtcactttatcggcggagcagcataaatacgcagaaagaaaagtaagagaagctggcttagaggaccgcataaattttctgctgtgcgactaccgtaaaataccaccttttaagtatgacgcaatcataagctgtggtatgattgaacatgttggccatgaatacatggacgaattttttgcttgctgtgagtcttacttggctgaagatgggatattggtcctccagttcatctcagttccagaggaacggtacgagcaatacagaaaaaggccagacttcataaaagagtacatattccctggtggttgccttccttctttggcccgtataatgtctgccatgaccgcgtcatcaaggttctgcatagagcatgtcgagaatattgggcccaattactacacaactctgatgcactggagggacaacttcatggccaacaaagaccaagttttggccctgggctttgatgaaaggttcctccgtatatgggagtactacctcatattctctgcggctggtttcaagtcacgagcaattggagattaccaggttgttttctctcgtccaggcaatcgtcgtctaggccagccttgatggccggagacaacatatccttctccgttcagcggccgaatcgttacttgtcagtaccgtacgagattttaataagtcagtcctggaatgattcgctcatgcccgaatcctactcaggtggtttggtgatctatcttgttgtttaaccatgcaatggttagtttttcgtgggagtgtcttgttatccatcaattaactagaattttgagaattgtatgtaaggaactggtttgtttgctttaatatctatgaggaagagttgatgtccttgcttgtagtttctcatgatctgatctattcggtgtttgccgttt

SEQ ID NO: 1602 - DNA, 3096 bp, Hordeum vulgare
agaggtaggtggttggtcgatccaaggacgcactgcggatggtggctattttcagtagtattggaatgcattccgtccctgagatgtagcactactgcactagtagtatattctgcaagttgtgacgcgcgctacagcctaccgcagccgctccggcttaaatagaggggcaggcctgagagcgcagagagcagagagcagagagcagagcggagcatagacaccgagaagaatgagggtggcggtggttggcagcgggggagacggcgtgcgagtgaccctgtacgaggaggaggccagcctcggcgggcacgccaggacggtggccgtcgatgacggcgccggctgcgtcaagctcgacctcggcttcatggtcttcaaccaggttacatatccgcgaatgatggaatggttagaaggacacggggttgagatggagaggtcagacatgtctttctctgtgagcacacaatctaaaggaggcggtggaggatgtgagtggggaaatggtaacggtatatcgagcctcttggcgcaaaaaactaacatactgaaacccagtttttggcgcatggtctgtgagatactcaagttcaggaacaatgctctgacgtacctggaggaccatgaacgtaaccctgatctggatcgtaatgagacactggggcagttcattcagtcgcatggatattccctatcgtttcaagaggcttatcttattccagtctgcacaggcacgtggtcatgttcatcacaagatgttttgagcctgtctgctttcttggtgctgtcattttgccgtaaccatggccttcttcagctgtttcgtcactcccagttgcccactgtcaagcctagttcgcagtcctatgtaaacaaggtaaaaggagaattggagagcattggctgtcgaattaaaaccagttgtcgggtcaaatctgtttcaagtcttgatggagctggctacagagtcttggagaatgatggttcagtggaaacatacgacagtgtcatctttggggtccatgcatccaatgctctcaaattattaggagctgaagcatcacatcacgaacgaagaattctaggtgcctgtcagtatgtccaaagagatatatacctccactgcgatcaaaatttgatgccccgaaaatcatcagcatggagtgcgtggaatttccttgggacaactagtaggggtttttctattacttactggctaaaccaaattcagaaatttgaatcgggcaggcctttcctggtgacactcaatcccccttgtgttccggatcatgtactacttaaatggaatacaagccttcctgttccgtctgtggccgcggcgaaggcttatcttcagcttcatcagatccagggaaagaggggaatatggttctgtggggcatatcaaggtcatggcttccatgaagacggattaaagtctgggaaagcagcggctcaaggtttgcttggaaagaaatgtgagcttctgctgaacccaaagaatatgattccatcatggattgaggctggggcacgccttctagttgcaagatttttcaaccaatacatatccattggtaacttgatattggtcgaagaaggaggtagtgtgttcagctttggtaaagcttgcgacaaatgctgtgtaaaatctgtcatccaagttcatgaccccttgttttattggaaggttgcaatagaaggaggcatgggcttggcagaatcctatattgacggttgtttctctgttcttgacaagagagaaggccttctaaatcttatcctgattctcattgctaacagagacgagcgtaggaaccgccgcattgccagaaaagggttttggttgtcacccttccatgtaatagctcaattggcatatgctaaacactttttgcgccaggcaacaaggaagaacactgcaacacaaactcgtcgaaacatctctgagcactatgatcttagtaacgactttttttcgctttttctggataaatcgatgacttactcctgtgcagttttcaaggagaacgaaagcttagaagcagcccaacaacgtaaacttagccttctaatcaataaggctaaagtcaagagggagcatcatgttcttgatatcggtagcggctggggaagtttagcaatagaaacagttaagcaaactggctgcaaatacactggagtcactttatcggcggagcagcataaatacgcagaaagaaaagtaagagaagctggcttagaggaccgcataaattttctgctgtgcgactaccgtaaaataccaccttttaagtatgacgcaatcataagctgtggtatgattgaacatgttggccatgaatacatggacgaattttttgcttgctgtgagtcttacttggctgaagatgggatattggtcctccagttcatctcagttccagaggaacggtacgagcaatacagaaaaaggccagacttcataaaagagtacatattccctggtggttgccttccttctttggcccgtataatgtctgccatgaccgcgtcatcaaggttctgcatagagcatgtcgagaatattgggcccaattactacacaactctgatgcactggagggacaacttcatggccaacaaagaccaagttttggccctgggctttgatgaaaggttcctccgtatatgggagtactacctcatattctctgcggctggtttcaagtcacgagcaattggagattaccaggttgttttctctcgtccaggcaatcgtcgtctaggccagccttgatggccggagacaacatatccttctccgttcagcggccgaatcgttacttgtcagtaccgtacgagattttaataagtcagtcctggaatgattcgctcatgcccgaatcctactcaggtggtttggtgatctatcttgttgtttaaccatgcaatggttagtttttcgtgggagtgtcttgttatccatcaattaactagaattttgagaattgtatgtaaggaactggtttgtttgctttaatatctatgaggaagagttgatgtccttgcttgtagtttctcatgatctgatctattcggtgtttgccgttt

SEQ ID NO: 1603 - DNA, 2151 bp, Triticum aestivum
gaccgttttctattccttccctcttttgttttctcccgcgagcagctcgtgcgacagctgagctgcggccgccgccgccacactttgcttcgctgtgagcggtcccgagcgtgagccggtgggggtgtcggcgaggcgcgcgagggtcaggcagcgaggagaccgccgccgctgcagcctggtgtgcgcgcgctccaggctgctccgccactcagccaccgggttgcagatgccgccattgctcctgctaggctgctaccgtccgtcgccagccgtccgcgctgctgctgccaccttcgccgcgcacctgaccgcgccgccgcccgggaattgcccgacgcggccgtctcgtgttgccctctgccggcgcgcgcggcagacgacgcctttgacgtctatctttctggccaaacgcattcctcgggcatacagaggctaaagtcaaccttaaaatggaggatgctaacgcagtagtagattggaatgttgacattattggcccagatggtggtagcggcgcttgccgcaaattggcaaaaactgaagaccctgatgccacagagtgttcaagttcctttggggacacactatctggatctcaggatgatgcaaagccttcagagattagtgacattgaagtagactcaccattctgccgttatcctcataatggtgatgctgctgcactcttggatgcagctgctgctgacaatttggatagattattgaaaaagaaaaaagtgaccgatcattggagaagctatatcagcccattaatgtggagatgccaatggttagagctgcggatgaaagacttgcaatctcaagtatccagatatgacagggagcttgcagtacttaaacatgagaaagagttgcagacaaaaatgattgagttggactgttcctcgtcaagatcagtgcccttctcttctcattgctgcaggaagactatgaagaggaagaagagaaagagaaatgaggagaaaatcaatgctccctcatacatcgcaacccacaccatattgtcttattatgaaaaagagaaaacggaaggtgatggccattctatcgacgacaatggaaacttagatgacagcacaaaaggaaataatgacgctgactggctactcggtaatggagacgatgctactgtcgagcagattcttgtaagcattcagtctgttcaagacagagtctgtagtctgagatcagatctcaagaaagcaatggccaagaagagtaaggggcttctccttaaagtcaacacacaggtcaacggcgcacagagctctaattgctcacatggaaaaggcaaagttactgaaatgcctgaaatatcacctcaagatgcatcggattgtgatatgggtgatacggacatgcccgatagtgctgtctcaagctatggagaagctaacaatatggatatttttgagagcacgatgaacctattgtcagttgaagatccagataaaattggtgaactacgccagacttcggaagatgtattgatcgacaaccaaccagctgaggaagggtatcaaaattttgaggtgatcagtcacccatgccagcgactacgggtatcagtcaagagggaacaggtacctgtcaagagagaaactgtagcacattctgaggatgagagcgtcgccgcccccatggcggtcgtcaaggaagaaggcggcacaaccaggatgggcctccaggggatcttgaagccctgctacacgggcaagagaaaagggaggaggccgaagattctaaggcgcggtggttcatcatctgctctcagctcatggaggagcgcccggactcgaaagaagaggaaatcgtagatgcagatggtctcagtgaacacaccctatcctctggcttcagttcttccgtttgattagatgatgatgacggcaactgcgcactccctctcttttttcttttcttttccttctatctgactgatgacattttccgcggagccagaagagagtgatggaaaatggcgctatggctttcagccgcgaggtgcttgtaaacctagcgatgtctgtttctgtttctattgttgttgttacgtctggtctttgttctgaaagagtcgaactttggttgttacagtgtaacttttgataaggctttcctgcaatg

SEQ ID NO: 1604 - DNA, 1864 bp, Brachypodium distachyon
ccctagtcctagtccttagccagctgacggcgccgccgcacggcaggaacaaagcctctcgctcccactcgccgccgccgcctcctcctcctctgccgccgctgcagaatatacagaggccaaggtcaaccttaaaatggaggatgtgaatggagtagtagattggaacgttgacattattggcccagatggtggtggcccgtccagcaaattggccaaaattgaagaccctgatgccacagagtgctcaagttcctttggggatacattgtctggatcagaggatgatgcaaggccttcagagattagtgacattgaagtggactcaccattctgccgctatcatcctaatggtgatgctgctgcactcttggatactgctgctgctgacaatttggatagatcactgaagaagaaaaaggtaactgatcattggagaacgtatatcagcccattaatgtggagatgccaatggttagaactgcggatgaaggagttgcactctcaagtatccagatatgacagggagcttgcagttcttaaacatgagaaagagttgcaaacaaaaatgatcgagttggactgttcgtcatcgagatcagtgcccttctcttctctttgttgcaggaagactatgaagaggaggaggagaaagagaactgaggagaaaatgaatgcgtcctcatacatcgcgacccacaccatattgtcttattatgagaaagagaaagcggaagcggatggccattctattgacgacaatggaatcttagcggatgacagcacaaaaggtaacaatgatgctgactggctactgggtaatggaagtgatgctactgttgagcagattcttgcaagcattcagtctgttcaagacagagtccttagtctgagatcatacctcaagacagaaatcgacaagaagagtaacggaatagatcttaaagtcaacacacgggtcaatgttgcacagagctctaattgcgcacatggaaaaggaaaagttgctgaaatgcttgaaatctcaccccaggacgcatcagattgtgatatggatgatactgacatgccagacagtgctgtctcaagctttggagaagctaacaatatggatatttttgagagcaccatgaacctattatcagctgaagatccacataaaatgggtgaattacaacagagttcggaagatgtattgatcgacaatcaaccagctgaggaagggtatcaaaactttgaggtaatcagtcatccgtgcaagcgtctgcgggtgtcagtcaagagtgaagcaggggtagtcaagagagaaaccggggcacattctgaggatgagagcatcgctgcccccacagtagcaattgtgaaaaaagaagaaccaccggaagatggcacaaccaggtttggtctccaggggattttgaagccctgctacacgggcaagcggaaaggaaggaaaccaaaaatcctaaggcgtggaggttcatcctcgtctgctctcagctcttggaggagtgctcggactcgaaaaaagaggaaattgtaggtgtagactatctctgggaacacatcttaccctctggcttcggatcttagttttaattagatgatgatgacggcaaccatggttttcctccctttatttctttctttcgttgtacctgatgatgacatttttcatgatgccagaagagaaagatggaaaacggcactatggctttctgccctgaagtgcttgtaacttagtaaggcatatttctatttccattgtcgttgcatgcggtcttgacctgaaacagtcgaactgggttgctacagtgtaacttattataattactgatatgttgctctgttgctacttttgttt

SEQ ID NO: 1605 - DNA, 1364 bp, Hordeum vulgare
tcgagttttatgctataaacacagattcccaggctctcgtcaattcgcaggcacaacatccgttacaaattggagaacaattgactcgtgggctgggtactggtggaaatcctaatttgggagaacaggctgccgaggaatcaaaggaagtgatagccaatgccctccgagattcggaccttgtcttcataacagctgggatgggagggggtactggctccggtgctgctccagttgttgcccagatagcaaaggaagctggttatcttactgtcggtgttgtcacctacccattcagcttcgaaggacgcaaacgctctttacaggcacttgaagcattagagaagctggaaaggagtgttgacacactaattgtgataccaaatgatcggttgttagatattgctgatgaaaatatgcccttgcaagacgcgtttctccttgcagatgatgtccttcgtcagggtgtccaaggaatatcagacataatcacgatacctgggcttgtgaatgttgattttgccgatgtgaaagctgtgatgaaaaattctggaactgccatgcttggcgttggtgtttcttccagcaaaaaccgcgcccaagaagctgctgagcaggcaactcttgcccctttgatagggtcatccattgaggcagctaccggtgttgtgtacaatatcactggcgggaaggacatcactttgcaagaagtaaacaaggtctctcagattgtgacaagcttggccgacccctcggcaaacataatttttggtgctgtcgtagacgaccgttataacggcgagatccacgtgaccatcatcgcaacaggatttccgcagtccttccagaagtcccttctggctgaccctaagggagctcggatactggaggcgaaagaaaaggcggctagcctcgtatcagctgctgtgcaacaaccgacgccggcggccgtcccgacatggtcgcggaggctcttctcctgaacaccgttcagcaggcacaaacaaccttgtgaagctgtggttctcactttatcaaggcagtagagagttagccggtgcggtgtaaacactctgaaactagtttcgcgtagtgattaggttctcgcctggtgtatgtattgttcagaagtctcttgactcggttgttttagaaggtgttctgttcgttgacagctttggcaaccccagggctcgcctgctgaattttgtgggtgcgtacgagcttttcttcgattgctgaatttagtgaggttcgtggatttatgcggccggaggtgtgatcggcaggcgtgtcagcgttctatggagtgtatacgcggtcgtacccgattgactatttgtgttggtaatgctaagatgctg

SEQ ID NO: 1606 - DNA, 2647 bp, Gossypium hirsutum
aacaatttacgctttatccctctctcccccgtcggtcataactttgcatttcgtggtatttgagaatgggggcttctattttatcagatctcggaaccgagatcttaattccagtttgcgccgtgattggaattgccttttctctcctacaatgggttctcgtttccaaggtgaagctctctcctggtcgagacccgggttctcctagaaacaacggtgcgggtggaaaaaatgactgcgccgattacctcattgaagaagaggaaggacttaatgatcataatgttgttcttaaatgtgctgaaattcaaagcgccatttctgaaggtgcaacctcgtttcttttcactgagtaccagtatgttggcatttttatggttgcttttgcaatcttgatttttgtcttccttggttcggtagaggctttcagcacaaagagtcagccttgcacatatgaccaatctaggatttgcaagcctgctcttgccactgctgcattcagcacaatatctttcttacttggtgctgtcacttcagttgtttctggctttcttggaatgaagattgctacctatgcaaatgctagaaccaccctggaggcaagaaagggagttggaaaggcatttatcactgcatttagatctggtgctgtcatgggttttcttcttgctgcaaatggccttctggtgctctacattgccatcaacttattcaagatctactatggtgatgattggggtggtctttttgaggcgatcactggttatgggcttggaggttcatccatggctctttttggtagagttggtggaggcatctacaccaaagctgctgatgtgggtgctgatcttgttggcaaggtggaaaggaacattcctgaggatgaccctagaaacccagctgttattgctgacaatgttggagataatgttggtgatatagctggaatgggatctgatctttttggttcctatgctgaatcatcttgtgctgcacttgttgttgcttccatctcttcttttggcatcaatcatgagttcactccaatgttatatcctctcatcataagttctgttggtatcattgtttgtttaatcacaaccttatttgcaactgatttctttgaaatcaaggctgttaaggaaattgagccatcattgaagaggcaacttatcatatccactgttctcatgactattggaatcggggttgttagttgggtagctcttccatcttcctttaccattttcaactttggagatcagaaagttgtcaagaactggcaactattcttatgtgttgctgttggtctttgggctggtctaattattggttttgtaaccgaatactataccagtaacgcatacagtcctgtacaagatgttgctgattcctgcagaactggagcagcaactaatgttattttcggccttgcattgggttacaagtcttgcattattcctatatttgctattgcagtcagtatttttgttagttttagctttgctgctatgtatggcattgctgttgctgcccttggaatgctgagcaccatagctactggactggctattgatgcttatggtcctatcagtgacaatgctggaggtattgctgagatggctggcatgagccacagaatacgagagagaacggatgctcttgatgctgctggaaacaccactgctgctattggaaagggtttcgccattggttcagctgcccttgtgtcccttgccctctttggtgcttttgtgagccgtgctgctatttcaacagttgatgtattgacccctaaagtttttattggcttgcttgtcggggcaatgcttccttactggttttctgctatgaccatgaagagtgtgggaagtgcagctttgaagatggttgaggaagtgcgcaggcaattcaacacaatcccaggtctcatggagggtactgctaaacctgactatgctacctgtgttaagatctctactgatgcttcaatcaaagaaatgatcccacctggtgcccttgttatgctcacaccccttgttgttgggatcttttttggcgtggaaactctctctggtgtcctcgctggatctcttgtctctggtgtccagattgctatctctgcatccaacacaggaggtgcttgggataatgccaagaagtatattgaggctggtgcttctgaacatgcaaaaactcttggtcccaaaggttcagatccacataaggctgccgttattggtgacaccattggtgaccctttaaaggatacatctgggccatcgctgaacatcctcatcaagctaatggctgttgaatctcttgtctttgctcccttctttgctacacatggtgggctgctttttaagatattttaagtgaagacaaacatcggctactagtctaccatttccgatacctgtctgttattctcttataattttcattttgaagtatatttaggtcgtagcacattttgactctagagatcatttcctctttaaagtcatattggtagtaaaagtttaccctttgtaacaacgacattgatgttgttgttgatgatgatgatgattatggtcaatctaggaaaagagttgaaaccacattgttactattgttactgttttgttcaatgaagaatgtt

SEQ ID NO: 1607 - DNA, 2652 bp, Gossypium hirsutum
acgctttatctctctttcccccgtcggtcataactttgcatatcgtggtctttgagaatgggggcttctattttatcagatctcggaaccgagatcttaattccagtttgcgccgtgattggaattgccttttctctcttacaatgggttctcgtttccaaggtgaagctctctcctggtcgagacccgggttcacctagaaacaacggtgcgggtggaaaaaatgactgcgccgattacctcattgaagaagaagaaggacttaatgatcataatgttgttcttaaatgtgctgaaattcaaagcgccatctctgaaggggcaacctcatttcttttcaccgagtaccagtatgttggcattttcatggttgcttttgcaatcttgatttttgtcttccttggttcggtagagggtttcagcacaaagagtcagccttgctcatatgaccaatctaagatttgcaagcctgctcttgccactgctgcattcagcacaatatctttcttacttggtgctgtcacttcagttgtttctggctttattggaatgaagattgctacctatgcaaatgctagaaccaccctggaggcaagaaagggagttggaaaggcatttatcactgcatttagatctggtgctgtcatgggttttcttcttgctgcaaatggccttctcgtgctctacattaccatcaacttattcaagatctactatggtgatgattggggtggtctttttgaagcgatcactggttatgggcttggaggttcatccatggcactttttggtagagttggtggaggcatctacaccaaagctgctgatgtgggtgctgatcttgttggcaaggtggaaaggaacattcctgaggatgaccctagaaacccagctgttattgctgacaatgttggagataatgttggtgatatagctggaatgggatctgatctttttggttcctatgctgaatcatcttgtgctgcacttgttgttgcttccatctcttcttttggcatcaatcatgagttcactccaatgttatatcctctcatcataagttctgttggtatcattgtttgtttaatcacaaccttatttgcaactgatttctttgagatcaaggctgttaaggaaattgagccatcattgaagaggcaacttatcatatccactgttctcatgactattggaattggggttgttagttgggtagctcttccatcttcctttaccattttcaactttggagatcagaaagttgtcaagaactggcaactattcttatgtgttgctgttggtctttgggctggtctaattattggttttgtaaccgagtactataccagtaacgcatacagccctgtacaagatgttgctgattcctgcagaactggagcagcaactaatgttattttcggccttgcattgggttacaagtcttgcattattcctatatttgctattgcagtcagtatttttgttagttttagctttgctgctatgtatggcattgctgttgctgcccttggaatgctgagcaccatagctactggactggctattgatgcttatggtcctatcagtgacaatgctggaggtattgctgagatggctggcatgagccacagaatacgagagagaacggatgctctggatgctgctggaaacaccactgctgctattggaaagggtttcgccattggttcagctgcccttgtgtcccttgccctctttggtgcttttgtgagccgtgctgctatttcaacagttgatgtattgacccctaaagtttttattggtttgcttgtcggggcaatgcttccttactggttttctgctatgaccatgaagagtgtgggaagtgcagctttgaagatggttgaggaagtgcgcaggcaattcaacacaatcccaggtctcatggagggtactgctaaacctgactatgctacctgtgttaagatctctactgatgcttcaatcaaagaaatgatcccacctggtgcccttgttatgctcacaccccttgttgttgggatcttttttggcgtggaaactctctctggtgtcctcgctggatctcttgtctctggtgtccagattgctatctctgcatccaacacaggaggtgcttgggataatgccaagaagtatattgaggctggtgcttctgaacatgcaaaaactcttggtcccaaaggttcagatccacataaggctgccgttattggtgacaccattggtgaccctttaaaggatacatctgggccatcactgaacatcctcatcaagctaatggctgttgaatctcttgtctttgctcccttctttgctacacatggtgggctgctttttaagatattttaagtgaagacaaacatcggctactagtctaccatttccgattcctgtctgttattctcttataattttcatttttaagtatatttaggtcgtagcacattttgactctagagatcatttcctctttaaagtcatattggtagtaaaagtttaccctttgtaacaacgacattgttgttgttgttgatgatgatgatgattacggtcaatctaggaaaagagttgaaacttgaaaccacattgttactattattactgttttgttcaatgaagaatgttattttt

SEQ ID NO: 1608 - DNA, 2692 bp, Gossypium hirsutum
agctttgcatttcgtctcttttggggaaggtggtttgatatgggggcctcctcgattttgccagatctcggaaccgagatcctgatcccggtttgtgccgtgattggaattgccttttctctcgttcaatggattctcgtttcccgggtcaagctctctcccggtcgagactctggtgcccccggtaacaacggtgccgctggtaaaaacggctacgctgattacctcattgaagaagaagaaggtctcaatgaccataatgttgttgttaaatgtgctgaaatacaaaacgccatctctgaaggtgcaacctcatttcttttcactgagtatcagtatgttggcattttcatggttgcttttgcaatcttgattttcctcttcctcggctccgtagagggtttcagcatgaagagccaaccttgcacatatgacctatctaggatgtgcaagcctgcccttgccactgctgcactaagcaccttatcattcttgctcggtgctgtcacttcagttgtttctggctttcttgggatgaaaattgctacctatgcaaatgctagaaccacccttgaggcaagaaagggagttggaaaggcatttattactgcatttagatctggtgctgtcatgggctttcttcttgctgcaaatggccttttggtgctttacattgccataaatgtattcaagctctactatggtgatgactggggtggtcttttggaggcaatcactggttacgggcttggaggttcatccatggctcttttcggcagagttggtggaggaatctatactaaagctgctgatgtgggtgctgatcttgtaggcaaggtggagaggaacattcccgaggatgaccctagaaaccctgctgtgattgctgacaatgttggggacaatgttggtgatattgctggaatgggatctgatctttttgggtcctatgccgaatcatcttgtgctgccctagttgttgcttccatctcttcttttggaatgaatcatgaattgactccaatgttatatcctctcatcatcagttctgtcggtatcattgtttgtttaatcaccaccttatttgcaactgatttctttgagatcaaggctgttgatgaaattgaaccatcattgaagaggcaacttataatctccactgttctcatgactattggaattggagttgttagttggatagctcttccaccttcctttaccattttcaattttggagaccagaaacttgtgaagaattggcaactattcttatgtgttgctgttggtctttgggctggcctaattattggttttgtaactgagtactacactagcaatgcatacagccctgtacaagatgttgctgattcctgcaggactggagccgcaactaatgttatttttggtcttgcattgggttacaagtcttgcattattcctatttttgctattgctatcagtatttttgttagttttagctttgctgctatgtatggcattgctgttgctgcccttggaatgctgagtaccatagctactggattggctattgatgcttatggtcccatcagtgataatgctggaggcattgctgaaatggctggcatgagccatagaatacgagagagaactgatgctcttgatgctgcagggaacaccactgctgctattggaaagggttttgccattggttcagcagccctggtgtcccttgccctttttggtgcttttgtgagccgtgctgcaatttcaacagttgatgtattgacccctaaagtttttattggtttgcttgtcggggcaatgcttccttactggttctctgctatgaccatgaagagtgtgggaagtgcagctttgaagatggttgaggaagtgcgcagacaattcaacacaatcccaggtctcatggagggcacttccaagcctgactatgctacctgtgtcaagatctctactgacgcctctatcaaagaaatgatccctcctggtgcccttgttatgctcacaccccttattgttgggatcttttttggtgtcgaaactctctctggtgtccttgctggatctctcgtctctggtgtccagattgctatctctgcatccaacacagggggtgcttgggataacgctaagaagtacattgaggcggctgcttcagaccatgcaagggctcttggtcccaaaggatcggatccacataaggcagctgttattggtgacaccattggagaccctctaaaggatacatctgggccatcactgaacatactcatcaagctcatggctgttgaatcacttgtttttgctcccttctttgctacacatggtggactgctgtttaagatattctaagagaaaacaaacattggctaaaggcccactgattcccatctctgccgggttccacatttccaattttcctaagtatatttagtttagcaccttttttactctagagaccatctcctctcaaaggccaaatcaggcaatgaaaaatttccccttgtaaagggtttacaaagacattgataatgatgatgatgatgatgataatggtcaatccatagaaaagagttaaaactgtattgttactattattactttttgttatatgaagaatgttgatttttgctctcgtctaaaaagaaaaaagtaccgactgcgactctgcgttgatacacctgcgcgg

SEQ ID NO: 1609 - DNA, 2706 bp, Gossypium hirsutum
ttacgctttatccctctctcccccgtcggtcataactttgcatttcgtggtatttgagaatgggggcttctattttatcagatctcggaaccgagatcttaattccagtttgcgccgtgattggaattgccttttctctcctacaatgggttctcgtttccaaggtgaagctctctcctggtcgagacccgggttctcctagaaacaacggtgcgggtggaaaaaatgactgcgccgattacctcattgaagaagaggaaggacttaatgatcataatgttgttcttaaatgtgctgaaattcaaagcgccatttctgaaggtgcaacctcgtttcttttcactgagtaccagtatgttggcatttttatggttgcttttgcaatcttgatttttgtcttccttggttcggtagaggctttcagcacaaagagtcagccttgcacatatgaccaatctaggatttgcaagcctgctcttgccactgctgcattcagcacaatatctttcttacttggtgctgtcacttcagttgtttctggctttcttggaatgaagattgctacctatgcaaatgctagaaccaccctggaggcaagaaagggagttggaaaggcatttatcactgcatttagatctggtgctgtcatgggttttcttcttgctgcaaatggccttctggtgctctacattgccatcaacttattcaagatctactatggtgatgattggggtggtctttttgaggcgatcactggttatgggcttggaggttcatccatggctctttttggtagagttggtggaggcatctacaccaaagctgctgatgtgggtgctgatcttgttggcaaggtggaaaggaacattcctgaggatgaccctagaaacccagctgttattgctgacaatgttggagataatgttggtgatatagctggaatgggatctgatcttttggttcctatgctgaatcatcttgtgctgcacttgttgttgcttccatctcttcttttggcatcaatcatgagttcactccaatgttatatcctctcatcataagttctgttggtatcattgtttgtttaatcacaaccttatttgcaactgatttctttgaaatcaaggctgttaaggaaattgagccatcattgaagaggcaacttatcatatccactgttctcatgactattggaatcggggttgttagttgggtagctcttccatcttcctttaccattttcaactttggagatcagaaagttgtcaagaactggcaactattcttatgtgttgctgttggtctttgggctggtctaattattggttttgtaaccgaatactataccagtaacgcatacagtcctgtacaagatgttgctgattcctgcagaactggagcagcaactaatgttattttcggccttgcattgggttacaagtcttgcattattcctatatttgctattgcagtcagtatttttgttagttttagctttgctgctatgtatggcattgctgttgctgcccttggaatgctgagcaccatagctactggactggctattgatgcttatggtcctatcagtgacaatgctggaggtattgctgagatggctggcatgagccacagaatacgagagagaacggatgctcttgatgctgctggaaacaccactgctgctattggaaagggtttcgccattggttcagctgcccttgtgtcccttgccctctttggtgcttttgtgagccgtgctgctatttcaacagttgatgtattgacccctaaagtttttattggcttgcttgtcggggcaatgcttccttactggttttctgctatgaccatgaagagtgtgggaagtgcagctttgaagatggttgaggaagtgcgcaggcaattcaacacaatcccaggtctcatggagggtactgctaaacctgactatgctacctgtgttaagatctctactgatgcttcaatcaaagaaatgatcccacctggtgcccttgttatgctcacaccccttgttgttgggatcttttttggcgtggaaactctctctggtgtcctcgctggatctcttgtctctggtgtccagattgctatctctgcatccaacacaggaggtgcttgggataatgccaagaagtatattgaggctggtgcttctgaacatgcaaaaactcttggtcccaaaggttcagatccacataaggctgccgttattggtgacaccattggtgaccctttaaaggatacatctgggccatcgctgaacatcctcatcaagctaatggctgttgaatctcttgtctttgctcccttctttgctacacatggtgggctgctttttaagatattttaagtgaagacaaacatcggctactagtctaccatttccgatacctgtctgttattctcttataattttcattttgaagtatatttaggtcgtagcacattttgactctagagatcatttcctctttaaagtcatattggtagtaaaagtttaccctttgtaacaacgacattgatgttgttgttgatgatgatgatgattatggtcaatctaggaaaagagttgaaaccacattgttactattgttactgttttgttcaatgaagaatgttttttttgcttctctgaatttcctgtcatgagctattttaatgatgaatgagcactttgaacgatat

SEQ ID NO: 1610 - DNA, 2884 bp, Gossypium hirsutum
ggcacgagcggcacgaggaattttctattatatcttataataataataataataaaatacagaaatcttcattttcacactttgatttttagcttttacactgcaaaaactttttttttctgtatataaaccctcacttgtctcccatttttcctcactgggaaattttgttctttaccatcggtttgcagcttctcatttcgtttagtttgaagggtggttttatttacgtatgggggcttcgattttgtctgatttcggagccgagatcctgatcccggtttgcgccgtgattgggattgccttttcgctcgtacaatgggttctagtttccaaagtgaagctttctccgggtcgggagtcggtgaacaatggttcgggcgccaaaaacgggtactccgattaccttattgaagaagaagaaggtcttaatgaccatagtgttgttcttaaatgtgctgaaattcaaagcgccatttctgaaggagcaacttcgtttcttttcactgagtatcagtacgttggcattttcatggttgcttttgcaatcttgattttccttttccttggctcggtagagggtttcagttcaaagagccagccttgcacgtacgacaaatctaaaatttgcaagcctgctctagccacagctgcattcagcaccatatctttcttgcttggtgccatcacttcagttgtttctggatttgtcgggatgaaaatcgctacctatgcaaacgctagaaccaccctcgaggcaaggaagggagttggaaaggcatttataaccgcgtttagatctggtgctgtcatgggctttcttcttgctgcaaatggccttttggtgctttacattgccatcaacttattcaaactttattacggcgatgactggagtggtcttttcgaggcaatcactggttatgggcttggaggttcatccatggctctttttggcagagttggtggaggaatctataccaaagccgctgatgtgggtgctgatcttgtagggaaggtggaaaggaacattcctgaggatgaccctagaaacccagctgtgattgctgataatgttggagataatgttggtgatatagctggaatgggatctgatctttttgggtcctatgctgaatcatcttgtgctgcacttgttgttgcttccatctcttcttttggcatcaatcatgaattgactccaatgttatatcctctgatcatcagttccgttggtatcattgtttgtttaatcacaaccttatttgcaactgatttctttgagatcaaggctgttaaggaaatcgagccatcattgaagcggcaactcataatttcgactgttctcatgactattggaatcgggattgttagttggatagctcttccatcttcctttactattttcaatttcggagaccagaaagctgtgaagaactggcaactattcttatgtgttgctgttggtctttgggccggcctaattatcggtttcgtaactgagtactatactagcaatgcatacagccctgtacaagatgtcgctgattcctgcaggactggagctgctactaacgttatttttggccttgcattgggttacaagtcttgcattattcctatttttgctattgcaatcagcattttcgttagttttagctttgctgctatgtatggcattgctgttgctgcccttggaatgctgagcaccatagctaccgggttggctattgatgcttatggtcccatcagcgataatgccggaggcattgctgagatggctggcatgagccacagaatacgggagagaactgatgctcttgatgctgcaggcaacaccactgctgctatcggaaagggtttcgccattggttcagcagcactggtttcccttgctctctttggtgcctttgtgagccgagctgctatctcaactgtcgatgtattgacccctaaagtttttatcggtttgcttgttggggcaatgcttccttattggttctctgctatgaccatgaagagtgtgggaagtgcagctttgaagatggtcgaggaagtgcgcagacagttcaacacaatccctggtctcatggagggcaccactaagcccgactacgctacctgtgttaagatctctactgatgcttccatcaaagaaatgatcccaccgggtgctcttgtcatgctcacaccccttgttgttgggatctttttcggcgtggaaactctttctggtgtcctcgctggatctctcgtctcaggtgttcagatcgctatctctgcatccaacacggggggcgcttgggacaacgccaagaagtacatcgaggctggtgcttcaacacatgcaaaatctcttggccccaaaggttcagatccacacaaggcagctgttataggcgacaccatcggtgaccctttaaaggatacatccgggccatcgttgaacatcctcatcaagctaatggcagtcgaatcactcgtcttcgctcccttcttcgctacacatggtggactgcttttcaagttattttgagtgaaggtcaacaaaaagtaaacagctaatggtccgtccacccattgcagactctctcaattgatccatttgaatctgtagaacattttgagttgccatattctctttaaaaaggttaaatcggcattgaaaaattttcccttggtaaaagggttgacaaaataactttgatgatgatgataatggtcaacctagaaatgagttaaaaatggcccctttttttattgcggttattattattattatttgtctctctttaccctttccctttccctttccctttcgttgttctaatatgcatggctttgaagtttgaacaattatcaagaatggattattgaacattgg

SEQ ID NO: 1611 - DNA, 2589 bp, Gossypium hirsutum
tcgattttgccagatctcggaaccgagatcctgatcccggtttgtgccgtgattggaattgccttttctctcgttcaatggattctcgtttcccgggtcaagctctctcccggtcgagactctggtgcccccggtaacaacggtgccgctggtaaaaacggctacgctgattacctcattgaagaagaagaaggtctcaatgaccacaatgttgttgttaaatgtgctgaaatccaaaacgccatctctgaaggtgcaacctcatttcttttcaccgagtatcagtatgttggcattttcatggttgcttttgcaatcttgattttcctcttcctcggctccgtagagggtttcagcatgaagagccaaccttgcacatatgacctatctaggatgtgcaagcctgcccttgccactgctgcactaagcaccttatcattcttgctcggtgcagtcacttcagttgtttctggctttcttgggatgaaaattgctacctatgcaaatgctagaaccacccttgaggcaagaaagggagttggaaaggcatttattactgcatttagatctggtgctgtcatgggctttcttcttgctgcaaatggcctttgggtgctttacattgccataaatgtattcaagctctactatggtgatgactggggtggtcttttggaggcaatcactggttacgggcttggaggttcatccatggcactttttggcagagttggtggaggaatctataccaaagctgctgatgtgggtgctgatcttgtaggcaaggtggagaggaacattcccgaggatgaccctagaaaccctgctgtgattgctgacaatgttggggataatgttggtgatattgctggaatgggatctgatctttttgggtcctatgctgaatcatcttgtgctgccctagttgttgcttccatctcttcttttggaatgaatcatgaattgactccaatgttatatcctctcatcatcagttctgtcggtatcattgtttgtttaatcaccaccttatttgcaactgatttctttgagatcaaggctgttgatgaaattgaaccatcattgaagaggcaacttataatctccactgttctcatgactattggaatcggagttgttagttggatagctcttccaccttcctttaccattttcaattttggagatcagaaacttgtgaagaattggcaactattcttatgtgttgctgttggtctttgggctggcctaattattggttttgtaactgagtactacactagcaatgcatacagccctgtacaagatgttgctgattcctgcaggactggagccgcaactaatgttatttttggtcttgcattgggttacaagtcttgcattattcctatttttgctattgctatcagtatttttgttagttttagctttgctgctatgtatggcattgctgttgctgcccttggaatgctgagtaccatagctactggattggctattgatgcttatggtcccatcagtgataatgccggaggcattgctgaaatggctggcatgagccatagaatacgagagagaactgatgctcttgatgctgcggggaacaccactgctgctattggaaagggttttgccattggttcagcagccctggtgtcccttgccctctttggtgcttttgtgagccgtgctgcaatttcaacagttgatgtattgacccctaaagtttttattggtttgcttgtcggggcaatgcttccttactggttctctgctatgaccatgaagagcgtgggaagtgcagctttgaagatggttgaggaagtgcgcagacaattcaacacaatcccaggtctcatggagggcacttccaagcctgactatgctacctgtgtcaagatctctactgacgcctctatcaaagaaatgatccctcctggtgcccttgttatgctcacaccccttattgttgggatcttttttggtgtcgaaactctctctggtgtccttgctggatcccttgtctctggcgtccagattgctatctctgcatccaacacagggggtgcttgggataacgctaagaagtacatcgaggcgggtgcttcagaccatgcaagagctcttggtcccaaaggatcggatccacataaggcagctgttattggtgacaccattggagaccctctaaaggatacatctgggccatcactgaacatactcatcaagctcatggctgttgaatcacttgtttttgctcccttctttgctacacatggtggactgctgtttaagatattctaagagaaaacaaacattggctaaaggcccactgattcccatctctgccgggttccacatttccaattttcctaagtatatttagtctagcaccttttttactctagagaccatctcctctcaaaggccaaatcaggcaatgaaaaatttccccttgtaaagggtttacaaagacattgataatgatgatgatgatgataatggtcaatccatagaaaagagttaaaactgtattgttactattattactttttgttatatgaagaatgttgatttttgctctcgtct

SEQ ID NO: 1612 - DNA, 2792 bp, Citrus sinensis
cacacatttctcccattcaatactttcactccctaccaaaatcaatttctcattttcccaattctacccctgcgacggagacgagcacttgttttcgtccttctgagtaggtgaaaaattcaatccatgggtgcggcaattctgccagatctcggagcggagattttgataccggtgtgcgccgttattggaatcgcgttcgcgctggttcaatgggtcctcgtctccaacatcaagctgtctcccgccagagacgcgtcggggaacagccccggcgccggcggaggcaagaatggctgcactgactatctcattgaagaagaggaagggcttaatgaccacaacgttgtcatcaaatgcgccgaaattcaaagcgccatctctgaaggggcaacctctttcctgttcactgaatatcagtatgtcggtgttttcatggttgcttttgcgatcttgattttccttttccttggctctgttgagggcttcagcacaaagagccaggcttgcacctatgatccatttaagatgtgcaagcctgctctggccactgctgccttcagcactgtatccttcttgcttggtggcatcacttcagttgtttctggcttccttgggatgaaaattgctacctttgcaaatgcaagaaccacactggaggcaaggaagggagttgggaaggcttttatcgttgcctttcgatctggtgctgtcatgggttttctcctagctgcaaatggtcttttagtgcttttcatcgccatcaacttattcaagctgtattatggtgatgactggtctggtctttttgaggctataactggttatggtcttggaggttcctccatggccctctttggcagagttggtggaggtatctacactaaagctgctgatgttggtgctgatcttgttggcaaggttgagaggaacattccggaagatgatcctagaaacccagctgtgattgctgacaatgttggtgataatgttggagatattgctggaatgggatctgatctttttggctcatatgctgagtcctcttgtgctgcccttgtggttgcttcaatctcctctttcggaatcaatcatgagttgactgcaatgttgtatcctctgctcatcagttctgctggtatcattgtttgtttgatcaccactttatttgcaactgatatctttgagatcaaggctgtcaaggaaattgagccatctttgaagaagcaactcatcatctccactgttctgatgactgttgcaattgcaattgttagttggatagctcttccatcttcattcaccatcttcaattttgggagccagaaagttgtgaagaactggcaactctttttatgtgttgctgttggtctttgggctggtcttattattggatttgtaaccgagtactacactagcaatgcatacagccctgtccaagatgttgctgattcctgccgaactggagctgctactaatgttattttcggccttgcattgggatacaaatctgttattattcctatttttgccattgcagtcagcatctttgtcagttttagttttgctgccatgtatggtattgcagttgccgcccttggaatgctaagcaccatagctactggattggctattgatgcatatggtcccatcagtgacaatgctggaggcattgctgagatggcaggcatgagccacagaatcagagagagaactgatgctcttgatgctgcaggaaacaccactgcagctattggaaagggtttcgccattggttctgcagctcttgtgtcgctagccctctttggtgcctttgtgagccgtgcagctatttcaactgttgatgtgttgactccaaaagtgtttattggtttgattgttggtgctatgcttccttactggttctctgccatgacaatgaagagtgtgggaagtgcagctcttaaaatggttgaggaagtgcgcaggcaatttaacaccatccctggtcttatggaaggcactgccaaacctgattatgctacctgtgttaagatctccaccgatgcatccatcaaagagatgatcccacctggtgcccttgtcatgcttacaccccttattgttggtatcttttttggtgtggaaactctctctggggtccttgccggttcccttgtctcaggtgtacagattgctatctctgcatccaacactggtggtgcctgggataacgccaagaagtacattgaggctggcgcttcagagcacgccagaactcttggtccaaaaggatcagatccacacaaggctgcggtcattggtgacacaattggggatccattgaaggacacatctggaccatcacttaacatcctaatcaagctaatggcagtggaatcacttgtttttgctcccttttttgccacacacggtggcttgcttttcaagatatggaattagaagaatactccaacagacaggagcctgggcggtccaccaataaccctaatttctgtttgttctttttctctgtatccttctctgaatgtatattagtatgctcaggagtcaggacgttgaccctttgaaattctatctcttaaagcagaattgcgtgagaaaattttccatcaaggggttgatgatgatgataatttgtctatctaatgaatgagtcggggctgcgttgttcttaagtttcttatttttggaagtaaaaaacgattttagcgtccattttttcacgactctttccctgtgctctttttattgcattgtatgtgcgcgccagtacaaaaggtttaattaca

SEQ ID NO: 1613 - DNA, 2672 bp, Ricinus communis
gggttctcgttgttgttataatgggtgatgctattttgccagatcttgggaccgagattttgatcccgatatgtgcaattataggaatcgggttttctttgattcaatggttacttgtttctaaagtgaagttggtccctagcggtggtgctggcaataataataataacaataaaaatgggtatagtgattatctcatcgaagaagaagaaggtgttaatgatcataacgtcgtccttaaatgcgccgacattcaaaacgctatctccgaaggggcaacctctttcctttttaccgagtatcagtatgttggcattttcatggttgcttttgccatccttattttcgtattcctcggctctgttgagggattcagcaccaagtctcagccttgcacatatgaccaattcaagatgtgcaagcctgctctggcaactgctgccttcagcactgtatcattcttgcttggtgctttcacttctgtggtttctggattccttgggatgaaaattgctacatatgccaatgctagaacaacccttgaggcaagaaaaggagttgggaaggcttttatcactgcatttagatctggtgctgtcatgggttttctccttgctgcaaatggccttttggtactttacattgccatcaacctctttaagttgtactatggtgatgactgggctgggctttttgaggctataactggttatggtcttggaggatcttccatggctctctttggcagagttggtggaggtatctacactaaagctgctgatgttggtgctgatcttgttggcaaggtcgaaaagaacatccctgaggacgacccaagaaatccagctgtaatcgctgataatgttggtgacaatgttggtgatatagctggtatgggatctgacctctttggctcatacgcagaatcttcttgtgctgccctagttgttgcttccatttcatcttttggaatgaatcatgagttgactccaatgctatatcctcttatcattagttctgtgggtatccttgtttgcttgctcaccaccttatttgcaactgacttttttgagatcaaggctgtaaatgagattgagccagctttgaagaggcagctcattatttcaactgttcttatgactatcggagttgctgttgttagttggattgctcttccatcttccttcaccatcttcaattttgggactcagaaagttgtcaagaactggcaacttttcttgtgtgttgctgttggtctatgggctgggctcattattggatttgtaactgaatactacactagcaatgcatacagccctgttcaagatgttgctgattcatgtcgaactggagctgccactaatgttatttttgggcttgcattgggatataaatctgttatcattcccatttttgccattgcgattagcatttttgttagtttcagctttgctgctatgtatggtattgcagtagctgcccttggaatgctgagtaccattgcaactggattggcaattgatgcatatggtcccattagtgacaatgctggaggtattgctgagatggcaggcatgagccaccgaatccgagagagaactgatgcccttgatgctgcaggaaacaccactgctgctattgggaagggttttgccattggttctgcagctcttgtgtcgcttgctctctttggtgcctttgttagtcgtgcttcaatttcaacagtagatgtgttgacaccaaaagttttcattggtttgattgtgggtgcaatgcttccttactggttttctgccatgacaatgaagagtgtcggaagtgcagctctgaagatggtggaggaagtccgcaggcaattcaacaccatccctggtttgatggagggtactaccaagcccgactatgctacatgtgttaagatttccactgatgcttcaatcaaagagatgatcccacctggtgcacttgtcatgctcacccctctcattgttgggatcttttttggtgtggaaaccctctctggtgtcctagctggatctcttgtatctggagttcagattgccatctctgcatctaacactggtggtgcttgggataatgccaagaagtatattgaggctggtgcttctgagcatgcaagaacgcttggtcctaaagggtctgatccacacaaggcagctgttattggcgacaccatcggtgacccattgaaggacacatctggaccatcacttaacatccttatcaagcttatggcagttgaatcgcttgtgtttgcaccattctttgctacacatggaggtctacttttcaagatattctaaatggggtcaaaaatcgctactggttcttcacatccttgttattttgctctcaaaagtatatgtagtttgtagtttatgttgactcttgaaatttgtctctgcttatattgagtggtggagagaagttccctcctcttaaaaagggtctgattatagcagcaatgataagaatggaaatggtgaatctagtgaagagtatcacttttccctagcaagaccattcatttttcaacttccatgcaattttgtattgatgctgttctttgtactgcctttctctttctctgaagttcaattatatggttctggcacatacattgtaaaatgggaaaaatcctgattctatct

SEQ ID NO: 1614 - DNA, 5109 bp, Citrus clementina
cacacatttctcccattcaatactttcactccctgccaaaatcaatttctcattttcccaattctacccctgcgacggagacgagcacttgttttcgtccttctgagtaggtgaaaaattcaatccatgggtgcggcaattctgccagatctcggagcggagattttgataccggtgtgcgccgttattggaatcgcgttcgcgctggttcaatgggtcctcgtctccaacatcaagctgtctcccgccagagacgcgtcggggaacagccccggcgccggcggaggcaagaatggctgcactgactatctcattgaagaagaggaagggcttaatgaccacaacgttgtcatcaaatgcgccgaaattcaaagcgccatctctgaaggggcaacctctttcctgttcactgaatatcagtatgttggtgttttcatggttgcttttgcaatcttgattttcattttccttggctctgttgagggcttcagcacaaagagccaggcttgcacctatgatccatttaagatgtgcaagcctgctctggccactgctgccttcagcactgtatccttcttgcttggtggcatcacttcagttgtttctggcttccttgggatgaaaattgctacctatgcaaatgcaagaaccacactggaggcaaggaagggagttgggaaggcttttattgttgcctttagatctggtgctgtcatgggttttctcctagctgcaaatggtcttttagtgcttttcatcgccatcaacttattcaagctgtattatggtgatgactggtctggtctttttgaggctataactggttatggtcttggaggttcctccatggccctctttggcagagttggtggaggtatctacactaaagctgctgatgttggtgctgatcttgttggcaaggttgagaggaacattccggaagatgatcctagaaacccagctgtgattgctgacaatgttggtgataatgttggagatattgctggaatgggatctgatctttttggctcatatgctgagtcctcttgtgctgcccttgtggttgcttcaatctcctctttcggaatcaatcatgagttgactgcgatgttgtatcctctgctcatcagttctgctggtatcattgtttgtttgatcaccactttatttgcaactgatatctttgagatcaaggctgtcaaggaaattgagccatctttgaagaagcaactcatcatctccactgttctgatgactgttgcaattgcaattgttagttggatagctcttccatcttcattcaccatcttcaattttgggagccagaaagttgtgaagaactggcaactctttttatgtgttgctgttggtctttgggctggtcttattattggatttgtaaccgagtactacactagcaatgcatacagccctgtccaagatgtcgctgattcctgccgaactggagctgctactaatgttatttttggccttgcattgggatacaaatctgttattattcctatttttgccattgcagtcagcatctttgtcagttttagttttgctgccatgtatggtattgcagttgccgcccttggaatgctaagcaccatagctactggattggctattgatgcatatggtcccatcagtgacaatgctggaggcattgctgagatggcaggcatgagccacagaatcagagagagaactgatgctcttgatgctgcaggaaacaccactgcagctattggaaagggtttcgccattggttctgcagctcttgtgtcgctagccctctttggtgcctttgtgagccgtgcagctatttcaactgttgatgtgttgactccaaaagtgtttattggtttgattgttggtgctatgcttccttactggttctctgccatgacaatgaagagtgtgggaagtgcagctcttaaaatggttgaggaagtgcgcaggcaatttaacaccatccctggtcttatggaaggcactgccaaacctgattatgctacctgtgttaagatctccaccgatgcatccatcaaagagatgatcccacctggtgcccttgtcatgcttacaccccttattgttggtatcttttttggtgtggaaactctctctggggtccttgccggttcccttgtctcagatttacagattgctatctctgcatccaacactggtggtgcctgggataacgccaagaagtacattgaggctggcgcttcagagcacgccagaactcttggtccaaaaggatcagatccacacaaggctgcggtcattggtgacacaattggggatccattgaaggacacatctggaccatcacttaacatcctaatcaagctaatggcagtggaatcacttgtttttgctccctttttcgccacacacggtggcttgcttttcaagatatggaattagaagaatactcaaacagacaggagcctgggcggtccaccaacaaccctaatttctgtttgttctttttctctgtatccttctctgaatgtatattagtctttctcgaatccatgagcatctcaatgcattccctttctcacgctcattcccttcaccacaatcacaatcgccatcaccttgtttctcccccaaagccatttcctgttcctcggttttcaatcagaccccgcagagagtggtctccttctagtctccgcatgcaatcattccccgtttgctcccacaactcagtaaccaaacccgaacccattaacccgaccacccacttagccccctctcaccacctcaaaatcgccgtcatcggcttcggcaactacggccaattcctcgccaaaaccctcgtctctcaaggccacaccgtcctcgcccactcgcgatctgaccactcccacaccgcccaaaaactcggcgtctcgttcttcgccgacccacatgacctctgcgaagaacaccctgatgttattttgctctgcacttccgttatctccactgaacaggtcctcaggtcgttccctttacagcgtttgaagcgaaacacgttgttcgtcgacgttttctcagtcaaagaagtcgccaagaaccttttgctcgaagttttgcccaatgacttcgatattctttgcactcatcccatgtttgggccgcagagcgggaggcaaggctgggctggaatgtattgtatgttcgagaaagtgagggtcgggaatgaggagtcgagaatctctcgatgtgacaagtatttggatattttcgcgagggaaggatgtaggatggtggagatgagctgttctgagcatgattcttatgcggcggggtcacagtttgtgacgcatactgttggaagagtgttgcagatgttggaattggagtctacgccgattaacaccaaagggtacgagtctttgttgaatttggtagaaaatactgcaggggatagttttgatttgtactatgggttgttcatgtataacaagagtgcccttgagatgttggagaggcttgatttggcgtttgaggcgttgaggactcagttgtttgggagtctgcatgaggtggtgaggaagcagttgtttgagaatgggaaggcgcggagaaggcaaaggagtttgcgagagaccaatgggaatgggagtgcagtgggacaaacttccatgattcatatgaggtctaaagatgttcttcaaccacacgagtacataccacaggcctctggctctgtagatgccagctcgaagctgaagattgccattgttggatttggaaacttcggtcagttccttgcgaaaaccatagttcgtcagggccacacagtcttagcctattctcgaactgattactctgatgtagctcgaaagatgggggtttcatacttttctgatgcagatgatctttgtgaagagcatccagaagttgttcttctctgtacatcgattctttcaacagaaaaagttctgaagtcattgccatttcagagattgaagagaagtactctgttcgttgatgtactctcagtaaaagagttcccacagaaattgtttttccaacatttgccaccagattttgatattctctgcacgcatcctatgtttggaccagagagtggaaaaaatggatggagtggtcttacttttgtctttgatagggttagggttggatataatgaagcaagaagatcaaggtgcaataggtttctggatatatttgctcgagaagggtgccaaatggtggagatgtcttgcgcagagcacgattggcatgcagcagggtctcagttcatcactcacactattggaagaatactggagaagttcgggttggaatcaacaccaattaatacaaaaggctatgagactttgttgaagttggtggagaatactgcaggggatagctttgatctttattatgggttgttcatgtacaatgcaaatgcgatggagcagctagaaagattagattttgcttttgaatcattgaaaaagcaacttatcggtagattgcatggtgtccttcggaagcaactgtttgaccatgaacagaatctccctgaactccctgtttggaaggagaatcctgcggcagcaaagctatctcaaaatggtgctcaaaacggtgctgcacatgcatcatcttcagagcttcttaagatccagaattgatctctatgcttttgccttatagccaatgtgatatttctattgtaaagtttgccaatcgataaataccgcaaactgcagatattctcataattatgtttgttgttgccctgtgtgccatttagaaaaatggatgcattggcaagcagggatttgattcatgtcgaggaaggttggttagttcggcctgaagtggttgtagattgacacaacgtatgagaatatatcactcaagagagagttccatttccaccctcacccaatagatgggttctgtaatatcttttatgtgcagcaattggagctcctctgtttgtttgtatattttatgtggtgcatctcttcaccattaatgtaaaattaaggtgataataattgggaatctcttctcagctgtaaaattttgagcagattgtgctgaatctgaaaaaaagttaaattgagatgagttagg

SEQ ID NO: 1615 - DNA, 2854 bp, Nicotiana tabacum
ttagggttacggtgaagtatgggggcggcgttgttaccagatctaggggcggagattgtgattccggtatgcgccgtcattggaatcgtgttctcgttagttcaatggtaccttgtttcgaacgtgaagctgacgccggaatcatcttctccgagcaacaacggtaagaatgggtacggagattacttgattgaagaagaagaaggtattaatgaacaaaacgttgtcgtcaagtgcgccgagatacagaacgctatctctgaaggggcgacatccttcctgttcactgaatatcagtatgtgggtatcttcatgattgcttttgcaattctgatcttccttttcctcggctctgttgagggcttcagcactaagagccaaccatgcacctacaacaaggagaaactttgcaagccagcccttgcaactgccatctttagcactgtatcattcttgctaggtgctgtcacttctgttgtttctggtttccttgggatgaaaatagcaacgtatgcaaacgcaaggacaaccctggaagcaagaaaaggtgttggaaaggctttcatagtagcattcagatctggtgctgtgatgggttttctccttgcagccaatggtctcttggtactttacattgcgattaatctcttcaagctatactatggtgatgattgggagggcctttttgaggcaattactggatatggtctaggtggctcctccatggctctttttggtagagttggtggtggtatttacaccaaggctgctgatgttggtgctgatcttgttgggaaggttgagaggaacattccagaagatgatcccagaaatcctgctgttattgctgacaatgtcggcgataatgttggggacattgctggaatggggtctgatctttttggctcatatgctgaagcatcatgtgccgctttagttgtggcttccatctcgtcttttggaattaatcatgaattcactgcaatgttgtatcccctgctcataagttctatgggtatcctcatttgtttgatcactaccctttttgcaactgacttctttgaaattaaggctgtcaaggaaattgaaccggcactgaagaaccagcttattatctcaactgctcttatgacggttggaattgcaattgttacatggacttgccttccatcttcctttaccatctttaattttggagctcagaaggttgtaaagaattggcaactatttttatgtgtggctgttggtctttgggctggacttatcattgggtttgtcactgagtactacactagcaatgcttatagccctgtccaagatgtagctgactcctgcaggactggagctgccaccaatgttattttcggcctcgcacttggatacaaatctgtcatcattccaatttttgccattgcaatagctatctttgtcagttttagttttgctgccatgtatggtattgcagttgccgcgcttgggatgttgagcaccattgcaactggactggccattgatgcatatggacctatcagtgacaatgctggaggaatagctgagatggctggtatgagccatcggattcgtgaaaggacagatgcccttgatgccgctggaaacaccactgctgctattggaaagggctttgccattggatccgctgccctcgtgtctttggcactgtttggtgcttttgtgagtcgggctgcaattactacagttgatgtcttgactccccaagttttcattggtttgattgttggcgccatgcttccctactggttctctgccatgaccatgaagagtgtgggtagtgcagctttgaagatggttgaagaagttcgcagacaatttaacactattcctggtctcatggagggcactgccaagcctgattatgcgacttgtgttaagatttcaactgatgcatctatcaaggaaatgattcccccaggtgctctagtcatgcttacacccctcatagttgggattttcttcggagtggagactctctctggtgttcttgctggtgctttggtttcgggtgtacagatagcaatatctgcatcgaacactggtggtgcatgggacaatgccaagaagtatattgaggctggtgcttcggagcatgcaaggacccttggtccaaagggttcagacccacacaaggctgctgttattggtgacaccattggcgaccctctgaaggacacttcaggcccatcactcaacattctgatcaagctgatggcagtcgaatcactcgtatttgctccattctttgccactcatggtggtctgcttttcaagattttttaaggagcttgttgggaggcattcacatacctctggtttttctttcctcgacacccttttactcaaatttccccaagcatggggcttccaagttagttcgtaggtagtcagaggttttagttttgatgagctgatgatgacgacgatatttgttagctctgcaaggaagtaaaagagaattgtcggcttgcttgtactagtcttttgttagtgtattacctttcatgttctgcgggacctagtttccaattttgtttgtaacgcgttctaaggagatggagacatatgttcacatcttgttttgttacacaacgcagattgtctctcgacgtgtgtgatcccccatcaccacccatttccttggaaagtagacttaattttcactgagatctattttttcactcttgtatcgggaaggaatcaggaaatctttaaggaactatacttttccttgcattctctaaattcgaatagatcaccagttcaagtgcctgagaaaaaaatggttggaattgggtgctcaatttcagagaaactgagc

SEQ ID NO: 1616 - DNA, 2708 bp, Actinidia deliciosa
catacgatgtttctccagctgaaacaacatcacaaccgcgaagagagagaaagagtgaaggagagagagagagccaccgcacaaagcggctcacgtcatcattaccgttcgattttcaggcgagacgaactcctccgtgcgccgccgcgtcgagtaaggtcatgggggcggggattctctcagatctcgcgacggagatcctgatcccggtgtgcgccgtcatcgggatcgcgttctctctcatccaatgggtgatcgtctcgcgcgtccagctctcgccggagaagcattctccgacaaacgacggcaagaacggtttcgttgagtcgctgatcgaggaggaggaaggtctcaatgaccacaacgttgttcagaaatgcgccgaaatccagaacgcgatatcggaaggtgcaacctccttcctctttactgaatatcagtatgttggaattttcatgggcgcttttgctgttttaatcttccttttccttggctctgtggagggattcagcacaagtagtcagccttgtacttacgacagctccaaaaggtgcaagcctgctcttgccactgctgtcttcagcaccatatctttcttgcttggtgctgtcacatcggtggtttctggctttcttggaatgaaaattgctacctatgcaaatgccagaaccaccttggaggcaagaaagggtgttgggaaggcttttatcaccgcatttagatctggtgcagtcatgggtttcctccttgctgcaaatggtcttctggtgctctatattgccatcaacctgttcaagttgtattatggtgatgattgggaaggcctctttgaagctataactggttatggcctgggtggatcctctatggccctctttggcagagttggtggaggtatttatacgaaagctgctgatgttggtgctgatcttgtgggcaaggttgagaggaacatccctgaggatgatcctagaaatccagcggtgatagccgacaatgttggtgacaatgttggagatatcgctggtatgggatcagatctatttggctcgtatgcggaatcatcatgtgctgctcttgtcgttgcttccatctcctcttttgggatcaatcatgatttgactgcaatgctttatcctctgctcatcagttcaatgggtatccttgtttgtttgatcaccaccttatttgcaactgatttcttcgaaatcaaggccgtaaaggatattgagccaactttgaagaggcaactcatcatctccactgtactgatgactgctggtatagctataatcagttggatttcacttccatcttccttcaccatcttcaattttggagtccagaaagaagtaaagaactggcagctgttcttgtgtgttggtgttggtttgtgggctgggcttattattgggtttgtaactgagtactatacaagcaatgcatacagccctgtgcaagatgttgctgattcctgccgtactggagcagctactaatgttatttttggccttgcgttgggatacaaatccgtcattattccaatttttgccattgcaatcagcatttttgttagttttagctttgctgccatgtatggtattgcagtagcagctcttggaatgctgagcacaatagctacgggattggccattgatgcatatggtcccatcagtgacaatgccggaggtattgctgagatggctggcatgagccatagaatccgggaaagaactgatgctcttgatgctgctggaaacaccacagcagctattggaaagggtttcgcaattgggtctgcagctcttgtgtcccttgccctcttcggtgcctttgtgagccgagcaggcattagtactgttgatgtattgacaccaaaagttttcattggattgcttgtcggtgcaatgcttccatattggttctcagccatgacaatgaagagcgttggaagtgcggctcttaaaatggttgaggaagtgcgcaggcaattcaacaccatccccggcctcatggaaggtactgccaagcccgactatgccacttgtgtgaagatctccacagatgcctcgatcaaagagatgattcctcccggtgctcttgtcatgctcacacccctcatcgttgggatcttttttggcgtggaaacattatccggtgtgcttgctggatccctcgtctcgggtgtacagattgctatctctgcgtctaacaccggtggggcttgggataatgccaagaagtatatcgaggctggtgcttcggagcatgcaaggaccctcgggcccaagggatccgacccacacaaggcagctgtgatcggtgatactgttggagatccactcaaggacacgtctggaccgtcccttaacatccttatcaagcttatggccgttgaatcgcttgtgtttgctccctttttcgccacacacggtggccttctattcaaaatcttttaggactagacggggactgatccaggccgtccgtctatcttaccccgattctcccatttccttctctctctgctgcatttttctacgtctaacttttatgtcaactatattcagtttctggtggtggttaaattcagaaacattgtattctctattaagttgagatggtggagagaaattttccctcgtggggttggttatgtgatgaactttgtcattttttgccctggtaaatgaactggttatttttca

SEQ ID NO: 1617 - DNA, 2884 bp, Glycine max
gccgagtcacctaaaaataagatctggcatataggaaaattacaaattacagatattggtaaaattttcatattctgagccacacacaccttcttctgtctctccagtcatcattcccacccctatcttctctctgtcacgtataaaaccccactccacccctcacccattcatcactcattcattccttccctcattcttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacgatcacaacgttgtcctcaaatgcgccgaaatccaaaacgccatttccgaaggagcaacctctttccttttcactgaatacaagtatgtgggaatcttcatggtggcttttgccattttgatattcctattccttggctctgtggaaggattcagcacgagctaccagccttgcacctatgatcaaactaaaatgtgtaagccagctcttgctactgctgttttcagcaccatatctttcctgcttggtggtgtcacatcgcttatttctggattccttggaatgaaaattgcaacttacgccaatgcaagaaccaccctggaggcaagaaagggtgttgggaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagttggtggaggtatctatactaaggctgctgatgttggtgctgatcttgtcggaaaggttgaaagaaacatccccgaagatgatccaagaaatccagctgtgattgctgataatgttggtgataatgttggggatatcgctggtatgggatctgatctttttggttcatatgccgagtcatcctgtgctgctcttgttgttgcttccatctcttcttttggggtgaatcatgagttgactgctatgttataccctctcattatcagttctgtgggtatccttgtttgtttgctcacaaccttatttgcaactgacttctttgagatcaaggctgtaaaggagattgagcctgcattgaagaaacaactcatcatttccactgccctgatgactattgggattgcaattgttagttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatgttgcagactcctgcaggactggtgctgcaactaatgttatatttggccttgccttgggatacaagtctgttattattccaatttttgctattgccattagtatttttgttagtttcacctttgctgccatgtatggtattgctgttgctgcgcttggcatgctgagtaccattgccaccggattggccattgatgcatatggtccaatcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctttggtgtctggtgtacagattgctatttctgcatccaacaccggtggtgcttgggataatgccaagaagtacattgaggctggtgcttctgagcatgcaagaagccttggtccaaaagggtcagattgtcacaaggcagctgttattggtgacaccattggagaccctctaaaggatacatctggaccttcacttaacatccttattaagctcatggcggttgagtctcttgtgtttgctcccttctttgctacacatggtggcctactcttcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttttaagacaacttgattaggctgagtctgttgcgaaaattttccttgtatgatgacgatgatgtttaccatctcttccgcgtggtcaattttctaaatatattcctttccggatggttcaactttcttaatatttctttaccatttt

SEQ ID NO: 1618 - DNA, 2682 bp, Glycine max
ttccttccctcattcttatttttttcctctcttcactttcactctctctctctctctcaatcatcaagcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacgatcacaacgttgtcctcaaatgcgccgaaatccaaaacgccatttccgaaggagcaacctctttccttttcactgaatacaagtatgtgggaatcttcatggtggcttttgccattttgatattcctattccttggctctgtggaaggattcagcacgagctaccagccttgcacctatgatcaaactaaaatgtgtaagccagctcttgctactgctgttttcagcaccatatctttcctgcttggtggtgtcacatcgcttatttctggattccttggaatgaaaattgcaacttacgccaatgcaagaaccaccctggaggcaagaaagggtgttgggaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagttggtggaggtatctatactaaggctgctgatgttggtgctgatcttgtcggaaaggttgaaagaaacatccccgaagatgatccaagaaatccagctgtgattgctgataatgttggtgataatgttggggatatcgctggtatgggatctgatctttttggttcatatgccgagtcatcctgtgctgctcttgttgttgcttccatctcttcttttggggtgaatcatgagttgactgctatgttataccctctcattatcagttctgtgggtatccttgtttgtttgctcacaaccttatttgcaactgacttctttgagatcaaggctgtaaaggagattgagcctgcattgaagaaacaactcatcatttccactgccctgatgactattgggattgcaattgttagttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatgttgcagactcctgcaggactggtgctgcaactaatgttatatttggccttgccttgggatacaagtctgttattattccaatttttgctattgccattagtatttttgttagtttcacctttgctgccatgtatggtattgctgttgctgcgcttggcatgctgagtaccattgccaccggattggccattgatgcatatggtccaatcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctttggtgtctggtgtacagattgctatttctgcatccaacaccggtggtgcttgggataatgccaagaagtacattgaggctggtgcttctgagcatgcaagaagccttggtccaaaagggtcagattgtcacaaggcagctgttattggtgacaccattggagaccctctaaaggatacatctggaccttcacttaacatccttattaagctcatggcggttgagtctcttgtgtttgctcccttctttgctacacatggtggcctactcttcaagatctaaaggatttgatagaaaaagagcatcgtccatcatttttctacaacgacagaacaaggaaaatccgtccttttaccaatgccttctcgttttttgttagtctttaactcatctgtcatgtcgacttcattgtttttgaaaccttttcctcccccaccttgaaacaaagtatattttgtctcatgtagttttaagacaacttgattaggttgagtctgcagcaaaattttccttgtatgatgacgatgatgtttaccatctcttccgcgtggtcaattttctaaatatattcctttccggatggttcaactttcttaa

SEQ ID NO: 1619 - DNA, 2656 bp, Vigna unguiculata
tttttatttttctccctttcgctctctctcaatcttcaagccatgggagcagcgattctcccagatctcggaaccgagattctcattcccgtctgcgcggtcattggaatcgccttcgccctcttccagtggctcctcgtctccaaggtcaaactctctgccgtcagagacgcttctcccaacgccgccgccaagaatggctacaacgactacctcatcgaagaggaggagggcatcaacgaccacaacgtcgtcgtcaaatgcgccgaaatacagaacgccatttccgaaggagcaacctctttcctttttactgaatacaagtatgtgggaatcttcatggtggcttttgccattttgatattcctcttccttggttcagtggaaggattcagcacaagcccccagccttgcacatacgataaaactaaaacgtgtaagccagcacttgccacggctattttcagcaccgtatctttcctgcttggtggcgtcacatcacttgtttctggattccttggaatgaaaattgcaacttacgccaatgcaagaaccaccctggaggcaagaaagggcgttgggaaggccttcattacggcttttagatctggtgctgttatgggttttctcctagctgcaaatggtcttctggttctttacattgccatcaacttgtttaagatctactatggtgatgactggggtggtctttttgaggccataactggttatggtcttggtgggtcttctatggctttgtttgggagagttggcggaggtatttataccaaagctgctgatgttggtgctgatcttgttggcaaggttgagaggaatattcccgaagatgatcccagaaatccagctgtgattgctgacaatgttggtgacaatgttggagatatagctggtatgggatctgatctgtttggttcatatgcggagtcatcttgtgctgctcttgttgttgcttccatctcctcatttgggttgaatcatgagttcactgcgatgctctaccctctcattgtcagttctgtgggtattcttgtttgtttgctcaccaccttatttgcaactgacttctttgagatcaaggctgtgaaggagattgagcctgcattgaaaaagcagctcgttatttccactgtgttgatgactattggggttgcagttgttagttttgttgcacttccaacttccttcactatcttcaattttggagtgcagaaagacgtcaagagctggcagctatttttgtgtgttgctgttggtctttgggcaggacttattatcggatttgtaaccgagtactatactagtaatgcatatagtcctgttcaagacgtagctgactcctgcagaactggtgctgcaactaatgttatatttggccttgccttgggatacaagtctgttatcattccaatttttgctatagcaattagtatttttgttagtttcacctttgctgccatgtatggtattgccgtggctgcacttgggatgctgagtaccattgccactgggttggccatagacgcatatggtccaatcagtgacaatgctggaggtattgctgagatggctggtatgagtcacagaattcgtgagagaactgatgcccttgatgctgctggtaacacgactgctgcaattgggaagggctttgccattggttctgccgcccttgtatctctggccctttttggtgcctttgtgagccgagcatctattacgactgttgatgtgttgactccaaaggttttcattggtttaattgtgggggcaatgcttccttactggttttctgccatgaccatgaagagtgtgggaagtgctgctctgaagatggttgaggaagtgcgcaggcaattcaataccattccagggttgatggagggaactgccaagcctgactatgctacatgtgttaagatctctactgatgcttccattaaggaaatgattccacctggtgctcttgtcatgcttacacctcttgttgttgggatcctttttggtgttgaaacactttctggtgtcctcgctggatctttggtatctggtgtacagattgccatctctgcatccaacaccggcggtgcatgggataacgcaaagaagtacattgaggctggtgcttctgagcatgctagaagccttggtccaaaagggtcagattgccacaaggcagcagttattggtgacaccattggagaccctctcaaggatacatctggtccctcacttaacatccttatcaagctgatggcagttgagtctcttgtttttgcccccttctttgctacccatggtggtttactcttcaagatcttctaaagagtttgagagaaaagagcatcgttcatcaattttctactatgatggcagaacaaggaaaatcagtccttttaccaccatgcctttacttttttgttagtcttttaactcatctgtcatatcgacttcattgtttttgaaacaaagtatattttgtcactcatttgtagttttaagaaacttcattaggttgagtctgcagcaaaattttccttgttacgtggagtttcatgatgatgacgatgattatactattttcagcgcgatccatttattagatgtctatcagttggccgaaaaaaaagagaaaaaa

SEQ ID NO: 1620 - DNA, 2760 bp, Glycine max
attcactcattccgttccttcttcccttccctctcttcactatcactctctctctctctccatctctctcatccatcatgggagcagtgattctcccagatctcggcaccgagattttgattcccgtctgcgccatcattggaatagcgttcgccctcttccagtgggtcctcgtctctaaggtcaagctctccgctgcgagagacgcttcctccaacgccggcggcggcaaaaatggctacaacgattacctcatcgaagaagaggaaggcctcaacgaccacaacgtcgtcctcaaatgcgccgaaatccaaaacgccatttccgaaggagcaacctctttccttttcactgagtataagtacgtgggaatcttcatggtggcttttgccattttgatattcctcttccttggctctgtggaaggattcagcacaagctaccagccttgcacctatgaccaaactaaaatgtgtaagccagctcttgccactgctgttttcagcaccatatctttcctgcttggaggtgtcacatcgcttatttctggattccttggaatgaaaattgcaacttatgccaatgcaagaaccaccctggaggcaagaaagggtgttggaaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagtaggtggaggtatctatactaaggctgctgatgttggtgctgatcttgtcggaaaggtcgaaagaaacatcccggaagatgatccaagaaatccagctgtgattgctgataatgttggtgataatgttggtgatatcgctggtatgggatctgatctttttggttcatatgccgagtcatcctgtgctgctcttgttgttgcttccatctcttcttttggggtgaatcatgagttgactgctatgttataccctctaattatcagttctgtgggtatccttgtttgtttgctcacaactttatttgcaactgacttctttgagatcaaggctgtaaaggagattgagcctgcattgaagaaacagctcatcatttccactgccttgatgactattgggattgcaattgttagttggattgcactcccaacttccttcactatcttcaattttggagtgcagaaagatgtcaagaattggcagctattcttgtgtgttgctgttggtctttgggcagggcttattattggatttgtaactgagtactatactagcaatgcatatagtccggtgcaagacgttgcagactcctgcaggactggtgctgcaactaatgttatctttggccttgccttgggatacaagtctgttattatccaatttttgctattgcaatcagtatttttgttagtttcacctttgctgccatgtatggtattgccgttgctgcacttggcatgctgagtaccattgccaccggattggccattgatgcatatggtccaatcagtgacaatgctggaggtattgctgagatggccggtatgagtcacagaattagagagagaactgatgcccttgatgctgccggaaacacaactgccgcaattgggaagggatttgccatcggttctgctgcccttgtatctctggccctctttggtgcctttgtgagccgagctgctattacaactgttgatgtgttgactccaaaggttttcattggtttgattgtgggtgcaatgcttccttactggttttctgccatgaccatgaagagtgtgggaagtgctgctctgaagatggttgaggaagtacgcaggcaattcaacaccattccaggattgatggagggaactgctaagcctgactacgccacttgtgttaagatctccactgatgcttccattaaagaaatgattccacctggtgctcttgtcatgcttacaccccttgttgttggaatcctttttggtgtcgaaacactttctggtgtcctagctggatctttggtgtctggtgtacagattgctatctctgcatccaacaccggtggtgcttgggataatgccaagaagtacattgaggctggtgcttctgagcatgcaaggagccttggtccaaaagggtcagattgtcacaaggcagctgttattggtgacaccattggagaccccctcaaggatacatcagggccttcacttaacatccttatcaagctcatggccgttgagtctcttgtgtttgctcccttctttgcgacacatggtggcctactcttcaagatctaaaggattcaatagaaaaaagagcatcgtccatcaattttctacaatggcagaacaaggaaaagcccgttcctttaccagtgccttctcttttttgttagtctttaactcatctgtcatgtcaattccattgtttttgaaacctttccatcccccaccttgaaacaaaagtataatttgtctcatgtagttttaagacactcgattaggctgagcctgcagcgaaaattttccttgtaaagaggaggttgatgatgacgacgacgacgatgatgtttaccatctctcccgcgtggtcaattttcttatatattccttttggatggtccaattttcttaatatttccttaccatattttatatatatttatattgtctgttattaa

SEQ ID NO: 1621 - DNA, 2661 bp, Glycine max
atgggagcagtgattctcccagatctcggcaccgagattttgattcccgtctgcgccatcattggaatagcgttcgccctcttccagtgggtcctcgtctctaaggtcaagctctccgctgcgagagacgcttcctccaacgccggcggcggcaaaaatggctacaacgattacctcatcgaagaagaggaaggcctcaacgaccacaacgtcgtcctcaaatgcgccgaaatccaaaacgccatttccgaaggagcaacctctttccttttcactgagtataagtacgtgggaatcttcatggtggcttttgccattttgatattcctcttccttggctctgtggaaggattcagcacaagctaccagccttgcacctatgaccaaactaaaatgtgtaagccagctcttgccactgctgttttcagcaccatatctttcctgcttggaggtgtcacatcgcttatttctggattccttggaatgaaaattgcaacttatgccaatgcaagaaccaccctggaggcaagaaagggtgttggaaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagtaggtggaggtatctatactaaggctgctgatgttggtgctgatcttgtcggaaaggtcgaaagaaacatcccggaagatgatccaagaaatccagctgtgattgctgataatgttggtgataatgttggtgatatcgctggtatgggatctgatctttttggttcatatgccgagtcatcctgtgctgctcttgttgttgcttccatctcttcttttggggtgaatcatgagttgactgctatgttataccctctaattatcagttctgtgggtatccttgtttgtttgctcacaactttatttgcaactgacttctttgagatcaaggctgtaaaggagattgagcctgcattgaagaaacagctcatcatttccactgccttgatgactattgggattgcaattgttagttggattgcactcccaacttccttcactatcttcaattttggagtgcagaaagatgtcaagaattggcagctattcttgtgtgttgctgttggtctttgggcagggcttattattggatttgtaactgagtactatactagcaatgcatatagtccggtgcaagacgttgcagactcctgcaggactggtgctgcaactaatgttatctttggccttgccttgggatacaagtctgttattatccaatttttgctattgcaatcagtatttttgttagtttcacctttgctgccatgtatggtattgccgttgctgcacttggcatgctgagtaccattgccaccggattggccattgatgcatatggtccaatcagtgacaatgctggaggtattgctgagatggccggtatgagtcacagaattagagagagaactgatgcccttgatgctgccggaaacacaactgccgcaattgggaagggatttgccatcggttctgctgcccttgtatctctggccctctttggtgcctttgtgagccgagctgctattacaactgttgatgtgttgactccaaaggttttcattggtttgattgtgggtgcaatgcttccttactggttttctgccatgaccatgaagagtgtgggaagtgctgctctgaagatggttgaggaagtacgcaggcaattcaacaccattccaggattgatggagggaactgctaagcctgactacgccacttgtgttaagatctccactgatgcttccattaaagaaatgattccacctggtgctcttgtcatgcttacaccccttgttgttggaatcctttttggtgtcgaaacactttctggtgtcctagctggatctttggtgtctggtgtacagattgctatctctgcatccaacaccggtggtgcttgggataatgccaagaagtacattgaggctggtgcttctgagcatgcaaggagccttggtccaaaagggtcagattgtcacaaggcagctgttattggtgacaccattggagaccccctcaaggatacatcagggccttcacttaacatccttatcaagctcatggccgttgagtctcttgtgtttgctcccttctttgcgacacatggtggcctactcttcaagatctaaaggagttgagagaaaaaagagcgtcgttcatcaattttctactatggcagaacaaggaaaatccgtccttttaccatgcctttacttttttgttagtctttaactcatctgtcgtgtcgacttcattgtttttgaaacctttccatcccccaccttgaaacaaaagtataatttgtctcatgtagttttaagacactcgattaggctgagcctgcagcgaaaattttccttgtaaagaggaggttgatgatgacgacgacgacgatgatgtttaccatctctcccgcgtggtcaattttcttatatattccttttggatggtccaattttcttaatatttccttaccatattttatatata

SEQ ID NO: 1622 - DNA, 2862 bp, Manihot esculenta
ttcgttctctttcacactctcctcacataatttctctatttggaagcagtttccggcgttctgagaccggagaattgttgaaggtttcaggtgaggaggatgggatcggctgtgttgtcggagctggggacggagatactggtgccagtatgcgctgtggttggcatcgtcttctcattagttcagtggtacttggtctcgcgcgtgacgctcacggcggaacgccagggacccgggtcgtccccaagtggtgctaacaagaatggctacaatgattacctgattgaagaagaggaaggtctcaatgaccccagcgttgtggccaagtgcgcagagatacagaatgcaatctctgaaggtgccacatcttttctgttcactgaatatcagtatgtgggggtcttcatggtggcttttgcaattctgatcttcctttttctgggttctgttgagggctttagcacaaagagccaaccttgcacttatgataaacagaagacgtgcaagccagcacttgctactgcaatattcagcactgtctcatttttgcttggtgctttcacctcagttgtctctggcttcctagggatgaaaattgctacctatgccaatgcaagaacaactttggaagcaagaaagggtgttggcaaggcttttattactgcatttaggtctggtgcagtaatgggttttctccttgctgcaaatggtctactagttctcttcattgctataaatctcttcaagctttactacggtgaagattgggaaggactctttgaatctattactggctatggtcttgggggttcttccatggctctctttggaagggttggtggtggtatttataccaaagctgctgatgttggtgcagatcttgtgggaaaggttgagagaaacattccagaagatgatcctagaaacccagcggtcattgctgacaatgttggtgacaatgttggagatattgctggtatggggtctgatctttttggctcatatgctgagtcatcttgtgctgctcttgttgttgcctccatctcatcttttggaatcaaccatgaattcacttccatgctgtatcctctgctcattagttctgtgggtatcctcgtttgtttgatcacaaccctcttcgctactgatttctttgaaatcaaggctgtaaaggaaattgaaccagcattgaagaagcagctcattatctccactgttcttatgactgtgggcattgcaattgtaacctggattgccttgccttcatctttctcaatttacaattttggaacacagaaggttgtcaagaactggcagttgttcttgtgcgtggctgttggtctttgggctggacttattattggatttgttactgagtattacacaagcaatgcgtacagccctgtgcaagatgtcgccgactcctgcaggactggtgctgcaactaatgtcatctttggccttgccttgggatacaaatctgtaatcattccaatttttgccatagcaattagtatttttgttagttttagttttgcagccatgtatggcattgctgtggctgctcttggaatgttaagcaccattgccactggattggccattgatgcctatggtccaatcagtgataatgctggaggcattgctgagatggctggcatgagccaccgcatccgtgaacgaactgatgcacttgatgcagccggcaacaccactgctgctattggaaagggatttgccattggatctgctgcacttgtgtctttggctctgtttggtgcttttgtcagccgtgcatctatttcaactgttgatgttttgaccccaaaggtcttcattggtctgatcgtgggtgccatgcttccttattggttctctgccatgaccatgaagagtgtgggaagtgcagctctgaagatggttgaagaggtccgcaggcagttcaacaccattcctggtcttatggagggtcataccaagcctgattatgctacatgtgtcaagatctctactgatgcatccatcaaagagatgattccaccaggtgcccttgtcatgcttacaccccttattgttggaatcttctttggcgttgaaactctctctggtgttctggctggttcccttgtttctggtgttcagatagcaatttctgcatccaacactggtggtgcttgggataatgctaagaagtatattgaggctggtgcttcagagcatgcaaggacactaggcccaaaaggttcagagccacacaaagcagctgtgattggagacaccatcggtgacccactcaaggacacctcaggcccatcactcaacattctcatcaagctcatggctgtggaatctctcgtcttcgctcccttctttgccacacacggtggcctgcttttcaagatattctgaagtggagaatgacgaagacgtagggaagggaagttgatataacgttgcctactcttgtaggatccagccctcattctacttcttcagttatcgtttatcccagttaatgggattttaaaactagtttccgtagttcagtcaatactatttgtgatgggctgatgatggcaattaaagatggtttgaatggtggagagaaaaatggtcataggttggaaattgcaaatggtgagtcatgtccgagagaagagtctgagaatttgacacgtttaagtagttttggaacaagttgcgtttaaaattttgtattgttacccttttgcctggggaaaagttggcattttggactttgatcttctgcggttcaggttctatattcacacgctgtcggccattaaggcttttatcatttcttaagtggtcatctgaatatgatcgtctctggtaattcac

SEQ ID NO: 1623 - DNA, 2891 bp, Manihot esculenta
gaggcttcgttctctttcatacttcgtacttcactcttctcaggctttgtctaactagaattagtttgcggcggcctgataccggagaattgtggtagggtccagaagaggaggatgggatcggcggtgctatcggaattggggacggagatattggtgccggtgtgtgcggttgttggcatagtcttctcattagttcagtggtacttggtgtcgcgcgtgaagctcacagcggagcgccacgcgccgggcagtgctaacaagaatggctacaatgattacctgattgaagaagaggaaggtcttaatgaccacagcgttgtggccaagtgcgctgaaatacagagtgcaatatctgaaggtgccacttcttttctgttcactgaatatcagtatgttggggtgttcatggtggcttttgcaattctcatcttccttttcctgggttctgttgagggctttagcacaaagagccaaccatgtacttatgataaagagaagatgtgcaagccggcacttgctactgcaatattcagcacagtctcatttatgcttggtgctttcacctctgttgtctctggtttcctagggatgaaaattgctacctatgccaatgcaagaacaactctggaagctagaaagggtgttggcaaggcttttattactgcattcaggtctggtgcagtaatgggttttctccttgctgcaaatggtctgttggttctctacattgctataaatctcttcaagctgtactatggagaagattgggaagggctctttgaatctattactggttatggtcttgggggttcttccatggctctctttggaagggttggtggtggtatttataccaaagctgctgatgttggtgctgatcttgtaggaaaggttgaaagaaacattccagaagatgatcctagaaacccagctgtcattgctgacaatgttggtgacaatgttggagatattgctggtatggggtctgatctttttggctcatatgctgagtcatcttgtgctgcccttgttgttgcctccatctcctcgtttggaatcaaccatgaattcacttccatgttatatcctttgctcattagttctgttggtatccttgtttgtttgattacaactctctttgccactgatttctttgaaatcaaggctgtaaaggaaattgaaccggcattaaagaagcagctcattatctccactattcttatgactgttgggattgctattgtaacctggattggcttgccttcgtctttcacaatttataattttggaactcagaaggttgttaagaactggcagttgttcttgtgtgtggctgttggtctctgggctggacttattattggatttgtaaccgagtactacaccagcaatgcatacagccctgtgcaagatgttgccgactcttgcaggactggagctgccactaatgtcatctttggccttgccttgggatacaaatctgtcatcattccaatttttgccattgctattggtatttttgttagttttagttttgcagccatgtatggcattgctgtggctgctcttggaatgttgagcactattgccactggattagcaattgatgcttatggtcccatcagtgacaatgctggaggcattgctgagatggctggtatgagtcaccgcatccgtgaacgaactgatgcacttgatgcagctggcaatactactgctgctattgggaagggatttgccattggatctgctgcactagtatctttggctctgtttggtgcttttgtgagccgtgcatctatttcaactgttgatgtcttgacaccaaaggtcttcattggtctgattgtgggtgctatgcttccttactggttctctgccatgaccatgaaaagtgtgggaagtgcagctttgaagatggttgaggaggttcgcaggcagttcaacaccattcctggtatcatggagggtcatgccaagcctgattatgctacttgtgtcaagatatctactgatgcatccatcaaggagatgattccaccaggtgctcttgtcatgcttacacccctcattgttggaaccttctttggcgttgagactctttctggtgttttggctggctctcttgtttctggtgttcagatagcaatttctgcatctaacactggtggtgcatgggataatgccaagaagtatattgaggctggtgcgtcagagcatgcaaggacgctaggcccaaaagggtcagagccacacaaagctgcagtgattggtgatacaattggtgacccactgaaggacacatcaggcccatcactcaacattctcatcaagcttatggctgtggaatctctcgtctttgctcccttctttgccactcatggtggcctgcttttcaagatattctgaaatgagaggataatgacgaagacgtagggaaggagagctgttgtttaacttgatttctttttgtagaatgcttatccacactcctgcttctgcatttatcttttgtcccatttaatgggattttaaagctagtttagtgaaaatactatatcttgatgtgctgatgacaattaaagatggtggcgagaaaaaaagatcattggttgcaaacttacaaatggtcgagtcaacgtgcaaggaattttgagaatttgatacgttactctctagttgttttggaacaatttgggtttaaaattttgtatgtcagccttttcctctagaggagggatggcattttggactcttgattgattgtgtttgtggtggttttaaaactcctgatcacctcatttttccgagggggggattttcatatattatggcaatttgaaaaactctcattcatttgatttgagtttattattgggatttggaag

SEQ ID NO: 1624 - DNA, 3141 bp, Quercus alba
atggggattcatcaccgaatacacacaaaaccactgtgaaaactctctctctctcactctctctttcttatctcattctcttttgtttggttgttctgagtttcggatatgggtgtgacgctcctaccagatctcggtaccgagattctgattccggtttgtgcggtcgtcggaatcgctttctcgctcatccagtggctgctcgtctcgaaagtcaagctcactccctcgtcggagcatgcttctgccaacaacggcgccggaaagaatggcttcgccgaccacctcatcgaagaagaggaaggaatcaacgaccacagcgtcgttctcaagtgcgccgatatccaaaccgctatctctgaaggagcaacctcctttctatttaccgaatatcagtatgttggtgtttttatggcggcttttgctgtattgatattcctcttccttggctctgtggagggtttcagcaccaaaaatcagccttgcacatatgacgaaaccaagtcgtgcaagcctgctcttgcaactgctctcttcagtaccatatcatttgtgctcggtgctgtcacttcagttgtttctggcttccttggaatgaaaattgctacctatgcaaatgccagaactactttggaggcaagaaagggtgttgggaaggcatttatcactgcatttagatctggtgcagtcatgggctttctccttgctgcgaatggtctcttggtgcttttcattgccatcaatctctttaagctgtattatggtgatgattggggtggtctttttgagtctatcactggttatggtcttggtggatcttccatggctctctttggcagagttggtggaggtatctatactaaagctgctgatgttggcgctgatcttgttggcaagattgaaagggacattccagaggatgatccaagaaatccagctgtcatagctgataatgttggtgataatgttggggatatagctggtatgggatctgatctttttggctcatatgctgagtcttcctgtgctgcccttgttgttgcttccatctcctcctttgggatcaatcatgagttcactccgatgttatatcctcttattatcagttctgtgggtatcattgtttgtttgattaccaccttatttgcaactgatttctttgaaatcaaggctgtgaaagaaattgagccagcattgaagaggcaactcatcatttcaaccattctgatgactgttggagttgcagttgttagttgggttgctctcccatcttccttcactatcttcaactttggaactcagaaagttgtccataattggcagctgttcttatgtgttgctgttggtttgtgggctgggcttattattggatttgtaactgagtattatactagtaatgcatacagccctgtacaagatgtcgctgactcttgccgtactggagctgctaccaatgtcatttttggccttgcattgggctacaaatcagtcattattcctatctttgccattgctcttagtatttttgttagtttcagctttgccgctatgtatggtattgcgatgtctgctcttggaatgctgagcacaatagccactggattggcaattgatgcttatggtcccatcagtgataatgctggaggcattgctgagatggcaggcatgagccacagaatccgagagagaactgatgctcttgatgctgcaggaaacaccactgctgctattggaaagggttttgcaattggttctgcagctcttgtgtctctggcgctctttggtgcttttgtgagccgcgcaggaatctcagcagttgatgtcttgactccaaaagtgtttattggtctgattgtgggagctatgcttccttactggttctctgccatgacaatgaagagcgtgggaagtgcagctctaaagatggttgaggaagtccgcagacagttcaacaccatcccaggtctcatggagggcactgccaagcctgactatgctacctgtgttaaaatctccactgatgcttcaattaaggagatgatcccacctggtgcccttgtcatgctcacaccacttattgctggtatcttttttggtgtggaaactctctctggtgtactcgctggatcccttgtttctggtgtacaggtagcaatctctgcgtccaacactggtggtgcttgggataatgccaagaagtatattgaggctggtgcttcagagcatgcaaggacccttggtccaaaaggatctgatccacacaaggcagctgttattggtgacaccatcggggatccactcaaagatacatctggaccatcactcaacattcttatcaagctaatggctgttgagtcacttgtgtttgctcccttctttgctacacatggtggcctgctcttcaagttcctctaaaacacaacgatgaagaaaacaacgggggatggtttccccctctgttatgacctcccatcttcaatctctcctaaatttgcatgggctcttttctctgtcgattcttcttcttctcctcctcctattatgaattagtttctagagggtgttaggctttagaaattatctctcttatagttgaactggtagggagaaaaatcccctttttagggggttgatgatgatgatgatgatgatgatgataatggtagtagtggtggatctgtggaaagctgggactgctttattattcattatccttagtaaagacagataattgtccattttctgttatactttcttttgatgtttactctatcaactttttgagtttaaatgtaaagtttatgatgtctgtgaaggtattcatttttaaggtcagctggcacgttaaacactgacagatttatagtgttttgtcacatatgtatgcaaccctactgccaaagtagggttggtatgggccaagatttggatccggtgagagtgaagaattatcaaggtaaaaagattttgattgaagggtttggatttaaatgaactttaaatctttcaaccctactgccttgtaaacttcttttaagattttgggtataggaaggtttctattttttgcatacaatgattcccctggcctaacattatggattctgtactttcgtaagttggtagatatgagtgtaaatt

SEQ ID NO: 1625 - DNA, 2834 bp, Glycine max
cactaaagtaagatctcacatttctttggaatgttcgttggcactcaccgtaggatgattgaaaatctcaatgcaaccaatacaacggtgataatctcgggtacaacttcacgttcagaaaccgaacgcactctatcactctctctcccaatataaatctcgtcatgcctggccgcactcgagcttccctcacacacgttctctgtgactgcctctgttccgccaagcgcagcattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaggaagaaggcatcaacgaccacagcgtcgttgtgaaatgcgctgagatacagaacgctatctccgaaggtgcaacatcctttcttttcactgaatatcaatatgtggggatcttcatggttgcttttgcaatactgatcttcctttttctgggctctgtggaaggcttcagtactaagagccagccctgcacatatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggctttcattactgcatttaggtctggtgcagtgatgggtttccttcttgcagcaaatggtcttttggtgctctacattaccatcaatctcttcaagctatattatggtgatgattgggaaggtctttttgaggctataactggttatggtttgggtggatcttccatggctctgtttggcagagttggtggtggtatctacaccaaggctgctgatgttggggctgatctggttggaaaagttgaaagaaatatcccagaggatgatccaagaaacccagctgtgattgctgacaatgttggtgataatgttggagatattgctgggatgggttctgatctttttggttcatatgccgaatcgtcttgtgctgccttagttgttgcatccatttcctcatttggaatcaaccatgagttcactgcaatgttatatcccctactcatcagttctatgggcattattgtctgtttgattactactctctttgcaactgatttctttgagatcaaggctgtcaaggaaattgaaccagctttgaaaaagcagcttatcatctctacagtactcatgactgttggaattgcaattattagttggattgctctgccaacatccttcacaattttcaactttggcgctcagaaggaagtaaagagctggcagctgttcctctgtgtgggtgttggtctatgggctggacttattattggttttgttacagagtattatacaagcaatgcttacagccctgtacaagatgttgctgattcctgccggactggagctgcaaccaatgtcatctttggccttgctctgggatacaagtctgtcattattcctatttttgccatcgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgctgctttggtgtctttggccctatttggtgcatttgtgagcagagctggaattttgactgttgatgtcttgactcccaaggtctttattggactcatagttggtgccatgcttccttactggttttctgccatgaccatgaagagtgttggaagtgcagctttgaagatggttgaggaggttcgtaggcagttcaacaccattccaggactgatggagggtcatgccaagcctgattatgccacctgcgtcaaaatttctactgatgcatccatcaaggagatgattcctccgggtgcccttgtcatgctcacaccactcattgttggaatcttcttcggggtggaaacactttcaggtgttcttgccggggctctagtttctggtgtacagattgcaatatcagcatccaacactggcggtgcttgggataatgctaagaagtacatagaggctggtgcgtctgagcatgcaaggaccctgggcccgaagggatctgaaccacataaggcagctgttattggagataccattggagaccctcttaaagatacttcaggtccttcactcaacatcctcatcaagctcatggccgttgagtcgctcgtcttcgcaccatttttcgccactcacggtggcctgcttttcaagatcttttgatttgagggtagagttttctatcaatttatcctatttttctcggagcctgcagcaggcatttttctttgtaccaatataccctctccacctttaggggtagctcttctaattatcaggacttgctcttcaaattatcaggacttgaaatttgttactaaatgtagtagcttttcgatttttcacccagttttatatgataattcgtaatttaattatgaatcaattattaaatattataaaacttaac

SEQ ID NO: 1626 - DNA, 2556 bp, Glycine max
ggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaggaagaaggcatcaacgaccacagcgtcgttgtgaaatgcgctgagatacagaacgctatctccgaaggtgcaacatcctttcttttcactgaatatcaatatgtggggatcttcatggttgcttttgcaatactgatcttcctttttctgggctctgtggaaggcttcagtactaagagccagccctgcacatatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggctttcattactgcatttaggtctggtgcagtgatgggtttccttcttgcagcaaatggtcttttggtgctctacattaccatcaatctcttcaagctatattatggtgatgattgggaaggtctttttgaggctataactggttatggtttgggtggatcttccatggctctgtttggcagagttggtggtggtatctacaccaaggctgctgatgttggggctgatctggttggaaaagttgaaagaaatatcccagaggatgatccaagaaacccagctgtgattgctgacaatgttggtgataatgttggagatattgctgggatgggttctgatctttttggttcatatgccgaatcgtcttgtgctgccttagttgttgcatccatttcctcatttggaatcaaccatgagttcactgcaatgttatatcccctactcatcagttctatgggcattattgtctgtttgattactactctctttgcaactgatttctttgagatcaaggctgtcaaggaaattgaaccagctttgaaaaagcagcttatcatctctacagtactcatgactgttggaattgcaattattagttggattgctctgccaacatccttcacaattttcaactttggcgctcagaaggaagtaaagagctggcagctgttcctctgtgtgggtgttggtctatgggctggacttattattggttttgttacagagtattatacaagcaatgcttacagccctgtacaagatgttgctgattcctgccggactggagctgcaaccaatgtcatctttggccttgctctgggatacaagtctgtcattattcctatttttgccatcgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgctgctttggtgtctttggccctatttggtgcatttgtgagcagagctggaattttgactgttgatgtcttgactcccaaggtctttattggactcatagttggtgccatgcttccttactggttttctgccatgaccatgaagagtgttggaagtgcagctttgaagatggttgaggaggttcgtaggcagttcaacaccattccaggactgatggagggtcatgccaagcctgattatgccacctgcgtcaaaatttctactgatgcatccatcaaggagatgattcctccgggtgcccttgtcatgctcacaccactcattgttggaatcttcttcggggtggaaacactttcaggtgttcttgccggggctctagtttctggtgtacagattgcaatatcagcatccaacactggcggtgcttgggataatgctaagaagtacatagaggctggtgcgtctgagcatgcaaggaccctgggcccgaagggatctgaaccacataaggcagctgttattggagataccattggagaccctcttaaagatacttcaggtccttcactcaacatcctcatcaagctcatggccgttgagtcgctcgtcttcgcaccatttttcgccactcacggtggcctgcttttcaagatcttttgatttgagggtagagttttctatcaatttatcctatttttctcggagcctgcagcaggcatttttctttgtaccaatataccctctccacctttaggggtagctcttctaattatcaggacttgctcttcaaattatcaggacttgaaatttgttactaaatgtagtagcttttcgatttttcacccagttttatatgataattcgtaatttaattatgaatcaattattaaatatt

SEQ ID NO: 1627 - DNA, 2667 bp, Glycine max
gagcttccctcacacattctctgtgactgcctctgttccgccgaacccagcattttcccaccgttcgggccaccggcggagttagttttccggcaaggatgggtgctgctctgctgtctgagcttgcgacggagatagttgtgccggcctgcgccgtcatcgggatcgtgttctcgttggtgcagtggttcctcgtgtcgcgcgtcaagctcactcccgaccgaaacggaacgacgtcgtcgccgcgcaacaacaagaacggctacggcgacttcctcattgaggaggaagaaggcatcaacgaccacagcgtcgttgtgaaatgcgctgagatacagaacgctatctccgaaggtgcaacatcctttcttttcactgaatatcaatatgtggggatcttcatggttgcttttgcaatactgatcttccttttcctgggctccgtggagggcttcagtactaagagccagccctgcacgtatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggcaaggctttcattactgcatttaggtctggtgcagtgatgggtttccttcttgcagcaaatggtcttttggtgctctacattaccatcaatctcttcaagctatattatggtgatgattgggaaggtctttttgaggctataactggttatggtttgggtggatcttccatggctctgtttggcagagttggtggtggtatctataccaaggctgctgatgttggtgctgatctggttggaaaagttgagagaaatatcccagaggatgatccaagaaatccagctgtgattgctgacaatgttggtgataatgttggagatattgcagggatgggttctgatctttttggctcatatgctgaatcatcttgtgctgccttagttgttgcttccatttcctcatttggaatcaaccacgagttcactgcaatgttatatcccctactcatcagttctatgggcattattgtctgtttgattactactctctttgcaactgatttctttgagatcaaggctgtcaaggaaattgaaccagctctaaaaaagcagcttatcatctctacagtactcatgactgttggaattgcaattattagttggattgctctgccaacatccttcacaattttcaactttggtgctcagaaggaagtaaagagctggcagctgttcctctgtgtgggtgttggtctatgggctggacttattattgggtttgttactgagtactatacaagcaatgcttacagtcctgtacaagatgttgctgattcctgccggactggagctgcaaccaatgtcatctttggccttgctctgggatacaagtctgtcattattcctatttttgccattgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgccgctctggtgtctttggccctatttggtgcatttgtgagcagagctggaatttcaactgttgatgtcttgacacccaaggtctttattggactcatagttggtgccatgcttccttactggttttccgctatgaccatgaagagtgttggaagtgcagctttgaagatggttgaggaggttcgtaggcagttcaacactattccaggacttatggagggtcatgccaagcctgattatgccacctgcgtcaaaatttctactgatgcatccatcaaggagatgattcctccaggtgcccttgtcatgctcacaccactcattgttggcatcttctttggtgtggaaacactttcgggtgttcttgccggggctctagtttctggcgtacagattgcaatatcagcatccaacactggcggtgcttgggataatgctaagaagtacattgaggctggtgcgtccgagcatgcaaggaccttgggcccgaaaggatctgaaccgcacaaggcagctgttattggggataccattggagaccctcttaaagatacttcaggcccttcactcaacatcctcatcaagctcatggcagttgagtcgcttgtcttcgcaccattttttgccactcatggtggtctgcttttcaagatcttttgatttgagggaatgcaaccgtacttagggtagagttttctatcaatttatcctatttttgtcggagcctgcaggcatttttcttttgtatcaataccctctccacctttaggggtagctcttcaaattatcaggacttgaaatttgttaccaaatgtagtagtagtttttgccaaagtgaattttcaattaaccagcttttggacttttcatcgagttttttaaccaatcattaattattaatatataagttaattttatttta

SEQ ID NO: 1628 - DNA, 2569 bp, Glycine max
atgggtgctgctctgctgtctgagcttgcgacggagatagttgtgccggcctgcgccgtcatcgggatcgtgttctcgttggtgcagtggttcctcgtgtcgcgcgtcaagctcactcccgaccgaaacggaacgacgtcgtcgccgcgcaacaacaagaacggctacggcgacttcctcattgaggaggaagaaggcatcaacgaccacagcgtcgttgtgaaatgcgctgagatacagaacgctatctccgaaggtgcaacatcctttcttttcactgaatatcaatatgtggggatcttcatggttgcttttgcaatactgatcttccttttcctgggctccgtggagggcttcagtactaagagccagccctgcacgtatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggcaaggctttcattactgcatttaggtctggtgcagtgatgggtttccttcttgcagcaaatggtcttttggtgctctacattaccatcaatctcttcaagctatattatggtgatgattgggaaggtctttttgaggctataactggttatggtttgggtggatcttccatggctctgtttggcagagttggtggtggtatctataccaaggctgctgatgttggtgctgatctggttggaaaagttgagagaaatatcccagaggatgatccaagaaatccagctgtgattgctgacaatgttggtgataatgttggagatattgcagggatgggttctgatctttttggctcatatgctgaatcatcttgtgctgccttagttgttgcttccatttcctcatttggaatcaaccacgagttcactgcaatgttatatcccctactcatcagttctatgggcattattgtctgtttgattactactctctttgcaactgatttctttgagatcaaggctgtcaaggaaattgaaccagctctaaaaaagcagcttatcatctctacagtactcatgactgttggaattgcaattattagttggattgctctgccaacatccttcacaattttcaactttggtgctcagaaggaagtaaagagctggcagctgttcctctgtgtgggtgttggtctatgggctggacttattattgggtttgttactgagtactatacaagcaatgcttacagtcctgtacaagatgttgctgattcctgccggactggagctgcaaccaatgtcatctttggccttgctctgggatacaagtctgtcattattcctatttttgccattgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgccgctctggtgtctttggccctatttggtgcatttgtgagcagagctggaatttcaactgttgatgtcttgacacccaaggtctttattggactcatagttggtgccatgcttccttactggttttccgctatgaccatgaagagtgttggaagtgcagctttgaagatggttgaggaggttcgtaggcagttcaacactattccaggacttatggagggtcatgccaagcctgattatgccacctgcgtcaaaatttctactgatgcatccatcaaggagatgattcctccaggtgcccttgtcatgctcacaccactcattgttggcatcttctttggtgtggaaacactttcgggtgttcttgccggggctctagtttctggcgtacagattgcaatatcagcatccaacactggcggtgcttgggataatgctaagaagtacattgaggctggtgcgtccgagcatgcaaggaccttgggcccgaaaggatctgaaccgcacaaggcagctgttattggggataccattggagaccctcttaaagatacttcaggcccttcactcaacatcctcatcaagctcatggcagttgagtcgcttgtcttcgcaccattttttgccactcatggtggtctgcttttcaagatcttttgatttgagggaatgcaaccgtacttagggtagagttttctatcaatttatcctatttttgtcggagcctgcaggcatttttcttttgtatcaataccctctccacctttaggggtagctcttcaaattatcaggacttgaaatttgttaccaaatgtagtagtagtttttgccaaagtgaattttcaattaaccagcttttggacttttcatcgagttttttaaccaatcattaattattaatatataagttaattttatttta

SEQ ID NO: 1629 - DNA, 2547 bp, Amsonia hubrichtii
gcttcggctagtagtttagggttccggtgaaggatggcgtcggcgctgctgccagatctagggacagagatcgtgattccggtgtgtgctatcatcggaatcatcttctcgctcattcagtgggtcatagtttctcgcgtgaaagtctcgcccgaacgaagctcttcgagcaacaacaacaagaatggctacaatgattacttgattgaagaagaggaaggtatcaatgaccacaatgttgtcgttaaatgtgccgagattcagaacgccatttcggagggtgctacatcgtttttgtttacagaatatagatatgttgggtttttcatggttgcttttgcaatccttatcttcctcttcctgggatcggtcgagggcttcagtacaaagagccagacttgcacttataacaaggagaaattgtgcaagccagctcttgcaactgctatatttagcactgtatcattcttgcttggggctttcacctcagttgtttctggtttcctcgggatgaaaattgctacctatgctaatgcaaggacaactctggaagctagaaaaggtgttggcaaggcttttatcactgcattcagatctggtgcagttatgggctttctccttgcagcaaatgggcttttggtgctctatattgcaatcaatctctttaagctgtactacggtgaggactgggaggggctgtttgaggcaattactggttatggtcttggtggatcttccatggctctcttcggcagagttggtggaggtatttataccaaggctgctgatgttggtgctgatcttgttggcaaggttgagaggaacattcctgaggatgatccccggaatcctgctgtgattgctgacaatgtgggggataatgttggtgatattgctggaatggggtctgatctttttggttcttatgctgaatcatcttgtgctgcccttgttgtggcctctatttcttcttttggaatcaatcatgactttactgcaatgttatatccgttgcttattagttccatgggaattcttgtctgcttgattacaaccctttttgcaactgacttctttgagattaaggctgtcaaagaaattgaaccagcactgaagatgcagcttattatctccactgttctcatgactgttggagttgcaatagttacctggacttgcttgccttcttcgtttacaattttcaactttggtactcagaaggttgtaaagaactggcaactattcctgtgtgtcggagtgggtctttgggctgggcttattataggatttgtgaccgagtattataccagcaatgcttacagccctgtgcaagatgttgctgattcctgcaggactggagctgcaacaaatgttatttttggccttgctttgggatacaaatcagtcatcattcctatttttgctattgcaataagtatctttgttagtttcacttttgctgccatgtatggtattgccatggctgcccttggaatgttgagcacaattgctaccgggttggctattgatgcttatggccccatcagtgacaatgctggaggcattgctgagatggctggaatgagtcacagaatccgtgagagaaccgatgcacttgatgctgctgggaacactactgctgccattggaaagggttttgccattggatctgctgcacttgtttctctcgctctatttggtgcctttgtcagtcgagcagctatttcgacagttgatgtcttgacccctaaggttttcattggtctgattgttggtgccatgctcccatattggttctctgcaatgacaatgaagagtgttggcagtgctgctctaaagatggtagaggaagttcgtaggcaatttaatactatccctgggctcatggagggccaagccaagcctgactatgcaacttgtgtcaagatctctactgatgcctctatcaaggagatgattcctccaggtgctctcgttatgcttacacctatcattgttggtactttctttggtgtggagaccctctccggggtgcttgctggttcccttgtttctggtgtccagatagcaatctctgcatcaaacactggtggtgcttgggacaatgctaagaagtatattgaggctggtgcttctgagcatgctagaacccttggacccaagggatctgaaccccacaaagcagctgttattggagatactattggggatcccctcaaggacacttcaggtccatctctgaacattctcatcaagctgatggccgttgagtctcttgtttttgctcccttctttgcaactcacggtggcttgcttttcaagatataaggcattaatagccaaaaaggatgggagaagtagttcagcctgctttccctttgtagcattagtctcagcagctcaatgatcttcgccattttatcacaacccttttcttcatttcatttttccaatgagtttttccttggtagtttatagctagttggatattatttttgacaaagtcgacgatgatgataattgtgctggtgaacgaggatgaaaaga

SEQ ID NO: 1630 - DNA, 3244 bp, Castanea mollissima
ctctctctctctctctcttccttatctcattctctttggttgttttgggtttctctgtttatagttgttttgagtttcggatatgggtgtgacgctgctaccagatctcggaacccaggttctgattccggcttgcgcggtcgtcggaatcgctttctcgctcatccagtggctgctcgtctcgaaagttaagctcactccctcgtcggagcacgcttctgccaacaacggcgccggaaagaatggcttcgccgatcacctcatcgaagaagaggaaggactcaacgaccacagcgtcgttctcaagtgcgccgaaatccaaaccgctatctctgaaggagcaacctcctttctatttactgaatatcagtatgttggtgtttttatggcggcttttgctgtattgatattcctcttccttggctctgtggagggtttcagcaccaaaagtcagccttgcacatatgatgaaaccaagtcgtgcaagcctgctcttgcaactgctgtcttcagtaccgtatcatttgtgcttggtgctgtcacttcagttatttctggtttccttggaatgaaaattgctacctatgcaaatgccagaaccactttggaggcaagaaagggtgttgggaaggcatttatcactgcatttagatctggtgcagtcatgggctttctccttgctgcaaatggtctcttggtgcttttcattgccatcaatctctttaagctgtattatggtgatgattggggaggtctttttgagtctatcactggttatggtcttggtggatcttccatggctctctttggcagagttggtggaggtatctatactaaagctgctgatgttggtgctgatcttgttggcaagattgaaagggacattcctgaggatgatccaagaaacccagctgtcatagctgataatgttggtgataatgttggggatatagctggtatgggatctgatctttttggctcatatgcggagtcttcctgtgctgcccttgttgttgcttccatctcctcctttgggatcaatcatgagttcactccgatgttatatcctcttattgtcagttctgtgggtatcattgtttgtttgattaccaccttatttgcaactgatttctttgaaatcaaggctgtgaaagaaattgagccagcattgaagaggcaactcatcatttcaactattctgatgactgtcggagttgcagttattagttgggttgctctcccatcttccttcactatcttcaactttggaactcagaaagttgtccataattggcagctgttcttatgtgttgctgttggtttgtgggctgggcttattattggatttgtaactgagtattatactagcaatgcatacagccctgtacaagacgtcgctgactcttgccgtactggagctgctactaatgtcatttttggccttgcattgggctacaaatcagtcattattcctatctttgccattgctattagtatttttgttagtttcagctttgctgctatgtatggtattgcgatgtctgctcttggaatgctgagcacaatagctactggattggcaattgatgcttatggtcccatcagtgacaatgctggaggcattgctgagatggctggcatgagccacagaatccgagagagaactgatgctcttgatgctgcaggaaacaccactgctgctattggaaagggttttgcaattggttctgctgctcttgtgtccctggcgctctttggtgcttttgtgagccgtgcaggaatctcaacagttgatgtcttgactccaaaagtgtttattggactgattgtgggagcgatgcttccttactggttctctgccatgacaatgaagagcgtgggaagtgcagctctaaagatggttgaggaagtccgcagacagttcaacaccatcccgggtctcatggagggcactgccaagcctgactatgctacctgtgttaaaatctccactgatgcttcaattaaagagatgatcccacctggttgccttgtcatgctgacaccacttattgttggtatcttttttggtgtggaaactctctctggtgtacttgctggatcccttgtttctggtgtacagatagcaatctctgcgtccaatactggtggtgcttgggataatgccaagaagtatattgaggctggtgtttcggagcatgcgaggtcccttggtccaaaaggatctgatccacacaaggcagctgttattggtgacaccatcggggatccactcaaagatacatctggaccatcactcaacattcttatcaagctaatggctgttgagtcacttgtgtttgctcccttctttgctacacatggtggcctgctcttcaagttcctctaaacacaacgatgaagaaaacaatgggggatggttttcccctgttacagcctcccatcttcaatctctcctaaattcgcatgggctctctatgtcgattcttcttctcctcctattatgaattagtttctagagggtgttaggctttagaaattataactcctatagttgaactggtagggagaaatatccccttttgaggggttgatgttgacgatgacgaggatgatgatggtgatgatgatgataatggtagtagtggtggatctgtggaaagctgggactgctttattattcattatccttagtaaagacagataattgtccattttctgttttactttcttttgatgtttcctctatcaacttttgagtttaaatgtaaagtttatgatgtctgtgaaggtattcatttttaaggtcagctggcacgttaaactctgacaaaaaaaatgaataccttcacagacatcataaactttacatttaaactcaaaagttgatagaggaaacatcaaaagaaagtaaaacagaaaatggacaattatctgtctttactaaggataatgactaataaagcagtcccagctttccatagatccaccactactaccattatcatcatcatcatcatcatcatcatcatcaacccctaaaaaggggatatttctcccaaccagttcaactataagagatataatttctaaagcctaacaccctctagaaactaattcataataggaggagaagaagaatcgacatagagagcccatgcgaatttaggagagattgaagatgggaggctgtaataggggaaaaccatcccccattgtttcttcatcgttgtgtttagaggaa

SEQ ID NO: 1631 - DNA, 2673 bp, Prunus persica
cacaaacacacccacctccaagccaagccccctctgtttcttctgtttcctctgttttcttctctgttttctctgttgggtaaaatcatgggggcgacgcttctcccagatctcgggaccgagattctgataccgctgtgcgcggtcattggcatcgctttctctgtggtgcagtggatgtttgtctctcaggtcaagctctcgcctggtcgagacgccaactcaaacgcccccggcaaaaatggctacaacgattacctcatcgaagaagaagaaggcggtaatgaccacaacgtcgtcctcaaatgcgccgaaattcaaaacgccatctctgaaggagcaacctcattccttttcaccgaatacaaatacgtcggtggtttcatggtggcttttgcagtcttgattttcgttttccttggctctgtggagggatttagcacaagtagccgtccatgtacatatgaccaaacaaagatatgcaaaccagctctcgccactgccatctttagcacaatttccttcttgcttggtgctataacttcagtggtttctggattccttgggatgaagattgctacttatgcgaatgccagaacaacattggaggcaagaaaaggtgttgggaaggcttttattactgcattcagagcaggagctgttatgggctttctccttgcttcaagtggtctattggttctttacattgctatcaacgccttcaagttgtactatggtgatgactggggtggtcttttcgaggctataactggttatggtcttgggggatcttccatggctctctttggcagggttggtggaggcatctataccaaagctgctgatgttggtgctgatcttgttggcaaggttgagaggaatattcccgaggatgacccaaggaacccagctgtgatagctgataatgttggagacaatgttggggatatagccggcatgggatctgatcttttcggatcctacgctgaggcatcgtgtgctgctcttgtggtcgcatccatttcctcatttgggatcaatcatgagttgactgcaatgctatatcctctcattgtcagttccgttgggatcctcgtttgtttgctcaccaccctgtgtgcaacagatttctttgagatcaaggctgtaaatgaaattgaaccagcactgaagaggcagctcatcatttccactgtactgatgactgttggaattgcaattgttacatggatttctgttccatcttccttcacgatcttcaattttggcacacagaaagttgtgaagagctggcagctattcttatgtgttggtgttggtttgtgggctgggcttatcattggttttgtaacagagtattacactagcaatgcgtacagccctgtgcaagatgttgctgattcttgtcggactggagctgccactaatgtcatttttggccttgcattgggatacaaatccgtcattattcctatttttgccattgcaattagcatttttgttagttttagctttgcagctatgtatggaattgctgtagctgcccttggaatgctgagcaccatagcaactggattggccattgatgcatatggtcccatcagtgacaatgctggaggaattgctgagatggcaggcatgagccacagaatcagagagagaactgatgctcttgatgcggcaggaaacaccactgctgctattggaaagggatttgcaattgggtctgctgctcttgtgtcccttgctctctttggtgcctttgttagccgtgctggtatctcaacggttgatgtgttgtctccaaaagtggttattggtttgttagtgggcgcaatgcttccttattggttctctgccatgacgatgaagagtgtgggaagtgcagctctaaagatggttgaggaagtgcgcaggcaattcaataccatcccaggtctcatggagggtactgccaagcctgactatgctacatgcgttaagatttcgacggacgcctccatcaaagagatgatcccccctggtgcccttgtcatgcttacacccctcattgttgggatcttttttggtgtggaaactctctccggggtgcttgccggatcccttgtctctggtgtacagattgctatctctgcatccaacacgggtggtgcttgggataatgccaagaagtacattgaggctggtgcttcagagcatgcaaggacgcttggtccaaaaggatcagatccccacaaagcagctgtcattggtgacaccattggagaccctctcaaggatacatctgggccatcgctcaacattcttatcaagctcatggctgtcgagtcgcttgtgtttgctccgttcttcgctacgcacggtggcctgctcttcaagatttaagtttataaagggtgcaacagacaagtgggaagttcccctctgttgtttgattcttcgctctcttcacactcacgatccctttctttcaatctcctcagcaaaatattagtctttagaacatgctggtttagcttttgaattagctaccaaaagtagaattgacgaaagaaattttccctttctaggggggatgggggtggtgattatgatgaagctggttataacgatgttgatgatgatgatgatgataatggttcaacttagtgaagagtttggattttcttctaa

SEQ ID NO: 1632 - DNA, 2747 bp, Tripterygium wilfordii
atttgtatataaactgctccacatcgtcagcttacttccttcgcctccataaccatctctcccacactttcgttgatttggttcttgtgttttaagttatgggttcggggatcatgccagatcttgcttccgagatcttgattccggtgtgtgccgttataggcatagccttcgcgttagttcagtgggttattgtctctcgcgttaagctctcaccgggaagaggctcgaatggtagagggaagaatgggtactctgattgcttaatcgaggaggaagaaggactcaatgaccataacgtcgtactcaaatgcgctgaaatccagactgcaatctctgaaggggcaacctcgttcctttttacggaatatcagtatgtcgggattttcatggttgcttttgcaatcttgattttcgttttccttggctcagttaatgggttcagcacaaaaagccagccttgcacatatgacctacaatcaatgtgcaagccagctcttgccactgctgccttcagcacggtatcgttcctgcttggagctttcacttcagtgatttctggcttcctagggatgaaaattgccacatatgcaaatgctagaaccaccttggaggcaagaaaaggggttgggaaggcctttattgttgcgtttaggtctggcgctgtcatgggttttctccttgcagcaagtggacttttggtactttacattatcattaacctcttcaagctgtactatggtgatgactgggaaggcctttttgaggctataactggttatggtcttgggggttcctccatggctctcttcggcagggtcggtggaggtatctacacaaaagctgctgatgttggtgctgatcttgtaggcaaggttgaaaggaacattcctgaggatgacccaagaaatccagctgtgattgcagacaatgttggtgataatgttggggatatagctgggatgggttctgatctctttggctcttatgccgagtcatcatgcgctgccctagtcgttgcttccatctcctcatttgggattaatcatgatttgactgcaatgttgtatcctctaatcatcagctcagttggtattgttgtttgtttgataacaaccttgtttgcaacggatttcttcgaggtcaaagctgttaatgagattgaaccagcattgaaaaaccagctcattatttcaacagttctgatgactgttgcatttggaattgttacatggatatctgttccatcttcattcaccatcttcaactttggtacccaaaaagtagtgaagaactggcaactcttcttatgtgtcgctgttggtctttgggctggactcattattggatttgttactgagtattatacaagcaatgcatacagtcctgtgcaagatgttgctgattcctgccgaactggagcggctactaatgtcatatttgggctagcattgggatacaaatctgtcattattcctatatttgctattgcagttagcatatttgttagtgttagctttgctgccatgtatggtgtttcggttgctgcccttggaatgctgagcaccattgccactgggttggctattgatgcatatggtcccatcagtgataatgctggaggcattgctgagatggcaggcatgagtcatagaatccgggagagaaccgatgcccttgatgccgctggaaacacaactgctgctattggaaagggttttgctattggttctgctgctctggtgtccttggctctgtttggtgcctttgtgagccgtgcatctatcacgacagttgatgtgctctctccaaaggtttttattggtttgattgtcggtgctatgcttccttactggttctctgccatgacaatgaagagtgtgggaagtgcagctctgaagatggttgaggaagtccgtaggcaattcaacaccatccctggtcttatggagggaactgcgaagcccgactatgctacctgtgttaagatctccactgatgcttctatcaaggagatgatcccacctggtgcccttgttatgctcaccccactcattgttgggatccttttcggtgtagaaactctggctggtgttcttgctggatctctcgtgtctggtgtacagattgccatctctgcttccaacactggcggtgcttgggacaatgccaagaagtacattgaggcgggtgcttctgagcatgcgcgaaccctcggtcccaaaggatcagatccacacaaggcagctgttattggagacaccgttggagaccctttgaaggacacatctggaccttcgctcaacatcctcatcaagctaatggcggttgaatcacttgtgtttgcaccatttttcgctacgcatggtggcctcctcttcaagttattataaaccgttgattcaaatgtgggatagacagtctactggtcactctctgctggatctttgttcttccctccacatgctaaaaattattatgtagtttgtagtgcatggttgactcttaattggcagcaaattttccctcccaaggggttggcgacaaggacgaggacgataatgatcagtgttaggaagagttagtaactcattgttatccctgtttttctgggtattggtagagcaattaatttctgaatcccttacattccttctctttttgttctgctgttatctctgggttcttacctaattggccaagattgattgtttctgttttttaccaagattatattgaacaacttg

SEQ ID NO: 1633 - DNA, 2772 bp, Gossypium hirsutum
ctccactccatttctctgtttatctcccactcttatctgtctcaaggcgggaggactgtagcgttgtcaatgatgggagcggttttgttgtcggagtttgcgacggagatcgtggtgccagtgtgcgccgtgattggaattgctttctcgttggtgcagtggctgttggtgtcgcgcgtgaagcttaacccggagcggcatgcatcggggaatagcaacaagaacggttacagtgattacttgattgaggaagaggaaggacttaatgaccccagcgtcgtcaccaagtgcgctgaaattcaaagcgctatctccgaaggtgcaacatcctttcttttcactgaatatcagtatgttggcatcttcatggttgcttttgctatcttgatattcctcttcctgggttctgttgagggcttcagctcaaagagccagccttgcacctatgataaggagaagacctgcaaaccagctcttgccactgctatcttcagtaccatatccttcttgcttggtgctatcacctctgttctttctgggttccttgggatgaaaattgctacatatgccaatgcaagaacaaccttagaagcaagaaagggtgttggaaaggcttttattgttgcatttagatctggcgcggtaatgggttttctcctcgctgccaatggcttgttggtgcttttcgttgccatcaatctattcaagctgtactatggtgatgactgggaaggcctttttgaggctattactggttatggtcttgggggatcctctatggcactgtttggaagagttggtggtggtatctatacaaaggctgctgatgtcggtgctgatcttgtaggaaaggttgaaaggaacattccagaggatgacccaagaaacccagctgtcattgccgacaatgttggcgataatgttggggatattgctggtatgggttctgatctatttggctcatatgctgaatcttcctgtgctgctcttgttgttgcttctatatcctcttttggaataaaccacgagttcactgccatgttgtatcctctgctcattagttctgttggtattcttgtctgtttgatcacaaccctatttgctacggatttcttcgaaattaaggctgtcaaagaaatcgaaccagctttgaagaagcagcttattatatctactgttcttatgactgtggggattgcaattgttacttgggttggtgtgccatcgtccttcaccatttacaattttggggatcagaaagttgttaagaactggcaactatttttgtgcgttggtgttggtctctgggctggacttattattggttttgttactgagtactacaccagtaatgcttacagtcccgtgcaggatgttgccgattcctgcaggacaggagcagctaccaatgttatatttggccttgctttaggatacaaatctgtgatcatcccaatttttgccattgcaatctgcatttttgttagttttagctttgctgccatgtatgggattgcagttgctgcccttggaatgttaagcaccattgcaactgggttggccattgatgcttatggtcccatcagtgacaatgctggaggcattgctgagatggctggcatgagccatcacattcgtgagagaactgatgcactagatgctgctggaaacactacagctgccattggaaagggatttgccattgggtcagcagcattggtgtcattggctctatttggtgcctttgtgagccttgcagctatctctactgttgatgtcttgaccccgaaggttttcattggtttaatagttggtgccatgcttccctactggttctctgctatgaccatgaaaagcgtggggagtgcagctttaaagatggttgaggaggttcgcaggcagttcaacaccatccctggtctcatggagggtcgtgccaagcctgattatgctacctgtgtcaaaatctcaactgatgcctctatcaaggagatgattcctcctggtgcccttgttatgcttactcccctaatcgttggaactttctttggtgttgagactcttgccggtgtccttgctggtgcccttgtttctggtgttcagattgcaatatctgcttccaacactggtggtgcatgggataatgccaagaagtacattgaggctggtgcctcagagcacgcgaggaccctgggtccaaaaggatcggatcctcacaaggcagctgtcattggtgacacggttggtgatccactcaaggatacctctggcccttcactcaacatcctgatcaagcttatggcagtcgagtcactcgtatttgctcccttctttgccactcacggtggcttgcttttcaagatcttttagaggggatgggcggaaacagcagtagggagggtgacttgttagttacaggccctatgtaagagtgttgttcctgttcacccattaagtttctgtatccgtccaaactctcatagttagcgaagcttagctttagtcattgctatttttgataggttgatatcgatgataactgagatatgggttaggttgatcaccgaaaacgatcattgttatcgtggacgagtcaaggtgggatatcttacttttccagttctagaacagcttttgcttaattttgaaattttgtactcgcaaaaaatcttttccagcatttaaccttaatgatattttgatgagttctctgttacaaaaaaaaaaaaaaaagtaacgaactgcgactctgcgttgatactggccgctcgt

SEQ ID NO: 1634 - DNA, 2949 bp, Aristolochia fimbriata
cagctcagaaggaaaaactctcactggaagaaaaaaaccttccctttccacttcctccttgcttccggtgattccgtttttccccttccaagagcgccatgggagcggcgatcctctccgaactcctcacggagattcttatcccggtggctgccgtcatcggtatcgccttcgcgcttgtgcagtggatgctggtctccagcgttaagctctcgccggagagacagccatcgacgacgacgaacaacaacaagaatggatacacggactatctcatcgaggaggaggaaggacttaacgaccacaacgttgtcgttaagtgcgccgagatacagaatgctatctctgaaggggcaacatccttcctttttaccgaataccaatacgttggtattttcatggtggcttttgccattttgatcttcctcttcctgggatcagtcgaaagcttcagtacaaaaatgcagccttgcacgtacaacaaggagaagatgtgcaagtctgctcttgccaatgccatcttcagcactgtttcctttctacttggtgccatcacatctcttttctctggttttctgggcatgaaaattgctacatatgcaaatgcaagaacaactttagaggcaaggaaaggtgttggcaaggctttcattacagcattcaggtctggagcagttatgggctttttgcttgctgcaaatgggcttttggtgctttacattgctataaatctctttaaactgtactatggagatgattgggaaggtctctttgaggcaattactggttatggtcttggtgggtcatccatggctctgtttgggagagttggaggaggaatctatacaaaagctgctgatgttggtgctgatcttgtgggaaaagtcgagagaaacattcccgaggatgacccaagaaaccctgctgtgattgcggacaatgttggtgacaatgttggagatattgctggaatgggatcagatctttttggttcttatgcagaggcttcctgtgctgctcttgttgtggcgtcaatttcctcctttgggataaaccatgaactgactgcaatgttgtatccccttctcattagttccatgggcattgttgtttgtttgatcactaccctctttgctaccgatttctttgagattaaagcagtgaaggagattgagccttctttgaagaatcagcttatcatttccactgccctcatgactgctggcattgctgttgttagctggattggcctgccaccatcctttacaatctataactttggagtccagaaggttgtgaaaaactgggagttgttcttctgtgttgctattggtctttgggctggacttgtcattgggtttgtaactgagtactacaccagtaatgcttacagccctgtgcaagatgtggctgattcctgcagaacaggagctgccacaaatgtgatttttgggcttgctctgggatacaagtctgtcattattcccatttttgctattgctgtcagcatttttgtgagctttagccttgctgccatgtatggtattgcagtggctgctctgggaatgttgagtaccattgctactggtttggccattgatgcatatggtcctattagtgataatgctggaggtattgctgagatggctggcatgagccacaggataagagagagaactgatgcccttgatgctgctggaaacactactgctgccattggaaagggatttgccattggttctgctgctttggtgtctttggctctgtttggtgcttttgtgagcagggcagaaatttcaacagtggatgttttgactcctaaagtcttcattgggcttattgtgggtgcaatgcttccatactggttctctgccatgaccatgaagagtgtgggtagtgctgctttgaaaatggtggaggaagtcaggagacagttcaacactattcctggtctaatggagggtactgccaaacctgactatgcgacttgtgtcaagatatccactgatgcatccatcaaagaaatgattccccctggtgctctggttatgctcacaccccttattgttggtactctttttggtgttgagaccttgtctggtgttttagccggctctcttgtttccggtgttcagattgccatatcggcttccaacactggtggtgcttgggataatgccaagaagtacattgaggctggtgcttctgagcacgcaaggaccctaggacccaaaggatcagagccacacaaagcagctgtcattggtgacaccattggtgatccactgaaggacacctctggcccatcgttgaacatcctcatcaagctgatggctgtggaatcgctcgtctttgctcctttctttgccaggcatggtggtctcctcttcaagatctaaactctggaagggaaaacagtaaagaacaggagaaatgataaccaagctgagcgctgccgcgttttacacttccttgagtctcctttaccttcttcatccgttatttagtgttctagtcctaattctaaaagtcattttaaattgttagggtgcccatgatctatttttgttttgtaattcagcgatgggcaagaaaattttccttattttatttggtgatagagataggagtggtgatcattattgatgtctggaaaatgagttgaattgggcaggttgtcctatttcaagaggaatgtttgaacatgctgggttcccagtttatatcactgctgtaacacgtttttggtccacccgttattggaatgggatgaaactcttttggaaatatcgtgttggttgtgcgttgttgcttgtcgtggtttatcatagaaatgtgaggcgtgtggggattaagactgaaaggaaatgttgtctagcaaatctgtatgcgaatgactcgccgtcaatgtgatgttgcgtgtgcccatctgtttagtcgagttcaatc

SEQ ID NO: 1635 - DNA, 2839 bp, Medicago truncatula
atcttctctctctcccacatataaaaccctcatcaccccccttctaccatttcacacttcgttcattcttcttccttcattttctcattttctcgttatttctcgtctctctttctctgtttctcgccatgggagcagtaattctcccagatctcggtactgagattttgattcctgtttgtgctgtcattggaatcgcttttgcacttttccaatggcttctcgtttccaaagtcaagctcactgctggaagagactctgctactgaagctcctggcaaaaatggttacaatgattctctcatcgaagaagaagaaggtatcaacgaccataacgtcgttctcaaatgtgctgaaatccagaacgctatttccgaaggttcaacatctttccttttcactatgtacaagtatgtgggaatcttcatggtggcttttgccattttgatattcctcttccttggctctgtggaaggattcagcacaagccatcagccttgcacttacgatgaaactaagatgtgtaagccagctcttgccacagcccttttcagcaccatagcatttatccttggtggcatcacatcagttatttctggtttccttggaatgaaaattgcaacttacgcaaatgcaagaaccacccttgaagcgagaaagggtgttggaaaggctttcattactgcattcagatcaggtgcagttatgggatttctcctcgctgctaatggtcttttggttctttacattaccatcaacttgttcaagatttactatggtgatgactggggtggtctatttgaggccatcactggttatggtcttggtgggtcttctatggctttgttcggaagagttggtggaggtatctacactaaggctgctgatgttggtgccgatcttgttggcaaggttgaaaggaacattcccgaggatgatccaagaaatccagctgtgattgctgacaatgttggtgataacgttggggatattgccggaatgggatccgatttatttggttcatatgcagaggcatcttgtgctgcccttgttgttgcttctatctcttcttttggagtgaatcatgagttcactcccatgttgttccctcttatcatcagttctgtgggcctccttgtttgtttgctcaccaccttatttgcaaccgacttttttgagatcaaacttgtaaaagaaattgagcctgcattgaaaaaacagcttgttatttcaactgcactgatgactgttggaattgctattgttagttggatagcactcccagcttccttcaccatcttcaattttggagagcagaaggatgtcaagaactggcagctattcttgtgtgttgcagttggtctttgggcagggcttatcattggatttgtcactgaatactataccagcaatgcatacagtcctgtgcaagatgttgcagactcctgcaggactggtgctgctaccaatgttatatttggccttgccttgggatacaagtctgttatcattccaatttttgccattgcaattagtatttttgttagtttcagttttgctgccatgtacggtgttgctgttgctgcacttggaatgttgagtaccatagccaccggattagccattgatgcatacggtccaatcagtgacaatgctggaggtattgctgagatggcaggcatgagtcacagaattcgagagagaaccgatgctctggatgctgcaggaaacacaactgccgccattggaaaggggtttgctattggttctgccgcccttgtgtctttggctctctttggtgcctttgtgagcagagctggtattacgacagttgatgtgctgactcccaaggttttcattggtttgcttgttggttccatgctcccttactggttttctgccatgacaatgaagagtgttggaagtgctgctctaaagatggttgaggaagtccgcaggcaattcaacaccattcctggcttgatggagggaactgccaagcctgactatgccacatgtgttacaatctccaccgacgcatctatcaaagaaatgatcccacctggtgcccttgttatgctcacaccccttattgttgggatcttttttggtgtggagacactctctggtgtcctcgctggatccttggtgtctggtgtacagattgctatctctgcatccaacactggcggtgcttgggataatgccaagaagtacattgaggctggtgcctcagagcatgcaagaagccttggtccaaaagggtcagacccacacaaggcagcagttattggtgacaccattggggacccattgaaggacacatctggtccatcccttaacattcttatcaagctgatggcagtggagtctctggtgtttgctcctttctttgcaacccatggtggtctcctcttcaagatctaagatttgatggagaaacgaagagcatcgtccatcatcgcagcccttctaccaaccatcatggcctctcttttttgttagtttgatggcaacttcttttctatttgttttttattttaaaaatcttattattccttagtcccctcttcccccccttctagatttgagaaacttaattaggcttaatctttgccgcgtggtcatttttcatgtaagagatgaggttgatgatgacgatcaaatttactatcttgcccgcgtggtcatttttccatattcctttcacatttccttctttcattaatatttgttgaatgccgagtagaattagaatatgttatccattcatcgtaacgtatggtcattctctaatgcaacctgcatatattgatgtttttatatactcctttatttgg

SEQ ID NO: 1636 - DNA, 3000 bp, Quercus alba
aacgcagagtacatgggattcatcaccgaatacacacaaaaccactgtgaaaactctctctctctctcactctctctttcttatctcattctcttttgtttggttgttctgagtttcggatatgggtgtgacgctcctaccagatctcggcaccgagattctgattccggcctgcgcggtcgtcggaatcgctttctcgctcatccagtggctgatcgtctcgaaagtcaaggtcactccctcgtcggagcacgcttctgccaacaacggcgccggaaagaatggcttcgccgaccacctcatcgaagaagaggaaggactcaacgaccacagcatcgttctcaagtgcgccgaaatccaaaccgctatctctgaaggagcaacctcctttctatttaccgaatatcagtacgttggtgtttttatggcggcttttgctgtattaatattcctcttccttggctctgtggagggtttcagcaccaaaaatcagccttgcacatatgacgaaaccaagacttgcaagcctgctcttgcaactgctctcttcagtaccatatcatttgtgcttggtgctgtcacttcagttgtttctggcttccttggaatgaaaattgctacctatgcaaatgccagaaccacattggaggcaagaaagggtgttgggaaggcatttatcactgcatttagatctggtgcagtcatgggctttctccttgctgcgaatggtctcttggtgcttttcattgccatcaatctctttaagatgtattatggtgatgattggggaggtctttttgagtctatcactggttatggtcttggtggatcttccatggctctctttggaagagttggtgggggtatctatactaaagctgctgatgttggtgctgatcttgttggcaagattgaaagggacattccagaggatgatccaagaaatccagctgtcatagctgataatgttggtgataatgttggggatatagctggcatgggatctgatctatttggctcatatgctgagtcttcctgtgctgcccttgttgtagcttccatctcctcctttgggatcaatcatgagttcactccgatgttatatcctcttattgtcagttctgtgggtatcattgtttgtttgattaccaccttatttgcaactgatttctttgaaatcaaggctgtgaaagaaattgagccagcattgaagaggcaactcatcatttcaaccattctgatgactgttggagttgcagttattagttgggttgctctcccatcttccttcactatcttcaactttggaactcagaaagttgtccataattggcagctgttcttatgtgttgctgttggtttgtgggctgggcttattattggatttgtaactgagtattatactagcaatgcatacagccctgtacaagacgtcgctgactcttgccgtactggagctgctactaatgtcatttttggccttgcattgggctacaaatcagtcattattcctatctttgccattgctattagtatttttgttagtttcagctttgctgctatgtatggtattgcgatgtctgctcttggaatgctgagcacaatagctactggattggcaattgatgcttatggtcccatcagtgacaatgctggaggcattgctgagatggctggcatgagccacagaatccgagagagaactgatgctcttgatgctgctggaaacaccactgctgctattggaaagggttttgcaattggttctgctgcccttgtgtccctggcgctctttggtgcatttgtgagccgtgcaggaatctcaacagttgatgtcttgactccaaaagtgtttattggactgattgtgggagcgatgcttccttactggttctctgccatgacaatgaagagtgtgggaagtgcagctctaaagatggttgaggaagtccgcagacagttcaacaccatcccaggtctcatggagggcactgccaagcctgactatgctacctgtgttaaaatctccactgatgcttcaattaaagagatgatcccacccggtgcccttgtcatgctcacaccacttattgttggtatcttttttggtgtggaaactctctctggtgtacttgctggagcccttgtttctggtgtacagatagcaatctctgcgtccaacactggtggtgcttgggataatgccaagaagtatattgaggctggtgtttcagagcatgcgaagtcccttggtccaaaaggatctgatccacacaaggcagctgttattggtgacaccatcggggatccactcaaagatacatctggaccatcacttaacattcttatcaagctaatggccgttgagtcacttgtgtttgctcccttctttgctacacatggtggcctgctcttcaagttcctctaaaacacaatgatgaagaaaacaatggggatggttttcccctctgttacgacctcccatcttcaatctctcctaaattcgcatgggctctttctctgtcgattcttcttcttcttctcctcctcttatgaaatagtttctagagggtgttaggctttagaaattatatctcttatagttgaactggtagggagaaatatgtcctttttaggggttgatgttgatgatggtgatgatggtgatgatgatgataatggtagtagtggtggatctgtggaaagctgggactgctttgttgttcattatctagtaaagacagataattgtccattttctgttatactttcttttgatgtttcctctatcaactttttgagtttaaatgtaaagtttatgatgtctgtgaaggtattcacttttaaggtcagctggcacgttaaactcttgacagatttatagtgttttgtcacatatgtattcaaccctactgctaaattagggttggtatgggccaagatttggatccggtgagagtgaagaattatcaaggtaaaaagattttgactgaagggttt

SEQ ID NO: 1637 - DNA, 2743 bp, Solanum tuberosum
tactgtgaaacctcacaaaattttcatttaaccttctctctattttttctttatttttattggccggagctccggtagtctgccggtcggagtttatttttgtcggcgaagatgggtgtgactattttaacagatctcggaatggagattttgattccgatatgtgccgttatcggcatcgctttctcgctcttccagtggcatctcgtctccaaagttacggtcggtactgataagcctcattcctccggcgacgataagaatggatatgctgaatctctcattgaagaagaagaaggcatcaatgaccataacgttgttcaaaaatgcgctgaaattcaaaacgctatttctgaaggagcaacctcatttctctttacaatgtaccagtatgttggtgttttcatggttgcttttgcaattttaatcttcgttttcctcggctctgttgagggattcagcacaaaggaccagccttgcacatatgacagcaccaaaacttgcaagccagctcttgcaactgctgtcttcagcaccatatcgtttctgcttggtgctgttacctctgtggtgtcggggttccttggaatgaaaatcgccacatatgcaaatgccagaactaccttggaggctagaaaaggtgtcgggaaggcttttattgttgcattcagatctggtgctgtgatgggtttccttcttgctgcaaacggtcttttggttttattcataacaatccttctatttaagatgtactatggtgatgactgggaaggtctatttgaggctataactggttatggtcttggtggatcttcaatggccctctttggtagagttggtggagggatttacaccaaagcagcagatgttggagctgatcttgtgggcaaggtggagaggaacatccctgaagatgatcctagaaacccagcggtgattgctgacaatgttggagacaatgtcggagatattgctggtatgggatcagatctgtttggatcttatgcagagtcatcctgtgcggctcttgttgttgcttcaatctcctccttcggtgtcaatcatgagcttactgccatgctatatccccttctcatcagctctgtcggcatccttgtctgtttgcttaccaccttatttgcaactgatttctttgaagtcaaggctgttaaggaaattgagccagcattgaagaagcaactcattatctcaactgctctcatgactattgggattgcttttgttagttggattgcccttccatcgaccttcacaatattcaatttcggagttcagaaagaagtaaagaactggcaattgttcttgtgtgttggagttggtttgtgggctggactcattattgggtttgtcactgagtactataccagcaatgcttacagccccgtccaagatgttgctgattcatgccgcactggtgctgccaccaatgtcatctttggccttgccttgggttacaaatccgtcatcattcccatttttgccattgcaatcagtatatttgttagcttcagctttgctgcaatgtacggcattgcagttgctgcccttggaatgctgagcactatagccactggtttggcaattgatgcatatggtcccattagtgataatgcaggaggtattgctgagatggctggaatgagccacagaatcagagagagaactgatgcacttgatgctgcaggaaacaccactgctgctattggaaagggatttgctattggttctgctgcactcgtgtctcttgccctctttggcgcgtttgtcagccgagcagcaatttccactgtagatgtcttgacacctaaagtcttcattggtttgctagtcggtgcaatgcttccttactggttctccgccatgacaatgaagagtgttggaagcgctgctcttaagatggttgaggaagtgcgcaggcaattcaacaccatccctggtctcatggaaggaactgccaagcctgactatgccacctgtgtcaagatctccacagatgcatcaatcaaggagatgattccacctggtgctcttgtcatgctcactccattgattgttgggatcttgtttggcgtcgaaacactttctggtgttcttgcaggatctctcgtctctggtgtacagattgccatttctgcatccaacaccggtggtgcctgggacaacgctaagaagtacatcgaggctggagcctcagaacatgcaaggactcttggccccaagggatctgatgcacacaaagctgctgtaattggtgatactgttggtgaccctctcaaggacacatctggaccatcattgaacattcttatcaagctgatggctgtggagtcccttgtgtttgctcccttcttcgccacccatggtggtcttctcttcaagttgttttagaaagcaaatgcaaccaactcctatgtcacatgactgtatcatgaatctattgttcctctttactcttcccccgtatttcacattcaaacttcctttcaagcatttttcgtgtttttagtagctagaatgtggggattagcatatggtgttaggctgtggagggagattattcacgagaatgcgcgttgtgatgatggtaagggtgaagtgattttgcagagttcagaagaaacatcaaatgttctttcctagagtaattgtatcagttttttttctctcttaataccttcttgtcattgccctttttgggtgttcaatttttgaagacttacta

SEQ ID NO: 1638 - DNA, 2732 bp, Solanum phureja
actgtgaaacctcacaaatttttcatttaaccttctctctattttttctttatttttattggccggagctccggtagtctgccggtcggagtttatttttgtcggcgaagatgggtgtgactattttaacagatctcggaatggagattttgattccgatatgtgccgttatcggcatcgctttctcgctcttccagtggcatctcgtctccaaagttacggtcggtactgataagcctcattcctccggagacgataagaatggatatgctgaatctctcattgaagaagaagaaggcatcaatgaccataacgttgttcaaaaatgcgctgaaattcaaaacgctatttctgaaggagcaacctcatttctctttacaatgtaccagtatgttggtgttttcatggttgcttttgcaattttaatcttcgttttcctcggctctgttgagggattcagcacaaaggaccagccttgcacatatgacagcaccaaaacttgcaagccagctcttgcaactgctgtcttcagcaccatatcgtttctgcttggtgctgttacctctgtggtgtcggggttccttggaatgaaaatcgccacatatgcaaatgccagaactaccttggaggctagaaaaggtgtcgggaaggcttttattgttgcattcagatctggtgctgtgatgggtttccttcttgctgcaaacggtcttttggttttattcataacaatccttctatttaagatgtactatggtgatgactgggaaggtctatttgaggctataactggttatggtcttggtggatcttcaatggccctctttggtagagttggtggagggatttacaccaaagcagcagatgttggagctgatcttgtgggcaaggtggagaggaacatccctgaagatgatcctagaaacccagcggtgattgctgacaatgttggagacaatgtcggagatattgctggtatgggatcagatctgtttggatcttatgcagagtcatcttgtgcggctcttgttgttgcttcaatctcctccttcggtgtcaatcatgagcttactgccatgctatatccccttctcatcagctctgtcggcatccttgtctgtttgcttaccaccttatttgcaactgatttctttgaagtcaaggctgttaaggaaattgagccagcattgaagaagcaactcattatctcaactgctctcatgactattgggattgcttttgttagttggattgcccttccatcgaccttcacaatattcaatttcggagttcagaaagaagtaaagaactggcaattgttcttgtgtgttggagttggtttgtgggctggactcattattgggtttgtcactgagtactataccagcaatgcttacagccccgtccaagacgttgctgattcatgccgcactggtgctgccaccaatgtcatctttggccttgccttgggttacaaatccgtcatcattcccatttttgccattgcaatcagtatatttgttagcttcagctttgctgcaatgtacggcattgcagttgctgcccttggaatgctgagcactatagccactggtttggcaattgatgcatatggtcccattagtgataatgcaggaggtattgctgagatggctggaatgagccacagaatcagagagagaactgatgcacttgatgctgcaggaaacaccactgctgctattggaaagggatttgctattggttctgctgcactcgtgtctcttgccctctttggcgcgtttgtcagtcgagcagcaatttccactgtagatgtcttgacacctaaagtcttcattggtttgctagtcggtgcaatgcttccttactggttctccgccatgacaatgaagagtgttggaagcgctgctcttaagatggttgaggaagtgcgcaggcaattcaacaccatccctggtctcatggaaggaactgccaagcctgactatgccacctgtgtcaagatctccacagatgcatcaatcaaggagatgattccacctggtgctcttgtcatgctcactccattgattgttgggatcttgtttggtgtcgaaacactttctggtgttcttgcaggatctctcgtctctggtgtacagattgccatttctgcatccaacactggtggtgcctgggacaacgctaagaagtacattgaggctggagcctcagaacatgcaaggactcttggccccaagggatctgatgcacacaaagctgctgtaattggtgacactgttggtgaccctctcaaggacacatctggaccatcattgaacattcttatcaagctgatggctgtggagtccctcgtgtttgctcccttcttcgccacccatggtggtcttctcttcaagttgttttagaaagcaaatgcaaccaactcctatgtcacatgactgtatcatgaatctattgttcctctttactcttccccccgtatttcacattcaaacttcctttcaagcatttttcgtgtttttagtagctagaatgtggggattagcatatggtgttagggttgtgatgatggtaagggtgaagtgattttgcagagttcaaaagaagcatcaaatgttctttcctagagtaattgtatcagttttttttttttttttctcttaataccttcttgttattgccctttttgggtgttcaatttttgaagacttactaagcttttatgtgca

SEQ ID NO: 1639 - DNA, 2809 bp, Solanum lycopersicum
actgtgaaacctcacaaatttttcatttatcttttctctctatttttttctttatttttattggccggagctccggtagtctgccggtcggagtttatttttgtcggcaaagatgggagtgactattttaacagatctcggaatggagattttgattccggtatgtgccgttgtcggcatagctttctcgctcttccagtggtatctcgtctccaaagttacggtcggtactgataagtctcattcctccggcgacgataagaatggatatgctgaatctctcattgaagaagaagaaggcatcaatgaccataacgttgttcaaaaatgcgctgaaattcaaaacgctatctctgaaggagcaacctcatttctctttacgatgtaccagtatgttggtgttttcatggttgctttcgcaattttgatcttcgttttcctcggctctgttgagggattcagcacgaagaaccagccgtgcacatatgacagcaccaaaacttgcaagccagctcttgcaactgctgtcttcagcactgtatcatttctgcttggtgctgttacctctgtggtgtccgggttccttggaatgaaaattgccacatatgcaaatgcccgaactaccttggaggctagaaaaggtgttgggaaggcttttattgttgcatttagatctggtgctgtgatgggtttccttcttgctgcaaatggtcttttggttttatttataaccatccttctatttaagatgtactacggtgatgactgggaaggtctatttgaggctataactggttatggtcttggtggatcttcaatggccctttttggtagagttggtggaggtatttataccaaagcagcagatgttggagctgatcttgtgggcaaggtggagaggaacattcctgaagatgatcctagaaacccagcggtgattgctgacaatgttggagacaatgtcggagatattgctggtatgggatcagatctttttggatcttatgcagagtcatcctgtgcagctcttgttgttgcttcaatctcatcctttggtgtcaatcatgagcttactgctatgctatatccccttctcgtcagctctgtcggcatccttgtgtgtttgcttaccaccttatttgcaactgatttctttgaagtcaaggctgttaaggaaattgagccagcattgaagaagcaactcattatctcaaccattctcatgactattggaattgcttttgttagttggattgcccttccatcgaccttcacaatattcaattttggagttcagaaagaagtaaagaactggcaattgttcttgtgtgttggagttggtttgtgggctggactcattattgggtttgtcactgagtactataccagcaatgcctacagccccgtccaagatgttgctgattcatgccgcactggtgctgccaccaatgtcatctttggccttgccttgggttacaaatccgtcatcattcccatttttgccattgcaatcagtatatttgttagcttcagctttgctgcaatgtacggcattgcagttgctgcccttggaatgctgagcactatagccactggtttggcaattgatgcatatggtcccattagtgataatgcaggaggtattgctgagatggctggaatgagccacagaatcagagagagaaccgatgcacttgatgctgcaggaaacaccactgctgctattggaaagggatttgctattggttctgctgcacttgtgtctcttgccctctttggggcgtttgtcagccgggcagcaatttccactgtagatgtcttgactcctaaagtctttattggtctgctagtcggtgcaatgcttccttattggttctccgccatgacaatgaagagtgttggaagtgctgctcttaagatggttgaggaagtgcgtaggcaattcaacaccatccctggtctcatggaaggaactgccaagcctgactatgccacctgtgtcaagatctccacagatgcatcgatcaaggagatgattccacctggtgccctcgtcatgctcactccattgattgttggtatcttgtttggcgtcgaaacactttctggtgttcttgcaggatctctcgtctctggtgtacagattgccatttctgcatccaacactggtggtgcctgggacaacgctaagaagtacatcgaggctggagcctcagaacatgctaggactcttggccccaagggatctgatgcacacaaagctgctgtaattggtgacactgttggtgaccctctcaaggacacatctggaccatcattgaacattcttatcaagctgatggctgtcgagtccctcgtgtttgctcccttctttgccacgcacggtggtcttctcttcaagttattttaatgcaaccaactcctatgactgtatgatgaatctctattattcctcttctcttcccattcaaacttccgtttcaatcatttttcgtgtttttagtatctagaatgttgggattagcatatggtgttaggttgtgatgatgatggtaagggtgaagtgattttgcagagttcagaagaaacatcaaatgttctttcctagagtaattgtatcagttttttctctcctcttaataccttcttgtcattgccctttttgggtattcaatttttcaagacttctttatctgcatttctcttttctttctccatacataaaactgacattttcagctcaatattttgtaagaacttttgtgtgtgttacgtcgagcctattatacatattatacgctagtcactt

SEQ ID NO: 1640 - DNA, 4094 bp, Solanum lycopersicum
actgtgaaacctcacaaatttttcatttatcttttctctctatttttttctttatttttattggccggagctccggtggtctgccggtcggagtttatttttgtcggcaaagatgggagtgactattttaacagatctcggaatggagattttgattccggtatgtgccgttgtcggcatagctttctcgctcttccagtggtatctcgtctccaaagttacggtcggtactgataagtctcattcctccggcgacgataagaatggatatgctgaatctctcattgaagaagaagaaggcatcaatgaccataacgttgttcaaaaatgcgctgaaattcaaaacgctatctctgaaggagcaacctcatttctctttacgatgtaccagtatgttggtgttttcatggttgctttcgcaattttgatcttcgttttcctcggctctgttgagggattcagcacgaagaaccagccgtgcacatatgacagcaccaaaacttgcaagccagctcttgcaactgctgtcttcagcactgtatcatttctgcttggtgctgttacctctgtggtgtccgggttccttggaatgaaaattgccacatatgcaaatgcccgaactaccttggaggctagaaaaggtgttgggaaggcttttattgttgcatttagatctggtgctgtgatgggtttccttcttgctgcaaatggtcttttggttttatttataaccatccttctatttaagatgtactacggtgatgactgggaaggtctatttgaggctataactggttatggtcttggtggatcttcaatggccctttttggtagagttggtggaggtatttataccaaagcagcagatgttggagctgatcttgtgggcaaggtggagaggaacattcctgaagatgatcctagaaacccagcggtgattgctgacaatgttggagacaatgtcggagatattgctggtatgggatcagatctttttggatcttatgcagagtcatcctgtgcagctcttgttgttgcttcaatctcatcctttggtgtcaatcatgagcttactgctatgctatatccccttctcgtcagctctgtcggcatccttgtgtgtttgcttaccaccttatttgcaactgatttctttgaagtcaaggctgttaaggaaattgagccagcattgaagaagcaactcattatctcaaccattctcatgactattggaattgcttttgttagttggattgcccttccatcgaccttcacaatattcaattttggagttcagaaagaagtaaagaactggcaattgttcttgtgtgttggagttggtttgtgggctggactcattattgggtttgtcactgagtactataccagcaatgcctacagccccgtccaagatgttgctgattcatgccgcactggtgctgccaccaatgtcatctttggccttgccttgggttacaaatccgtcatcattcccatttttgccattgcaatcagtatatttgttagcttcagctttgctgcaatgtacggcattgcagttgctgcccttggaatgctgagcactatagccactggtttggcaattgatgcatatggtcccattagtgataatgcaggaggtattgctgagatggctggaatgagccacagaatcagagagagaaccgatgcacttgatgctgcaggaaacaccactgctgctattggaaagggatttgctattggttctgctgcacttgtgtctcttgccctctttggggcgtttgtcagccgggcagcaatttccactgtagatgtcttgactcctaaagtctttattggtctgctagtcggtgcaatgcttccttattggttctccgccatgacaatgaagagtgttggaagtgctgctcttaagatggttgaggaagtgcgtaggcaattcaacaccatccctggtctcatggaaggaactgccaagcctgactatgccacctgtgtcaagatctccacagatgcatcgatcaaggagatgattccacctggtgccctcgtcatgctcactccattgattgttggtatcttgtttggcgtcgaaacactttctggtgttcttgcaggatctctcgtctctggtgtacagattgccatttctgcatccaacactggtggtgcctgggacaacgctaagaagtacatcgaggctggagcctcagaacatgctaggactcttggccccaagggatctgatgcacacaaagctgctgtaattggtgacactgttggtgaccctctcaaggacacatctggaccatcattgaacattcttatcaagctgatggctgtcgagtccctcgtgtttgctcccttctttgccacgcacggtggtcttctcttcaagttattttaatgcaaccaactcctatgactgtatgatgaatctctattattcctcttctcttcccattcaaacttccgtttcaatcatttttcatcaaaaatcaagaatctttctgtatagacaacattgtattgtatataccatgttgtctttcaccccacttcaatccaagccaaccccaacttccaattctaatcgtttctctaatctcaccaaccccactagcagtaccagccgccgccggcatttctctgtctcttctccgtcacaagtcagtcaccaccatggacgccgtcgtctgagtatcaaagctattgatgctgcacagccttatgattatgaagcattggtgtcaaatcaatatgctcagtcaggtaggctaaaaattgctatagtggggtttggcaattttggtcagtttcttgcaaaatcctttgttagtaaaggtcattttgtgttggctcattcaagaacagattattcccaaattgctaattctttaggggtttccttttttcaagatccacatgatctttgtgagcaacaccctgatgttattgtactttgtacttcgattatttcaactgagactgttcttaggtcattaccaattcaaaggctgaagaggaacacattgtttgttgatgttttatcagtcaaagaatttccaaaaaatatttttcttcaagttttgccaacccattttgatattctttgtactcatcccatgtttggacctgaaagtggtaaggatagttggaaagatttgatctttatgtttgacaaagttcgaattggtgaagggagatcaagaacagcaagggttgacaagtttcttgatatatttgagaaagaagggtgtaggatggtgccaatgacatgtgctgagcatgataagcatgctgcaggttcacagttcattacacatacaatggggagggtgttggagaagttgggtttggagtcaactcctattaatactaaagggtatgagactttgttgaatctggtggataatactgctagtgatagctttgacttgtactatgggctgtttatgtacaataaaaatgctatggaggagttggaaagacttgacttggcttttgaggctttgaagaaggagttattcgggcatttacatgatttgttgaggaagcaattgtttgggaaggcggaggaagcaggacagaggcgtgtcttatccaagttgcccaggaatggctatgcgctgccagccccttcatcggatgctgttaaacctgagaacaactgagggaattatgaatcttggtatgtctgcattttttgttggtgacctctagctttgggattcaaaggatgtattattaacacgatatttaatgtggcaattcaataatagcaatgtaactatgctacaaggacatactcattctgttgtttatcctgctgttaatgagaagattaaagagaagcactagttcaaccttggagttggggttaggtgttgagttgtaagatcatcaaaagaactatattttgacctgtaacttcgtccttttgatattttaggaacatttgtggtaggagagtgacttttgatgtgattacatttcagatgttgaagaatgtagtttaggatggaaattcagttaacagttatctatttgttgctggataaactagtatgtatctcatgtatttatgtttc

SEQ ID NO: 1641 - DNA, 2781 bp, Tripterygium wilfordii
cggctccacctctacgacttccttcgcctccataaccatctctctttcattctctctctttcacacactttcgttgatttggtttttgtatttcaagtcatgggttcggcgattatgccagatctcgctaccgagatcttgattccggtgtgtgccgttataggcatagccttcgcgttggttcagtgggttatagtctctcgcgttaagctcacaccgggaggagactctccggcgaacagtggagggaagaatgggtactctgattacctcatcgaggaggaggaaggactcaatgaccacaacgtcgtcctcaaatgcgctgaaattcagactgcaatttctgaaggggcaacctcattcctttttacggaatatcagtatgtcgggatttttatggttgcttttgcaatcttgattttccttttccttggctctgttaatgggttcagcacaaagagccagacttgcacgtacgacccacaatcaatgtgcaagccagctcttgccactgctgccttcagtacggtatccttcctgcttggtgctgtcacttcagtggtttctggcttcctgggtatgaaaattgccacttatgcaaatgccagaaccaccttggaggcaagaaaaggagttgggaaggcctttatcactgcgtttagggctggcgctgtcatgggttttctccttgcagcaagtggacttttggtactctacattaccatcaacctcttcaagctgtactatggtgatgactgggaaggcctttttgaggctataactggctatggtcttgggggttcctccatggctctcttcggcagggttggtggaggtatctacaccaaagccgctgatgttggcgctgatcttgtaggcaaggttgaaagaaacattcctgaggatgacccaagaaatccagctgtgattgcagacaatgttggtgataatgttggggatatagctgggatgggttctgatctctttggctcatatgctgagtcatcttgcgctgccctagtcgttgcttccatctcctcattcgggattaatcatgatttgactgcaatgttgtatcctctaatcgttagctcagttggtattgttgtttgtttgttcacaaccttgtttgcaacggatttcttcgaggtcaaagctgttaatgagattgagccggcattgaaaaagcagctcatcatctcaacagttctgatgactgttgcagttggaattgttacttggatatccgttccatcttcattcaccatcttcaactttggaacccaaaaagtagtaaagaactggcaactcttcttatgtgttgctgttggtctttgggctggactcattattggatttgttactgagtattataccagcaatgcatacagtcctgtacaagatgttgctgattcctgccgaactggagcggcaactaacgtcatatttgggctcgcattgggatacaaatcggttattattcccatatttgctattgcagttagcatgtttgttagttttagctttgctgccatgtatggtgttgcggtagctgcccttggaatgcttagcaccattgccactgggttggctattgatgcttatggtcccatcagtgataatgctggaggcattgctgagatggctggcatgagccacagaatccgagagagaactgatgcccttgatgccgctggaaacacaactgctgctattggaaagggttttgccattggttctgctgctctggtgtccttggctctgtttggtgcctttgcgagccgtgcatctatcacgacagttgatgtgctctctccaaaggtttttattggtttgattgtgggtgctatgcttccttactggttctccgccatgacaatgaagagcgtgggtagtgcagctttgaagatggttgaggaagtccgtaggcaattcaacaccatccctggtcttatggagggcactacaaagcctgactatgctacgtgtgttaagatatccactgacgcttctatcaaggagatgatcccacctggtgcccttgttatgcttaccccaatcattgttgggatccttttcggtgtagaaactctggctggtgttcttaccggagctctcgtgtctggtgtacagattgccatctctgcttccaacactggtggtgcttgggacaatgccaagaagtacattgaggcgggtgcttctgagcatgcgcgaacccttggtcccaaaggatcagatgcacacaaggcagctgttattggtgacaccgttggagaccctctgaaagacacatctggaccttcactcaacatcctcatcaagctaatggctgttgaatcactcgtgtttgccccgtttttcgctacacatggtggcatcctctttaagatattataaatcattggatcaaatgtggatggtctactggttaccgtctgccggatctttgttcctccctcatgttaaaaactattatgtactttgtagttcatggttgactctttaattggctgcaaatttccctcccaaggggttgatgacaaggacgatgacgatgaccacgaggagtcggtgctaggaagagttggtaactcgatttctttttgggtcttggtagatcaattcatttctgaatcccttacgttccttctctccttttgttctgtaatagattttgactcctggtattgtaatctgggttcttacctaattggtctagatgctacatattgttctctttttactaaatatcatatcgaagaacctgaaaaacttcaa

SEQ ID NO: 1642 - DNA, 2524 bp, Vinca minor
tctcccccatttttatccagtccggcaagttttttagggtttcggcgttgaagaatgacgtcagcattattaccagatctaggaactgaaatcgtgattccggtgtgtgctattatcggaatcgccttctcattaatccagtgggtcatagtttcccgcgtgaaactctcgccggaacaaaacggttcgaccaacaacagtaaaaatggttacaatgattacttaattgaggaagaagaaggaatcaatgaccacaacgttgtcgctaagtgtgctgagattcaaaacgccatctccgaaggtgctacatcatttttgtttacggaatacaaatatgttggttttttcatgtctgcttttgcgatccttatcttcctcttcctgggatccgttgagggcttcagcacaaagagccagccttgcacatataacaaggagaaaacgtgcaagccagcccttgcaactgctgtatttagcactgtatccttcgttctcggtgctgttacctcagttgtttctggttttctcgggatgaaaattgctacatatgccaatgcaaggaccactttggaggcgagaaaaggtgttggcaaagcttttatcgttgcgttcaggtctggtgctgtaatggggtttctccttgcagcaaatgggcttctggtgctctacattgctatcaacctctttaagttgtactatggtagtgactgggaggggcttttcgaggcaattactggctatggtcttggcggatcttccatggctctctttggcagagttggtggaggtatctataccaaggctgctgatgttggtgctgatcttgtcgggaagctcgaaaggaacattcctgaggatgatcctagaaatccggctgtgattgctgacaatgtgggggataatgttggtgatattgctggaatgggttctgatctgttcggttcttacgctgaagcatcatgtgctgctcttgttgttgcttctatttcttcatttgggatcgatcatgacttcactgcaatgttatttccattgctgattagttccatgggaattattgtctgcttgattacaactctttttgcaaccgacttctttgagattaaggctgtaaaagaaattgaaccggcactcaagaatcagcttattatttccactgctcttatgactgttggagttgcaatagttacatggacttgcttaccttcttcgtttacaattttcaacttcggtactcagaaagttgtcaagaactggcagatattcttgtgtgttggagtgggtctttgggccgggcttattattggttttgttacagagtattataccagcaatgcttacagtcctgtgcaagatgtagctgattcctgcaggactggagctgcaacaaatgttatttttggacttgccttgggctacaaatcagtgatcattcccatttttgctatcgccataagtatttttgttagtttcagttttgctgccatgtacggaattgctatggctgcccttggaatgctgagcacaattgctactgggttggctattgatgcttatggccccatcagcgataatgctggaggcattgctgagatggctggaatgagtcacagaattcgtgagagaactgatgctcttgatgccgctggaaacaccactgctgccattggaaagggttttgccattggatctgctgcccttgtttctctggcactgttcggtgcctttgtcagccgagcagctatctccacagttgatgtcttgacccctaaggtcttcattggtttaattgttggtgccatgcttccgtactggttctctgctatgacaatgaagagtgttgggagtgcagctctaaagatggttgaggaagtccgcaggcaatttaatactatccccgggctaatggagggcactgccaagcctgactatgccacctgtgtgaagatatctactgatgcatctctcaaggagatgattcctccgggtgctcttgtcatgcttacacctctcattgtcggtactttctttggtgtggagaccctctccggagtgcttgctggttcccttgtttctggtgtccagatagcaatttctgcttcaaacaccggtggtgcttgggacaatgcaaagaagtatattgaggccggtgcttccgagcatgctagaacccttggacctaagggatctgaaccccacaaggctgctgttatcggagatactattggggatcctctcaaggacacttcaggtccatcactcaacattctcatcaagttgatggctgtcgagtctcttgttttcgctcccttctttgcaactcacggtggtttgcttttcaagctatggtaaaaaaagagagggaggagctgctgctctcagcttcttttccttgtagcattattcttattatctttgccattctatcaccactcttttgtctcaaaattttccatcaacgttttccttttaaattttagtctttagttggttggtcgggtattatttttgtcgagttgatgat

SEQ ID NO: 1643 - DNA, 2693 bp, Gossypium hirsutum
tgttgtcggagtttgcgacggagatcgtggtgccagtgtgcgccgtgattggaattgctttctcgttggtgcagtggctgttggtgtcgcgcgtgaagcttaacccggagcggcatgcatcggggaatagcaacaagaacggttacagtgattacttgattgaggaagaggaaggacttaatgaccccagtgtcgtcaccaagtgcgctgaaattcaaagcgctatctccgaaggtgcaacatcctttcttttcactgaatatcagtatgttggcatcttcatggttgcttttgctatcttgatattccttttcctgggttctgttgagggcttcagctcaaagagccagccttgcacctatgataaggagaagacctgcaaaccagctcttgccactgctatcttcagtaggatatccttcttgcttggtgctatcacctctgttctttctgggttccttgggatgaaaattgctacatatgccaatgcaagaacaaccttagaagcaagaaagggtgttggaaaggcttttattgttgcatttagatctggcgcagtaatgggttttctgctcgctgccaatggcttgttggtgcttttcgttgccatcaatctattcaagctgtactacggtgatgactgggaaggcctttttgaggctattactggttatggtcttgggggatcctctatggcactgtttggaagagttggtggtggtatatatacaaaggctgctgatgtcggtgctgatcttgtaggaaaggttgaaaggaacattccagaggatgacccaagaaacccagctgtcattgccgacaatgttggcgataatgttggggatattgctggtatgggttctgatctatttggctcatatgctgaatcctcctgtgctgctcttgttgttgcttctatatcctcttttggaataaaccacgagttcactgccatgttgtatcctctgctcattagttctgttggtattcttgtctgtttgatcacaaccctatttgctacggatttcttcgaaatcaaggctgtcaaagaaatcgaaccagctttgaagaagcagcttattatatctactgttcttatgactgtggggattgcaattgttacttgggttggtgtgccatcgtccttcaccatttacaattttggggatcagaaagttgttaagaactggcaactatttttgtgcgttggtgttggtctctgggctggacttattattggttttgttactgagtactacaccagtaatgcttacagtcccgtgcaggatgttgctgattcctgcaggacaggagcagctaccaatgttatatttggccttgctttaggatacaaatctgtgatcatcccaatttttgccattgcaatctgcatttttgttagttttagctttgctgccatgtatgggattgcagttgctgcccttggaatgttaagcaccattgcaactgggttggccattgatgcttatggtcccatcagtgacaatgctggaggcattgctgagatggctggcatgagccatcacattcgtgagagaactgatgcactagatgctgctggaaacactacagctgccattggaaagggatttgccattgggtcagcagcattggtgtcattggctctatttggtgcctttgtgagccttgcagctatctctactgttgatgtcttgaccccgaaggttttcattggtttaatagttggtgccatgcttccctactggttctctgctatgaccatgaaaagcgtggggagtgcagctttaaagatggttgaggaggttcgcaggcagttcaacaccatccctggtctcatggagggtcgtgccaagcctgattatgctacctgtgtcaaaatctcaactgatgcctctatcaaggagatgattcctcctggtgcccttgttatgcttactcccctaatcgttggaactttctttggtgttgagactcttgccggtgtccttgctggtgcccttgtttctggtgttcagattgcaatatctgcttccaacactggtggtgcatgggataatgccaagaagtacattgaggctggtgcctcagagcacgcgaggaccctgggtccaaaaggatcggatcctcacaaggcagctgtcattggtgacacggttggtgatccactcaaggatacctctggcccttcactcaacatcctgatcaagcttatggcagtcgagtcactcgtatttgctcccttctttgccactcacggtggcttgcttttcaagatcttttagaggggatgggcggaaacagcagtagggagggtgacttgttagttacaggccctatgtaagagtgttgttcctgttcacccattaagtttctgtatccgtccaaactctcatagttagcgaagcttagctttagtcattgctatttttgataggttgatatcgatgataactgagatatgggttaggttgatcaccgaaaacgatcattgttatcgtggacgagtcaaggtgggatatcttacttttccagttctagaacagcttttgcttaattttgaaattttgtactcgcaaaaaatcttttccagcatttaaccttaatgatatttagatatttaaaaaaaaaacttaaaatggcatgttgcaagaattatgtatcaaaatggtacattcaaatgggtggagggt

SEQ ID NO: 1644 - DNA, 2714 bp, Solanum lycopersicum
gaacaaatctgctatctcttcatcttcttctcttatttatttatttttcccattcacgtttttttttcttccatctctctcacttttttcactattttctctctctaaatcacactttctctctctctagatttgtcggtgatgggaacaacaattctgccagatctcggaacggagattctgattccggtgtgtgcagttatcggaatcggatttgcgttggtacaatgggtgattgtttcgaaagttacggtatcgactgatggtaaatcgtcatctcccggtgccggcgctgatggtaagaatggatatgctgaatcgcttattgaagaagaagaagggattaatgaccatagcgttgttcgtaagtgtgctgaaattcaaaatgccattgctgaaggtgcaacctcgttcctgtttacggaataccagtatgttggtgttttcatggttgcttttgcattactgatctttctattcctcggttctgttgagggtttcagcacaaagagccaggaatgtacgtatgacagttccaaaatgtgcaagcctgctcttgcaactgctgtctttagcaccatatccttcttgcttggtgctattacctccgtgatttccggatttcttggaatgaaaattgcaacatatgcaaatgcacggactacattggaggctagaaagggtgttggtaaggctttcattgttgcattccgttctggtgctgtgatgggcttccttcttgctgcaaatggtcttcttgttttgtacatcgcaatcaacgtattcaagttatactatggtgatgactgggaagggctatttgaggctataactggttatgggcttggtgggtcatcaatggccctttttggtagagttggtggaggtatatacactaaagctgcagatgttggagctgatcttgtgggcaaggtggagaggaatatccctgaagatgatcctagaaatccagcggttattgctgacaatgtcggtgacaatgttggagatattgctggaatggggtcagatctatttggatcttatgcagagtcatcgtgtgctgccctagttgttgcttctatctcttctttcggggtcaaccatgagttcacagccatgctatatcctcttcttatcagttctgtgggtatccttgtgtgtttgcttacgaccttatttgcaactgatttctttgaagtcaaggctgtaaaagaaattgagccagcattgaagaagcaacttgtaatctcaactgttctcatgacaattggaattgctcttgtttcttggactgctcttccctctaccttcacaatattcaattttggaatacagaaagaagttcagagctggcagttgttcttatgcgttggagttggtctgtgggctggacttatcattggatttgttaccgagtactataccagcaatgcttacagccccgtgcaagacgttgctgattcttgccgcactggtgctgctacaaatattatttttggccttgccttgggctacaaatcagttatcattccaatttttgccatagcaatcagcatttttgttagcttcagttttgctgcaatgtacggcattgcagttgctgctctcggaatgctgagcacgatagctactggtttggcaattgacgcctatggtcccatcagtgacaacgcaggaggcattgccgagatggctggaatgagccacagaataagagaaagaaccgatgccctagatgctgcaggaaacaccactgctgctattggaaagggattcgcgattggatctgctgctcttgtatctctagccctctttggtgcatttgtgagtcgtgcaggaatttctactgtagatgtcttgacacctaaagtattcattggcttgctcgtcggtgcaatgcttccttactggttctctgccatgacaatgaagagtgtgggaagtgctgcccttaagatggttgaggaagtgcgcaggcaattcaacaccatccctggactcatggaaggaaccgcaaagcctgattatgccaactgcgtcaagatctccaccgatgcatcaatcaaagaaatgatcccacctggtgcccttgtcatgcttactccattgattgtaggaatattattcggagtggaaaccctgtccggtgtacttgcaggatctctggtctccggtgtacagattgccatttctgcatcaaacaccggtggtgcttgggacaacgccaagaagtacatcgaggctggaacttcagaacacgcgaaaactcttggtcccaagggatccgatccacacaaggctgctgtcattggtgacactgttggtgaccccctcaaggatacatctggaccatcattgaacattcttatcaagctgatggctgtggagtcactcgttttcgctcctttcttcgccacccacggtggtctgctcttcaagatgttttaagacaaaaccaactcaactgcatcgaatttccatctggtgatgtttttactccttttgcctactttatttcgagcaatttttcgtgttcatcgatagattaggatatgtaggtttgtggagaactagtgatgatagcgaaatgtttatgaagagtttagaaaaatccaacattcttttcttaaagagtaaaatgtatcctatatagatagtatatagtatatttatacttttagagaagttgaaaattttgtaagcttttattt

SEQ ID NO: 1645 - DNA, 2468 bp, Solanum lycopersicum
gaacaaatctgctatctcttcatcttcttctcttatttatttatttttcccattcacgtttttttttcttccatctctctcacttttttcactattttctctctctaaatcacactttctctctctctagatttgtcggtgatgggaacaacaattctgccagatctcggaacggagattctgattccggtgtgtgcagttatcggaatcggatttgcgttggtacaatgggtgattgtttcgaaagttacggtatcgactgatggtaaatcgtcatctcccggtgccggcgctgatggtaagaatggatatgctgaatcgcttattgaagaagaagaagggattaatgaccatagcgttgttcgtaagtgtgctgaaattcaaaatgccattgctgaaggtgcaacctcgttcctgtttacggaataccagtatgttggtgttttcatggttgcttttgcattactgatctttctattcctcggttctgttgagggtttcagcacaaagagccaggaatgtacgtatgacagttccaaaatgtgcaagcctgctcttgcaactgctgtctttagcaccatatccttcttgcttggtgctattacctccgtgatttccggatttcttggaatgaaaattgcaacatatgcaaatgcacggactacattggaggctagaaagggtgttggtaaggctttcattgttgcattccgttctggtgctgtgatgggcttccttcttgctgcaaatggtcttcttgttttgtacatcgcaatcaacgtattcaagttatactatggtgatgactgggaagggctatttgaggctataactggttatgggcttggtgggtcatcaatggccctttttggtagagttggtggaggtatatacactaaagctgcagatgttggagctgatcttgtgggcaaggtggagaggaatatccctgaagatgatcctagaaatccagcggttattgctgacaatgtcggtgacaatgttggagatattgctggaatggggtcagatctatttggatcttatgcagagtcatcgtgtgctgccctagttgttgcttctatctcttctttcggggtcaaccatgagttcacagccatgctatatcctcttcttatcagttctgtgggtatccttgtgtgtttgcttacgaccttatttgcaactgatttctttgaagtcaaggctgtaaaagaaattgagccagcattgaagaagcaacttgtaatctcaactgttctcatgacaattggaattgctcttgtttcttggactgctcttccctctaccttcacaatattcaattttggaatacagaaagaagttcagagctggcagttgttcttatgcgttggagttggtctgtgggctggacttatcattggatttgttaccgagtactataccagcaatgcttacagccccgtgcaagacgttgctgattcttgccgcactggtgctgctacaaatattatttttggccttgccttgggctacaaatcagttatcattccaatttttgccatagcaatcagcatttttgttagcttcagttttgctgcaatgtacggcattgcagttgctgctctcggaatgctgagcacgatagctactggtttggcaattgacgcctatggtcccatcagtgacaacgcaggaggcattgccgagatggctggaatgagccacagaataagagaaagaaccgatgccctagatgctgcaggaaacaccactgctgctattggaaagggattcgcgattggatctgctgctcttgtatctctagccctctttggtgcatttgtgagtcgtgcaggaatttctactgtagatgtcttgacacctaaagtattcattggcttgctcgtcggtgcaatgcttccttactggttctctgccatgacaatgaagagtgtgggaagtgctgcccttaagatggttgaggaagtgcgcaggcaattcaacaccatccctggactcatggaaggaaccgcaaagcctgattatgccaactgcgtcaagatctccaccgatgcatcaatcaaagaaatgatcccacctggtgcccttgtcatgcttactccattgattgtaggaatattattcggagtggaaaccctgtccggtgtacttgcaggatctctggtctccggtgtacagattgccatttctgcatcaaacaccggtggtgcttgggacaacgccaagaagtacatcgaggctggaacttcagaacacgcgaaaactcttggtcccaagggatccgatccacacaaggctgctgtcattggtgacactgttggtgaccccctcaaggatacatctggaccatcattgaacattcttatcaagctgatggctgtggagtcactcgttttcgctcctttcttcgccacccacggtggtctgctcttcaagatgttttaagacaaaaccaactcaac

SEQ ID NO: 1646 - DNA, 2756 bp, Orobanche aegyptiaca
ttttcctgctaagctcttgctctcaaagtttaccttttctcattttctttttatatttgcattttctcttcgcccggtgtattccggtaagaatagtcaggtttccggtgagtaatggctctgctgccagatctggggacggaaatcgtgattccggtgtgcgccatcatcggcatcgtcttctcgctcgtgcagtggttactggtgtctagagtcaagctctcgccggagaaaggtggtgcgtcggctgcaaagaacggcaagactgggcacaatgattacttgattgaggaggaagacggcatccacgaccagaacgttgtcgctaagtgtgccgagatccagaacgctatatctgagggtgcaacgtctttcctgtttactgaatatcaatatgtgggcattttcatgattgcttttgcaatcctcatcttcctgttcctgggctcggttgagggtttcagcacaaagagtcagccttgcacatatgaaccggagaagttgtgcaagcccgcccttgcaactgccatcttcagcacggtatccttcttgcttggtgccatcacttctgtcgtttctggtttccttgggatgaaaattgcaacctatgcaaatgcaaggacaacattggaagccagaaaaggtgtcggaaaagcgtttatcgttgcatttagatctggcgcagtcatggggtttctccttgctgcaaatggtctattggttctttacattgttatcaatttgttcaagctctactatggtgatgattgggaaggactttttgaggcaattactggatatggtctcggtgggtcctccatggctttgtttgggagagtcggaggcggtatttacaccaaagctgctgatgttggtgctgatcttgttgggaagcttgagcggaacattccggaagatgaccccaggaatccggctgtgattgctgacaatgttggtgataatgttggagatattgctggaatgggatctgatctttttggttcatatgctgaatcatcgtgtgctgctcttgttgttgcctccatatcctctttcgggatgacgcacgacttcaccgcaatgtgttacccgttgctcattagttctatgggaatcctggtttgcttaatcactactcttttcgccacggacttttttgagatcaaggctgtcaaggaaatcgagccagcattgaaaaaacagcttattatctccactgttcttatgactgtgggaattgcaattgtcacatggacttgcctgccatcatcctttacaattttcaatttcggtgctcaaaaggttgtgaagaattggcaactcttcctatgtgtttgtgttggtctttgggctggacttatcattgggtttgtgaccgagtattacaccagcaatgcttacagccctgtgcaagatgttgctgattcttgccgaactggtgctgccactaatgttatatttggtcttgcattgggatacaaatctgttatcattcccatttttgccattgcaattagcattttcgtcagcttctcctttgctgctatgtatggtattgcggtggctgctttgggtatgctaagcaccattgccactggattggctattgatgcttatggccctatcagtgataatgctggaggcatagctgagatggctgggatgagccacaggattcgggagagaaccgatgctcttgatgctgctggcaataccactgctgctattggaaagggttttgccattggatctgctgcccttgtttcattggcgctttttggcgcctttgtgagccgtgcagggatatcgactgtagatgtcttgacccctaaagtcttcataggtttgattgttggtgccatgcttccgtactggttttctgccatgaccatgaagagtgtcggtagtgccgctctgcaaatggttgaagaagttcgtaggcagttcaacactattcctggtctgatggagggtctcgccaagcctgattatgcaacatgcgtgaagatttcgactgatgcatctattaaggagatgatcccacccggcgcccttgtcatgcttacccctcttattgttgggacattttttggtgttgagactctgtctggtgttcttgctggttctcttgtttctggtgtgcagattgcaatttctgcatcaaatactggtggtgcatgggataatgcaaagaaatatattgaggctggtgcatccgaacatgcgagaactcttggtcccaagggatcagaaccacacaaggctgccgtaattggtgacaccatcggagaccctctcaaggacacttcaggtccttctctcaacatccttataaagctcatggcagtcgagtcgctcgtgtttgctcctttctttgccactcacggtgggctgctgtttaagatgttctaagaaaaatggatgttttgggcaaaaaagtccgtagggtctcggcctcttttttccttttggaagcatactcttcacctccgaagtgtctgataaattagatcgtagctactgaaatgatatatttttgatgagctgataatgataataattatgttgtggtagggagggatgaggataaaaatctgcatccttgtcattagtagagggtgtcggatcaaaatgttctagttctgtttcaacttcaatctataaaaaacttgttttgtaattttctttgtatgggaataaattttgctcgggaaaagacagcgacacgtgagtggaggtaaccagtttatggacta

SEQ ID NO: 1647 - DNA, 2713 bp, Solanum phureja
gaacaaatctgccatcttttcatcttcttctcttatttaatttttttttcccattcacgttttttttctccatctcactcttatctctctctaaatcacactttctctctctagatttgtcggtgatgggaacaacaattctgtcagatctcggaacggagattctgattccggtgtgtgcactcatcggaattggatttgcgttagtacaatgggtgattgtttcgaaagttacggtttcgactgatggtaaatcgtcatcttccggtgccggcactgacggtaagaatgggtatgctgaatcgcttattgaagaagaagaagggattaatgaccatagcgttgttcacaagtgtgctgaaattcaaaatgccattgctgaaggtgcaacctcgttcctgtttacggaataccagtatgttggtgttttcatggttgcttttgcaattctgatctttctattccttggttctgttgagggtttcagcacaaagagtcaggcatgtacgtatgacagctccaaaatgtgcaagcctgctcttgcaactgctgtcttcagcaccatatccttcttgcttggtgctgtaacctctgtgatttccgggtttcttggaatgaaaattgcaacatatgcaaatgcacggactacattggaggctagaaagggtgttggtaaggctttcattgttgcattccgttctggtgctgtgatgggcttccttcttgctgcaaatggtcttcttgttttgtacattgccatcaacgttttcaagttatactacggtgatgactgggaagggctatttgaggctataactggttatgggcttggtgggtcatcaatggccctttttggtagagttggtggaggtatatacactaaagctgcagatgttggagctgatcttgtgggcaaggtggagagaaacatccctgaagatgatcctagaaatccagcggttattgccgacaatgttggtgacaatgttggagatattgctgggatggggtcagatctatttggatcttatgcagagtcatcgtgtgctgccctagttgttgcttctatctcttcttttggggtcaaccatgagttcacagccatgctatatcctcttctaatcagttctgtgggtatccttgtgtgtttgcttacgaccttatttgcaactgatttctttgaagtcaaggctgtaaaagaaattgagccagcgttgaagaagcaacttgtaatctcaactgttctcatgacaattggaattgctcttgtttcttggattgcccttccatctaccttcacaatattcaattttggaattcagaaagaagttcagagctggcagttgttcttatgcgttggagttggtctgtgggctggacttatcattggatttgttaccgagtactataccagcaatgcttacagccctgtgcaagacgttgctgattcttgccgcactggtgctgccaccaatattatttttggccttgccctgggctacaaatcagttatcattccaatttttgccatagcaatcagcatttttgttagcttcagttttgctgcaatgtacggcattgcagtcgctgctcttggaatgctgagcaccatagctactggtttggcaattgacgcctatggtcccatcagtgacaatgcaggaggcattgctgagatggctgggatgagccacagaatcagagaaagaaccgatgcccttgatgctgcaggaaacaccactgctgctattggaaagggattcgccattggatctgctgctcttgtatctctggccctctttggtgcatttgtgagccgtgcaggaatttccactgtagacgtcttgacacctaaagtattcattggcttgcttgtcggtgcaatgcttccttactggttctctgccatgacaatgaagagtgtgggaagtgctgcccttaagatggttgaggaagtgcgcaggcaattcaacaccatccctggactcatggaaggaaccgcaaagcctgattatgccaactgcgtcaagatctccaccgatgcatcaatcaaagaaatgatcccacctggtgcccttgtcatgcttactccattgattgtagggatattattcggtgtggaaaccctgtccggtgtgcttgcaggatctctcgtctccggtgtacagattgccatctctgcatcaaacaccggtggtgcttgggacaatgccaagaagtacatcgaggctggagcttcagaacacgcgaaaactcttggtcccaagggatccgatccacacaaggctgctgtcattggtgacactgttggtgaccccctcaaggacacatctggaccatcattgaacattcttatcaagctgatggctgtggagtcactcgttttcgctcctttcttcgccacccacggtggtctgctcttcaagatgttttaagacaaaagcaactcaactgcatcgaattttcgtctggtgatgtttttactccttttgcctacgttatttcgagcatttttcatgttcatcgataggtaggatgtaggtctgtggagaactagcgatgatagcgaaatgtttatgaagagtttagaaaaatccaactttctttttcttaaagagtaaaatgtatcttatatagtatatagtatatatatacttttaaagaagttgaaaattttgtaagcttttatttgttgttattttgttggtcttta

SEQ ID NO: 1648 - DNA, 2895 bp, Trigonella foenum-graecum
actctctctctatctctaaccccatccactgtctctcccgtcatcattccaaccctatcttctctctcccacatataaaaccctcatcaccccttcaaccatttcacacttcgttccttcttcttccttcattttctcgtttcttttcgttatttctcgttcctctctctgtttctcgccatgggagcagtaattctcccagatctcgctactcagattttgatccctgtttgcgctgtcattggaattgcttttgcgcttttccaatggcttctcgtttccaaagttaagctcactgccggaagagactcttcttctgatgctccagggaagaatggttacaacgattcactcatcgaagaagaagaaggtatcaacgaccataacgtcgttcttaaatgtgctgaaatccaaaacgctatttccgaaggatcaacatctttcctattcactatgtacaagtatgtaggaatcttcatggtgttttttgccattttgatattcctcttccttggctctgtggaaggatttagcactagccaccagccttgcacttacgatgaaaagaagatgtgcaaaccagctcttgccacagcccttttcagcaccatagcttttatccttggtggcatcacatcggttatttctggtttccttggaatgaagattgcaacttatgccaatgcaagaactaccttggaggcaaggaagggtgttggaaaggctttcattaccgcattcagatcaggtgcagttatgggttttctccttgctgcaaatggtcttttggttctttacattaccatcaacttgttcaagatttactatggtgatgactggggtggtctttttgaggccatcactggttatggtcttggtgggtcttctatggctttgtttggacgagttggtggaggcatctataccaaggctgctgatgttggtgccgatcttgttggaaaggttgaaagaaacattcccgaggatgatccaagaaatccagctgtgattgctgataatgttggtgataatgttggggatatagctggtatgggatccgatctttttggttcgtatgcagaggcatcttgtgctgcccttgttgttgcttccatctcttcttttggggtgaatcatgagttcaccgccatgttgttccccctcatcatcagttctgtgggtctccttgtttgtttgctcaccaccttatttgcaaccgacttttttgagatcaaacttgtaaaggaaattgagcctgcattgaaaaaacagctcgttatttcaacagctctgatgactgttggaattgcagttgttagttggatagcactcccatcttccttcaccatcttcaattttggtgagcagaaagttgtcaagaactggcagctattcttgtgtgttgctgttggtctttgggcagggcttatcattggatttgttactgaatactatactagcaatgcatacagtcctgtgcaagatgttgcagactcctgcaggactggtgcggctaccaatgttatctttggcctcgccttgggatacaagtctgttatcattccaatttttgccattgcaattagtatttttgttagttttagttttgctgccatgtacggtgttgctgttgctgcccttggaatgttgagtaccatagccaccggattagccatcgatgcatacggtccaatcagtgacaatgccggaggtattgctgagatggctggaatgagtcacagaattcgtgagagaactgatgcccttgatgctgcaggaaacacaactgccgccattggaaaggggtttgctattggttctgctgcccttgtgtctctggccctctttggtgcctttgtgagccgagctggtattacgacagttgatgtgctgactcccaaggttttcattggtttgcttgtgggtgccatgctcccttactggttttctgccatgaccatgaagagtgttggaagtgcagctcttaagatggttgaggaagtacgcaggcaattcaacaccattcccggcttgatggagggaactgctaagcctgactatgccacatgtgttacaatctccaccgacgcatccatcaaagaaatgatcccgcctggtgcccttgttatgctcacaccccttcttgttgggatctttttgggtgtggagacactctcgggtgtcctcgctggatcattggtgtctggtgtacagattgccatctctgcatccaacactggcggtgcttgggataatgccaagaagtacattgaggctggtgcctcagatcatgcaagaagccttggtccaaaagggtcagacccacacaaggcagcagttattggtgacaccattggggacccattgaaggatacatctggaccatcccttaacatccttatcaagctgatggcagttgagtctctggtgtttgctcctttctttgcaacccatggtggtctcctcttcaagatctaagatttgacagagaagcgaagagcatcgtccgtccatcatcgccgcccttctaccaaccatgatggcctctcttttttgttagtttgatggcaatttcttttctatttgttttttattttaaaaatcttattatccccttagacccctctttcccccctctagatttgagatacttaattaggcttaatcttttccgcgtggtcatttttcttgtaagagatgaggttgatgatgacgatcacatttattatcttggctgcgtggtcatttttcaatattcctttcacatttccaatttcacattccttttttttatttattggaattacaatgtgctcaattgtcgaaaagcgaattagattatgctttgttctgcaaatacaactcgtatgatagcgtcaaagacattgataggca

SEQ ID NO: 1649 - DNA, 2628 bp, Gossypium hirsutum
ctcagctcagctcagctcagctcaactcacttcacttaactcttttctgctgcggtggcgatgggggcggcgatgttgtcggagttggcgacggagatcgtggtgccagtgtgcgccgtgattggaatagctttctcgttggtgcagtgggtgatggtgtcgcgcgtgaagcttacctccgagcgccatgcgtcgtcggcgaatagtagcaagaatggttacggtgattacttgattgaggaagaggaaggaatcaatgaccatagcgttgtcaccaagtgcgctgatattcaaaacgctatctctgaaggtgcaacatcctttctttttactgaatatcagtatgttggcatcttcatgattgctttcgctatcctgattttcctcttcctgggctctgtcgagggcttcagcatgaagagccagccttgcacctatgataaggagaagatgtgcaaaccagctcttgcgactgctatcttcagtactgtatccttcttgcttggtgccatcacttcagttctttctggattccttggaatgaaaattgctacctatgccaatgcaagaacaaccttggaagcaagaaaaggcgtcggaaaggcttttattgttgcgtttagatctggtgcagtaatgggttttctccttgcagcaaatggtttattggtactttacattgccatcaatctattcaagctgtactatggtgatgactgggaaggcctttttgaggctattactggttatggtcttggtggatcctctatggcactctttggaagagttggtggtggtatctatacaaaggctgctgatgttggtgctgatctcgtaggaaaggttgaaaggaacattccagaagatgacccaagaaacccagctgtcattgctgataatgttggtgataatgtcggggacattgctggaatggggtctgatctatttggctcatatgctgaatcttcttgtgctgctcttgttgtagcttctatatcctcctttggaataaaccatgacttcacgggcatgttgtatcctctgctcattagttctgttagtattcttgtctgtttgatcacaaccctatttgctaccgatttgttcgaaatcaaggttgtcaaggaaattgaaccagctttgaagaagcagctcatcatctccactattctaatgacagtaggaattgcaattgttacttggattggtgtgccatcttccttcaccatttacaattttggggttcagaaagttgttaagaattggcaactatttttgtgcgtgggtgttggtctctgggctggacttattattggttttgttaccgagtactacaccagcaatgcttacagccctgtgcaggatgttgctgactcttgcaggacgggagcagcaaccaatgttatatttggccttgctttaggatacaaatctgtgatcatcccaatttttgccatagcaatcagtatttttgttagttttagctttgctgctatgtatgggattgcagttgctgcccttggaatgttgagcaccattgcaactgggttggctatcgatgcttatggtcccatcagtgacaatgctggaggtattgctgagatggctggtatgagccatcgcattcgtgagagaactgatgctcttgatgctgctggaaacaccactgctgccattggaaagggatttgccattgggtcagcggcgttggtgtctttggctctatttggtgcctttgtgagccgtgctgctatcacgaccgtagatgtcttgaccccaaaagttttcattggtttaatagttggagccatgcttccttactggttctctgcaatgaccatgaagagtgtgggaagtgctgctttaaagatggttgaggaggttcgcagacagttcaacaccattcccggtctcatggagggtcatgccaagcccgattatgctacctgtgtcaaaatctcaactgatgcctctatcaaggagatgatccctcctggtgcccttgttatgcttactcccctcattgttggaactttctttggtgtagagactctttctggtgtccttgctggggctcttgtttccggtgttcagattgcaatttctgcatccaatactggtggggcatgggacaatgccaagaagtacattgaggccggtgtgtccgagcatgcaaggaccctaggtccaaagggatccgatcctcacaaggcagctgtcatcggtgacactgttggagaccctctcaaggatacctccggtccatcacttaacattcttatcaagcttatggcagtcgagtcacttgtgtttgctcccttcttcgccacacacggtggtctactcttcaagatcttttagggaatggatggctggaaatgcacggtggaaggctggttagcatctctgtttaaatagtgttgtttccattcagtcattacttttagtttcttgcatgattgtatccatccacagtttgttatgaggtctttttttagttttgcatagttgctaatgatgataactgagatgggttaggattggacctggcacttcgtatcctgtttgtgtaatttgttacagtcgtaatttttgataggttaataaattgtatcatagattttgaca

SEQ ID NO: 1650 - DNA, 2900 bp, Quercus alba
actctctgtgtgactctctttctctctctcacagtgtgtgcgtgtgtactgtgtttagcttaggcttttcactttccggcgcgtggggacacgcgagtggagctagggttccggctaaggatggcattgctctcggagctggcgacggagatcgtgatcccagtctgcgctgtgatcgggatcgccttctcgttcgtgcagtttatactagtctcgcgcgtgaaggtcacgcccgagcgccacgcgccgcctcagtccggaaacaacaacaagaatggttacggcgagtacttgatcgaagaggaggacggcatcaacgaccaaaacgtcgtcgttaagtgcgctgagattcagaacgccatttccgaaggtgcgacatccttcctctttaccgaatatcagtatgttggggtctttatggttgcttttgcaattttgatcttcctcttcttggggtccgtcaagggcttcagcacaaaaaaccagccctgcacttatgatgcagaaaagttatgcaagccagcacttgcaactgcaatctttagcactgtctcttttgtgcttggtgctttcacctcagttttgtctggttaccttggaatgaaaattgctacttatgccaatgcaaggacaacactggaagcaagaaagggtgttgggaaggctttcattactgcattcagatccggtgcagtgatgggttttctacttgctgcaaatggtcttttggttctttacattactatcaatctctttaagctgtactatggtgatgattgggaaggcctttttgaggctataactggttatggtcttggtggatcttccatggcactctttggaagagttggtggcggtatttatactaaggctgcagatgttggtgctgaccttgtaggaaaggttgaaagaaacattccagaagatgacccaagaaacccagctgtaattgcagacaatgttggtgataatgttggggatattgctggaatgggatctgatctttttggctcgtatgctgaatcatcttgtgctgcccttgttgttgcttccatctcctcctttggtatcaaccatgaattcactgcaatgtgctatccacttctcatcagttctatgggtatccttgtctgtttaatcacaaccctctttgcaactgatttctttgaaatcaaggctgtcaaggaaattgaaccagcactgaaaaagcaactaatcatctccactgttctcatgactgtggggattgcgattgttagctgggttgctctgccatcatccttcacaatttacaattttggggttcaaaaagttgtgaagaactgggagctcttcttgtgcgtgggtgttggtctttgggctggacttgttattgggtttgttacagagtactatactagcaatgcctacagccccgtgcaagatgttgccgattcctgcaggactggagctgccactaatgttatatttggccttgctctaggatacaaatcggtcatcattccaatctttgccattgcagttagcatttttgttagtttcagctttgctgcaatgtatggaattgcagtggctgctcttgggatgctgagcaccattgctactgggttggctatcgatgcttatggacccatcagtgacaatgctggaggtattgctgagatggcgggcatgagccaccgaatccgtgaaagaactgatgccctagatgctgctggtaacaccactgctgccattggcaagggatttgcaattggatctgctgcacttgtgtctttggctctatttggtgcttttgtgagccgtgctgctatttcaaccgttgatgtattgacccccaaggttttcattggactgattgtgggtgccatgcttccttactggttctctgccatgaccatgaagagtgtgggaagtgcagccttgaaaatggttgaggaggtacgtaggcaattcaacactattccaggtctcatggagggtcttgccaagcccgactatgctacctgtgtgaagatctccactgatgcatccatcaaagagatgattcctcctggtgcccttgtcatgcttacacctcttattgttggaatcttctttggcgtggagaccctatctggtgttctggctggttcccttgtttctggtgtgcagatagcaatatctgcatctaataccggtggagcttgggataatgctaagaagtatattgaggctggtgcttcagagcatgcaaggagccttggcccgaaggggtctgatccacacaaggcagctgtgattggtgacaccattggagacccactcaaggacacctccggcccatcactcaacatccttattaagctcatggcagttgagtcgctcgtgtttgctcctttcttcgccacacatggtggccttcttttcaagatcttctgaggattgacaaaaaagaacactgcgggcaagaagcttatttcaattttatcttaattttgtccgccagaagaggtttattaacttgctcttttcttgtatcattatccttctccgcccttaggtagtgtttgattcaatcatgaactttgagaattaattttgcgaaatgatttttccaaatatgaggataacatttgaaaattgcgcttgacacaggccgcaaatttcatattgactacatatttgcattatgcagtaagcttactacaaaaatcttgtggaaaatgattttattgaagggttcgtacttcatagaaattgaaaacgcattcaactcgtgccttttcaagtttccttcctaagacttgagtgcatcaggccttcaaggaagttcactggggaaaacgctttcaacttggatgcacttcacatgatcagacatggagtgacgatctattgagtttctgcaatctatttag

SEQ ID NO: 1651 - DNA, 2794 bp, Eucalyptus grandis
agcacactccccgtttcactcctctctctgcatctctctctgtctctgtctctctctctctctgataggcgtcgagtccagagattccggcgaccgtagcctagggttccggcgagaatggcgttgctctcacctctcgcgacggagatcgcgatcccggcctgcgccttggtcgggatcgtgttctccctggtgcagtggctcctcgtgtcgcgcgtgaagctcaccccggagccccgcgccccgtcgtcctcgtcccccggcagcaacaacaacaagaacggctacggcgagtacctcatcgaggaggaggacggcgtcaacgaccacagcgtcgtggccaagtgtgccgagatacagagcgccatctccgaaggtgcgacatcttttctgttcacggagtaccagtatgttggagttttcatggttgcttttgcggttctaatcttcctcttccttggctctgttgagagcttcagcacccaaagccagccttgcacgtatgacccttcaaaattgtgcaagcctgcacttgccactgctgttttcagtacagtttcattcctgcttggtggtttcacctcggttgtctctggtttccttggcatgaaaattgctacctatgccaatgcaaggactaccttggaagcgagaaaaggcgttggaaaagctttcattactgctttcagatctggtgcagttatgggatttcttcttgctgctaatggtcttcttgtgctctatattgcaatcaatctgttcaagttgtactatggcgatgactgggaaggtctttttgaggccattaccggttatggtctcggtggttcttccatggctctctttggaagagtcggtggtggaatttataccaaggccgctgatgttggtgctgatctggttggaaaggttgagagaaatatcccagaagatgatccaagaaacccagcggtgattgctgataatgttggtgataatgttggggatattgccggtatggggtctgatctttttggctcttatgctgaatcatcctgcgcagcccttgttgttgcttccatctcttctttcggaatcgatcacgacttcactgccatgtgttatcccctgctgatcagctctatgggtatccttgtatgcttgattacaactctctttgcaactgacttctttgaaatcaaggtagtggaggaaattgagcctgcattgaagaagcaacttattatttccacaattctaatgactgtcggaatagctattgttagctggattgctctgccctcatcattcacaatttacaactttgggtcgcagaaagttgtgaagaattggcagctgttcttgtgtgttggtgttggtctttgggctgggctaattattgggtttgtcactgaatattataccagtaatgcctacagccccgtccaagatgttgctgattcctgcagaactggtgctgcgactaatgttatttttggcctcgccttgggatataaatctgtcattatcccaatttttgccattgccattagcatttttgtgagtttcagttttgctgccatgtatggaattgctgtggctgcccttggaatgttaagtaccattgccactggattggccatagatgcttatggtcccatcagcgataatgctggaggtattgctgagatggctggcatgagtcacagaattcgtgagagaactgatgcccttgacgctgctggcaatactactgctgccattggaaagggatttgccattggatcagctgccctggtgtctcttgctctgtttggtgcatttgtgagtcgtgcagcaatttctactgttgatgtcctgacacctaaggtcttcattggtttgatcgtgggtgccatgcttccttactggttctctgctatgacaatgaaaagtgtcggaagtgcagcattgaagatggttgaggaggtccgcaggcagtttaacaccattccagggctcatggagggtcttgcgaagcctgactatgctacatgtgtcaaaatttcaaccgatgcatctctcaaggagatgattccacctggtgcccttgtcatgcttacaccacttattgttgggatcttctttggtgtggagacgctgtctggtgttttggctggctctcttgtttctggtgttcagattgcaatttcggcatccaacactggtggagcatgggacaatgcaaagaagtacattgaggctggtgcttcggagcatgcgaggacccttggccctaaagggtcagagcctcacaaggctgctgttattggagataccattggcgatccactgaaggacacttcaggtccatcactcaatatcctcatcaagctcatggcagtggagtcgctcgtgttcgctcccttctttgctactcacggcggtctactcttcaagatattctgagggagggattggaagacttcctttttgtagcggcagcatcatcatgaactcaatttgcccttggcatctattctgcgttagttctccataattttagcgattctgattcctaaggatgatgatgatgatgatgattatgatgattaggaatttatattaacatgcgaatctcaacgtacgttttaaggttgaacctggcaaattttgattcatggcccaggattcttcacttttagtgtatttttgtgttttacccgtaaaaaagaactgtatggatgcctttttccatccattcaatgggggtcatttttcagctgatgatcttcgcggtcttgctttgatatctatataactcgaattgtggtca

SEQ ID NO: 1652 - DNA, 2752 bp, Euphorbia peplus
cctctacatctctttcgtctctatactggtacggtcgccggagtttcattgttagggttcaggcgaggaggaggagaatgacgtcggcgttgctgtcggagctcggaaccgagataatcgtgcccgtatgcgcagtgattggaataatcttctcgctagtccagtggttcctggtctcgcgcgtgactctcacgtccgacaggaaagggtccgggacgtccccggctggtgataacaagaatggcttcaatgattacctcattgaagaagaggaaggtatcaatgaccacagtgtcgtcgctaaatgtgctgaaatccagaatgctatctctgaaggtgctacgtctttcctgttcactgaataccagtatgttggggtattcatggttgcttttgcgggtttgatctttgttttcctgggttctgttgagggcttcagcacgaagagccaaccatgcacttacgcaccagagaggacctgcaagcctgcccttgcaacagctatgttcagcactatctcatttgtacttggtgctgtcacctcagttatctctggttttctagggatgaaaatcgctacctatgccaatgcaagaactactttggaagcaagaaagggtgttggcaaggcctttatagtagcatttaggtctggtgcagtcatgggatttttgttagctgcaaatggtttattggttctttacattatcattaatgtcttccgtatatattatggagatgactgggaaggcctatttgaatctataactggttatggtcttggaggatcttccatggctctctttgggagggttggtggtggtatctataccaaagctgctgatgttggagctgatcttgtggggaaggttgaaaggaacattcccgaagatgacccaagaaacccagctgtcattgccgacaatgttggtgataatgttggagatattgctggtatgggttctgatctgtttggctcgtatgctgagtcatcctgtgctgcccttgttgttgcgtcaatctcctctttcggaatcaaccatgaattcactcccatgctctatcctctacttgtcagttctgtgggtattcttgtatgtttgattactactctattcgccactgatttctttgaaatcaaggctgttaaagaaattgaacctgcactcaagaagcagcttatcatctccaccattcttatgactgtgggtattgccattgtctctttcgttgcgttgccttcatcgtttactattttcaattttggtacccagaaggttgttaagaactggcaattgtttttgtgtgtggctgttggtctttgggctggacttattattggttttgttaccgagtactacaccagtaatgcttacagccctgtgcaagatgttgctgattcctgcaggactggggcagccactaatgtcatctttggtcttgccttgggatataaatctgtgatcattcccatttttgccattgctatcagcatatttgttagttttagctttgcagccatgtatggaattgctgttgctgctcttggtatgctaagcaccattgccactggattagccatagatgcttatggtcccatcagtgacaatgctggagggattgctgagatggctggcatgagccaccgcatccgtgaacgaactgatgctcttgatgctgctggtaacaccactgctgccattggaaagggatttgccatcggatctgctgctttggtgtccctggctttatttggcgcttttgtcagccgtgcagcaatttcaactgttgatgtgttgaccccaaaggtcttcattggtttgcttgtgggtgccatgcttccttactggttctctgctatgaccatgaagagtgtgggaaaagcagctctagcgatggttgaggaagtccgtaggcagtttaacaccattcctggtcttatggagggtaccacaaagcctgattatgctacctgtgtcaagatttcaactgatgcttccatcaaagaaatgattccaccaggtgctcttgtcatgcttacacccatcattgttggaaccttctttggcgtggaaacactttccggtgttcttgctggttccctcgtctctggtgttcagattgccatctctgcatccaacaccggaggtgcatgggataatgccaagaagtatattgaggctggtgcttcagagcatgcaaggtcgctgggcccgaaaggctcagatccacacaaagctgctgtgattggagataccattggagacccacttaaggacacctctgggccatcgctcaacattctgatcaagctgatggctgtggaatctctagtgtttgctccattcttcgccactcatggtggtctgcttttcaagatattcaactgaagacattttgatgcgttcatttgtgatgacaaaatgcatgccattctcttgtagagaatctttaaattttagttctgcattttatgatctctccctgttaatgggattcttaagttagtttctttagttttagttaaatacactatttttgaaggtctgatgaggatgatgatgaaagatgaaagaatgattctaaggatgcgagaattggtcattgatgttttaggagaggcagcggagaatttggtacctttaccctgtagctctggaacatgttgtcttgaaaattttgtatcattacccttttacctctgagcaagacagtaatctgaaatttcgactctggttaattcagcaattta

SEQ ID NO: 1653 - DNA, 4166 bp, Nicotiana tabacum
  misc_feature (837)..(837): n is a, c, g, or t
  misc_feature (1126)..(1126): n is a, c, g, or t
  misc_feature (2412)..(2412): n is a, c, g, or t
  misc_feature (4052)..(4052): n is a, c, g, or t
ggccattacggccggggctctataaacacacacacacaaagaagtggaattagcacgtctgctaaatcaaaacgctaaatagaagtggaatctgatcatttacttcgctgtagtaagtacagatttcacgggatttgagctcatccctcatcacttgttgttgttgttgttgttgccgtccctgtctttcttcaactaccaactatactcaatcttgtgattcatcttcctccacgtagcttagcttgttgaagttaaaaaggagagctttatggatcgggtggcaatggcagtaggagcagggatggacgtgccgatcatgcacgatagtgatagatacgagctagtaaaggatattggttctgggaattttggagtggcaaggcttatgagggacaggcaaactaatgagcttgttgctgttaagtatatcgagagaggtgagaagattgatgaaaatgttaagagagaaatcatcaaccatagatcattgaggcaccctaacatagtcagattcaaagaggtcatattgacaccaactcatttggctatagtgatggaatacgcatctggaggagaactgtttgagcgcatatgcaatgcaggccgtttcagcgaggatgaggcacggtttttcttccaacaactcatatcaggggtcagcttctgtcacgccatgcaagtatgccacagagacttgaaactggagaatacattattggatggcagccctgcaccaaggctaaagatttgtgattttggatattctaagtcctcggtgttgcattcacaaccaaagtcaactgttggtacacctgcatatattgctcctgaagngttattgaagaaagaatatgatgggaagattgcagatgtctggtcttgtggggtgactttgtatgtcatgctggtaggagcatacccttttgaagacccagaggagcctaaaatttttcgcaagacaatacagcgaatcttgaatgtacagtattcaattccagattatgtacatatctctccagaatgtcgtcatctaatatcaaggatttttgttgctgatcctgcaaagaggataacgatccctgagatcaagaaccatgagtggttcttgaggaaccttcctgcngatctcatggatgataatatgacaaacaatcagtttgaggagccagatcaacgtatgcagagcattgacgaaatcatgcagataataactgaggccaccattcctgctgctgggaccaacagccttaatcattaccttactggtatcttggacattgatgatgacatggaagaagacatggagagtgaccctgaccttgatattgatagcagcggagagattgtctatgcaatgtaaatgatatgtgcgtactaagttgatggatcaaactaaaccagccgaatgtttgtagttcttaattatctggtctgccttttggtatccactggttttttctctctatttttttcttcatttctagccggagctccggtagtccgccgtcggtcggagttatgggagcgccaattttatcagatctcggaacggagattttgattccggtatgtgccgtcgtcggtattgctttctcgctatttcagtggtttctcgtctctaaagtgacgctcagtgctgataagtcctccggcgccgccgacgataagaatggttacgctgctgaatcgctcattgaagaagaagaaggcattaatgaccataatgttgttcagaaatgtgcagaaattcaaaacgccatttccgaaggtgcaacatcattcctttttactgagtaccagtatgttggtgttttcatggttgcttttgcaattttaatcttccttttcctcggctctgttgagggtttcagcacaaagaaccaaccctgtacatatgacagcaccaaaacttgcaagcccgctcttgccactgctgtcttcagcaccgtatctttcttgcttggtgctgttacatctgtggtgtccgggtttcttggaatgaaaattgctacatatgcaaatgccagaactaccttggaggctagaaaaggtgttgggaaggcttttattgttgcattcagatctggtgctgtgatgggtttccttcttgctgcaaatggtcttctggttttgtacataaccatccttctatttaagttgtactatggtgatgactgggaaggtctttttgaggctataacaggttatgggcttggtggatcttcaatggccctctttggtagagttgctggaggtatttataccaaagcagcagatgttggagctgatcttgtgggcaaggtggaaaggaacatccctgaagatgatcctagaaacccagcggttattgctgacaatgtcggtgacaatgtcggagatattgctggtatgggatcagatctgtttggntcttatgcagagtcatcctgtgcagctcttgttgttgcttcaatctcctccttcggtgtcaaccatgagttcactgctatgctatatccccttctcgtcagctctgttggtatccttgtttgtttgcttaccaccttattcgcaactgatttctttgaagtcaaggctgttaaggaaattgagccagcattgaagcagcaactcgttatctcaactgctctcatgacagttggaattgctgttgttacttggattgcccttccatcgaccttcacaatattcaatttcggggctcagaaagaagtaaaaagctggcagttgttcttgtgtgtcggagttggtttgtgggctggacttattattgggttcgtcaccgagtactataccagcaatgcttacagccctgtgcaagatgttgctgattcatgtcggactggtgctgcaacaaatgttatttttggtcttgccttgggttataaatcagtgatcatccccatatttgccatagcagtcagtatatttgttagcttcagctttgctgcaatgtatggcattgcagttgctgccctaggaatgctgagcactatagccactggtttggcaattgatgcatatggtcccatcagcgataatgcaggaggcattgctgagatggctggaatgagccacagaatcagagagagaactgatgcacttgatgctgcaggaaacaccactgcagctattggaaagggatttgccattggttctgctgctctcgtgtctctggccctctttggagcatttgtcagccgagcagcaatttccactgtagatgtcttgacacctaaagtatttattggtttgctagtcggtgcaatgcttccttattggttctccgccatgacaatgaagagtgttggaagtgctgctcttaagatggttgaggaagtgcgcaggcaattcaacaccattcctggtctcatggaaggaactgccaagcctgactacgccacctgtgtcaagatctctacagatgcatcgatcaaggagatgattgcacctggtgctcttgtcatgctcactccattgattgttgggatcttgtttggcgtcgaaacactttctggtgtgcttgcaggatctctcgtctccggtgtacagattgccatctctgcatctaatacaggtggtgcctgggataatgctaagaagtacattgaggccggagtctcagaacacgcaagaacacttggccccaagggatctgacgcacacaaggctgctgttattggtgacactgttggtgaccctctcaaggacacatctggaccatcattgaacattctcatcaagctgatggctgtcgaatccctcgtgttcgctcccttcttcgccactcacggtggtcttctcttcaagctattttaaaacgaatgtcactcctatgtcacacgactgtctcacgaaatctatcgttcctctttctccctttctcttcgtttaactacctttccagcatttttcgtgtttttagtcactagaatgtgggctgtggaaggagagagattcacgacaatgagtgttgatgaaaggtgatggtaagggtgaaatgtttttgcagaattcagaagaacgtcaatattctttcctagagtatngtatcagtttcttaaaataccttcttctcttgcccgtttcgggtgttaagattttgaatttttcttatgctctctccaaaatctgcaatataacatgaggtagatattacttcc

SEQ ID NO: 1654 - DNA, 3316 bp, Beta vulgaris
  misc_feature (2885)..(2885): n is a, c, g, or t
  misc_feature (2898)..(2898): n is a, c, g, or t
  misc_feature (2916)..(2916): n is a, c, g, or t
  misc_feature (2923)..(2923): n is a, c, g, or t
tgacttctgagcttaaccttgggtggcaaattcatccattagtttgtctcagcgcaggtttctgtctctctttcaattgccagcactacgcacaactacacactcaaattgtgttgttgtcttaactgtattttctctgttgccggaatttcggcgatttttagggttccggcgtaaaattagggttccggtgaagaaaaatgatttcagatctagcaacagagatctttattccggtgtgcgccgtcatcggaattatattttctcttgtacaatggtttcttgtttctaaagttaaagtttccactgaccgacacgtcaacaatggcggaagtgctaaaaatggctttaatgattacttgattgaagaagaagaaggtgttaatgaccaaaacgtcgtcgctaaatgtgctgaaatccaaaacgccatttctgaaggtgcaacatcctttctgtttacggaataccagtatgtgggggtgttcatgtgtgcatttgctgtcctcatcttcgtctttttaggatctgtggaaggctttagtacagaaagccaaccatgcacttacagccctttgaagaagtgcaaacctgcattggctacagctcttttcagcaccgtctctttcttgcttggtgctatcacttctgttgtctctggtttcctaggaatgaagattgctactgatgcaaatgcaagaacaaccttagaagctagaaagggtgttgggaaggctttcattattgccttcagatctggtgctgttatgggtttcctccttgcagccaatggtctattggtcctttacattgccattaatttgctcaagctgtattatggtgatgattgggaaggtctttttgaggctattactggttatggtcttggtggttcttcgatggcccttttcggtagagttgggggaggtatctatactaaggctgctgatgtaggtgctgatcttgtaggaaaggttgaaaggaacatcccagaggatgatccaagaaatccagctgtgattgctgacaatgtcggtgacaatgttggtgatattgctgggatgggttctgatctttttggttcttatgctgaagcatcatgtgctgcacttgttgttgcctccatatcctccttcggtatcaaccacgagttcactgccatgtgttatccgttacttatcagttccatggggatcatagtttgcttggtcacaactctctttgctactgatttctttgaaattaaagctgtcaaagaaattgagccagcactgaagaagcaactcattatttcaactgttcttatgaccgtgggaattgcaatcatcacttggattgctctcccatcctctttcaccattttcaattttggcacacaaaaggtcgtccacaattggcaactgttcctatgtgtatgtgttggtctttgggctggactcatcattggttttgtaacagagtactacaccagtaatgcatacagtcctgtgcaagatgttgctgattcctgccggacaggagctgccacaaatgttatttttggtctagccctgggttacaaatctgtcatcattcccatctttgctatagctgtcagcatctttgtcagtttcagttttgctgccatgtatggtgttgctgttgctgcccttggaatgctgagcaccattgccactggtctcgccattgatgcttatggtccaatcagtgacaacgctggaggtattgctgagatggcagggatgagccaccgaattcgtgagagaaccgatgcccttgatgcagcagggaacacaactgctgccattgggaagggatttgctataggatctgcagctttagtctccttagctctgtttggtgcctttgtcagtcgcgcagctatttcaaccgttgatgttttgactcctaaagttttcatcggtttgattgttggtgccatgcttccttactggttctctgctatgactatgaagagtgtgggtagtgctgctcttaagatggtggaggaggtccgcagacagttcaataccatcccgggtctgatggaaggaactgccaagcctgattatgccacttgtgttaaaatctccactgatgcatctatcaaggagatgatcccacctggtgcgttggtcatgctcaccccactcattgttggaatcttctttggtgttgagaccctatctggtgttctagctggatcccttgtttccggagtccagatagcaatatctgcctccaacactggtggtgcatgggacaatgccaagaagtacatcgaggctggtgcttcagagcatgcaaggagtcttggaccaaaggggtctgagccacacaaggcagcagtcattggtgataccattggtgacccactcaaggacacctcaggcccttcattgaacattttgatcaaacttatggccgttgagtctctcgttttcgctccattctttgcaactcatggtggtttgttgttcaaactattttaagaggatgccaaatgtgaattcaacaggaaggtcaattttcgagcttctcttcagtctttatgggcgaatgcagaatgcgcattaagcagacatcctgttgtactcatttctatcatggctcagtttttgccccaattttttgggttttgtctgttagttttggtagaggtaaggatgattgttgtcacttatgatgattgtaggaatgattatgcatttcgagtttagaggaaagaagatctgcggttagttgttacctttgttgtaggaaaggttgatagatcaaccaccaatgttgttagatcggaatgagcaaaatgttgccatcttgttgaggttataaattttgttggcttctttgtaacatcgatgatttgatgtatggtgtctttcggntattttgaatccnagattttgaaggattttncctttanaaaaaaaaaaaaaaaaaatccaggggggcccggacccaattccctaaaggggccgattcaattctgggccctttttcacgccggatggaaaacctgggtcccaattaatccttggaaaacccctttccctggggaaaaaaaaaacccccatcccttccaaattcgcccctaaggaagggaattaacttaattttaaatcccaattttttaaccttttttaaaaggcagggaaacttataaaaaaaccaggtttgtttctttaaaactttaaaagtcccaaggaacttgggggccccacccctattttggggggaaaaatctcaccttttggaagcccaaaaaaaagcggtgaaattccccccccccgggtgggggtttttatcaaaaaaaatt

SEQ ID NO: 1655 - DNA, 2736 bp, Cucumis sativus
tttctttttttctttccgccatgggcgccaccattcttccagatctcggtgctcagattttcattcctctctgtgctattgtcggaatcctcttctctttagtccagtggtactacgtttcacaagttaaactctcttctgctcgtgattccgctaataacaattcctcttctgctaaaaatggctactctgactaccttattgaagaggaagaaggtgttaatgaccataacgttgttattaaatgtgccgaaattcaaaacgccatctctgaaggggcaacctccttccttttcacggagtacaagtatgttggcatctttatgatattgtttgcagcattgatttttgtattccttggatcagtagagggttttagtaccaagccccaaccatgctcatatgacaaaacaaagacttgtaagccagctttggcaacggctacattcagtactatatcatttttgcttggtgcagtgacttcagtggtttctggtttccttggaatgaaaattgctacatatgcaaatgccagaaccaccttggaggcaagaaaaggtgttggaaaggcatttattactgcttttaggtctggtgctgtcatgggcttcctcctagctgccaacggtctcttggttttgtttattgccattaacctcttcaaattgtactatggtgaagattggggtggtcttttcgagtctatcactgggtatggtcttggtggatcctccatggctctctttggtagagttggtggtggtatctacaccaaagctgctgatgttggtgccgaccttgtgggtaaagtggaaagaaacattcctgaggacgacccaagaaatccagctgtgattgctgataatgtgggtgacaatgttggggatattgccggtatgggatctgatctttttggttcatatgctgagtcatcctgtgctgctctcgttgttgcatctatctcctctttcggcaacaaccatgagttcacagcaatgctctatccactcatcgttagttctatgggtatccttgtctgtctgatcaccactttatttgcaacggatttctttgagatcaaggctgttaaggaaattgagccagcattgaagaatcaactcataatttccactgttataatgacctttggaattgcaattgttacttgggtgagtgttccagcaaaattcaccatcttcaactttggaactcaaaaagttgtacagaactgggaacttttcttgtgcgttgctgttggtctttgggctgggctgataataggatttgtgacagagtactatactagcaatgcatacagccctgtgcaagacgttgctgattcttgccgaactggagctgctacaaatgttatttttggcttggccttgggatacaaatctgtcattatccctatctttgcaattgcagctagtatttttgtgagtttctcctttgctgcaatgtacggcattgccgttgctgcccttggaatgttgagtacaattgctactggtttggccatcgatgcatatggtccaatcagtgacaatgctggaggcattgctgagatggctggcatgagccacagaattcgggagagaaccgatgcccttgatgctgctggaaacacaactgcagcaattggaaagggttttgccattggttcagctgctctcgtgtcccttgccctctttggtgcctttgttagccgtgctggtgttgtcgttgttgacctcttgacacccaaagttttcattggcttgatcgttggtgctatgctgccatactggttttctgccatgacaatgaagagtgttgggagtgcagccctaaagatggttgaggaggtccgaaggcaattcaacacaatcccaggtctcatggaaggtactgccaagcccgactatgctacgtgtgtcaagatctcaactgatgcatctattaaggagatgatcccacctggtgcccttgtcatgttgacacccctcattgttggtatcctattcggagttgaaactctttctggcgtccttgctggatcccttgtttctggtgtccagattgccatttccgcatccaacaccggaggtgcttgggacaatgctaagaagtacatcgaggctggtacctctgagcacgcaagaacccttggcccgaaaggatcagatccacacaaagctgctgttatcggggacacaatcggagacccactcaaggatacatctggaccttctctcaacattctcatcaagttgatggctgtggagtcactcgtgtttgctcctttctttgccagccacggtggcattctgttcaagatcttctaagaatgaaagaggaatgaatctttgccattacatcatcctctcttccttccattgacataacctctcctctacgaaattttcaatgctttttttagacttcatattatcatatattcaagtctgtagctttgattcccttttgagaaacttgtagtttcaagtggcagagccttttaccctttcatcggttgtgatgatgatgaagaagaagaaagataagaagataaattggtcaaatcttgtgaaatgagactgcgaagttaaaattctctttttcccaattgagaacaggctattattgttattctcactccttttcctccctttctctttctctctgttgaatgctgagttcaattttgaattttgaggatcttataccaaacgcattcatgggttttgtctttgt

SEQ ID NO: 1656 - DNA, 2671 bp, Gossypium hirsutum
tgttgtcggagatggcgacggagatcgtggtgccagtgtgcgccgtgattggaatagctttctcgttggtgcagtgggtgatggtgtcgcgcgtgaagcttacctccgagcgccatgcgtcgtcggcgaatagtagcaagaatggttacggtgattacttgattgaggaagaggaaggaatcaatgaccatagcgttgtcaccaagtgcgctgatattcaaaacgctatctctgaaggtgcaacatcctttctttttactgaatatcagtatgttggcatcttcatgattgctttcgctatcctgattttcctcttcctgggctctgtcgagggcttcagcatgaagagccagccttgcacctatgataaggagaagatgtgcaaaccagctcttgcgactgctatcttcagtactgtatccttcttgcttggtgccatcacttcagttctttctggattccttggaatgaaaattgctacctatgccaatgcaagaacaaccttagaagcaagaaaaggcgtcggaaaggcttttattgttgcgtttagatctggtgcagtaatgggttttctccttgcagcaaatggtttattggtactttacattgccatcaatctattcaagctgtactatggtgatgactgggaaggcctttttgaggctattactggttatggtcttggtggatcctctatggcactctttggaagagttggtggtggtatctatacaaaggctgctgatgttggtgctgatctcgtaggaaaggttgaaaggaacattccagaagatgacccaagaaacccagctgtcattgctgataatgttggtgataatgtcggggacattgctggaatggggtctgatctatttggctcatatgctgaatcttcttgtgctgctcttgttgtagcttctatatcctcctttggaataaaccatgacttcacgggcatgttgtatcctctgctcattagttctgttagtattcttgtctgtttgatcacaaccctatttgctaccgatttgttcgaaatcaaggttgtcaaggaaattgaaccagctttgaagaagcagctcatcatctccactattcttatgacagtaggaattgcaattgttacttggattggtgtgccatcttccttcaccatttacaattttggggttcagaaagttgttaagaattggcaactatttttgtgcgtgggtgttggtctctgggctggacttattattggttttgttaccgagtactacaccagcaatgcttacagccctgtgcaggatgttgctgactcttgcaggacgggagcagcaaccaatgttatatttggccttgctttaggatacaaatctgtgatcatcccaatttttgccatagcaatcagtatttttgttagttttagctttgctgctatgtatgggattgcagttgctgcccttggaatgttaagcaccattgcaactgggttggctatcgatgcttatggtcccatcagtgacaatgctggaggtattgctgagatggctggtatgagccatcgcattcgtgagagaactgatgctcttgatgctgctggaaacaccactgctgccattggaaagggatttgccattgggtcagcggcgttggtgtctttggctctatttggtgcctttgtgagccgtgctgctatcacgaccgtagatgtcttgaccccaaaagttttcattggtttaatagttggagccatgcttccttactggttctctgcaatgaccatgaagagtgtgggaagtgctgctttaaagatggttgaggaggttcgcagacagttcaacaccattcccggtctcatggagggtcatgccaagcccgattatgctacctgtgtcaaaatctcaactgatgcctctatcaaggagatgatccctcctggtgcccttgttatgcttactcccctcattgttggaactttctttggtgttgagactctttctggtgtccttgctggggctcttgtttccggtgttcagattgcaatatctgcatccaatactggtggggcatgggacaatgccaagaagtacattgaggccggtgcgtccgagcatgcaaagaccctcggtccaaaaggatccgatcctcacaaggcagctgtcattggtgacactgttggagaccctctcaaggatacctccggtccatcacttaacattcttatcaagcttatggcagtcgagtcacttgtgtttgctcccttcttcgccacacacggtggtctactcttcaagatcttttagggaatggatggctggaaatgcaccgtggaaggctggttagcatctctgtttaaatagtgttgtttccattcagtcattacttttagtttcttgcatgattgtatccatccacagtctgttatggggtctttttttagttttgcatagttgctactgatgataactgagatgggttaggattggacctggcacttcgtatcctgtttgtgtaattgttttttgttagagtcgtaatttttgataggttaataaattgtatcatagattttgacatgcttgtgtttttcttcccctcatattgtgtaattgtttcgcgtttgatattgcggagtctctttaggggtatggatgaaaatgggagcttaaggatgagcttaatttga

SEQ ID NO: 1657 - DNA, 2957 bp, Cucumis melo
ctctctccccttcttccttcattcatttcccttcactcactgctccgtgagaagaagaagaaaaccacccacaccccaactctctcttttttcgtgctgtcttcccccttttcttctttgtttccgccatgggcgccaccattcttccagatctcggtgctcagattttcattcctctttgtgctattatcggaatccttttttctttagtccagtggtactacgtttcacaagttaaactctcttctgctcgtgattccgctaataacaactcctcttctgctaaaaatggctactctgactaccttattgaagaggaagaaggtgttaatgaccataacgttgttattaaatgtgccgaaattcaaaacgccatctctgagggggcaacctccttccttttcacggagtacaagtatgttggcatctttatgatattgtttgcagcattgatttttgtattccttggatcagtggagggttttagtaccaagccccaaccgtgctcatatgacaaaacaaaaacttgtaagccagctttggcaacggctacattcagtactatatcatttctgcttggtgcagttacttcagtggtttctggttttcttggaatgaaaattgctacatatgcaaatgccagaaccaccttggaggcaagaaaaggtgttggaaaggcatttattactgcttttaggtctggtgctgtcatgggcttcctcctagctgccaacggtctcttggttttgtttattgccattaacatcttcaaattgtactatggtgaagattggggtggtcttttcgagtctatcactgggtatggtcttggtggatcttccatggctctctttggtagagttggtggtggtatctacactaaagctgctgatgttggtgccgaccttgtgggtaaggtggaaaggaacattcctgaggacgacccaagaaatccagctgtgattgctgataatgtgggtgacaacgttggggatattgcgggtatgggatctgatctttttggttcatatgctgagtcatcctgtgctgctctcgttgttgcttctatctcctctttcggcaacaaccatgagttcacagcaatgctctatccactcatcgttagttctatgggtatccttgtctgcctggtcaccactttatttgcaacggatttttttgagatcaaggctgttaaggaaattgagccagcattgaaaaatcaactcattatttccactgttataatgacctttggaattgcaattgttacttgggtgggtgttccagcaaaattcaccatcttcaactttggaactcaaaaagttgtacagaactgggaacttttcttgtgcgttgctgttggtctttgggctgggctgataataggatttgtgacagagtactatactagcaatgcatacagccctgtgcaagatgttgctgattcttgtcgaactggagctgctacaaatgttatttttggcttggccttgggatacaaatctgtcattatccctatctttgcaattgcagttagtatttttgtgagtttctcctttgctgcaatgtacggcattgccgttgcggcccttggaatgttgagtacaattgctactggtttggccatcgatgcgtacggtccaatcagtgacaatgctggaggcattgcagagatggctggcatgagccacagaattcgggagagaaccgatgcccttgatgctgctggaaacacaactgcagcaattggaaagggttttgccattggttcagctgctcttgtgtcccttgccctctttggtgcctttgttagccgtgctggtgttgtcgttgttgacctcttgacacccaaagttttcattggcttgatcgttggtgctatgctgccatactggttttctgccatgacaatgaagagcgttgggagtgcagccctgaagatggttgaggaggtccgaaggcaattcaacacaatcccaggtctcatggagggtactgccaagcccgactacgctacatgtgtcaagatctcaactgatgcttctattaaggagatgatcccacctggtgcccttgtcatgttgacacccctcattgttggtatcctatttggagtcgaaactctttctggtgtccttgctggatcccttgtttctggtgtccagattgctatctccgcatccaacaccggaggtgcctgggacaatgctaagaagtacatcgaggctggtacctctgagcacgcaagaacccttggcccgaaaggatcagatccacacaaagctgctgttatcggggacacaatcggagacccactcaaggatacatctggaccttctctcaacattctcatcaagttgatggctgtggagtcactcgtgtttgctcctttctttgccagccacggtggtattctgttcaagatcttctaagaatgaaagaggaatgaatctttgtgccattacatcatcctctcctccttccattgacataacctctcccctctacgaaattttcaatgctttttttagacttcatattattatatgttcaagtctgtagctttgattcccttttgagaaacttgtagtttcaagtggcagagccttttaccctttcatcggttgtgatgatgatgatgaagaagaagaaagataagaagataaatcggtcaaatcttgtgaaatgagactgcgaagttaaaattctctttttcccaattgagaacaggctattattgttattctcactccttttcctccctctctctttttctctgttcaatgctgagttccattttgaattttgaggacctaaaatttttgaggatcttataccaaatgcattcgtgggttctctctttgttgaaaatctttgcttctttcattcatctaatttaaagcaagctgtggttggtaacttattcttgatccaaaaaaacctcctcgtatttg

SEQ ID NO: 1658 - DNA, 2707 bp, Triphysaria pusilla
cctcaatttcgcggctctgtgtctccctataagcttcctttttcatttttcatttccggtgtattccggtgagattagttaggttttcggagagaaatggctctactgacagatctgggaacggaaatcgtgattccggtgtgcgctatcatcggtatcatcttttcgctcgtgcagtggtttctggtgtctaaagtgaaggtcacgccggagcgaggtggctcgtcggctgcgaagaacgggaagaatgggtacagtgactacttgattgaggaagaggacggcatcgacgaccagaacgtcgtagctaagtgcgccgagatccagaacgctatctctgagggttcaacatctttcttgtttaccatgtatcaatatgtgggcattttcatggttgcttttgcaatcctcatcttcctgttcctgggctcagtcgagggtttcagcacaaagagccaggcatgcacgtacgataaggagaagctttgcaagcctgcccttgcaactgccatcttcagcacggcagccttcatgctcggtgccatcacttctgtcatttctggtttccttgggatgaaaatcgcaacctatgcgaatgcgaggacaacactggaagccaggaaaggtgtcgggaaagcttttatcactgcgtttagatctggcgcagtcatgggctttctccttgccgccaatggcttgttggttctttatatcactatcaatttattcaagatctactatggagatgactgggaagggcttttcgaggctattactggatatggtctcggtggatcctctatggctttgtttggaagagtcggagggggtatttacactaaggccgccgatgttggtgctgatcttgttggaaaggttgaaaggaacattccagaagatgaccccaggaatccagctgtgatcgcagacaatgtgggtgataatgtcggagatattgccggaatgggatccgatctttttggttcatatgcagaagcatcgtgtgccgctcttgttgtggcctccatttcctcttttgggacgactcatgatttcaccgcaatgtgttacccattgctcattagttccatgggaattctggtttgcttaatcacaacccttttcgccaccgacttttttgagatcaaggctgtcaaggaaatcgaaccagcgttgaagaagcagctcattatctccaccgttcttatgactttgggagttgcagtcgtcacatggacttgcctgccgtcgtcctttacaatcttcaatttcggtactcaaaaggttgtgaagaactggcaactattcctctgtgtctgtgttgggctttgggctggacttgtcattgggtttgtgactgaatattacaccagcaatgcttacagccctgtgcaagatgttgctgattcatgcagaaccggtgctgcaaccaatgttatattcggtctcgccttgggatacaaatctgttatcattcccatttttgctattgcaattagcattttcgttagtttctcctttgctgctatgtatgggattgctgtcgctgctctgggtatgctgagcactattgccactggactggctattgacgcttatggcccaatcagtgacaacgctggaggtatcgctgagatggccgggatgagccacaggattcgtgagagaactgatgcccttgatgctgctggcaacaccactgctgctattggaaagggttttgccattggatctgctgcgcttgtttcattggcactttttggtgcctttgtcagccgtgctgaaatttcaaaggttgacgtcttgaccccaaaagtcttcatcggtttacttgtcggtgccatgcttccatactggttctctgccatgaccatgaagagtgtcggcagcgcagctttgaaaatggtcgaagaagttcgcaggcagttcaacactattcctggtctgatggagggtcttgccaagcccgattatgctacgtgtgttaagatttcgaccgatgcatctctgaaggagatgatcccacctggcgcccttgtcatgcttactcctctgattgttggaacctttttcggggttgagaccctgtctggtgttcttgctggttctctcgtttctggtgtgcagattgcgatttctgcatccaacactggtggtgcgtgggacaatgcaaagaaatatatcgaggctggtgcatctgagcatgcaaggacccttggccccaagggatcagaaccacacaaggctgctgtcattggtgacaccatcggagatcctctcaaggatacttcaggtccttcactcaacatccttattaagctcatggcagttgagtcactcgtttttgctcctttctttgccactcatggtggtttgctatttaagcttttctgaataatgatgaaaaagggaatttttaaggtattcttaattatcccttttagttctgcgttccctctgtttgatcaaagtgtcggaatttttaagttaggttttagctagtgaattttgttgtttttgttgagatgatgatgattatgagcatgataatcgtggtggcaaggatggcgatgaaaatctgcattcttgccatggattagtcatgttaaatgtactactttttgtttcaatgccaatttatgaactacggatgattttgttgtaatagatttaatgttgctagaagaacatcggctccctaatttca

SEQ ID NO: 1659 - DNA, 4431 bp, Theobroma cacao
ggagctatgaaatctataataatagaatcgtttgcagaggattgttctcctcttctaatataaaaaatattgcatatttcgtttcacactataaattcacctgaaaccctcacacggaagagctccactcctccaactcacttctctctttatagataaactctctcttgtgcgcggtggccggaggactgtagctgttggcggcgatgggggaggcagtattgtcggagatggcgactgagatcgtggtgccggtatgcgcagtgattggaatagctttctcgttggtgcagtgggtgctggtgtcgcgcgtgaagctcacctccgagcggcatgcatcgggtggctcggggagcaatagcaagaacggttacagtgattacttgattgaggaagaggaagggatcaatgaccatagcgttgtcaccaagtgcgcagatattcaaaccgctatctctgaaggtgcaacatcctttctttttactgaatatcagtatgttggcatcttcatgattgcttttgctatcctgattttcctcttcctgggctctgttgagggcttcagcacaaagagccagccttgcacctatgataaggagaaggcatgcaaaccagctcttgccactgctatcttcagtactgtgtccttcttgctcggtgcagtcacttctgttctttctgggttccttgggatgaaaattgctacctatgccaatgcaagaacaaccttagaagcaagaaagggtgttggaaaggctttcattattgcatttagatctggtgccgtcatgggttttcttctggcagcaaatggtttgttggtgctttacattgccatcaatctattcaagctgtactatggtgatgactgggaaggcctttttgaggctataactggttatggccttggaggatcctctatggcactctttggaagagttggtggcggtatctatacaaaggctgctgatgttggtgctgatcttgtaggaaaggttgaaaggaacatccctgaagatgacccaagaaacccagctgtcattgctgataatgttggtgataatgttggcgatattgctggtatgggttctgatctatttgggtcatatgctgaatcttcctgtgctgctcttgttgttgcttctatatcctcctttggagtaaaccatgagttcactgccatgttgtttcctctgctcattagttctgtgggtattcttgtctgtttgatcacaaccctatttgctactgatttctttgaaatcaaggttgtcaaggaaattgaaccagctttgaagaagcagcttattatctccactgttcttatgactgtgggaattgcaattgttactttgattggtgtgccatcttccttcaccatttacaattttgggactcagaaagatgtcaagaactggcagctatttttgtgtgtgggtgttggtctctgggctggacttattattggttttgttaccgagtactacacaagcaatgcttacagcccagtgcaggatgttgctgattcctgcaggacaggagcagccaccaatgttatatttggccttgctttaggatacaaatctgttattatcccaatttttgccattgcaatcagcatttttgttagttttagctttgctgccatgtatgggattgcagttgctgcgcttggaatgttgagcaccattgcaactgggttggccattgatgcttatggtcccatcagtgacaatgctggaggcattgctgagatggctggcatgagccatcgcattcgtgagagaactgatgctcttgatgctgctggaaacactactgcagccattggaaagggatttgccattgggtcagcagcattggtgtcattggctctatttggtgcatttgtaagccgtgcagctatctctactgttgatgtcctgaccccaaaggttttcattggtttaatagttggtgccatgcttccatactggttctctgccatgaccatgaagagtgtgggaagtgcagctttgaagatggttgaggaggttcgcaggcagttcaacaccattcctggtctcatggagggtcatgccaggcctgattattctacctgtgtcaaaatctccactgatgcctccatcaaggagatgatccctcctggtgcccttgttatgcttactcccctgattgttggaactttctttggtgttgagactctttctggtgtccttgctggtgctcttgtttctggtgttcagattgcaatttctgcttccaacactggtggtgcatgggacaatgccaagaagtacattgaggctggcgcctcagagcatgcaagggaccttggtccaaaaggatctgatcctcacaaggcagctgtgattggtgacactgttggagatccactcaaggatacctctggcccttcactcaacatccttatcaagcttatggcagtcgagtcacttgtgtttgctccctttttcgccacgcatggtccacagagagaaggaaagatcaaatctccattgaagtattcaattccccagttaggagaagcaaacggaaataccatctttgaatctgttcattgtctcccacaattctgtgtcaagtttcgaattttgagaatgctgctattctctgccacaagaccgctcaatcccccccaacccctccctttcctctccttctcccgcttcgtttccctctctctgcctctccctatcctgccgaacccttccagatccacccacttcccttctctccaaatttactccattgacgcagctcaaccttttgactacgaatcccacctcaaaaaccgttacctccaatccacttccctcaagatagccataataggctttggcaacttcggtcagttcctctccgaaaccttcatccgtcaccaccacactctcctcgctcactcaagaacaaactacaccaacctcgctaaccaactgggcgtctctttcttctccgacccaaacgaccttttcgagcaacaccctgacgtcgtcctcctctctacttccattctttcaactgaaaccttactacaacagctaccctttcaaagactacgtcgaaacacactttttgtcgacgtactttcagttaaagagtttcccagaaacctttttttgaagtacttacctccagacttcgatattttatgtacgcatcccatgttcgggcctgaaagtggtaaaaatacgtgggcgggacttccttttgtttatgataaagtgaggattggagatgaagagagcagggtaaagagatgtgagaagttcttagacatttttgaaaaagaaggatgtagaatggtggagatgagttgcatggagcatgataagtacgcggcggggtctcagttcgtgactcatacgatgggtagagtgctggagcagtttgggttagagtcttcgcctattaataccaaagggtatgagacattgttgaatttggtggagaatactaaaggagatagctttgatttgtattatgggttgtttatgtataaccagaatgctttggagcagttggagaggttggatatggctttcgaatcgattaagaaggagttgtttggaaggctacatcgggtttataggaagcagttgtttggggataaggaggagaaggagagagagagaaggtttgctcagaagctgcttggcaatggaggtctaattgaccctcctttggataatgttggacaagatggatcctaaaaaatagtaaaaaacagagttgttctgtttcttatggtatgagaattgattgctctttgtcaagattttagctttgtattctttttttgttgtaaatggaattagcgtagttattgctgcttaaacctggatgaaatgactgatttttactttatgtgaagaaggttgcaagctcagcaaacaaataggcgcttgtttttcttcaattgctttgagattcacttgtagtttctctgaattgtttatttttcccttagaaggttttagaggtcagtggctggagcataaatttgtggtgctgttgcttttgatcctaattgtagaacagcagagctgtcctatgttttaagtgaccctgttagttagatgatctatttgtgttatgagttttggctgactactagttgatttcagaaagtggtcaaagatagtatattattttgttctttccctaattgtcacatgttaaactgtttgtcacaagagaatggtttgggattggcaagttgcattgggaaattcatggttgtactaacgagattagtgtttattgattgagagaaactgcctattcttttggagcatgagcatgctatggcctagctaaacaagtgagatcttagtctttgatgggtattgagattttttagccggattatgaaagtattggggcttctcataaaggataatatggaac

SEQ ID NO: 1660 - DNA, 2599 bp, Castanea mollissima
tctgtctctctctctccctgtgcgtgtgttctgtgtttagcttgggcttttcattttccggcgcgtggggacacgcgagtgtagctagggttccggcttaggatggcattgctctcggagctggcgacggagatcgtgatcccagtctgcgctgtgatcgggatagccttctcgttcgtgcagtttgtactagtctcgcgcgtgaaagtcacgcccgagcgccacgcgccgcctcagtcggtaaacaacaacaagaacggttacggcgagtacttgatcgaagaggaggatggcatcaacgaccaaaacgtcgtcgctaagtgcgctgagattcagaacgccatttccgaaggtgcgacttccttcctctttaccgaatatcagtatgttggggtctttatggttgcttttgcaattttgatcttcctcttcttgggctctgtcaagggcttcagcttaaagaaccagccctgcacttatgatgcagaaaagttatgcaagccagcacttgcaactgcagtctttagcactgtctctttcgtgcttggtgctttaacctcagttttgtctggttaccttggaatgaaaattgctacttatgccaatgcaaggacaacactggaagcaagaaagggtgttggcaaggccttcattactgcattcagatctggtgcagtgatgggttttctacttgctgcaaacggtcttttggttctttacattactatcaatctctttaagctatactatggtgatgattgggaaggcctttttgaggctataactggttatggtcttggtggatcttccatggcactctttggaagagttggtggcggtatttatactaaggctgcagatgttggtgctgaccttgtaggaaaggttgaaagaaacattccagaagatgacccaagaaacccagctgtaattgcagacaatgttggtgataatgttggggatattgctggaatgggatctgatctgtttggctcatatgctgaatcatcttgtgctgcccttgttgttgcttccatctcctcttttggtatcagccatgacttcactgcaatgtgctatccacttctcatcagttctatgggtatccttgtctgtttaatcacaaccctcttcgcaactgatttctttgaaatcaaggctgtcaaggaaattgaaccagcactgaaaaagcaactaatcatctccactgttctcatgactgtggggattgcgattgttagctgggttgctctgccatcatccttcacaatttacaattttggggttcaaaaagttgtgaagaactgggagctcttcttgtgcgtgggtgttggtctttgggctggacttgttattgggtttgttacagagtactatactagcaatgcctacagccccgtgcaagatgttgccgattcctgcaggactggagctgccactaatgttatatttggccttgctctaggatacaaatcagtcatcattccaatctttgccattgcagttagcatttttgttagtttcagctttgctgcaatgtatggaattgcagtggctgctcttgggatgctgagcaccattgctactgggttggctattgatgcttatggacccatcagtgacaatgctggaggtattgctgagatggcgggcatgagccaccgaatccgtgaaagaactgatgccctcgatgctgctggtaacaccactgctgccattggcaagggatttgcaattggatctgctgcacttgtgtctttggctctatttggtgcttttgtgagccgtgctgctatttcaaccgttgatgtattgacccccaaggttttcattggactgattgtgggtgccatgcttccttactggttctctgccatgacaatgaagagtgtaggaagtgcagccttgaaaatggttgaggaggttcgtaggcaattcaacactattccaggtctcatggagggtcttgccaaacctgactatgctacctgtgtgaagatctccactgatgcatccatcaaggagatgattcctcctggtgcccttgtcatgcttacacctcttattgttggaatcttctttggcgtggagaccttatctggtgttctggctggttcccttgtttctggtgtgcagatagcaatatctgcatctaataccggtggagcttgggataatgctaagaagtatattgaggctggtgcttcagagcacgcaaggagccttggcccgaaggggtctgacgcacacaaggcagctgtgattggtgacaccattggagacccactcaaggacacctctggcccatcactcaacatccttattaagctcatggcagttgagtcgctcgtgtttgctcctttcttcgccactcacggtggccttcttttcaagatcttctgagagatgacaaaaaagaacactgggggcaagaagtttatttcaattttatcttaattttgtccgccagaagaggtttattaacttgctcttttcttgtatcattatccttctccgcccttaggtagtgtttgattcaatcatgaactttgagaattaattttgcgaaatgatttttccgaatatgaggatcacattt

SEQ ID NO: 1661 - DNA, 3801 bp, Citrus clementina
tctcgtgcttcactgcgttcatcccatttttccttccctctttttttcttcgtttttataattttctttcgcgatgggatcgacgctgctgtcggagctcgcgacggaaatcctggtcccggtttgtgccgtggtcggaatcatcttctcgctcgtccagtggttcatcgtctcccgcgtgaggctgacgcacgagaggccgacgagcagcaacagcgacaagaagaatggattcaacgattacttgatcgaagaagaggaagggattaacgaccagagtgtcgttgccaaatgcgccgatattcagagtgctatctctgaaggtgccacatcctttctttttactgaatatcagtatgttggggttttcatgatcgcttttgcaattttgatcttcgttttcctggggtctgtggagggcttcagcacaaaaggccaagcctgcacttatgaccagcagaagatgtgcaagccagcacttgccactgcagccttcagtactgtgtcattcttgcttggtgctataacctctgttctttctgggttccttgggatgaagattgccacttatgccaatgcaagaactaccttagaagcaagaaagagtgtcgggaaggcttttattgttgcatttagatctggtgcagtgatgggtttcctccttgcagctaatggtcttttagtgctgttcattgcaatcaatcttttcaagctgtactatggtgatgactgggagggactttttgaggccattactggttatggtcttggaggatcatccatggctctctttggaagagttggtggtggaatttataccaaggctgctgatgttggtgctgatcttgtcggaaaggttgagagaaacattccagaagatgacccaagaaacccagctgtcattgctgacaatgttggtgataatgttggagacatagctggcatgggttctgatctttttggctcctatgctgaatcatcctgtgctgctcttgtcgttgcatccatctcatcttttggaatcaaccacgagttcactagcatgctgtatcctctgctcatcagttctataggcatccttgtttgtctgatcacaacgctctttgctacagatatctttgaagtcaaggctgttaaggaaattgaaccatcattgaagaaacagcttatcatctctactgttcttatgactgttggaattgcaattgttagctggataggcttgccatcttccttcacaatttacaattttggagctcagaaggttgtgaagaactggcaactatttttatgtgtggctgttggtctttgggctggacttatcattgggtttgtgactgagtattacactagcaatgcatacagccctgtgcaagatgttgccgattcctgcagaacaggagctgccaccaatgttatctttggccttgccttgggatacaaatctgtcatcataccaatttttgccattgcagtcagcatttttgttagttttagttttgctgctatgtatggtattgctgtggctgcccttggaatgcttagcactattgccactggcttggccattgatgcttatggccccatcagtgacaatgctggaggcattgctgagatggctggcatgagccaccgcattcgtgagaggacggatgcccttgatgctgctgggaacacgactgctgccattggaaagggatttgccattggatctgctgcgttggtgtctttggctctatttggtgcttttgtgagccgtgctggaattacaactgttgatgttttgacccccaaggtcttcattggtctgattgttggtgccatgcttccttactggttctcagccatgacaatgaagagtgtgggaagtgcagctttgaagatggttgaggaagtccgcagacagttcaacaccattccaggtctcatggagggcactaccaagcctgattacgctacctgtgttaagatctcaaccgatgcatccatcaaggagatgattcctcctggtgctcttgtcatgctcacacccctcattgttggaatcttctttggtgtggaaaccctttctggtgtgctcgctggctcccttgtttcgggtgttcagatagcaatatctgcctccaacactggcggtgcatgggataatgccaagaaatatattgaggctggtgcctcagagcatgcaaggacccttggcccaaagggttctgagccacacaaggcagctgtgattggtgataccattggagatccactgaaggatacgtcaggcccatctctaaacatcctcatcaaactcatggccgttgaatcactggtgtttgctcctttctttgccacccacggtttccatcaattgcgttaaaaccagttaaccacaatagtgtattggggcgtctctgttgctcttcctcctcttctcagttctctaatctcttcccaacaatgttctcgacagcgttctcgacaaatctccccaaaacaatcccatcactgccgccgccaccactacactcattccctccaattgtcccctcattttccctcccactttcctcccccaaatcccgccaccaccagggtccactccgccacgtcatccgcgcaatcgacgccgcccagcccttcgactatgaatcccaactccacacccagtacgtgaagagcacgtccctcaaaatcgccgtcattggcttcggcaactttggccaattcctcgccaaggccttcgcccgccaccaccacacccttctcgtccactcccgctccgatcactcccccgctgtccgtcaacaactcaacgcccccttcttcgccgacctcaacgacctttgcgagctccaccccgacgtcgttttgctgtccacctccatcctctccacccaatccgtcctcaaatcaatccccttccagcggctcaaacgcagcaccctcttcgtggacgtcctttccgttaaagaattccccagaaacctcttcctcaagtacttgcctcaggactttgatattttgtgcacgcacccaatgtttggccccgagagtgcaaaaagttcgtgggaaaatctcccttttatgtatgataaggttagaattggaaatgacgaggaaagaatcaaaagggttgataaatttcttgatgtattcgcgaaagaagggtgtaggatggtggaaatgagttgttttgatcatgataagtatgcggcggggtctcagtttgtgactcatacaatggggagggtgttggagagatttggagtggagtcgtcgccaattaataccaaaggctatgagacattgttggatttggtggataacacgaaaggggatagctttgatttgtattatgggctgtttatgtataataagaatagtttggagcagttgcagaggttggaaatggctttcgagagtattaagcagcagttgtttgggcagatgtttcgggtttataggaaggagttgttcgggagtgcagaggaggaggaggaggagagagtcaggcttttgtctgcaacgaaagagactcagaatggtgctcctgtggagcaggcttctgtggatagtgaaagattggaaggatcttaaacttaaagcagagatgttctgtttttgcggtatgcattattgcgaatttcttgttgcatatggtattttttttttgaagttattatgggttgccagatcagaatagaatgaatatgaccgtttttctgaattccaaaataccttatgtacacttctattttattctttttttttttttggtttttccggcgtaatgaatgaataatttacttt

SEQ ID NO: 1662 - DNA, 3801 bp, Citrus sinensis
tctcgtgcttcactgcgttcatcccatttttccttccctctttttttcttcgtttttataattttctttcgcgatgggatcgacgctgctgtcggagctcgcgacggaaatcctggtcccggtttgtgccgtggtcggaatcatcttctcgctcgtccagtggttcatcgtctcccgcgtgaggctgacgcacgagaggccgccgagcagcaacagcgacaagaagaatggattcaacgattacttgatcgaagaagaggaagggattaacgaccagagtgtcgttgccaaatgcgccgatattcagagtgctatctctgaaggtgccacatcctttctttttactgaatatcagtatgttggggttttcatgatcgcttttgcaattttgatcttcgttttcctggggtctgtggagggcttcagcacaaaaggccaagcctgcacttatgaccagcagaagatgtgcaagccagcacttgccactgcagccttcagtactgtgtcattcttgcttggtgctataacctctgttctttctgggttccttgggatgaagattgccacttatgccaatgcaagaactaccttagaagcaagaaagagtgtcgggaaggcttttattgttgcatttagatctggtgcagtgatgggtttcctccttgcagctaatggtcttttagtgctgttcattgcaatcaatcttttcaagctgtactatggtgatgactgggagggactttttgaggccattactggttatggtcttggaggatcatccatggctctctttggaagagttggtggtggaatttataccaaggctgctgatgttggtgctgatcttgtcggaaaggttgagagaaacattccagaagatgacccaagaaacccagctgtcattgctgacaatgttggtgataatgttggagacatagctggcatgggttctgatctttttggctcctatgctgaatcatcctgtgctgctcttgtcgttgcatccatctcatcttttggaatcaaccacgagttcactagcatgctgtatcctctgctcatcagttctataggcatccttgtttgtctgatcacaacgctctttgctacagatatctttgaagtcaaggctgttaaggaaattgaaccatcattgaagaaacagcttatcatctctactgttcttatgactgttggaattgcaattgttagctggataggcttgccatcttccttcacaatttacaattttggagctcagaaggttgtgaagaactggcaactatttttatgtgtggctgttggtctttgggctggacttatcattgggtttgtgactgagtattacactagcaatgcatacagccctgtgcaagatgttgccgattcctgcagaacaggagctgccaccaatgttatctttggccttgccttgggatacaaatctgtcatcataccaatttttgccattgcagtcagcatttttgttagttttagttttgctgctatgtatggtattgctgtggctgcccttggaatgcttagcactattgccactggcttggccattgatgcttatggccccatcagtgacaatgctggaggcattgctgagatggctggcatgagccaccgcattcgtgagaggacagatgcccttgatgctgctgggaacacgaccgctgccattggaaagggatttgccattggatctgctgcgttggtgtctttggctctatttggtgcttttgtgagccgtgctggaattacaactgttgatgttttgacccccaaggtcttcattggtctgattgttggtgccatgcttccttactggttctcagccatgacaatgaagagtgtgggaagtgcagctttgaagatggttgaggaagtccgcagacagttcaacaccattccaggtctcatggagggcactaccaagcctgattacgctacctgtgttaagatctcaaccgatgcatccatcaaggagatgattcctcctggtgctcttgtcatgctcacacccctcattgttggaatcttctttggtgtggaaaccctttctggtgtgctcgctggctcccttgtttcgggtgttcagatagcaatatctgcctccaacactggcggtgcatgggataatgccaagaaatatattgaggctggtgcctcagagcatgcaaggacccttggcccaaagggttctgagccacacaaggcagctgtgattggtgataccattggagatccactgaaggatacgtcaggcccatctctaaacatcctcatcaaactcatggctgttgaatcactggtgtttgctcctttctttgccacccacggtttccatcaattgcgttaaaaccagttaaccacaatagtgtattggggcgtctctgttgctcttcctcctcttctcagttctctaatctcttcccaacaatgttctcgacagcgttctcgacaaatctccccaaaacaatcccatcactgccgccgccaccactacactcattccctccaattgtcccctcattttccctcccactttcctcccccaaatcccgccaccaccagggtccactccgccacgtcatccgcgcaatcgacgccgcccagcccttcgactatgaatcccaactccacacccagtacgtgaagagcacgtccctcaaaatcgccgtcattggcttcggcaactttggccaattcctcgccaaggccttcgcccgccaccaccacacccttctcgtccactcccgctccgatcactcccccgctgtccgtcaacaactcaacgcccccttcttcgccgacctcaacgacctttgcgagctccaccccgacgtcgttttgctgtccacctccatcctctccacccaatccgtcctcaaatcaatccccttccagcggctcaaacgcagcaccctcttcgtggacgtcctttccgttaaagaattccccagaaacctcttcctcaagtacttgcctcaggactttgatattttgtgcacgcacccaatgtttggccccgagagtgcaaaaagttcgtgggaaaatctcccttttatgtatgataaggttagaattggaaatgacgaggaaagaatcaaaagggttgataaatttcttgatgtattcgcgaaagaagggtgtaggatggtggaaatgagttgttttgatcatgataagtatgcggcggggtctcagtttgtgactcatacaatggggagagtgttggagagatttggagtggagtcgtcgccaattaataccaaaggctatgagacattgttggatttggtggataacacgaaaggggatagctttgatttgtattatgggctgtttatgtataataagaatagtttggagcagttgcagaggttggaaatggctttcgagagtattaagcagcagttgtttgggcagatgtttcgggtttataggaaggagttgttcgggagtgcagaggaggaggaggaggaggagagagtcaggcttttgtctgcaacgaaagagactcagaatggtgctcctgtggagcaggcttctgtggatagtgaaagattggaaggatcttaaacttaaagcagagatgttctgtttttgcggtatgcattattgcgaatttctcgttgcatatggtattttttttttgaagttattatgggttgccagatcagaatagaatgaatatgaccgtttttctgaattccgaaatatcttatgtacacttccattttattcttttttttttggtttttccggcgtaatgaatgaataatttacttt

SEQ ID NO: 1663 - DNA, 2617 bp, Triphysaria pusilla
cattcccaatattcctccctaccaaacgcccctttcaccataaattgctccccctcatcttcaccccttcacattcttcttttccgaagcgaaaaaaaggaaaaattgcaaaagcaatgggcgaggggccgctgctttcagatctcggcacccagattttgataccaatttgtgccgtggtcggcatagctttctccctcgtccaatgggtgcttgtggcgaaggtgaaggtttccgatggaaaatccgacgccgacggggaatctgggtttactgaagctttaatttctgaggaggaaggcggtaatgacctttccgtcgttcgtaagtgcgccgatatccaagctgccatttccgaaggttccacatcgtttcttttcaccatgtaccaatacgttggtatcttcatgattgcttttgcaatgttaatcttccttttcctcggatccgtgaaaggtttcagcactagccatcaaacctgcacatacgacatcaccaaaatgtgcaagcccgctcttgccacagctattttcagcaccgtagctttccttctcggtgccgtcacatccgttatctccggctttcttggaatgaaaatcgcaacctatgcaaacgctcgaactactctagaagctaggaaaggtgtcggaaaggctttcataatcgcgtttcgatccggtgctgttatgggtttcctccttgccgcaaatggtcttctagttttgtacattacgattaatctttttaagatatattatggtgatgactgggaagggctattcgaggctattacggggtatgggcttggaggctcgtctatggctctatttgggagagttggaggaggtatttatacgaaagctgctgatgtaggagcggatcttgtcgggaaagtagaaaggaatattcccgaggatgaccctaggaaccctgcggtcattgccgataacgttggtgataacgttggagatattgcgggtatgggatccgatctcttcggctcgtacgcagaatcttcatgtgcggctctcgttgttgcttccatttcatcatttgggataaatcatgaatttacggctatgctatatcctcttctaatcagctcggttggaatcctcgtttgtttgctgaccacattgtttgcaactgactttttcgaggttaaggctgtcaaagaaatcgagccggctttaaagaaccaactaattatttcaacaatactgatgactattggaatagctgtcgttagttgggttgcccttccttcgactttcacaatatttaatttcggcgtgcagaaagatgttaagaactggcaattgttcctatgtgtcgctgtcggtttatgggctggccttattatcggattcatcacagagtactatacaagcaatgcttatagccccgtacaagatgttgcggattcgtgccgtaccggagcagctaccaatgtgattttcggcctcgcgttgggctacaaatcggttataattccaattttcgctatagcgattagcatttttgttagctttagttttgctgcaatgtacggtatagcggtggctgcccttggaatgctgagcaccatagcgactggtttggctatcgatgcgtatgggccgattagtgataatgctgggggcattgctgagatggctggcatgagtcacactattcgagagcgaacggatgcgcttgatgctgcagggaacacaactgctgctattggaaagggatttgcaattgggtctgctgctctcgtttcccttgccctcttcggtgcattcgtgagccgagcagacattacaaccgtagacgtcttaaccccaaaagtattcatcggattgcttgtcggagctatgcttccttactggttctcggccatgacaatgaagagtgtaggaagtgccgctttgaagatggttgaagaagttcgtcggcagttcaacaccatccctggtctaatggaaggcactgcaaagcccgactatgcgacatgtgtcaaaatctctacagacgcatctctcaaggagatgatccctccaggtgctcttgtcatgcttacgccacttattgtcggcattttctttggcgtcgaaactctttctggcgttcttgctggttctctcgtctctggtgttcagattgccatctctgcatcaaacaccggtggtgcttgggataacgccaagaaatatatcgaggctggtgcatcagaacatgctcggactcttggtcccaaaggctcggatgcacacaaggcggctgtgatcggagacactgtcggagaccctctgaaagacacgtctgggccatctctgaacattctgatcaagctaatggctgtagaatcgcttgtgtttgcgcccttctttgctgcacatggtgggttgctgttcaagattttctgaatgcggcatacgagaattgtctaaattcttcctctttctctctcgtttctttttgtttttttatgatataatcctttgtgagacgtagtttatcgaggagaaatttcttgtcgtcgttaattgatattgtagcagagtttgtgttgttggttcagttctttcatggagtaaaataaatgtttaacatttggattctcaattcattt

SEQ ID NO: 1664 - DNA, 2852 bp, Orobanche aegyptiaca
ccttgaaagcaaaagcaaaagcaatggacgaggcgactctgcttccagatctcggcaccctaattattatcccaatttgtgccgttatcggcatatccttcgccctcgttcaatggctggtggtcgctaaggtgaaggttgccgatggaaattcaagctccgccgacgggaaaagtggctttaccgaagccctcatctcggaggaggaaggcatcaccgatcattccgtcgttcgcaagtgcgccgacatccaatccgccatctccgaaggtgcaacatcatttcttttcaccatgtaccagtatgttggtatcttcatggttgcttttgccatgttaatcttccttttcctcggctcagtgaaaggtttcagcactagtcatcaaccttgtacatatgacagaaccaaaatgtgcaagcctgctcttgccacagctatttttagcaccttatcattccttcttggtgccgtcacatctgtggtctctggctttcttggaatgaaaatagcaacttatgcgaatgctcgaactactttagaggctagaaagggtgtcggaaaggctttcatagttgcatttagatctggtgcagttatgggtttcctccttgccgcaaatggccttctcgttctatacattacaatcaacctcttcaagttgtattatggtgatgactgggaaggcctatttgaggctataactggttatgggcttggaggctcttctatggctctttttggaagagttggtggaggcatttacaccaaagctgctgatgtaggagctgatcttgttggcaaggtagaaaggaatattccggaagatgaccctaggaaccctgcggtcattgcagataatgttggtgataatgttggagatattgcgggtatgggatcagatctctttggctcatatgcggaatcttcatgtgcagcccttgttgttgcttccatctcatcatttgggattaatcatgacttgactgctatgctatatcctcttctagtcagctcggttggaatcctcgtttgtttgctgaccacattgttcgcaaccgatttctttgaagttaaggctgtcaatgaaatcgagccagcattaaagaagcaactcattatctcaacaatactgatgactattggactagctattgttagctggattgcccttccttcttctttcacaatatttaattttggagtgcagaaagaagttaagagctggcaattgttcctatgtgtcgctgttggtctatgggccggcctcattattggatttgtcacagagtactatactagcaatgcttatagccctgtgcaagatgttgccgattcatgccgcactggagcagctaccaacatcattttcggacttgcattgggctacaaatcagttatcattccaattttcgccatcgcaattagcatttttgtaagctttagtttcgctgcaatgtacggaattgcagttgctgcccttggaatgctgagtacaatagcaactggtttggccattgatgcgtatggacccatcagtgacaatgctgggggcattgctgagatggctggcatgagtcacactattagagagagaactgatgcccttgatgctgctgggaacaccactgcagctattggaaagggatttgcaattggttctgctgctcttgtttcccttgccctctttggtgcgttcgtgagccgcgctgacatcacaactgtagacgttttaactccaaaagtattcatcggtttgattgtgggtgccatgcttccttactggttctcggccatgacaatgaagagtgtaggcagcgctgctttgaagatggttgaagaagtgcgtagacaattcaacaccattcctggtctaatggaaggcactacaaagccagactatgcgacatgtgtcaagatctctacagatgcttctatcaaggagatgattcctccaggtgctcttgtcatgcttacgcctctcattgtcggggtcttctttggtgtggaaactctttctggtgttcttgctggttctcttgtctctggtgttcagattgctatctctgcatccaacactggtggtgcctgggataacgccaagaaatatattgaggctggtgcttcagaacatgcacgaattcttggtcctaaaggctccgatgcacacaaggcagctgtaattggagacactgttggtgaccctctcaaggacacatccggcccgtcattgaatattctcatcaagctgatggctgtagaatcactcgtgtttgcccctttctttgctgcccatggtggcttgctcttcaagatcttctgaagtatggcaacacgcaagctgctgcctgattattccactctttttttcttcttttcctctgtgagatttatttttcgagaagagatttttctgtcgtcagcaattgttatatcatgatagagttggaacatctgtcttgtattctttcatcgaggaaaatggatgaacatttgcatcccctttcatcttcctttctccccttcttggttttgcagtttagttaactgccaacttgatttagttagacattggctactttgagctaatgattgatgattctggtgaagggattcttatttgttggatccggacccagtcttcgcttttggtggtcagatattgtctcgttatagactccgcttttagcagttatatcctacactcggggtgtacttaaaatgttgcactcaaatgtaagtttgatgaacttgtaggataataatagtgaacatttggtaagacaattaaaattttaccgttaagtgtaccaaccattttaggtacacctgaatgaaaataatttgttgttgc

SEQ ID NO: 1665 - DNA, 2575 bp, Silene vulgaris
atctgtatctctctctttttattctatctcttgtttgttgtattgttaaaatggggtcggtgctgctaccagatctggtcacgttgatattcataccagtatcagctgttattggaattgccttttcattattccaatggtatctcgtctccaccgtcaaactctctgcttccccttcttctaacaatggtgtctctgattcccttattgaagaagaagaaggtcttaatgaccattccgttgtcgccaaatgcgctgaaattcagaccgccatttctgaagggtcaacttccttcctattcaccatgtaccagtatgttggtgtatttatggtcgcgtttgctgtgctgatctttgtttttctcggatctgttgagggcttcagtacaagtagtcagccttgcacatatgacaagacgaggaggtgcaaaccagctcttgccaccgctatctttagcacagtgtccttcttactaggtgcaatcacctctttagcttcaggtttccttgggatgaaaattgcgacatacgccaacgctcgaacaaccttggaggctagaaagggtgttggtaaagcttttattgttgcatttaggtcgggagctgtgatgggcttccttcttgctgcaaatggtcttttggttctgtatgggaccatcctcctcttcaagatatactatggtgatgattgggaaggtctttttgagtcaattactgggtatggtcttggaggatcttctatggccctatttggtagagttggtggtggtatttacacaaaagctgccgatgttggtgctgatcttgttggtaaaattgaaaggaacattcccgaagatgaccccaggaatccagctgttattgctgataacgttggtgacaatgttggagatattgctggtatgggatctgatctctttggctcctttgctgagtcatcatgtgcagcccttgttgttgcatctatttcctcgtttgggaacaaccatcaattcactgctatgttgtaccctctcctgatcagcgctgtcggtattattatgtgcttgattacaaccttatttgcaaccgactttttcgagatcaaggctgtgaaggagattgagcctgctcttaagaggcagctagtcatctccactgtgttgatgactattggtgttgcagctgtctcattcacagctcttccttcttcatttaccattttcgattttggaacacagaaagaggttaaaaactgggaactgttcttatgtgttgctgttggcttgtgggctggacttatcattggatttgtgacggaatactacactagcaatgcatacagccctgtgcaagacgttgccgattcttgcaaaactggagctgcgactaatgttatctttggcctggccttagggtacaagtcggtcatcatccctatctttgccattgcaatcagcatttttgttagttttagccttgcggctatgtatggtattgccgtggctgcccttggtatgttgagcactattgcaactggattggctattgatgcctatggtccaatcagtgacaatgccggtggcattgctgagatggctggcatgagccacacaatccgtgagaggactgacgcccttgatgctgctggaaacaccactgctgctattggaaagggtttcgccattggctcagcggctcttgtttctctggccctatttggtgcctttgtgagccgggcgtctattaccacagttgatgtgttgacccctaaagtcttcatcggtctcattgtaggagctatgcttccgtactggttctctgccatgacaatgaagagtgttggaagtgcagctttgaagatggttgaggaggtgcgccgacaattcaacaccatccctgggttgatggaaggcactgctaagcctgactacgctacttgtgtcaagatctccacagatgcttctatcaaggagatgattccccctggtgctcttgtcatgctcactcctttgattgttggcattttgtttggtgtcgaaactctctctggtgttcttgctggttctcttgtttccggtgttcagatcgccatctctgcatccaacaccggtggtgcttgggacaatgcgaagaaatacattgaggctggtgcgtccgagcatgcaaggtcgcttggtcctaagggatcagatgcacacaaagcagcagtgattggtgacacagtaggagaccctctgaaagacacatctgggccatctctcaacatccttatcaagctcatggctgttgaatctcttgtatttgcccccttctttgccacccacggtggcttgctcttcaagctttagacatgatacaacggcacccgagggaagtcttgtagcatatccctctattttgtcgctgacgaaattggttagtttgagttagtcgcaaatttttgaatgtcgtagatggcaaggctgatggggctcgccgctacccccctttgtttcgagggggatggtttggcgacgataacgacgaaaatatcggtcagtcctgtttactagagttattataaggtcaatattattctttctttcttttcttt

SEQ ID NO: 1666 - DNA, 2617 bp, Helianthus annuus
cggggctccaacacctctcttaatttctccacaacttatcctcccaaaacgtcgtcgtttcattcatctccatggctccaaccgtactgtcaacatttgcgacggagattattattccggtttgtgccgttatcggaattgctttttcgttaatccaatggtttttagtgtctagggttaaaatgacacctgaccgtaacgctaacaataataataatagtaataaaaacgggtatgatgattacttgattgaagaagaagaggggcttaatgatcataacgttgttgttaagtgtgctgagattcagaacgccatttctgaaggtgcgacctccttcttgtttaccgaataccaatacgtcagtattttcatggtggttttcgcaatcttaatcttccttttcctgggctcggtcgagggtttcagcacgaaaagccagaaatgcacatataacgtccaccagatgtgcaaacccgcactcgcaaccgccgccttcagtacaatcgccttcctactcggagcaatcacctcgctcatttccggattcctcgggatgaaaatcgccacttacgctaacgcaaggacaacgcttgaagcccgaaaaggcgtcggtaaagctttcattaccgcgttcaggtccggtgctgtaatgggctttcttcttgccgcaaacgggctattggtcttgtacatcgcgattaatctgtttaagttgtattacggggacgattgggaagggctttttgaagcgataactggttacggactcggtggttcgtcgatggctctgttcggaagagtcggtggaggtatatatacgaaagcagctgatgtcggtgcggatcttgtcgggaagattgaacggaacattccggaagatgaccctagaaatccagctgttatcgccgataacgttggagataatgttggggacattgccggaatgggatccgatcttttcggctcgtatgccgaatcatcgtgtgccgcactcgttgttgcttcgatttcttctttcggaatcgaacacgacttcactgcaatgtgttatccgttgcttgtgagctctgttgggattatcgtttgcttgataaccacgctgtttgcaactgatttctttgaaatcaaagtcgtcgatgagattcaatcggcgttgaaaaaacagcttatcatctccactgttcttatgaccgttggtatcgcaatcgttagcttcattgggctcccgacatcgttcacgatattcaatttcggtgttcagaaggtcgtgtataactggcaactgttcttgtgtgtatgtgtcggtctttgggctggactaatcattggttttgtgaccgagtactacaccagcaatgcttacagcccggtacaagatgttgctgactcctgcaggactggagccgcaacaaacgttattttcggtctcgcattgggatataaatccgtaatcattcctatttttgctatagcaatcagcatctttgttagttttagctttgctgccatgtatggtattgcggttgctgctcttggaatgcttagcaccattgccactggtctcgctatagacgcttacgggcccatcagtgacaatgctgggggcattgctgagatggcgggtatgagtcataggatccgtgagaggactgacgcccttgatgctgccggcaacaccactgccgccatcggaaagggatttgctatcggttcagcagcactggtctcattagcgctattcggagcctttgtgagccgtgcaggcatcgagacggtcgatgttctaacaccgaaagtcttcataggtctaatcgttggtgcgatgcttccgtactggttttcagccatgacgatgaagagtgtgggaagtgccgccttgaaaatggtggaggaagttaggcggcagtttaacacgattccgggactcatggaaggccttgcgaagcctgattataccacgtgtgtgaaaatctcgaccgatgcgtctattaaggaaatgatcccgcctggcgcccttgtgatactgactcctttgatcgtcggcacgttttttggagtcgagactctttcgggtgtccttgctggcgcgctagtttctggtgttcaggtggcgatttctgcatcgaacaccggtggtgcatgggacaatgccaagaagtatattgaggctggtgcatcagaacatgcaagaaccctcggaccaaaggggtctgaaccacacaaagccgctgtgatcggtgacaccatcggtgacccgctcaaggacacgtcaggcccatcactcaacattctgatcaaactgatggctgtggaatcacttgtgtttgcacccttctttgctgctcatggtggtttgctctttaaactgtagtcatcagccatcttttagcacttaagttagcctctctttttttttctgtttcaaaatgttagagctcatagatagtcaaatgatgatgatgataacatgatgatgttggaacatgtgttaggtttttttttcgtgtgtgttggactggttaatggttctagatgtttgctggcttttatggttgtagacttctagaaaaagaaactgtatctctgttttttggagtatacaagaagcagcagtta

SEQ ID NO: 1667 - DNA, 2682 bp, Mimulus guttatus
gttttccttgctaatctgctcccagttttttttcttcccattttatccttttcttcctgtttatatatttgtgtttattactccggtggggggagtagttaggtttccggtgagaatggcgttgctgtcagaacaggggacggagatcgtgattccggtgtgcgcggtcatcggcatcatcttctcgcttgtgcagtggtacatcgtgtccaaagtcaaggtctcgccggagagaagcggcgccgccgcatcgccggctgcaaacaacgggaagaacggcggctacaacgactacctgattgaggaggaggacggaatcgacgaccaaaacgtcgtcgctaagtgcgccgagatccagaatgctatctccgagggtgcaacatcattcctctacaccgagtaccaatacgtgggaatcttcatgatagctttcgcgatcctcatcttcctcttcctcggttcagtcgagggtttcagcacaaagaaccagccatgcacgtataacaaagaaaccctctgcaaaccagccctcgccaccgccgttttcagcaccgcctcctttttgcttggtgcagtcacctcggtcatatccggtttcctaggcatgaaaatcgccacctatgcgaatgcacgaacaacccttgaagccagaaaaggtgtcggaaaggccttcatcgttgcattccgatccggcgctgtaatgggctttctcctagcggcaaacgggcttttggttctatacatcaccataaatttattcaagatttactacggtgacgactgggaagggcttttcgaagctattaccggatacggtctcggtgggtcctccatggctttgttcggaagagtcggtggtgggatttacaccaaggccgctgatgttggcgctgacctcgtcggtaaggtcgagcggaacattccggaagatgaccccagaaaccctgccgtgattgcggataatgttggagacaacgtgggagatattgctggaatggggtccgatcttttcggttcgtacgctgagtcatcgtgcgcggctcttgttgtggcctcgatttcgtcttttgggttgactcacgatttcaccgcaatgtgctaccctttgcttatcagctcaatgggaatcttggtttgtttgataaccactcttttcgctaccgactttttcgagatcaaggctgtaaaagaaatcgaaccggcattgaagaagcagctaatcatctccactgttcttatgactgtcggagttgcaatcgtcacgtggacttgcctgccttcttccttcacaatcttcaatttcggcgctcaaaaagtcgtcaagaattgggaactattcctctgcgtttgcgtcggtctttgggctggactcattatcgggttcgtcactgaatattacacaagcaatgcttacagtcctgtgcaggatgttgctgattcatgcagaaccggtgctgcgaccaatgttatattcggtctcgcgttgggttacaaatcagtcataattccgattttcgccatcgcggttagcatattcgtcagtttcacattcgccgccatgtacggtattgctgtagctgctctgggtatgctgagcacaatcgctaccggcttagctatcgatgcttatggtccgatcagcgataacgctggcggcatagctgagatggccggtatgagccaccgcattcgcgagagaaccgacgctcttgatgctgccggaaacaccactgccgccatcggaaagggttttgcaattggatcagctgcactcgtttcattggcactcttcggagcgtttgttagcagagcggaaatcaagacagttgatgtgttgactccgaaagtcttcatcggattaatcgtcggagcgatgctgccgtactggttctcagccatgacgatgaagagcgtgggcagtgccgccctgaagatggtggaggaagtgaggaggcagttcaacacgattcccggtattatggaaggtaccgccaaaccggattacgccaggtgtgtgaagatatcgactgatgcttcgattaaggagatgattccacctggctgcctagtcatgcttacgcctttgattgtcggaaccttctttggggtcgagacactcgctggggttctcgccggtgccctcgtttctggcgtgcaggttgcgatatctgcatcgaacactggtggtgcatgggacaatgccaagaaatacatcgaggccggtgcatcggagcatgcaagaacactcgggccaaagggatcggaaccgcacaaggctgctgttataggtgacacaataggggacccactaaaggacacttcaggcccttcgctaaacatcctcatcaagctaatggcagtcgagtcgctcgtttttgctcctttcttcgccactcacggtggccttctctttaaactcttctgatcaatcatcaaacatgctcttcgtctctcgttttctctcctacttttcccaatgtaagaagcatctttcgctctgttttttcgtgtccaattttctcaagtacgggaattttctctgttttttttttttttaagttaggtcgtagctagcgagattttaaattttgttgaattgatgatgatgatgataattctgttggttaaattgaatgatgataaaaaaatctgcatccatcacaagtattagttttttgtcct

SEQ ID NO: 1668 - DNA, 2758 bp, Mimulus guttatus
ataactcaacagctcttcttccttgcttctctgctcactcaccgttctcacctcattttttttatatcctatttgtaattttatttctgccggtgagttccggcgaggtagttagggttccggcgagaatggcattgctttcagatctggggacggagatcgtgattccggtgtgcgccgtcatcggcatcgccttctcgctctttcagtggtaccttgtctcgcgtgtgaaggtcaagccggaccacggcggcgagccggcagctaagaacgggaagaatgggtacggcgactacttgattgacgaggaggaaagcatcaacgaccagaacgttgtcgccaagtgcgccgagatccagaacgctatttctgagggcgcgacgtctttcctgttcaccgaatatcaatatgtcggcatcttcatggttgcatttgcggtcctcatcttcctcttcctgggctcggtcgagggtttcagcacaaagagccaggcatgcacttacaacaaggacaagctgtgcaagccagctctcgcaactgctctcttcagcacaatatccttcgtgctcggtgccatcacatctgtcctttccggtttcttcggtatgaaaatcgcaacctacgcaaacgcaaggacaacattggaagccaggaaaggcgtcggcaaagcctttattgttgcgttcagatccggagcggttatgggttttctcctcgctgcaaacggtctgttggttctgtatatcaccatcaatgtattcaagatctactatggcgaggattgggaaggtcttttcgaggcgatcactggttatggtctcggtggttcctccatggctctgtttggcagagtcggtggtggtatatacaccaaggctgctgatgtcggcgctgatctcgtcggaaaggtcgagcggaacattccggaagatgaccctagaaatccagctgtgattgccgacaatgtaggtgacaatgttggagatattgctggaatggggtccgatcttttcggttcgtacgctgaagcttcttgtgctgctctggtcgtggcttcgatttcctcttttgggctgactcatgacttcactgcaatgtgctatccgttgcttattagctccatgggtatactcgtttgcttaatcactacccttttcgctaccgactttttcgagatcaaggctgtcaaggaaatcgagccagcgttgaagaagcagctcatcatatccaccattcttatgaccgtggggattgctattgtcacatggacttgtctgccatcatcgttcaccattttcaatttcggtgcacaaaaagttgtcaagaactgggagctgttcctctgtgtttgtgttgggctttgggctggactaatcatcggatttgtgactgaatattacaccagtaacgcttacagtcctgtgcaagatgttgctgattcgtgcagaactggtgctgcgacaaatgttatatttggtcttgcgttgggatacaaatcggttataattcccatctttgcgattgcagttagcatttttgttagtttcagctttgctgctatgtacggtatagcagtggctgctttgggcatgctgagcacaattgcaactggattggcaattgatgcatatggtcctattagtgataatgctggtggtattgctgagatggctggtatgagccacaggattcgcgagagaaccgatgccctcgatgctgctggaaataccactgctgctatcggaaaggggtttgcaatcggatccgcagcactcgtctcattggccctcttcggtgcctttgtgagccgtgctggaattacgaaagttgatgtgttgacccctaaggtcttcataggtttgctggtgggtgcaatgctcccatattggttctcagccatgacaatgaagagcgttggtagcgcagctttgaagatggtggaggaagtgagaaggcagttcaacgagattccgggcctcatggagggtactgcaaagcccgattatgccacgtgtgtcaagatctccaccgatgcgtcccttagggaaatgataccacctggcgcccttgtcatgcttacccctctcatcgttggaacctttttcggcgttgaaaccctctccggtgttcttgctggttctcttatttctggtgttcagatagcaatttctgcatccaacactggtggtgcatgggacaatgcaaagaagtacattgaggctggtgcttctgagcacgcaagaacactgggccccaagggatcggagccacacaaggcggccgtgatcggagacacgattggagatccactcaaggatacatcgggtccctcactcaacatcctcatcaagctcatggcagtcgaatccctcgtttttgctcccttcttcgccactcacggtggccttctattcaagctctgaactatatgattaatcagtactcgggttttatcttcacctcgtcattttactgagcgacgtttcgtgtgtttttaatgagctgataatgatgataatagtgatctaaagaggcggtgttatctgttttttttttcttcgtcccaaggcgctttagaatatctgtagttctatttgtaagaggaattagttttactttttgctcaggtagcatttatttgtcttaggtttttggttgtcctatgttgttgtaacatttgatgttgttgtaacatttatttttatttggttaaatcctctctacttttgttctactattgagccttgcttcttgatat

SEQ ID NO: 1669 - DNA, 2741 bp, Oryza sativa
gcgtcccctctcctccattctcatccacctcctctctctctctctctctctctctctctctctctctttctctctctctctgcgatccgaggcgcgaattgtgaggagagggggggagcttagctgcggagatggcggcggcggcgatactgccggagctggcggcgcaggtggtgatcccggtggcagcggcggtggggatcgcgttcgcggtgctgcagtgggcgctcgtctccaaggtgaagctcacggcggagccgcggcgcggggaggcggggggcgccgccggggggaagagcgggccgagcgactacctcatcgaggaggaggaggggctcaacgaccacaacgtcgtctccaagtgcgccgagatccagaccgccatctccgaaggagcgacatctttccttttcactgagtacaagtatgtcggattattcatgagcatcttcgcagttcttattttcctcttccttgggtctgttgagggcttcagcacgaagagccagccttgccactacagcaaggacaagacttgcaagcctgcccttgcaaatgctatctttagcactatagcttttgtgcttggtgcagttacctctctggtatctggttttcttggaatgaagattgcaacttatgcaaatgctcggacgactctggaggccaggaagggtgttggaaaggcttttatcactgctttccggtctggtgccgttatgggtttcctgcttgctgcaagcggtctcttggtcctttacattgcaattaatttgtttggaatttattatggtgatgactgggaaggcctttttgaagctattactggttatggacttggtggttcttctatggctcttttcggccgtgtaggtggtggtatttatacaaaagctgctgatgttggtgctgaccttgttgggaaggtggaaagaaatattcctgaggacgatcccagaaacccagctgtcattgcagacaatgttggtgacaatgttggagatattgctggaatgggatcagatctttttggttcttatgctgaatcatcgtgtgctgcacttgttgtggcatcaatctcttcttttggaatcaaccatgaatttactcccatggtgtaccctcttcttgtcagctctgtgggaattatagcgtgtctcataaccaccttgtttgcaactgatttctttgagataaaggctgtgagtgaaatagagccagctctcaagaaacagcttataatttccactgcttttatgactgttggcattgcccttgtcagttggttgggccttccttacaccttcaccatctttaactttggtgcccagaagacagtgcaaagctggcaattattcttgtgtgtggcggttggtctttgggctggtctaatcattggatttgttaccgagtattacaccagcaacgcatatagccctgtacaagatgttgctgattcttgcagaactggagctgccactaatgtcatttttgggcttgctttgggttacaaatcagtcatcatccctatttttgctattgctttcagcattttcctcagcttcagccttgctgccatgtatggtgttgctgtggctgctcttggaatgctgagcacaattgccacaggtcttgctatcgacgcctatggtcccatcagtgacaatgctggaggaattgctgaaatggccggcatgagccacagaattcgggagagaactgatgctctggatgctgccggaaacacaactgccgcaattggaaagggttttgccatcggctctgcagccttggtgtcacttgcactttttggtgcctttgtgagccgtgcggctatctctacggttgatgttctgacaccaaaagtgttcattgggcttattgttggtgctatgctcccatactggttctcagcaatgactatgaagagtgtaggcagcgcggcgctaaagatggtggaggaagtccgcaggcagttcaacaccatccctggactcatggagggcacaactaagcctgactatgcaacttgtgtcaagatctccactgatgcatccatcaaggagatgatccctcctggtgctcttgttatgctcaccccacttatcgtcggaattctgttcggcgtcgagaccctctctggagtccttgctggtgctctcgtctctggtgttcagattgccatctccgcatcaaacactggcggtgcttgggacaatgcaaagaaatacattgaggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaaaccggcgacgttgggtgtaacaaaggccatagttttgttggggatgagcaaaatatgtagactattttgtcatgatttgctccttgagttgatgactccattgtctacttgatttcccatttttgttctagttccaggttccaaccttgtgttttgatcccagaattttctctggtcctctttagcttttgtctccagctgcataagtcatcctgtggcacagtgaacaaggagcattggaaaatttgccattttctagcgataaaatgatgaggatgatgatgatgattgatgtcg

SEQ ID NO: 1670 - DNA, 2648 bp, Helianthus annuus
atatagagatatacatacatacatacatctatatctatctatatagagagagagagatttaacccaaaattattaaatctctctctgttctgttctccgtgttccgatcggatttccggtttatatctctgtgtgtagatctgatgacgtcagctactattctctcagatctcggcaccgagatccttatcccgatctgtgcggttataggcatattgttctcgctgttccagtggtaccttgtgtcgcaagttaagctcgttgctgagaaaccggatgctgacggaaagaacgggtttacggagtcgttgattgaagaagaagaaggtgttaatgatcatacagttgttcagaaatgcgctgagattcagaatgctatttctgaaggagcaacctctttcctgttcactgaataccaatacgttggagtatttatggtcattttcgctgttctaatcttcgtattcctcgggtccgttgagggattcagcacaagtaataaaacatgcacatacgacgccaccaagatgtgcaagcccgctctaatgacagcagtgttcagcactgtgtcattcttgcttggtgccatcacctcagttgtctccggctttcttggaatgaaaatcgccacatatgcaaatgccagaaccacccttgaggctagaaagggtgtcagcaaggctttcattgttgcgttccgatctggtgcagttatggggttcctccttgctgcaaatggcctacttgtattgtatattaccattaatctgtttaagatctattatggtgatgattgggaaggcctttttgagtccataactggttatggacttggtggttcttcaatggcgctttttggtagagttggtggtggtatttacacaaaagctgctgatgtcggcgctgatcttgttggcaagattgagaggaacatccctgaagatgaccccagaaatcctgcggttattgctgacaatgttggtgacaatgttggggacattgctggtatgggatcggatctgttcgggtcatatgctgagtcatcatgtgcagccctcgttgtcgcttcaatctcctcattcggtaacacccatgatttcacttcaatgatgtacccactaaccgtgagctccgttggcatcatagtctgcttgatcaccaccttgttcgccactgatttcttcgaagtcaaaactgtgaaacaaattgagccttctttgaaaaaccaactcatcatttcaaccgtgctgatgactatcggtatcgccattgttagttggatcgctcttccttctagcttcaccatcttcaattttggaacccaaaaagtagttaaaaattggcaattgttcttgtgtgtttgtgttggtttgtgggctggtcttgttattggattcgttaccgagtactacactagcaatgcttacagccctgtgcaagatgttgctgattcatgccgtaccggagctgctacaaatgttatatttggtcttgctttgggatacaaatcagttatcatcccgattttcgcaatagcaatcagtattttcgttagtttcacctttgccgccatgtacggtgttgctgtcgcagctcttgggatgctgagcaccatagcgaccggtttggccatcgatgcatatggtcccatcagtgacaatgctggtggtatcgcggaaatggccggaatgagccacagaattcgtgagaggaccgatgcccttgatgctgccggaaacaccaccgcagctatcggcaagggtttcgccatcggttcagcagctcttgtatccttggctctattcggtgcatttgtgagccgtgccgagatcacaaccgtagatgtattgacccctaaagttttcatcggtttgctcgtgggtgcgatgcttccatactggttctcagccatgacaatgaaaagcgtcggaaaagctgcacttaaaatggttgaagaggtccgtaggcaatttaacaccattccgggcctcatggaaggaaccgctaagcccgattatgccacctgtgtgaaaatctcgaccgatgcctcgattaaggagatgatcccgcctggcgctcttgtcatgctcactcccctcattgtcgggattttctttggcgttgaaacgctttctggtgttcttgctgggtctcttgtttctggtgtgcagattgctatctctgcatcaaacactggcggtgcttgggacaacgctaagaaatacatcgaggctggtgtttccgagcatgcaaaatcactcggacctaaagggtcagacccacacaaggcggctgtgatcggagacaccattggagatcctttaaaggacacttcaggaccgtcactaaacatcttgatcaagctcatggctgtcgaatctttggtgtttgcccccttctttgccacccatggaggccttttgttcaagttgttctagattcataatgaaggtgatgtcggttatatgtcctttgattagcctgtcgtttcatgcgtttagttgtatcacttgacgtctttgctttatttttcgagtcatctagcatatgtttctctacgtcttatttttgatgttttgttcggcgattagcaatttttcgatatgtataagacatgataagtaatccttctcatcaagagtttgaac

SEQ ID NO: 1671 - DNA, 2714 bp, Tropaeolum majus
aacctcctccactcccttccctcatccctttgaaatcgctctctaaacaagaaagtggattgagttccccacggcgctgtaacccccgagtttaatccggctagagaaaaataatggtgtcggcggagtcgctttcggagctcgggaccgagattgtgatccctatctgcgcggtggtagggattgcgttctcgattttgcaatggtactttgtgtcacgcgtgaagctcacgcatgaaccacagccgtcttctcataataacagcaagaatggttatggagattacttaattgaagaggaggacgggtctaatggtcagagtgttgttgaaaagtgtgctgagatacaaactgctatctccgaaggggcgacatcctttcttttcactgaataccaatatgtcggagttttcatggttgcttttgcaattctaattttgtattcttgggctcggtggagggattcagcacaaagagccaggcttgcacttatgatctgcagaagatgtgcaagccaagacttgctacagcagtcttcagtacagtttccttcttgctcggggctataacttctgtcctgtctggtttccttgggatgaaaattgctacatatgccaatgcaagaactaccttggaagcaagaaagggtgttgggaaagccttcattgttgcatttagatctggtgctgtgatgggtttccttcttgctgcaagcggtcttcttgtgctgtacattactatcaatctcttcaagctgtactatggcgatgactgggaaggtctttttgaggctatcactggttatggtcttggaggttcatctatggctctctttggtagagttggtggtggaatctataccaaagctgccgatgttggtgcagaccttgtcggaaaggttgaaagaaacattccagaagatgacccaagaatccagctgtcattgctgacaatgttggtgataatgttggtgatattgctggtatgggttctgatctttttggctcatatgctgagtcatcatgtgctgccctagttgttgcttccatctcctcatttggaatcgatcacgatttcactgccatgtgttatccattgcttattagttctatgggtattattgtgtgtttgatcacaaccctctttgccaccgatttttcggaaatcaaggctgtgaaggaaatagaaccagcgttgaagaagcagctcatcatctccactttgctcatgactgtgggaattgctgtagttagttgggttagcttaccagaatccttcacaatcttcaattttggaacacagaaggttgtaaagaactggcatctgttcttatgtgtgggtgttggtctctgggctggacttattattggatttgttacagagtattataccagcaatgcatacagccccgtgcaagatgtagccgattcctgcaggactggagctgcgactaatgttatatttggccttgctttaggatacaaatctgtcataattccaatttttgctattgcagtcagtatctttgttagttttagcttggctgctatgtacggtgttgctgttgctgcccttggaatgctaagtaccattgcaactggcttggccattgatgcctatggtcccattagtgacaatgctggaggcattgctgagatggctggcatgagccaccgaatccgtgaaaggacagatgcccttgatgctgctgggaacaccactgctgccattgggaagggatttgccatcgggtctgctgcattggtgtcgttggcactctttggtgcttttgttagccgtgcagcaatctcaaaagttgacgtgttgaccccgaaggtcatcattggtttgcttgttggtgccatgcttccttactggttctctgctatgacaatgaagagtgtgggaagtgctgcacttaagatggttgaagaggttcgtaggcagttcaacactattcccggtcttatggaaggtcttgcaaagcctgattatgccacctgtgtcaagatctccaccgatgcatctatcaaagagatgattccaccaggtgctcttgtcatgcttaccccactcatagttggtatcttttttggcgtcgagactctggctggtgtccttgctggctcccttgtttctggtgtgcagattgccatatctgcctccaacactggtggtgcatgggataatgccaagaagtacatcgaggccggtgtctctgagcatgcaagaagtctcggtccaaaagggtcggacccacacaaggcagccgttatcggtgacactattggcgacccacttaaggacacatcgggaccatcacttaacattctcatcaagctcatggcggttgagtctcttgtgttcgctccgttcttcgcaacccatgggggtttgcttttcaagatcttttaaaaggggaagaccgaatcatcgtcaaagcatcatatcctgtggaatcgttcttattttggaatttttgttagtttcaaatgtcgtttagttttctctgcctgcatcatccatttgatcataagatggaaatttctctcagttgtgtccaacagttatgggagttgttaatttttgaaatgttgattatgatgataaaaagatgacttcaaaatttacattctgtaatttagggttttatggccttagaagaagccttaagtttttgagttattgtaccgcttgaaattcaagcatttaaa

SEQ ID NO: 1672 - DNA, 2759 bp, Distylium racemosum
cgccaggtcaagggttcgaaacccgcagtgcgcgagtctcccccttctggaagagaattcccgctgtttttagtgtggaaaaccacgttgaaacttgctgctgtttaggctttaggactatttaaagctcccccgggggtttctggctttctaaggagaagtgcagtggctctgaagtctgaattgtggatttgagattgtgaagatggtggaagctatgttgagttcaatgcttacggagatcctgatacccgtggcggccgtggtggggatcatctttgccctggtgcagtgggtgctggtgtcgcgggtgaagatggtgccagggcatgcgaacggggcgaataataataatagtagcaaaaatgggtacacggagtatttgatcgaggaggaggaaggggtcaatgacaacaatgtggtcaacaagtgcgccgagatccagaatgccatttcggaaggagcaacctcttttcttttcaccgagtatcagtacatgggcattttcatggtctgcttcgcagttatcatatttttgttcctaggttcagtggagaaattcagcacaaaaagtcaaccatgcacttacaataaggaagtgatgtgcaagccagcccttgccaatgctatcttcagtaccgtatctttcttgcttggttctttgacatctgctatgtctggttaccttggaatgaagattgcgacttatgcaaatgcacgaacaacattagaagccaggaagggcgtgggaaaagctttcatcactgcgtttaggtctggtgctgttatgggatttttgcttgccgcaaatgggctgttggtgctttatattaccatcaatgttttcaaggtgtactatggagatgactgggagggactttttgaagctattactggttatggtctgggaggttcctccatggctctatttggcagagttggtggtggtatttacactaaggcagcagatgtaggtgcagatctcgttggaaaggttgagaggaacattcctgaagatgaccctcgaaacccagcggttattgctgataatgttggggacaatgttggagatattgctggcatgggttcagatctgtttggttcctatgctgagtcttcttgcgcggctctggttgtagcatcgatctcatcatttggagtcaatcatgaatttactgcaatgtgctaccccttgctcataagttcaatgggtatcattgtttgcttgatcactactctgtttgcaactgacatatttgagatcaaggctgtgaaggaaattgagccttcattgaaaaaacagcttattatctctactgtactcatgaccattggcattgctgttgtaagttttgttgcgttgccttcatccttcaccatcttcaattttggtgaacaaaaggttgttaaaaactgggagcttttcttttgtgtcgctgttggtttgtgggctggccttgtcattggttttgttaccgagtactacacaagcaatgcttacagcccagtgcaagatgttgctgattcatgcaggacaggagcagcaacaaatgttatctttggactagctttgggatataagtctgtcatcattcccatatttgctattgcagtaagcatatttgtcagtttcagtttggcagccatgtatggtattgcagtagctgcattgggaatgcttagtactattgcaactggattggcaattgatgcgtatggacccatcagtgacaatgctggtggaattgccgagatggctggcatgagtcacaggatccgtgaaaggactgacgcccttgatgctgctggcaacactactgctgccattggcaagggctttgctattggatcagctgcattggtgtcacttgcactgtttggagcatttgttagccgcgccgcaatttcaactgtagatgttttgactcctaaagtgttcattggtttaattgtgggagcaatgcttccctattggttctctgctatgacaatgaaaagtgttggaagtgctgccttgaaaatggttgaagaggtccgcagacaatttagtaccattcctggtctcatggaagggcttgccaagccagactatgcaacctgtgtgaagatatcaactgatgcttccctcaaggaaatgatccctcctggttgccttgtgatgcttacacctctcattgttggtactttctttggtgtggaaacactgtcaggtgttctggctggtgcccttgtttctggtgtgcaggttgctatatccgcttcaaacactggtggtgcttgggacaatgcaaagaagtacattgaggctggagtgtctgaacatgccaggtcacttggtccaaagggatctgatcctcacaaggctgctgtcattggtgacaccattggtgacccattgaaggacacctctgggccatcactgaacattttgatcaaactcatggctgttgagtcgctggtgtttgcgcccttctttgcaacccatggtggtttgctgtttaagctgtagaagtgttctttaagtcatactaggctcaaggtcaaccgcactaggtggaatcaattttctccacgggtttgatattggaaacttgtcaacaatgttatgaattgccctccagatatgggctgtggcaaccttatttacataagttaggttcgtggatgtgtcctcagaagatggtggtcgtagttagttaatgtcatttgtgcactgaacagttaaattttgttaccattttttaatgttaatataaggc

SEQ ID NO: 1673 - DNA, 2697 bp, Taxus baccata
caaactttagttttagttttaaggtttttgtacgaacagtggggaagtctttacttagctcaatgcttaccgagattctgatacctgttgctgctggtgtggggatagtgtttgcactggttcaatggctgattgtgtcgagagttaaggtgacgcctggtcatgccaatggttccaataatggcagcaacaacaaaaatgggtactctgaatatttgattgaagaggaagatggcggtaatgaccacagtgttgttaccaagtgtgctgagatccagagtgctatttctgaaggtgcaacctcatttttattcaccgagtatcagtacatgggcattttcatgatcttctttgctgttgtcatatttttattccttggttcggttgagaaattcagcacaaaaagtcaaccatgcacgtacaacaaggaaatgatgtgcaagcctgctcttgccaatgccatattcagtaccatatctttcttgcttggttcattgacatctgttttatctggttatcttggaatgaagattgcaacatacgcaaatgcaagaacaacattagaagccaggaagggtgttggaaaagctttcatcactgcctttaggtctggtgctgtaatgggatttttgcttgctgcaaatgggttgttggtgctttatattgccattaatctattcaagatgtattatggagatgactgggagggtctctttgaagctattaccggttatggtcttggaggttcctccatggctctatttggcagagttggtggtggtatttacaccaaagcagctgatgttggtgcggatcttgttggcaaggttgagaggaacattcctgaagatgatccacgtaaccctgcggttattgctgataatgttggtgacaatgttggagatattgctggcatgggatcagatctgtttggttcctatgccgaatcttcatgtgcagctctggttgtagcatcgatttcatcatttggaacctctcatgattttactgcaatgtgctacccattactcataagctcaatgggtatcattgtttgcttaatcacaactttatttgccactgacatatttgagatcaaggctgtgaaggaaattgagcctgcattgaaaaaacagcttattatttcgacagtgttgatgaccattggcattgctgttgtaagtttggttgcattgccaccatccttcaccatcttcaattttggtgaacaaaaggttgtcaaaaactggcaactcttcttctgtgttgctgttggtttatgggctggccttgtaattggttttgtcaccgagtactacacaagcaatgcttacagccctgtccaagacgttgccgattcatgcaggacaggagcagcaacaaatgttatatttgggctggctttgggttacaaatctgttattattcccatttttgcaattgcaataagcatctttgtcagttttagtttggctgccatgtatggtattgcagtagctgcattgggaatgctcagtactattgcaactggattggctattgatgcatatggacccatcagtgacaatgctggaggtatcgctgagatggctggcatgagtcacaggatccgtgaaagaactgatgctcttgatgcagctggcaataccactgctgccattggcaagggctttgcaattggatcagctgcattggtgtcacttgcattgtttggagcctttgtcagccgtgcagagatttcaactgtggatgtcttgactcctaaagtgttcattggtttaattgtgggagcaatgcttccctattggttctctgcaatgacaatgaaaagtgtgggtagtgcagccttgaaaatggttgaagaggttcgcagacaattcaacaccatccctggtctcatggaagggactgccaaaccagattatgcaacttgtgttaagatatcaactgatgcttccctgaaggaaatgattcctcctggttgccttgtgatgcttacacctctgattgttggtactttatttggtgtggagactctgtcaggtgttctagctggtgccctcgtgtctggtgtgcaggttgctatatcagcttcaaacactggtggtgcttgggacaatgcaaagaagtacattgaggctggagcctcagaacatgccaggacacttggtccaaagggttctgatccccacaaggctgctgtcattggtgacaccattggagacccactgaaggacacatctggaccgtctcttaacattttgatcaagcttatggctgttgagtcgctggtgtttgctcccttctttgcaacccatggtggtttgttgtttaagctatagaagtgttcctcaagctgtattaagcggaatcatttttctcctttgagcatggtattgaaagcttgccaaaaaaatgtcacgcattgccctcaaggggatgggcaatggcaagtttatttagataacgttaggttcttggatgaatgtcctaggtatgatttggctactttctgttcaattttgttaccatttctcgtgaaaatataaactactgtgaattatctcagaccatgttttctggtgtaattttatgtaaggtttttaacaaagcatgtttttgaatttgtttctatttaaaatattatattagtacaatcgtgctggattgtttctacatatatattagcacaattac

SEQ ID NO: 1674 - DNA, 2477 bp, Helianthus annuus
aaatctctctgttttccgatctctttttccggcaactcaccgccgtaatccgccatggtgacgtcaccaatcctctcagagctcggcaccgagatcctcatcccgatctgcgcagttatcggaatcatcttctctctgttccagtggtaccttgtgtcgcaagttaagttaacggttgagaaaccggctgccggagacggtaagaacgggttcactgaagcgttgattgaagaagaagaaggtgttaatgatcatgcggttgttcagaaatgcgctgagattcagaatgctatttctgaaggggcaacctcgttcctattcaccgaataccaatatgtcggtatttttatggtcattttcgccgttctgatctttgtgttccttgggtccgttgagggattcagcactagcagcaaaatatgcacatacgacgccaccagaatgtgtaaacccgctctaatgacagctgtcttcagcaccgtgtcattcgtgctaggtgccatcacctcagttgtctccggctttcttggaatgaaaatcgccacgtatgcaaatgccagaactacccttgaggctagaaagggtgtcagtaaggcgtttattgttgcatttagatctggagccgttatgggtttcctccttgctgcaaacgggcttcttgtgttgtatattaccattaatctttttaagatttattatggtgatgattgggaaggcctttttgagtccataaccggttatgggcttggtggttcttccatggctctttttggtagagttggtggcggtatttatacgaaagctgctgatgttggagccgatcttgttggcaaggtcgagagaaatatccctgaagatgaccccagaaatccagcggttattgctgacaatgttggtgacaatgttggggatattgctggtatgggatctgatctgtttgggtcatacgctgagtcatcatgtgcagctcttgttgttgcttcgatttcctctttcggcaacactcatgatttcacttcaatgatgtacccgctaaccgtgagctctgtgggcatccttgtatgcttaatcaccactttgtttgctactgatttctttgaagtcaaaaccgttgagcaaatcgagccttctttgaaaaatcaactcattatttcaactgtgttgatgactatcggtatcgctatcgttagttggatcgctcttccttctagcttcactatcttcaattttggagcccaaaaagtagttaagaactggcaattgttcttgtgtgttggtgtcggtttgtgggcaggtcttattatcggattcgtaactgagtactacactagcaatgcttacagccctgtgcaagatgttgctgattcatgccgtaccggagctgctacaaatgttatcttcggtctcgctttgggatacaaatcggttattatcccgatctttgcaattgcaatcagtatttttgttagctttagctttgccgccatgtacggtgttgctgtggcggctcttgggatgctgagcaccatagccaccggtttggctattgatgcgtacggtcccattagtgacaatgctggtggcattgctgaaatggctggcatgagccacagaattcgtgagcggaccgatgctcttgatgccgctggaaacaccactgcagctatcggcaagggtttcgctattggttcagcagctcttgtgtcgttggctctattcggtgcgtttgtgagccgtgccgaaataacaactgtagatgtattaaccccaaaagttttcattgggttgcttgtgggtgccatgcttccgtactggttctcggcaatgacaatgaaaagtgtcggaaaagcagcacttaaaatggttgaagaagtccgcaggcaattcaacaccattccgggcctcatggagggcactgctaagcctgattatgctacctgtgtgaaaatctccaccgacgcttcgattaaagagatgatcccgcctggcgcacttgtcatgctgacaccactcattgttggaattttgttcggtgttgaaacactttccggtgttcttgcaggatcacttgtttctggtgtccagattgctatctctgcttccaacactggtggtgcttgggacaacgctaagaaatatatcgaggctggtgtttctgaacacgcgaaatcgcttggaccaaaagggtcagacccacacaaggcggctgtgatcggagacactgttggggatcctttaaaggacacttccgggccatcactaaacatcctgatcaagctcatggctgttgaatctttggtgtttgcccctttctttgctactcacggaggtcttctgttcaaactcttctagatccgttatgaaggtgatgccagttgtcgtttcatctgtttagtctgtatcatcatttcattttcttgccttttttaagcttgtgggaatgtcttatttttgatgttttgtttcgtgcttagcaa

SEQ ID NO: 1675 - DNA, 2835 bp, Beta vulgaris
gcacgaggtccaaaccctcttcattttctctctctctctctcctttatcttcttcttcttcttcaattttcttctcccattttcaaaaatcatgggtgcagctcttcttccagatctcataacagagattatcattcctgtatgtgctgtaattggaattgctttctctctctttcaatggtacatcgtttctcaggtcaagctttcccctgattctacccgcaataataacaacaaaaatggattttctgatagtttgattgaagaagaagaaggtcttaatgaccaaagtgttgttgctaaatgtgctgaaattcagaatgctatttctgaaggagcaacttccttccttttcaccgagtaccagtatgttggtatctttatggttgcttttgctgtgttgatattccttttcctcggatctgtggagggcttcagcacaagtagccaggaatgtacctatgacaaaaccaggaggtgcaagcctgctcttgccactgctatcttcagcacagtggccttcttgcttggcgctatcacttctttgggttctggtttcttcgggatgaagattgccacatacgcaaatgcccgaacaacactagaggctagaaagggtgtcggcaaagcattcattgtagcattcaggtctggagctgtcatgggattcctacttgctgcaaatggtcttttggtgctttacattactatccttctcttcaagatttactatggtgatgactgggaaggtctgtttgaggctataactggttatggtcttggaggatcatccatggcccttttcggtagagttgctggaggtatttacacaaaagctgccgatgtgggtgctgatcttgtcggtaaggttgaaagagacatccctgaggatgaccccagaaatccagctgttattgctgacaatgtcggcgacaatgttggggatatcgctgggtatggggttctgatctttttggatagctacgctgagtcgtcctgtgctgctcttgttgttcgatccatttcctcattcggaatttcccatgatttgacggcaatgatgtacccattgttggttagctcggttggtattattgtttgcttgatcacaaccttatttgcaaccgatttcttcgagatcaaggctgttaaggagattgagcctgcactcaagaagcagctaatcatctccactgctcttatgactgtcggagttgcagttatttcttggattgctcttcctacttcatttaccatttttgacttcggatctcagaaggaggtgcagaactggcaattgtttttatgtgttgctgttgggttgtgggctgggctcatcatcggatttgtgactgaatactacactagcaatgcatacagccctgtgcaagatgttgctgattcttgccgaactggagctgccacaaatgttatttttggcctggccttgggttacaaatcagtcattattcctatttttgccattgctatcagcattttcgtcagttttagctttgcagctatgtatggtattgctatggctgctcttggtatgctgagcaccattgccactggattggctattgatgcatatggccctatcagtgataatgctggaggcattgctgagatggctggtatgagccacagaatccgtgagagaactgatgcccttgatgctgctggaaacacaaccgctgctattggaaagggttttgcaatcggttctgcagctcttgtttctcttgctctctttggtgcttttgtaagccgtgcatccatccaaactgtggatgtgttgaccccgaaagtattcattggtctcattgtgggagccatgcttccatactggttctctgccatgacaatgaagagtgtgggaagtgcagctttgaaaatggttgaagaggtcccgaagcaattcaacaccatccctggcttgctggaaggcactgccaaacccgactatgctacctgtgtcaagatctccactgatgcttccatcaaggagatgatccccccaggtgctcttgtcatgctcacaccattgattgttggaaccttctttggtgtcgaaactctgtctggcgttcttgctggttctcttgtgtctggtgtacagattgctatttctgcatccaacactggtggtgcttgggacaatgccaagaagtacattgaggctggtgcttcagagcatgcaaggacacttggtcccaagggatcagatgcacacaaggcagctgtgatcggtgacaccatcggtgacccacttaaggacacatcaggaccatcactcaacattctaatcaagcttatggctgtcgagtcactagtgttcgcccccttcttcgccacccacggtggcttgctcttcaagtacctctaatgaatgatcggcgcaaaatcagaaggcgacagagggaggaattcgcggtttcttctcctcattttatcgcctacaaatcgggcaagttttaaattttatcgcacaatttttgaatgtcgttagatgacaactacaaggctggaggggctaaaacttctacatgatgatgatgataatttggaagcaagtcttgtgaaaaatagagttatatggtcaacattattcttttcttttttgttccttttattgtaagatcgggatttgtagtaatcattttgcaaacctcttttgttaggtataactcattttctattttagtccttcagaaattgtatgcagttgcctttttattttctaaaaagagaacctgttcttgagcatctgttgtaaacgcataatattctctgtactttcttggaatttatctcattttgcagattggatct

SEQ ID NO: 1676 - DNA, 2661 bp, Plantago ovata
catcacatcaccatttcatttttcccctccatctctctgaaaattcttctcaccagcaccaccagcagaggaaagagatggtagagctaactctactccctgatttggctactcaaatcataattccggcttgtgcagtcgtcggtatcattttcgccctggtgcaatggcagctcgtcgccaaggtgaaggtctccgccgacaaatctccaggaaataatggcttggttgagtcgctgattgaggaggacggcgttgatgaccacgaggttgttgccaagtgtgctgaaatccaaaacgccatttctgaaggttctacatcattcctcttcactgagtaccagtatgttggtatcttcatggttgcgtttgctatcttgattttcgttttccttggatcggtggaagggtttagtacgaagccacaaacttgtacttatgacaccaccaaaatgtgcaagcctgctcttgctacagctatttttagtactgtatccttcattctaggtgcagtgacatctgttatttctggcttccttggaatgaaaatcgccacatatgcaaatgctcgcactacattagaggctaggaagggagttggcaaagcttttattgttgcatttagatcaggagctgtcatgggttttcttcttgctgcaaatggccttctggttttgtacatcactatcaatctcttcaagatatactatggtgatgactgggaaggcctatttgaggctataactggttatggactgggtggatcttccatggcactttttggtagagtagctggaggtatttacaccaaagctgctgatgttggagctgatcttgtcgggaaagtcgagaggaacattccagaagatgaccccaggaaccctgcggttattgcagataatgttggagacaatgtgggggatattgccggtatggggtcggacttgtttggctcgtatgcagaatcttcatgtgcagccctcgttgttgcttcgatctcatcatttggcatcaaccatgaattcactgctatgctttatcctcttctagtcagctccgttggaatccttgtttgcttgctaaccaccttgtttgcaactgatttctttgagatcaaggatgttaaggaaattgagcctgctctaaagaatcaacttattatttccactgtactgatgacagttggaattgctattgttagctggattgcccttccatcatccttcacaatattcaactttggagtccagaaagaggttaagaactggcaactattcctctgtgttgctgttgggctgtgggcgggactaattattggatttgttacagagtactttacaagcaatgcttatagacctgtgcaggatgttgcagattcctgccgtactggggctgctacaaatatcatttttggccttgcattgggataccaatcagttatcatcccaatttttgcgatagcaataagtatttttgttagtttcacctttgctgcaatgtatggcattgcagtagctgccctgggaatgttgagtacaattgctactggattggccatagatgcttacggtcccatcagtgacaatgctggaggtatcgctgagatggctggaatgagccacactattagagagaggaccgatgctcttgatgctgccggaaacacaactgcagctattggaaagggttttgctatcggatctgctgctcttgtgtcacttgccctctttggtgcatttgtgagccgggcatcaatcactacagtagatgttctaactccaaaagtattcatcggtttgattgtgggtgctatgctcccttactggttctcagctatgacaatgaaaagtgtgggtagcgctgctttgaagatggttgaagaagttcgccgtcaatttaatacaattcctggtctcatggaaggcactggaaagcccgactatgcaacttgtgtcaagatctccactgatgcatctatcaaggagatgattcctccaggcgctttagtcatgcttacacccctcattgtgggtgttttctttggtgttgaaacactctctggtattcttgctggatcactagtttctggcgttcagattgccatctctgcatctaacaccggtggtgcttgggataatgcgaaaaaatatattgaggctggagcttcagaacatgcccaaactcttggtcccaaagggtctgatgcacataaggctgccgtcattggagacacagttggtgaccctctgaaggacacatcaggaccatccttgaacattcttattaagctgatggccgttgaatcccttgtgtttgcccccttctttgctgcacatggtggcttactcttcaagatcttctaagtgaaggtacggcgtcatgatcagccttgtgagttgtgacttgtccacccacattttgtagctgtgttagaactaagaacctttttactgctttttgaaatttgtaagactaaggttttgaagcaaaaacttccattcaatttaatgatgatttgtgacatatcagtgaaaactaggccaggctgacgaaatgttaatttcccagcttgcttcctgctttccatttgctgttatcactgtgaaggtattggttttgttatcaaggtaataactgtccagttattactggccgtcgcgt

SEQ ID NO: 1677 - DNA, 2664 bp, Silene vulgaris
caactctccaaattctatctatcctctcatttaatttgcctcaatcatcaccatcaccttatctttatcatccatcaatggtggtgacagcaggaattctcccagatctcgcaacagagataataattccggtatgcgccgtcatcggaatcgccttctctttattccaatggtaccttgtctccaccgtcaaactctctccttccaccacccacaaaaatggcgtctctgatagtcttattgaagaagaagatggtggtaatgatcacagtgttgtcgctaaatgcgctgaaattcaaaacgccatttctgaaggatcaacatcattccttttcactatgtaccagtatgttggtatatttatgatcgcttttgctgtgctcatcttcctttttcttggatccgttgagggcttcagtacaaaaagccaagcctgcagatatgacaaaaccaagagttgcaaaccagctcttgccactgcgatctttagcacagtgtccttcttgcttggtgctgtcacctctttggcttcaggtttccttgggatgaagattgccacatatgctaatgctcgaacaacgttagaggctcgaaagggcgtgggtaaagcttttattgttgcatttaggtcaggggcagtgatgggcttccttcttgctgcaaacggtctgttggttttgtatgcgaccattctcctcttcaagatttactatggtgacgattgggaaggtctttttgagtcaatcactgggtatggtcttggaggatcttccatggccttatttggtagagttggtggaggtatttacacaaaggctgccgatgttggtgctgaccttgttggtaaagttgaaaggaacattcctgaagatgaccccaggaatccagctgtgattgctgataatgtcggtgacaatgttggggatattgccggtatgggatctgatctctttggttcctatgccgagtcgtcatgtgctgcccttgttgtcgcatccatttcctcttttgggatcaaccatgagctcactgcaatgatgtaccctttgttagttagctcagttggtattgtaatgtgcttgattacaaccttatttgcaaccgacttctttgaaatcaaggctgtgaaggagattgagccagctcttaagaggcagctaatcatctccactgtgttgatgacaattggggttgcagctgtgtcattcacagctcttccgtcttcgtttactatttttgattttggcaagcagaaagaggttaagaactgggagctgttcttatgtgttgcagttggcttgtgggctgggcttatcattggatttgtgacggaatactacactagcaatgcatacagccctgttcaagatgttgccgactcttgcaaaactggagccgctacaaatgttatttttgggttggccttgggctacaaatctgtcattattcccatctttgccattgctgttagcatttacgtgagttttagctttgcggctatgtacggtattgctgttgctgctcttggtatgttgagcaccatcgccaccggtttggctattgacgcgtatggtcccatcagtgataatgctggaggcattgctgagatggcaggcatgagccacacaatccgagagaggactgatgcccttgatgccgctggtaacacaactgctgctattggaaagggttttgcgattggttcagcagctcttgtttcacttgccctatttggtgcctatgtgagccgcgcatctatcactaccgttgatgtattgacccctaaagtcttcatcggtctcattgtgggagctatgcttccatactggttctccgccatgacaatgaagagtgtgggaaaggcagcattgaagatggttgaggaggttcgccgacaattcaacaccatccctggcttgatggaaggtactgctaaacccgactatgctacctgcgtcaagatctccactgatgcttctatcaaggagatggttcccccgggtgctctagtcatgctcactccattgattgttggcatcttgtttggtgttgaaactctttctggtgttcttgctggttctcttgtttccggtgttcagattgccatctctgcatccaatactggtggtgcttgggacaacgccaagaaatacattgaggctggtgcatcggagcatgcaaggtcgctaggtcccaagggatcagatgcacacaaagcagcggtcattggtgacacagtcggagacccgctaaaagacacatctggcccatctcttaacatcttgatcaagcttatggcggttgagtcgcttgtatttgctcccttctttgccacccatggtggcttgctgttcaagctctacagatagagcacaagcaccatcgcaagaatctcagattatttcgactcccgtttgtctccctcataaattggttagtttactttagttgcacaatttttgattgttgtagatggggaaagaccgaggggagctcacctgtccacccctttgtatgtaggggtgagaaggcaatgatgatgacgatgatgataaataataatctgggtaaatcattgtggtgtagacatgtaatgttatattttcgatcaaatttttcttgtatttgtaattccatttaagaacgcgggatacattttacctt

SEQ ID NO: 1678 - DNA, 2895 bp, Oryza sativa
ctctcctctcctcctcctcttcgcgtcgaatcctcctccgagaagaggagagtacatgaatcctagcgcgaggatctcgcaggtagcaatggcggcgatactgccggacctggcgacgcaggtgctggtcccggcggcggccgtggtcggcatcgcgttcgcggtggtgcagtgggtgctggtgtccaaggtgaagatgaccgcggagcggcgcggcggggaggggtcccccggcgcggccgccgggaaggacggcggcgccgccagcgagtacctcatcgaggaggaggaggggctcaacgagcacaacgtcgtcgagaagtgctccgagatccagcacgccatctccgaaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggcaacttttcttgtgtgtggcggttggtctttgggctggactaatcatcggatttgtgacagagtattacacaagcaacgcctacagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcagattgccatctctgcatcaaacactggtggtgcctgggacaacgcaaagaagtacattgaggctggtgcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagcta

SEQ ID NO: 1679 - DNA, 2775 bp, Thellungiella halophila
gacgccttcatttcatcatctcgtcgaaaacacttcccttcctttctctctactctctctctctcgttatcttcggtttctgctttctctattcggaggagagatggtggcgtcggcgtttcttccggagctctggacggagatcctggtgcctgtttgtgcggtgatcggcatcgctttctcgctcttccagtggttcatcgtctctcgcgtgagagtcaccgccgaccaaggcgcgtcgtcgtcttccggtggctcaaacaatgggaaaaatggctacggagattacctcatcgaggaagaggaaggtcttaacgagcagagtgtcgtcgccaagtgcgccgagattcagaccgctatttccgaaggtgcaacttcatttttgttcaccgagtacaaatatgttggtgtcttcatggttttctttgctgctatcatctttgttttcctcggctctgtcgagggattcagcacaaagaacaagccttgcacttacgacgataccaaaacttgcaagcctgcattggccaccgcagctttcagcacggttgctttcgtgcttggtgcagtcacctccgttctctctggttttcttgggatgaagattgccacctacgccaacgctagaaccaccttggaagcaaggaaaggtgtcggaaaggcgttcattgttgcgttcaggtccggtgctgtgatgggtttccttcttgctgcaagtggtcttttggtgctatacatcaccatcaatgtgttcaagatctattacggagatgattgggaaggtctttttgaggctatcactggctacgggcttggtgggtcttccatggctctctttggccgtgttggtggtgggatctacactaaagcagctgatgtgggtgctgaccttgtcggtaaaattgagaggaatattcctgaagacgatccaaggaacccagctgtcattgctgataatgtgggtgacaatgttggtgacattgctggtatgggatctgacctctttgggtcgtatgctgaagcatcatgtgccgctctcgttgtcgcttcgatctcttcctttggaatcaaccatgacttcactgccatgctctacccattgctcatcagctcaatgggtatcttggtttgtttgatcacaactctcttcgccaccgatttctttgagattaaggctgttaaggagattgagcctgcgttgaagaatcagctcatcatctctactgtcatcatgactgttggaattgctattgtgtcatgggttggcttgccgtcttcctttaccatcttcaactttggaacacaaaaagtcgtgaagaactggcagctattcctgtgtgtctgtgttggtctttgggctggactcattattggttttgtcactgaatactacactagcaacgcctacagccccgtgcaagatgttgcagattcatgcagaactggtgcagccaccaatgttatattcggactggcccttggttacaaatccgtcattattccaatctttgccattgctgccagtatattcgtgagcttcagctttgctgctatgtatggtgttgctgttgctgctctaggcatgctcagtaccatcgccactggtttggcaattgatgcttacggtcccatcagtgacaatgctggtggtattgctgaaatggctggaatgagccaccgcatccgtgaaagaaccgatgctcttgatgcagctggaaacaccactgccgctattggaaagggatttgccattggttctgctgctctagtctccttggctctgtttggtgcctttgtgagccgtgcaggtgtccacaccgtggatgttttgacccctaaggttatcattggactgcttgttggtgccatgcttccttactggttctcagccatgacaatgaagagtgtgggaagtgcagctcttaagatggttgaagaagtccgcaggcagttcaacaccatccctggactcatggaaggtaccgcaaaaccagactatgccacatgcgtcaagatctccaccgatgcttccatcaaggaaatgattcctcctggttgcctcgtcatgctcacacctctcatagttggattcttctttggggttgagaccctctctggtgttctcgccggctctcttgtttctggtgttcagattgccatttctgcatctaacactggtggtgcctgggacaatgccaagaaatacattgaggcgggtgtatcagagcacgcaaagagccttgggccaaagggttccgagccacacaaggcagctgttattggagacaccattggagacccattgaaggatacttcaggaccttcgttgaacatcctgatcaagctcatggctgttgagtctcttgtctttgctcccttctttgccacccacggtggtatccttttcaagtacctttaaacacaaatctgagtgaagaggaagatgacgatgatgatgatgatgaagaagaagatgatgatggagatcgattcaaaactctcttttttaccattcttattttcgttttgcgtaggtggttaaaaaaaactttttttttgttgtggggctcatttaaagaaccaaccaaatgatgttttcactctctttatctcctttttgtgttgtctagagtttagaaatccaccaagtacttgagacgtattttgccgttacttctgctcagcttgtttttttaaattgtttgtcttcttcgagacaaatggaattcattatcagtcttttgtcggcttaatgagagtgataccgtattgagt

SEQ ID NO: 1680 - DNA, 2887 bp, Zea mays
tcctctccgctctgctccctccgccgtgcgctcgaacgaactccacacgaaattatccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggagacggctccgccgggaagagcggcgccggcgccggcgccagcgagtacctcatcgaggaggaggaggggctcaacgagcacaacgtcgtcgtcaagtacgccgagatccagaacgccatctccgaaggagcaacttctttccttttcactgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgccacatatgcaaatgccaggacaactcttgaggctaggaagggtgttggaaaggcattcattaccgctttccgctctggtgctgtgatgggcttcctgcttgctgctagtggcctttttgttctttatattgcaatcaacttgtttggaatttattatggtgatgactgggagggcctttatgaggctatcactggttatggtcttggtggttcttctatggctctttttggtcgtgttggtggtgggatttacactaaagctgctgatgttggtgctgatcttgttgggaaagtcgaaaggaatatccctgaagatgatccgagaaacccagctgtcattgcggacaatgttggtgacaatgttggagatattgctggtatggggtcagatctctttggctcttatgctgagtcttcatgcgctgcgcttgtcgttgcctcaatctcttcattcgggatcaatcatgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgattcctgcagaactggagctgctacgaatgtcatctttggccttgctctgggatataaatccgtcattatccctatttttgctattgcttttagtatttttctcagcttcagccttgctgccatgtacggtgttgctgtggctgctcttggaatgctcagcacaatcgctactggccttgccattgatgcctatggtcctatcagtgacaatgctggaggaattgctgaaatggctggcatgagccacagaatccgtgagagaactgatgctcttgatgctgctggaaatactactgctgccattgggaagggttttgcaataggttcagcagccttggtgtctcttgccctctttggtgcttttgtcagccgtgctgagatctcgactgttgatgttctgacacccaaagttttcattggactgattgttggtgccatgctcccatactggttctcagcgatgacaatgaagagtgttggaagtgcagcactcaagatggttgaggaagtccgcaggcagttcaacaccatccctgggctcatggagggcattaccaagcctgactatgcgacgtgtgttaagatctctactgatgcatctatcaaggagatgatcccacctggtgcacttgtcatgcttacacctcttattgtggggatcttctttggtgttgaaaccctctctggagttcttgctggtgctcttgtttctggtgtccagattgccatctctgcatccaacactggaggtgcctgggacaacgcaaagaaatacattgaggctggtgcatctgagcatgcaagaaccttgggcccgaaaggttcagacccacacaaggctgctgtcatcggtgacaccatcggtgatcccctcaaggacacctcaggcccctcgctgaacatcctcatcaagctcatggctgtcgagtcccttgtctttgctcccttcttcgccacccatggaggcatcctcttcaaatggctttagaggaagaatggaagatggatgggtagtttatttttgccgggggagagcactagatatatgtcatagagaagtttcagtttacccatatggtgcacttcatccttttttgtttcgcttgtactgtgtcgcagtcttgttgaacttgtcagccgtggtatcacctagtttttgggtctagatgcagtagccgagtggagcaaaaacgtctagcattctacaggattggaatttggacatggatgtgttgggaagtttgatactgcatgtagatatttcgatgatgatgatcaaggaatgcacaagtcagatttacctgtgtttgtgaaacttgaaactctgcgtaggagtgtatggcggtagaatagtcaatcagtgaccgatcaaaatctgtaactcatcgaccttattttaatagtataaactagataaaattatacaacaaacccaattaaa

SEQ ID NO: 1681 - DNA, 2854 bp, Zea mays
cacgcgccccgagctcagggaagagagctgcagagagcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaagggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgcattttactggtggtatggtatctcgtacatcgtattggactgcagatgcctcattcgtatcatctaatgttaatacgtaatgatgtgtctgctgccgacacgttctatagttgagtaaaatatattttaggtacttaaacc

SEQ ID NO: 1682 - DNA, 2978 bp, Sorghum bicolor
cgcagtcactcgcctctgcacacctcgctgatgctcgtcttccttcacatcctttataaggcccggccgcggctctgctcgcctctcctcccttcccataccgtaccactctccccgtttctctccggccggttcgtgggagggccgaagcttcgagaaaggaaaccctaacgctgttgggacttgggagtagcctccggcgatggctgcggcggcgatcctgccggagctggcgacgcaggtgctcatcccggtcgcggcggccgtgggcatcgcgttcgcggtggtgcagtgggtgctggtgtccaaggtgcggctcacccccgagcgccgtgcggacggcggagccgccaagagcgggcccagcgactacctcatcgaggaggaggaggggctcaacgaccacaacgtcgtcgtcaagtgcgccgagatccagaacgccatctctgaaggagctacatctttccttttcactgagtacaagtatgttggattattcatgggcatctttgcaatccttatattcctcttccttgggtccgtcgagggattcagcacgaagagtcaaccttgccactatagcaagggcaaaacttgcaagcctgcccttgctaatgccatcttcagtactatagcttttgtgcttggtgccgtcacctcactggtttctggatttcttggaatgaagattgcaacttatgcgaatgcccggacaactttagaggccagaaagggtgttgggaaggcatttattactgccttccgatctggtgcagttatgggctttctgcttgctgccagtggtcttttggttctttacattgctatcaatttgtttggaatttattacggtgatgactgggaaggtctttttgaggctattactggttatggccttggtggttcttctatggctcttttcggccgcgttggtggtggtatttataccaaggctgctgatgttggtgctgaccttgtgggtaaggtagaaagaaacattcctgaggacgatccaagaaacccagctgtcattgctgacaatgttggtgataatgttggagatattgctggaatgggatcagatctcttcggctcatatgctgaatcgtcatgtgctgctcttgttgtggcctcaatctcgtcttttggaatcaaccatgaatttactccgatggtgtacccccttcttgtcagctctgttggtattatagcatgtctcgtaacaacgctgtttgcaactgatttcttcgagataaaggctgtgagtgaaatagagcctgctctcaagaaacaacttataatatctactgttgtgatgaccattggcattgcgctcatcagttggcttggtcttccatacaccttcaccatttttaactttggagaacagaagacagtgcaaagctggcaattattcttgtgtgtggcggttggtctctgggctggcctagtcattggatttgttaccgagtactacacaagcaatgcctacagccctgtacaagatgttgctgattcctgcagaactggagctgccactaatgtcatttttgggcttgctttgggttacaaatcagtcattatcccaatttttgctattgcgtttagtatcttcctcagcttcagccttgctgccatgtatggtgttgctgtggctgctcttggaatgctgagtaccattgccacaggccttgccattgatgcctatggccctatcagtgataatgctggaggaatagctgaaatggctgggatgagccataggattcgtgagagaaccgatgctctagattctgcaggaaacaccactgctgcaattggaaagggctttgccattggctccgcagccttggtgtcccttgcactcttcggtgcctttgtaagccgggctgctatctccactgttgatgttctgactcctaaagtattcattgggcttattgtcggtgctatgctcccatactggttctcggcaatgaccatgaagagtgtaggcagtgctgcactcaaaatggtggaggaagtccgccggcagttcaacaccatccctgggctcatggagggcaccacaaagcctgactatgcaacttgtgtcaagatctcaacggatgcatccatcaaggagatgatccccccaggtgctcttgttatgctcacaccactgatcgttgggattttgtttggggttgagaccctctctggagtccttgctggtgcccttgtctctggtgttcagattgccatttctgcatccaacactggtggtgcctgggacaatgccaagaagtacattgaggctggagcttcagagcatgccaggacccttggcccaaaaggttctgaccctcacaaggcagctgtcattggtgacaccattggagatcctctcaaggacacgtctggcccctccctcaacatcctcatcaagcttatggcggttgaatcccttgtctttgcccccttcttcgccgcccatggtggcattctcttcaaatggctctaagccagcgagagtcgcaggataaaggccgtagttttgcaaggggagtagagcagtatgtcagctatacagcatatatggcatgtgctttgctccaccagttgatgagccccgttgtgtattttggttttcgttttcttgagtttttagttccagggtccgaccatgttttgatcccataaattctcctccggccttcgagcaactgagactatcttcgtaagtcatcagacccagccaatcactgaagcattggaaaactaaacagtttctagcgatatggtgatgattatgatgatgatgattaatctcagcattttttttcttcttgacagtaattaacatggtctttgcttgaaatttcgttctcttttcaacacgttatgcatgcaaaatggatgtgatgtttttttttgagctgttgtttcaaaacaatatgcaagtaaaaaaaggaagtgatgctgttccaaactgttgt

SEQ ID NO: 1683 - DNA, 2722 bp, Arabidopsis lyrata
acgcctcattttcttcttcacctctttctctctgtgttcttgttgtctctctctcgcgcgaagcgctttatctttgtcttgtttttgttttcatttttcgtttttctcttatcggaggagagatggtggcgcctgctttattaccggagctctggacggagatccttgtaccgatttgtgcggtgattggtatagcgttttcgcttttccaatggtacgtcgtttctcgtgtgaaactcaccactgaccttggcgcatcgtcttctggtggagctaacaatgggaagaatggatacggtgattatctaatcgaggaagaggaaggtgttaatgaccagagtgttgtcgctaagtgcgctgagattcagactgctatatctgaaggtgcaacttcattcctgttcacggagtacaaatatgttggtgtcttcatgattttctttgctgctgttatctttgttttcctcggctctgttgagggattcagcactgatagcaagccttgtacttacgacaccaccagaacttgcaagcctgcattggctactgctggtttcagtaccattgctttcgtgcttggtgctgttacctctgttctctctggtttccttgggatgaagattgctacatacgctaatgctagaaccaccttggaagcgaggaaaggtgttggaaaggcgttcattgttgcattcaggtctggtgctgtgatgggattccttcttgcagccagtggtttgttggtgctttacattactatcaatgtgttcaagatctattatggagatgactgggaaggtctgtttgaggctattactggttacgggcttggtgggtcttccatggctctctttggccgtgttggtggtgggatctacactaaggcagctgatgttggtgctgaccttgtcggtaaaattgagaggaatattcctgaggatgatccaagaaacccagctgtcattgctgataatgtcggtgacaatgttggtgacattgctggtatgggatctgatctctttgggtcatatgctgaagcatcgtgtgctgctcttgttgttgcttctatctcttcgtttggaatcaaccacgatttcactgccatgtgctacccattgctcatcagttcgatggggatcttggtttgtttgatcacaactctcttcgccaccgatttctttgagatcaaggttgttaaggagattgaaccggcattgaagaatcagctcatcatctcaactgttattatgactgttggaattgctattgtgtcatgggttggcttgccgacctccttcaccattttcaactttggtacacaaaaagttgtcaagaactggcagctattcctgtgtgtttgtgttggtctttgggctggactcattattggtttcgtcaccgaatactacactagcaacgcatacagccccgtgcaagatgttgcagattcatgcagaactggtgcagctaccaatgttatattcggacttgctcttggttacaaatccgtcattattccaatctttgcaattgctatcagtatattcgttagcttcagctttgctgctatgtatggtgttgctgttgctgctcttggcatgctcagtaccattgccactggtttggcaattgatgcttacggtcccatcagtgacaatgctggtggtattgctgaaatggctggtatgagccaccgtattcgtgaaagaaccgatgctcttgatgccgctggaaacaccactgctgctattggaaagggatttgccattggctctgctgccctagtctccttggctctgtttggtgcctttgtgagccgtgcagggatccacaccgtggatgttttgacccctaaagttatcattgggctgcttgttggtgccatgcttccttactggttctctgctatgacaatgaagagtgtgggaagtgcagctcttaagatggttgaagaagttcgcaggcagttcaacaccatccctggactcatggaaggaaccgcaaaacccgactacgccacatgtgtcaagatctccaccgatgcatccatcaaggaaatgattcctcctggttgccttgtcatgcttacacctctcattgttggattcttctttggggttgagaccctctctggtgttctcgccggctctcttgtctctggtgttcagatcgccatatcagcatctaacactggtggtgcctgggacaacgccaagaaatacattgaggctggtgtatcagagcacgcaaagagccttgggccaaagggatcagagccacacaaggcagctgtgattggagacacaattggagacccattgaaggatacttcaggaccttcattgaacatcctcatcaagctcatggctgttgagtctctcgtctttgctcccttctttgccactcacggtggtatccttttcaagtacctctaaactcaatccgagtggagaagatgacgaagatgatgaagaagaagatgatggcgatcgattcacaactctcttttttaccattcttattttcgtttaccgtaggtggttaaaaacctttttttgttgatgaggctcatttaaagaaccaactaaatgatgtttctttctctctttctctgtctctctgtctttttgtgctgtctagattttagaaatccaccaagtattcgagacttgttttagccgttactttctgctacttatatttcttaaattggttttgtctt

SEQ ID NO: 1684 - DNA, 2631 bp, Arabidopsis thaliana
acgatatcctcacctatttacgcctcattttcttcttcacctctctctctgtgtgtgttctgtgttctctctctcgcgcgaagcggttctctttcttttgtttatttgtttttatttgtttttctcttatacggaggagagaagatggtggcgcctgctttgttaccggagctctggacggagatccttgtaccgatttgtgcggtgattggtatcgccttttcgcttttccaatggtacgttgtatctcgcgtgaaactcacctctgacctcggcgcatcgtcttccggtggagctaacaatgggaagaatggatacggtgattatctaatcgaggaagaggaaggtgttaatgaccagagtgttgtcgctaagtgcgctgagattcagactgctatttccgaaggtgcaacttcattcctattcacggagtacaaatatgttggtgtcttcatgattttctttgctgctgttatctttgttttcctcggctctgttgagggattcagcactgataacaagccttgtacttacgacaccaccagaacctgcaagcctgcattggctactgcagctttcagtaccattgctttcgtgcttggtgctgttacctctgttctatctggtttccttgggatgaagattgctacatacgctaatgctaggaccactttggaggcgaggaaaggtgttggaaaggcgttcattgttgcattcaggtctggtgctgtgatgggtttccttcttgcagcgagtggtctattggtgctttacattactatcaatgtgttcaagatctattacggagatgactgggaaggtctttttgaggctattactggttatggtcttggtgggtcttccatggctctctttggccgtgttggtggtgggatctacactaaggctgctgatgtcggcgctgaccttgtcggtaaaattgagaggaatattccagaggatgatccaagaaacccagctgtcattgctgataatgtcggtgacaatgttggtgacattgctggtatgggatctgatctctttggatcatatgctgaagcatcatgcgctgctcttgttgttgcctcgatctcatctttcggaatcaaccacgacttcactgccatgtgctacccattgctcatcagttcaatgggaatcttggtttgtttgatcacaactctctttgccactgacttctttgagattaagcttgtcaaggagattgaaccagcattgaagaaccagctcattatctcaactgttattatgactgttggtattgctattgtgtcatgggttggcttaccgacctcctttaccatcttcaactttggaacacaaaaagttgtcaagaactggcagctattcctttgtgtttgtgttggtctttgggctggactcattattggtttcgtcactgagtactacactagtaacgcctacagccctgtgcaagatgttgcagattcatgcagaactggtgcagctaccaatgttatcttcggccttgctcttggttacaaatccgtcattattccaatctttgctattgctatcagtatattcgttagcttcagctttgctgctatgtatggtgttgctgttgctgctcttggtatgctcagtaccattgccactggtttggcaattgatgcttatggtcccatcagtgacaatgctggtggtattgctgaaatggctggaatgagccaccgcatccgtgaaagaactgatgctcttgatgccgctggaaacaccactgctgctattggaaagggatttgccattggctctgctgccctagtctccttggctctctttggtgcctttgtgagccgtgcagggatccacaccgtagatgttttgacccctaaagttatcattgggctccttgttggtgccatgcttccttactggttctctgccatgacaatgaagagtgtgggaagtgcagctcttaagatggttgaagaagttcgcaggcagttcaacaccatccctggacttatggaaggaaccgcaaaaccagactacgccacatgtgtcaagatctccaccgatgcttccatcaaggaaatgatacctcctggttgccttgtcatgctcacacctctcattgttggtttcttctttggagttgagaccctctctggtgtcctcgccggatctcttgtatccggtgttcagatcgccatatcagcatctaacactggtggtgcctgggacaacgccaagaaatacatcgaggctggtgtatcagagcacgcaaagagccttggaccaaagggttcagagccacacaaggcagctgtgattggagacacaattggagacccattgaaggatacttcaggaccttcattgaacatcctcatcaagctcatggctgttgagtctcttgtctttgctcccttcttcgccactcacggtggtatccttttcaagtacttctaaactcaatccgagggaagaagatgacgatgatgaagaagaagaagatgatgatggcgatcgattctaaactttcttttttaccattcttattttcgtttaccgtaggtggttaaaaaaccttttttgttgatgaggctcatttaaagaaccaaccaaatgatgtttctttctctc

SEQ ID NO: 1685 - DNA, 2627 bp, Chelidonium majus
tcttctctcttgttcaatggtatatagtttctcaagtgaagctttcacctgaaagacacactccttcaaacaacagtaaaaatggttataatgattctctgattgaagaggaagaaggtcttaacgatcataatgttgttctcaaatgtgctgagatccagcaagctatctctgaaggggcaacttcgttcctttacaccgaatatcagtatgttggtatcttcatggttgcttttgcagctattatttttctcttcctcggatctgtggagagctttagcaccaagagccaaccctgcacctacaataaacacgctatgtgcaagtctgctcttgcaaatgctggattcagtaccatttcgtttgtgcttggtgctgtaacttcagtggtctctggtttccttggaatgaagattgctacatatgctaatgccaggacaaccttggaggcaaggaaaggtgttggaaaggctttcattactgcattcaggtctggtgcagtcatgggctttctccttgcagctaatggtcttttggttctttacattaccatcaacgtcttcaagatctactatggtgatgattgggaaggactttttgaggcaatcactggttatggtcttggtggttcttccatggccctctttggcagagttgcaggaggtatctacacaaaagctgctgatgttggtgctgatcttgtaggcaaggttgaaaggaacatccccgaggatgacccaaggaacccagctgttattgctgataatgtcggtgataatgttggtgatattgctgggatgggttctgatctttttggatcatatgctgagtcctcgtgcgctgcacttgttgttgcctctatctcctcttttggtatcaaccatgaattcactgctatgtgttatcctctaatcatcagttccgtcggtatcattgtgtgtttgatcactaccctctttgcaactgatatctttgaaatcaaggctgtcaaggaaattgagcctgcactcaagaatcaattgattatctccactgctctcatgactgttggaattgcacttgttagttgggttgccctcccagcagaattcacaatcttcaattttggagcccagaaggttgtgaagaactgggaactgttcttctgtgttgccatcggtctttgggctggattggttattgggtttgtgaccgagtattacactagcaatgcatacagccctgtgcaagatgttgctgattcctgcagaacaggagctgctactaatgttatctttggccttgctttgggatacaagtctgttattattccaatttttgctattgccctcagtatcttcgtcagtttcagccttgctgccatgtatggaattgcagtagctgctcttggaatgctcagcactattgctactggtttggccattgatgcatatggtcccattagtgacaatgctggaggaattgccgagatggctggcatgagtcacaggatccgagagagaacagatgccttggatgctgctggaaacactactgctgctattggaaagggatttgccatcggctcggctgctttggtgtctttggctctgtttggtgcctttgtaagccgtgcagctattaagactgtggatgtcctcacccccaaagtcttcatcggtttgcttgttggtgcaatgcttccgtactggttttcagccatgacaatgaagagtgttggaagtgcagcactaaagatggtggaggaggtccgcaggcaattcaacactatccctggcctgatggagggtactgcaaagcctgactacgccacttgtgtcaaaatctccacagatgcatcaatcaaggaaatgattgcacctggtgccttggtcatgcttaccccctcattgttggtaccttctttggtgttgagactctatctggtgtccttgctggttccctagtatctggtgtacagattgcaatctctgcatccaacactggtggtgcatgggataatgccaagaagtatattgaggctggtgtttcggatcatgcaaggagccttggccctaaaggatcagacccacacaaagcagctgttattggtgacaccatcggagatcctctcaaggacacttcaggcccatctctcaatatcctcatcaagctcatggctgtggagtcccttgtgtttgctcctttctttgccaaacacggtgggctgctcttcaagctcttttagatgaagataagaaacggttgaggtgagagaggctgcagaaagatgacttggtggaacattgaatctcatttttcttttcctcaatcagatactaagtagtctctgctctcaatttctttacacagctaagctcacttttaaaggttccccctccgtggttatttccttctttatattcgtcttttgggggttgattatgtcctaattggaaggtggtgggggatgatgattatgttgatttatgatgatgatgaagaaggggagtccggtcatattcttaattcataggagagtaagtagtagtggtggttttgaatctccttttgcgtaactcaaaagattggtttctattaatgaaggggataacattttgaaaagtcttatttgtctgctggtgctc

SEQ ID NO: 1686 - DNA, 2891 bp, Zea mays
gaagagcgtgcagagcgagacgcgtcgcctcctcccttcccccaccccgccgccgccctcgcgtccgtccgtccgtccttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcacaattaatgtatttaagttgtattacggtgatgactgggagggtctttttgagtccatcactggctatggtcttggtgggtcgtccatggctctcttcggaagagttggtggaggtatctacacaaaggctgctgatgttggtgccgatcttgttggaaaggtcgagaggaacattcctgaggatgatcctaggaacccagctgtgattgctgataatgtcggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcctgtgcaagatgttgcggattcgtgcagaactggtgctgccactaatgtcatttttggtcttgctcttggatacaagtctgttatcatcccgattttcgctattgctgttagcatctatgtcagtttctccattgctgcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccgtactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgattcctccgggcgctctggtcatgctgactcccctcatcgttggaaccctcttcggcgtcgagactctctccggcgttcttgctggtgcccttgtttctggagtgcagatcgccatctctgcttccaacaccggcggtgcatgggacaatgccaagaagtacattgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaaaaggggcaacaccaccaagcacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctgttcgcattcaatctttgggcctcccggagccgccggaggcgcgttttactgttagccttactactcttactccctgtagctccacgtagaagaaaccgatgtcctgcgtctggcaatttttcttagtccctcgatgatggcgatgatgctgaaacctttttttgaacaatgatacatgatgattgttgcgttgtactggtggtaaatcacggtccgtattggcctgttctgttggtgcccatttccaatcatccaatgtcgtgctctgcgttatacgattgctgtttgtactgtcatagctgctgccgacaaggtcataaagaaccttaaacttgaagcca

SEQ ID NO: 1687 - DNA, 2991 bp, Zea mays
ggttaggtaagaaatttgaaaacaaaaatccatgggagatgtttttacgtagaagaatagtgagaatttgagaaactttatttcctaagaaacaaagaaagttttggtgaaataattgaaacgaaaaattcgagaaactagaagcccgataatgcccttctcctctaccaactaccagcgcagtcactcgcctctgcacacgtcgctgatgctcgtcttccttccttcccatcctttataaggcccggccgcggctctgctcgcctctcctcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaat

SEQ ID NO: 1688 - DNA, 2932 bp, Zea mays
gctgcgccgccgctcgcctctcctcccttcccttccccgtaccgtgtcactctcctccccggttcgtcgtgcggagggccaaagcttcgaggaagcagaaccctagcgctagcgctgttggagtagtagcctacgccctacggccgatggctgcggcggcgatcctgccggagctggggacgcaggtgctcatcccggtcgcggcggccgtgggcatcgccttctcggtgctgcagtgggtgctggtgtccaaggtgcggctcgcccccgagcgacgcgcggacggcggcggagccgtcaagagcggccccagcgactacctcatcgaggaggaggaagggctcaacgaccacaacgtcgtcgtcaagtgcgccgagatccagaacgccatctccgaaggagctacatctttccttttcactgagtacaagtatgttggattattcatgggcatctttgcaatccttatattcctcttccttgggtccgtcgagggattcagcacaaagagtcaaccttgccactatagcaaggacaagacttgcaagcctgcccttgctaatgccatcttcagtactatagcttttgtgcttggtgcggtcacctcactggtttctggttttcttggaatgaagatagcaacttatgctaatgcccggacaactttagaggccagaaagggcgtcgggaaggcatttattactgccttccgatctggtgcagttatgggtttcctgcttgctgccagcggtcttttggttctttatattgctattaatttgtttggaatttattatggcgatgactgggaaggtctttttgaggctattactggttatggccttggtggttcttctatggctctttttggccgtgttggtggtggtatttataccaaggctgctgatgttggtgccgaccttgtggggaaggtagaaagaaacattcctgaggacgatccaagaaatccagctgtcattgctgacaatgttggtgataatgttggagatattgctggaatgggatcagatctctttggctcatatgctgaatcgtcatgtgctgctcttgttgtggcctcgatctcgtcttttggaatcaaccatcaatttactccaatggtgtatccccttcttgtcagctctgttggtattatagcatgtctcataacaacgctgtttgcaactgatttcttcgagataaaggctgtgaatgaaatagagcctgctctcaagaaacaacttataatatccactgttgtgatgaccattggcattgcgctcatcagttggcttggtcttccatacaccttcaccatttataactttggagcccagaagacagtgcaaagctggcaattgttcttgtgtgtggcggttggtctctgggctggcttagtcattggttttattactgagtactacacaagcaatgcctacagccctgtacaagttgttgctgattcctgcagaactggagctgccactaatgtcatttttgggcttgctctgggttacaaatcagtcattatcccaatttttgctattgcgtttagtatcttccttagcttcagccttgctgccatgtatggtgttgctgtggctgctcttggaatgctgagtaccattgccacaggccttgctattgatgcctatggccctatcagtgataatgctggaggcatagctgaaatggctgggatgagccataggattcgtgagagaactgatgctctagatgctgcaggaaacaccactgctgcaattggaaagggttttgctattggctctgcagccttggtatcccttgcactcttcggtgcctttgtaagccgggctgctatctccactgttgatgttctgactcctaaagtgttcattgggcttattgttggtgctatgctcccatactggttctcggcaatgaccatgaaaagtgtaggcagtgctgcactcaagatggtggaggaagtccgccggcagttcaacaccatccctgggctcatggagggcaccacaaagcctgactacgcaacttgtgtcaagatctcaacggatgcatccatcaaggagatgatccccccaggtgctcttgttatgctgacaccactgatcgttgggattttgtttggggttgagaccctcgctggggtccttgctggtgcccttgtctctggtgttcagattgccatttctgcatccaacactggtggtgcctgggacaacgccaagaagtacattgaggctggagcttcagagcatgccaggacccttggcccaaaaggttctgaccctcacaaggcggctgtcattggtgacaccattggagatcctctcaaggacacgtctggcccctccctcaacattctcatcaagcttatggcggttgaatcccttgtcttcgcccccttcttcgccgcccatggtggcattatcttcaaatggctctaaagatagcgacaacgttagttagtcgcaagagaaaggccgcagttctgcggctgcgaggggaatagagcagtatgtcagctatacaacatctatggcatgtgctttgctcctccacttgattatagcccccgttgtgtgtttcggtttctgttttcctggagtttttggttccaggcttccgaccatgttttgatcccataaattctcctccagccttcgagcaactgagtccatcttcgtaagtcatcagccctagccagacattgaagcatcggaaaactttaatagtttttagagatatggtgatgattatgatgatgattaatctcagtttttttcctttgaaagtaattagcatggtctttgcttgagattttgttctcttttcaaaacgatatgcatgcgaaatggaggtgatgtttttttttgaacggttgtttcaaagcaatatgaaaacataaaggtagtgatgttcttcaaaa

SEQ ID NO: 1689 - DNA, 2580 bp, Brassica rapa
  misc_feature (44)..(44): n is a, c, g, or t
  misc_feature (1061)..(1062): n is a, c, g, or t
  misc_feature (1277)..(1277): n is a, c, g, or t
  misc_feature (1283)..(1283): n is a, c, g, or t
  misc_feature (1287)..(1287): n is a, c, g, or t
  misc_feature (1295)..(1296): n is a, c, g, or t
cgaatcacttcccatctctctctctctctctctgtttttgttgngtctctctctctcgagcttatcttcgatggtggcgtcagcttttctcccggagctctggacggagatcctcattcccgtttgcgcggtggtcggcatcgctttctctctcttccaatggttcatcgtctctcgcgtgagagtctccgctgaccaaggcgcgtcgtcgtcttcctccggaggttcgaagaatggctacggagattacctcatcgaggaagaggaaggtgttaacgaccaaagcgtcgtcgccaaatgcgccgagattcagacagcaatctccgaaggtgcaacttcattcctattcacggagtacagatacgttggcgtcttcatggtgatcttcgccgctataatcttcgtcttcctcggctcggtcgagggattcagcacagagaacaagccttgcaccctacgacgagaccaaaacctgcaagcctgcgttagccaccgcagctttcagcaccattgctttcgtcctcggtgcggtcacctctgtgctctctggtttcctcggcatgaagattgccacttacgctaacgctagaaccactttggaagctagaaagggcgttgggaaggctttcattgttgcgttcaggtccggtgctgtgatgggtttccttcttgctgctagtggtctattggtgctttacgttactattaatgtgttcaagatctattacggtgatgactgggaaggtctttttgaggctattactggttatggtcttggtgggtcttccatggctctctttggccgtgttggtggtgggatctacactaaagcagctgatgttggtgctgatcttgtcggtaaaatcgagaggaacattccagaagacgatccaagaaacccagctgttattgctgataatgtgggtgacaatgttggtgacattgctggtatgggatctgatctctttggttcctatgctgaagcatcatgtgccgcacttgttgttgcttccatctcttcctttggtatcaaccacgacttcactgccatgtgctacccnntgctcatcagctcaatgggtatcttggtttgtttgatcacgactctcttcgccactgacttctttgagattaaggctgttaaggagattgagccagcgttgaagaaccagctcatcatctccactgctatcatgaccgttggaatcgctgttgtgtcatgggttggcttgccttcttccttcaccatcttcaactttggaacacaaaaagtcgtncagaantggnagctattnntgtgtgtttgtgttggtctttgggctggactcatcattggttttgtcactgaatactacactagcaacgcatacagccctgtgcaagatgttgcagattcatgcagaaccggtgcagccaccaatgttatattcggcctagctctcggttacaaatccgtcatcattccaatctttgccattgctgtcagtatattcgtcagtttcagctttgctgctatgtacggtgttgccgttgctgctctagggatgctcagtaccatcgccaccggcttggcgattgatgcttacggtcccatcagtgacaacgctggtggtattgctgaaatggctggaatgagccaccgcatccgcgaaagaaccgatgctcttgatgcagctggaaacaccactgccgctattggaaagggattcgctattggctctgctgcgttggtctctttggctctgttcggtgcctttgtgagccgtgcaggagtccacaccgtagatgttttgacaccaaaggttatcattgggctgcttgttggcgccatgcttccttactggttctcggctatgacgatgaagagcgtgggaagtgcggcgcttaagatggttgaagaagttcgcaggcagttcaacactattcctggactcatggaaggtaccgcgaaacctgactacgccacttgtgtcaagatctccactgacgcttctattaaggagatgattcctcctggttgccttgttatgctcacacctctcattgttggtttcttctttggtgttgagactctctctggtgttctcgccggctctcttgtctccggtgttcagattgccatctctgcatctaacactggtggtgcttgggacaacgctaagaagtacattgaggctggtgtatcagagcacgcgaagagtcttggaccaaagggctcagagccacacaaggcagctgtgattggagacaccattggagacccattgaaagatacttcaggaccttcgttgaacatcctgatcaagctcatggctgttgagtctctcgtctttgctcccttctttgccactcatggtggtatcctgttcaagtacctctaaactcaactcttgagtgaagaagaaagatgatgatgaagatggattcaaagcctcttttttaccattcttgttttgtttttgcgtaggtgttaaaaacttttttcgtttgttgatgaggctcatttaaagaaccaaaccaaatgatgcttctctctctttttgtgctgtctagattttagaaatccaacaagtacttgag

SEQ ID NO: 1690 - DNA, 2654 bp, Mimulus guttatus
cattctctcactactgagaactgagtagagcatatttttccccaaaaccgaggagagagagagagagagttagagagagagagagagtgagagatggccgaatcgacactgctcacagatctcggcactcagattatcatccctgtctgcgctttagttggaatagctttcgctctcctgcaatggtacttcgtcgccaaggtcaaggtttcgtcggaaaaatccgacgccaaaaatggtttctctgagccgctcattgaggaggaggacggcgtcagtgatcacgccgtcgttcgcaagtgcgccgagatccaagccgccatctctgaaggttcaacatcgtttctttacaccgagtacaaatatgtcggcatattcatggttgcttttgccgtcgtgattttcgtcttcctcggatcagtagagggattcagcacaaagccgcaaacttgtacttacgacgcaaccaaactgtgcaagcccgctcttgccacagctgctttcagcaccatatccttcatactcggtgcagtcacttctgtcatttctggctttcttggaatgaaaattgccacgtatgccaacgcccgtaccactttagaggctagaaagggtgtgggaaaagccttcatcgttgcatttagatctggtgcagttatgggcttccttctcgctgcaaatgggcttcttgttttgtacattgtcataaacctcttcaagttgtactatggagatgattgggaaggcctttttgaggctataacggggtatggtcttggtggatcttccatggctctttttggtagagttgctggcggtatttacaccaaagctgctgatgtaggggcggatcttgtgggcaaggtagaaaggaatattccggaagatgacccgaggaaccctgctgtgattgcagataatgttggtgacaatgttggggatattgctggaatggggtccgatttatttgggtcgtatgcagagtcttcttgtgctgcacttgttgttgcttcgatctcgtcttttgggataaaccatgaattcactgctatgctgtatcctctattagtgagctccgtgggaataatcgtttgtttgttgaccaccttatttgcaactgatttctttgaggtcaaagaggttgaccaaattgagccggcactgaagaagcaacttgttatctcgactgtgttgatgactgttggaatagctctcgttagttggattgcccttccttcctccttcacaatattcaatttcggagtccagaaagaagttaagagctggcaattattcttgtgtgttgctgttggtttgtgggctggcctaatcattgggtttgtcacagagtactacacgagcaatgcttacagcccagtacaggatgttgcagactcatgcagaactggagcagctacaaatgtgattttcgggcttgcattgggatacaaatcagtgataattccgatattcgccatagcaattagcattttcgtcagtttcagctttgcagcgatgtatgggatagcagtagctgcacttggaatgctgagcacaatagcgactggtttggcgatagatgcatatggaccaatcagtgacaacgctggtggtattgctgagatggctggcatgagcgccgttattcgtgagagaaccgatgcccttgatgctgcaggaaacaccaccgcagctatcggaaagggatttgcgattggatcagctgcacttgtgtcacttgcactattcggtgcatttgtgagccgagcggcaatttcgaaagtggacgttttgaccccgaaagtgttcatcggtttgctagtgggtgcaatgcttccatattggttctcagccatgacaatgaagagtgtggggagtgcagctctaaagatggttgaagaagtgagaaggcaattcaacacaatgcctggtataatgttgggcactcaaaagcccgattatgcaacctgcgttaagatctcaactgatgcttctatcaaagagatgattgctcctggtgctcttgttatgcttactcctctcattgtcggtgttttctttggcgtcgaaacactctccggtgttcttgccggttctctcgtctctggtgttcagattgccatctctgcatcaaacaccggtggtgcttgggataatgccaaaaaatatatcgaggctggtgcttcggagcatgcaaggacactgggtccaaaagggtcggacgcacacaaggcagctgtaattggagacacagtcggggacccactcaaggatacatctggaccttcgctcaacattcttatcaagcttatggctgttgaatccctcgtctttgcccccttctttgctactcatggtggcttgctcttcaaacttttctaaacaggggatgatgtcatgatgatgatgtcactatgatgatgatgatgatgacgatgacgaactccatgtaatttgccctctcctcccacattttgtaatctcagctccatttctagtactttggtttcttcttgccttccaaactgtttatctatcctcataaagattctgaggagaaaattttccatcaactgtattctattctttcactgagttaatcgacattttattctcccattttacttttcttttgccaacttatttttcaggct

SEQ ID NO: 1691 - DNA, 2734 bp, Pennisetum glaucum
cccgtgccgtgcgtgcgctcgaacgaattccgcacggaattctccgcacggaattctccgcgtggacgaaccctagcgcaccccggatctcgccgcggggtggtgcaatggcctcgccggcgttcctgcccgagctggccacgcaggtgatcgtgcccgtcgcagccgtggtcggcatcgcgttcgcggtgctgcagtgggtgctggtctccaaggtgaagctctcccccgagccccggcgcggggacggctcctccgggaaggccggcgccggcgccagcgagtacctcatcgaggaggaggaggggctcaacgagcacaacgtcgtcgtcaagtgcgccgagatccagaacgccatctccgaaggagcaacttccttccttttcactgaatacaagtatgttggactattcatgagcatttttgctgtcctgatcttcctcttccttggctctgttgaggggttcagcaccaagagtcagccttgccactacagcaagggcaagatgtgcaagcctgccctagctaacgctctcttcagcacaatcgcctttgtgcttggtgcagtcacctcacttgtttctgggtttcttggaatgaagattgcaacatatgcaaatgccagaacaacacttgaggcaaggaagggtgtcggaaaggcattcattactgccttccgctctggggctgtgatgggcttcctgcttgctgctagtggcctttttgtcctttatattgcaatcaacttgttcggaatttattatggtgatgactgggagggcctttatgaggctatcactggttatggtctcggtggttcttctatggctctttttggccgtgttggtggtggaatatacaccaaagctgctgatgttggtgcggatcttgttgggaaagttgaaaggaatatccctgaagacgatccgagaaacccagctgtcattgcagacaatgtcggtgacaatgttggagatattgctggaatgggatcagatctctttggctcctatgctgagtcttcatgtgctgctctggtcgttgcctcgatctcttcttttgggatcaatcatgagttcactcctatgctgtacccactcctcgttagctctgtgggtatcatagcttgcttgataaccactctttttgcaactgatatctttgagatcaaggcagtagacgaaattgagccagctctcaagaagcaacttataatttccactgctgtgatgactgttggcattgcacttgtcagttggttagggcttccatctacattcacaatcttcaactttggtgtgcagaagactgtgtataactggcaattattcctctgcgtggcagttggtctgtgggctggactagttattggatttgttaccgagtattacacgagcaatgcatacggtcctgtgcaggatgttgctgactcctgcagaactggagctgctactaatgtcatctttggccttgctctgggatacaaatcagtcattatccctatttttgctattgctttcagtattttcctcagcttcagccttgctgcaatgtacggtgttgctgtggctgctcttggaatgctcagcacaattgctacaggccttgctattgatgcctatggtcctatcagtgataatgctggaggaattgctgaaatggctggcatgagccacagaatccgtgagagaacagatgctctcgatgctgctggaaatactactgctgccattgggaagggttttgccattggttcagctgcattggtgtctcttgccctctttggtgctttgtcagccgtgctgagatcgtaactgttgatgttttgtcaccaaaagttttcattggactgattgttggtgccatgcttccatactggttctcagcaatgaccatgaagagtgttggcagtgcagcactcaagatggttgaggaagtccgcaggcagttcaacaccatccctggcctcatggagggcaccaccaagcctgactatgcaacatgtgtcaagatctccactgatgcgtctatcaaggagatgatcccccctggtgcacttgtcatgctcaccccgcttattgttgggatcttgtttggtgttgagaccctctctggtattcttgctggtgctcttgtttctggcgtccagattgccatctctgcatccaacactggaggtgcctgggacaatgcaaagaaatacattgaggctggtgcatctgagcatgcccaaaccctgggccccaaaggctctgacccacacaaggctgccgtcatcggcgacaccatcggtgatcccctcaaggacacctcaggcccctcgctgaacatcctcatcaagctcatggccgttgagtccctggtctttgcccccttctttgccacccatggaggcatcctcttcaaatggctttagaggaagaagatcgatggaccggttactttaattttgccggggagagcactagcattatctatggcatagagaagtttcagtttacccatatagtgcttttcttccattttgtttcgctcgtactgtattgctgtcaagttgaacttatcagccattgtgtcacctagtttgcgggtctagttgcagtagccgagtggagcaaatctctggccattctacaggtttggggtttggacattggaagtattggaaagttctgtagatatttcgatgatgatgatcaaggaatgaacaaatcagatttactgtcttcgctac

SEQ ID NO: 1692 - DNA, 2680 bp, Mimulus guttatus
cattattctcctatttttctctgttgcatacatatttttctccatacaaaggcccatggcggaggcgacgctgctctcagatctcggcacccaaattatcatacctatttgcgcgctagtcggcatagttttcgccctcgtgcaatggatgctcgtggccaaggtgaagatctccaccggaaaatcaaattccgccgacgggaataatggattcaccgaagccctaatcgaggaggaggaaggcatcagtgaacattccgtcattcgcaagtgcgccgatatccaagccgccatatccgaaggctcgacatcgttccttttcacaatgtaccaatatgtcggaatcttcatggttgcgttcgccttattaatcttcctcttcctcggatcagtcaaaggattcagcacaagccatcaaccctgtgcgtacgacagcaccaaaatgtgcaagcccgccctagcgacagctgtcttcagcacagtagccttccttctcggagctgtcacctctgtgatctccggttttcttggaatgaaaatcgccacctatgcgaatgctcgaaccaccttagaggcaagaaagggtgttggaaaggctttcatagttgcatttagatctggtgcagttatgggctttctcctggctgcaaatggtcttctcgttttgtttatcaccatcaatctctttaagttatactatggtgatgattgggaaggtttgttcgaggctataactggttatggccttggtggttcttcgatggctctctttggtagagttggtggaggtatctacactaaagctgctgatgtaggcgctgacctcgtcggcaaggtggagcagaacattccggaagatgaccccagaaaccctgcggttattgcggataatgtcggtgataatgttggagatattgctggaatggggtcggatctttttggctcgtacgcagaagcttcgtgtgctgctcttgttgttgcttcaatctcgtctttcggaatcaatcataactttactgctatgctgtttcctcttctggtcagctctgttggaatcctcgtttgtttgctcaccacattgtttgcaaccgatttcttcgaggtcaaggcagtcaatgagatcgagcccgcattgaagaagcagctcattatctccacaatactgatgacagctggaatagctttcgttagctggatcgctcttccttcgtccttcactatattcaatttcggtgtgcagaaagaagttcaaagctggcaattgttcttgtgtgtggcggttggtttgtgggcgggcttgattattggattcgtcacagagtactacacgagcaatgcttatagcccggtgcaagatgttgcagactcgtgccgtacaggggcggctacgaatgtgatttttgggctagcgttaggttacaaatcggttattattccgatattcgcaatcgcgattagcattttcgttagctttagctttgctgcaatgtacgggattgcggtggctgcacttggaatgctgagtacaatagcaactggattggctatcgatgcgtatggtccaatcagtgacaatgctgggggtatcgctgagatggcaaggatgagtcacactattcgagagaggaccgatgcacttgatgctgctgggaataccactgcagccattgggaagggatttgcaatcgggtctgcagctctcgtttccctagccctattcggtgcattcgtgagccgtgctgacatcacaaccgtagatgtactaactccaaaagtgttcattggtttgatagtgggtgcaatgctcccttattggttctctgccatgacaatgaagagcgtcggcaaagctgctcttaagatggtcgaagaagttcgccgacagtttaacacaatcgtgggtataatggacggttctggtaaacccgactatgcgacatgtgtcaagatctcaacggacgcttccatcaaggagatgattcctcccggtgctcttgtcatgctcactccactcattgtcggaatattctttggcgtcgagactctttccggtgttcttgctggatctctcgtctctggtgtccagattgctatctcagcctccaacacaggtggtgcatgggacaacgccaagaaatatatcgaggcgggtgcttcggagcatgcacgcagcctaggtccaaaaggatccgatccacacaaagcagctgtgatcggagacacgatcggtgacccactcaaggacacatctggaccgtcacttaacattctcatcaagcttatggctgttgaatctctcgtttttgctccgttctttgctgcacacggtggattgctcttcaagatcttctgaagtgtaaggcaaacacaaaatctctgcccccccccctaatttatcctgtcatgagtaataatcttttttttttttttttttttttgaggtttcgaatataaattttgccatgattaattagtatgttcgaatcttgccaatagttgggacactgttttattattgttattattattattattattattttttactttactctttgggtttaatattatatgtataaattgaaatatttcaagtgttggttcagcccatgtgcccaaatcctaattcacgttgcacccatttgtttgtaaaagtttttcagattgtatttatttaatc

SEQ ID NO: 1693 - DNA, 2795 bp, Brachypodium distachyon
gaactcccgaggcgggcggcgatggtgctgtcggagctggcgacgcagctggtggttccggtggcggccgtggtgggcatcgcgttcgcggtgctgcagtgggtgctggtctccaaggtcaaggtcacgcccgagcggcgcgacggggaaggggcttcctccggcgccgcggcgggcgccgggaagaacggcgccgccgccggcagcgagtacctcatcgaggaggaggaagggctcaacgaccacaacgtcgtcgtcaagtgcgccgagatccagaccgccatctccgaaggagcaacttccttccttttcactgaatacaagtatgctggaggattcatggccatttttgctgttctgatctttctcttcctgggctccattgaggggttcagcacaaaggatcaagcttgccattacagcaagggcaagacatgcaagcctgcgttggccaatgccctgttcagcacaattgccttcgtgctaggtgcaatcacctctcttgtatctggttttctcgggatgaagattgcaacttacgcaaatgccaggacaactcttgaggcaaggaagggtgttgggaaggcattcattactgctttccgctctggtgctgtgatgggcttccttcttgctgcaagtggcctctttgttctttatgttgcaatcaacgtgtttggactttattatggtgatgactgggagggtcttttcgaggctatcaccggttatggtctcggtggttcttctatggctctttttggccgtgtaggcggtggtatttacactaaagctgctgatgttggtgctgatcttgttgggaaggtggaaaggaacatccctgaagatgacccgaggaacccagctgtcatcgcagacaatgttggtgacaatgttggagatattgccgggatggggtcagatctcttcggttcctatgccgaatcatcttgtgctgctcttgttgttgcctcaatctcttcctttggaattaaccatgaattcaccccaatgatgtacccactcctaattagctctgtgggtataatagcttgtttgataacaactctttttgcgactgatttctttgaggtcaaggctgtagatgagatagagcctgccctaaaaaaacagcttataatttccactgccttgatgactgttggcattgcactcgtcagttggttaggcctcccgtctaccttcacaatattcaactttggtgcccagaagacggtgcataactggcaactatttttatgtgtgtcggttggtctctgggccggcctagtcattggatttgttacagagtactacacaagcaatgcatacagtcctgtgcaggatgttgctgattcctgcagaactggagctgctaccaatgtcatctttgggcttgctctgggatacaaatcagttattatccctatttttgccattgcttttagtattttcctcagcttcagccttgcagcaatgtatggtgttgctgtggctgctcttggaatgctcagcacaattgcaactggtcttgccattgatgcctatggccctatcagtgacaacgctggagggattgctgaaatggctggcatgagccacagaattcgtgagagaactgatgctctagatgctgcaggaaacacaactgctgccattggaaagggttttgccattggctcggctgccttggtgtcccttgctctcttcggtgcgtttgtgagccgtgctgggatcacaactgttgatgttctgacacctaatgttttcattggactgcttgttggtgccatgctcccatactggttctctgcaatgaccatgaagagtgttggcagtgcggctctcaagatggtggaggaagtgcgaaggcagttcaacaccatccctgggctcatggagggcactgccaagcctgactacgcgacatgtgtgaagatctccactgatgcatccatcaaggagatgatccccccgggtgctcttgtcatgctcacaccccttattgtggggaccttctttggcgtcgagaccctctctggagtccttgccggtgctctagtttctggtgttcagatcgccatttcagcatcaaacactggtggtgcctgggacaacgccaagaagtatattgaggctggcgcatctgagcatgcaagaaccctgggccctaaaggctcagattgccacaaggctgctgtgattggtgacaccattggggatcccctcaaggacacctcaggcccctcgctcaacatcctcattaagctcatggcggtcgagtccctcgtgttcgctcccttcttcgccacctatggaggcattctcttcaaatggctttagaggcagaagaacaacgagtacttagttttgccggtcgggagagatcatctatatgtcgtggagccccttgagatgacccgttatgctccctcatctgtttccccttccgttgttcatgtattccacacatcttgttgaacttgtctagttttcaatttctcattctggtagtagtaagtagcaatagcagcagcagcctgagggtagcgaaatcaacagccattcgacatgtttggacgagtgtcttggggagtttcattttgccaggggatgatgatgatcttgtatacacattgcggatatcctgtttatgagtgaaattttttcttcggatgcctctgtttattattattatgtactaggtcactgtgtggtagaaattggataactttgatctgcttcatgctttttctatgacattgctcttgcctggctagggagctgttgtgcaa

SEQ ID NO: 1694 - DNA, 2677 bp, Hordeum vulgare
gccagcgtactgatctcagcggcggagatggtggcggcggcgatcctgccggagctggccacgcagctggtggtgccggtggcggcggcggtcggcatcgccttcgcggtgctgcagtgggtgctcgtctccaaggtcaaggtcgcccccgagccgcgcgccgagggagggtcggcctccgccgtcggggcaaaggacggcgccaccgagtacctcatcgaggaggaggagggcctcaacgaccacaacgtcgtcctcaagtgcgccgagatccagaccgccatctccgaaggagcaacctccttccttttcactgaatacaagtatgccggaggattcatgaccattttcgcggtcctgatcttcgtcttccttggctccatcgaggggttcagcacaaagagccagccttgccattacagcgtgggcaagacatgcaagcctgctcttgctaatgctgccttcagcacaattgcctttgtgctaggtgcggtcacctctcttgtgtctggtttccttggaatgaagattgcgacctatgcgaatgccaggacaactctcgaggcaaggaagggtgttgggaaggcgttcatcaccgctttccgctctggtgccgtgatgggcttccttcttgctgcaagtggcctttttgttctttacgttgcaatcaacctgtttgggctttattatggtgatgactgggagggtctattcgaggctatcaccggttatggtctcggcggttcttccatggctctttttggccgtgtaggcggtgggatttacaccaaagctgctgatgttggtgctgatcttgttgggaaagtagaaaggaacatccctgaggatgacccgaggaacccagctgtcattgcagacaatgttggtgacaatgttggagatattgctggaatgggttcagatctctttggttcctatgccgagtcatcttgtgctgctcttgttgttgcctcaatctcttcctttggaattaaccatgaattcacccccatgatgtacccactcctaatcagctcagtgggtataatagcctgtttgataacaactctttttgcaactgatttctttgaggtgaaggaggtagatcaaatagagcctgccctaaaaaggcagcttataatctccactgctgtgatgaccattggcattgcactagtcagttggttgggtctcccatataccttcacaatattcaactttggtgcccagaagactgtgcatagctggcaactatttttgtgtgtggctgttggtctctgggctggcctagtcattggattcattacagagtactacacaagcaatgcatacagtcctgtgcaggatgtcgccgattcctgcagaactggagctgctaccaatgtcatctttggtcttgctctgggatacaaatcagttattatccctatctttgccattgccttcagtattttcctcagcttcagccttgctgcgatgtatggtgttgctgtggctgctcttggaatgctcagcacaattgctactggtcttgccattgatgcctatggccctatcagtgacaacgctggaggcattgctgaaatggctggcatgagccacagaattcgtgaaagaactgatgctctcgatgctgcaggaaacacaactgctgccattggaaagggctttgcaattggctcggctgccttggtgtcccttgctctctttggtgcctttgtgagccgtgctgggatcacgaccgttgatgtcctgacacctaatgtctttattgggctccttgttggcgccatgctcccatactggttctctgcaatgaccatgaaaagtgttggaagtgcggctctcaagatggtggaggaagtgcggaggcagttcaacaccatccctgggctcatggagggcaccgccaagcccgactatgcgacatgtgtgaagatctccactgatgcgtccatcaaggagatgatcccaccgggtgctcttgtcatgctcacaccactcattgttgggaccttatttggtgttgagaccctctctggtgtccttgccggtgctctggtttctggtgttcagattgccatttcggcatcgaacaccggtggtgcatgggacaacgccaagaagtacattgaggctggcgcatctgagcatgcaaagagcctgggcccgaaaggctctgactgccacaaggccgccgtgatcggtgacaccatcggggaccctctcaaggacacctcgggcccctcgctcaacatcctcatcaagctcatggcggttgagtccctcgtgttcgcccccttcttcgccacctatggaggaatcctcttcaagattctgtagagcaagaagatcgactgtctagttttgacggttgggagcgcgctacttcatccacatgttatggagctccttcagttgatgaccctcttgtgttttacattttgttgttcctggtcttgcgcaatcatgttggaacttgtctagtttttcattccggtagctgtagtagtggtagcagagggtagcgaaatggacggccattcgacaggtttgtattagagtgtcttgggagttatgttttgcctgtagatggatgatgacgacgacgacgacgatgaatcttgtatgcccattgcggatttcgtgtcttgaattttcaatgggagctactctt

SEQ ID NO: 1695 - DNA, 2726 bp, Avena sativa
cctctccctcccgtgctctcgctaacattccgctgagataaatcctccgctgaaagggggaaccctaggtccggatctcccgagccggagatggccgcgtcggtgatcctgccggacctggccacgcaggtggtggtccccgtggcggcggcgatcggcatcgccttcgccgtgctgcagtgggtgctggtctccaaggtgaaggtcacgcccgagcggggctccgccgggaaggacggcgcgagcgaggcgctcatcgaggaggaggagggcctcaacgaccacaacgtcgtcctcaagtgcgccgagatccagaccgccatctccgaaggagcaacctccttcctttacaccgagtacaagtatgctggagcattcatggcattttttgctgttctgatcttcgtcttcctcggctctatcgaagggttcagcacaaagagtcagccttgccattacagcgtgggcaagtattgcaagcctgctcttgctaatgccgtgttcagcacaatcgcttttgtgctaggtgcagtcacctctcttgtgtctggttttctcggaatgaagattgcaacctatgcaaatgccaggacaacccttgaggcaaggaaaggtgttgggaaggcattcatcgttgctttccgctctggtgctgtgatgggcttccttcttgctgccagtggcctttttgttctttaccttataatcaatttgtttggactttattatggtgatgactgggaaggtctttttgaggctatcaccggttatggtcttggtggttcttcgatggctctttttggccgtgttggtggtgggatttacactaaagctgctgatgttggtgctgatcttgttgggaaagtagaaaggaacatccctgaagatgacccgaggaacccagctgtcattgccgacaatgttggtgacaatgtgggagacattgctggaatggggtcagatctcttcggttcctatgccgagtcatcttgtgctgctcttgttgttgcctcaatctcttcctttggaattaaccatgagttcacccctatgatgtacccactcctaatcagctctgtgggtataatagcttgtttgataacaactctttttgcaaccgatttctttgaggtcaaggctgtagatcaaatagagccttccctaaaaaaacagctcataatctccactgctgtgatgaccattggcattgcactggtcagctggttaggcctcccatataccttcacaatattcaactttggtgctcagaagactgtgcataactggcaactatttttatgtgtgtctgttggtctctgggctggcctagtcattgggtttattacagagtactacacaagcaacgcatacagtcctgtgcaggatgttgctgattcctgcagaactggagctgctaccaatgtcatctttgggcttgctctgggatacaaatcagttattatcccaattttcgccattgccttcagtattttcctcagcttcagccttgctgcgatgtatggtgttgctgtggctgctctcggcatgctcagcacaattgctactggccttgccattgatgcctatggccctattagtgacaacgctggaggcattgctgaaatggctggcatgagccatagaattcgtgagagaactgatgctctggatgctgcaggaaacacaactgctgccattgggaagggttttgccattggctccgctgccttggtgtcccttgctctcttcggtgcctttgtgagccgtgctgggatcacaagtgttgatgttctgacacccaacgttttcattggactgcttgttggcgctatgctcccatactggttctctgcaatgaccatgaagagtgttggcagtgcggctctcaagatggtggaggaagtgcggaggcagttcaacactatccctgggctcatggagggcactgccaagcctgactatgcgacatgtgtgaagatctccactgatgcgtctatcaaggagatgatccctcctggtgctcttgtcatgctcacacctcttattgtcgggaccatctttggtgttgagaccctctctggagtccttgctggtgctctagtttcgggtgttcagattgctatttcagcatcaaacactggtggtgcctgggacaacgcaaagaagtacatcgaggctggtgtatctgaccatgcgaaatccctgggcccaaaaggctcagactgccacaaggctgctgtgattggtgacaccatcggggatcctctcaaggacacctctggcccctcgctcaacatcctcatcaagctcatggcggtcgagtcccttgtgtttgcccccttcttcgccacctatggaggcatcctcttcaaatatatttagagggagaagatccaacagacgatcgcttaattattttttgctggtcgggagcgtgctacttcatccatatgtcttggagctccttcagactcattatgcgccttttgttatccatttagttgttcctggtcttgttccatcatgttgaacttatctagttttcattctggtagatgtagtagtagcagagggtagcgaaatcgacggccatggtttgggcaagagtgtcatggagagtactgttctgtctgtaggtggattgtgatgacgatgatgagtcttgtatgaaactggggaatgttttgtctgaatttgggtaatattttatctgaaattgggtaatg

SEQ ID NO: 1696 - DNA, 2816 bp, Setaria italica
cgccgcctcgcgcccgtgcgttccccgcgcgtagggttagggttttggccccgccgacgccgccatggcgatcctctcgccgctcgccaccgaggtgttcatccccatcgccggcatcatcggcatcgccttcgccgtcgtgcagtgggtgatcgtgtcgcgggtgaagctctccccggccgcggccgcctcgggcggcagcaagaacggctacggcgactacctcatcgaggaggaggagggcctcaacgaccacaacgtcgtcgtcaagtgcgccgagatccagagcgccatctccgaaggagcaacatcgtttctcttcacggagtaccaatatgttggtattttcatgtcgatcttcgctgttgtcatcttcctcttccttggttcggttgagggattcagcacaaagagccagccctgcacctatagcaagggaaagtactgcaagcccgctctcttcactgcactcttcagcactgcatccttcttgcttggagctatcacctctttggtctctggtttccttggaatgaagattgccacatatgccaatgccagaaccaccctggaagccaggaagggtgtcgggaaggcatttattgtcgctttccgctctggtgccgtcatgggctttttgcttgcatcaagcggtcttgtggttctctacatcaccattaacgtatttaagttgtactatggtgatgactgggagggtcttttcgagtctatcactgggtatggccttggtgggtcttccatggctctctttggaagagttggtggaggtatctacacaaaggctgctgatgtgggtgctgatcttgttggcaaagttgaaaggaacatccccgaggatgatcctaggaacccagctgtgatcgctgataatgttggtgacaatgttggtgacattgctggaatggggtctgatctctttgggtcatacgcagaatcttcctgtgctgcccttgttgttgcatctatttcatcttttggaatcaaccatgattttactgggatgtgctacccactgcttgtgagctctgttggcatcatagtctgcttgctcaccacactctttgccactgacttctttgagatcaaggctgtgaaagaaatcgaacctgcacttaagaagcagctcatcatctccactgctctgatgactgttggtattgcgataatcagctggttggcccttccagccaagttcaccatcttcaactttggtgctcagaaggaagtatccaactggggcttgttcttctgtgtttcaattggtctgtgggctggtcttattattggttttgtcacagaatactacaccagcaatgcatacagtcctgtgcaagatgttgcggattcctgcagaactggtgctgccaccaatgtgattttcggtctggctctaggatacaagtcagttatcatcccaattttcgccattgctgtcagcatctatgtcagtttctctattgctgcaatgtacggcatagcagttgccgcccttggtatgctaagcacaatcgcaactggccttgctattgatgcttatggtcccattagtgataatgctggtggcattgctgagatggctggaatgagccacagaatccgtgagagaactgatgctccactgctgctattggaaagggatttgccattggatcagctgctcttgtgtccctggccctttttggtgcctttgtcagcagagctggagtgaaggttgtcgatgtcctgtcccccaaggtcttcattggcttgattgtcggagccatgcttccatactggttctctgccatgaccatgaagagtgttggaagtgctgctctgaagatggttgaggaggtccgcaggcagttcaacaccattcctggtctgatggagggaactggcaagcctgactacgctacctgtgtcaagatctctaccgatgcttccatcaaggagatgatccccccaggtgctctggtcatgctcactcccctcattgttggaaccctctttggtgtggagaccctctctggtgttcttgctggtgccctggtttctggagtgcagattgccatctctgcttccaacactggtggtgcatgggacaatgccaagaagtacattgaggctggtgccagcgagcacgcaaggaccctgggccccaagggatcagactgccacaaggctgccgttatcggcgacaccatcggtgaccccctgaaggacacctctggcccatccctcaacatcctcatcaagctcatggccgtggagtcccttgtgttcgcccccttcttcgctacccacggtggcctgatcttcaagtacctgtaagagccacaccaagcgcagcagaagtatacaccgatccgtggacatcttgaataactcttgccagatcgccagttcgtgtgtcgtgcgcgcagagttgcgccgctgtttttttggtctcattgtttcaggattgctgctactgttcatctttctctttgggcctcctggaggcgttaccattagccttactcttaccgcttgtagcaccacgtagaagagaagagatgtcctgtgtctggcaaattttcccagtcccttgatgatggcgatgatgttgaaatctttgaacaatgatacatgattgttgcatcgtactggtggcaaatcatatggtttgttaatggctaccttctgcccatcattccaatgttgtgttatgtactatcgcctgcagtgtagtgtaatgcaaggtaagcgcgcgttgctgtttgcattgcgcatttccattgtactatttcgctaaaacagccaacaaatctggc

SEQ ID NO: 1697 - DNA, 2682 bp, Hordeum vulgare
cgggacgaagccagcgtactgatctcagcggcggagatggtggcggcggcgatcctgccggagctggccacgcagctggtggtgccggtggcggcggcggtcggcatcgccttcgcggtgctgcagtgggtgctcgtctccaaggtcaaggtcgcccccgagccgcgcgccgagggagggtcggcctccgccgtcggggcaaaggacggcgccaccgagtacctcatcgaggaggaggagggcctcaacgaccacaacgtcgtcctcaagtgcgccgagatccagaccgccatctccgaaggagcaacctccttccttttcactgaatacaagtatgccggaggattcatgaccattttcgcggtcctgatcttcgtcttccttggctccatcgaggggttcagcacaaagagccagccttgccattacagcgtgggcaagacatgcaagcctgctcttgctaatgctgccttcagcacaattgcctttgtgctaggtgcggtcacctctcttgtgtctggtttccttggaatgaagattgcgacctatgcgaatgccaggacaactctcgaggcaaggaagggtgttgggaaggcgttcatcaccgctttccgctctggtgccgtgatgggcttccttcttgctgcaagtggcctttttgttctttacgttgcaatcaacctgtttgggctttattatggtgatgactgggagggtctattcgaggctatcaccggttatggtctcggcggttcttccatggctctttttggccgtgtaggcggtgggatttacaccaaagctgctgatgttggtgctgatcttgttgggaaagtagaaaggaacatccctgaggatgacccgaggaacccagctgtcattgcagacaatgttggtgacaatgttggagatattgctggaatgggttcagatctctttggttcctatgccgagtcatcttgtgctgctcttgttgttgcctcaatctcttcctttggaattaaccatgaattcacccccatgatgtacccactcctaatcagctcagtgggtataatagcctgtttgataacaactctttttgcaactgatttctttgaggtgaaggaggtagatcaaatagagcctgccctaaaaaggcagcttataatctccactgctgtgatgaccattggcattgcactagtcagttggttgggtctcccatataccttcacaatattcaactttggtgcccagaagactgtgcatagctggcaactatttttgtgtgtggctgttggtctctgggctggcctagtcattggattcattacagagtactacacaagcaatgcatacagtcctgtgcaggatgtcgccgattcctgcagaactggagctgctaccaatgtcatctttggtcttgctctgggatacaaatcagttattatccctatctttgccattgccttcagtattttcctcagcttcagccttgctgcgatgtatggtgttgctgtggctgctcttggaatgctcagcacaattgctactggtcttgccattgatgcctatggccctatcagtgacaacgctggaggcattgctgaaatggctggcatgagccacagaattcgtgaaagaactgatgctctcgatgctgcaggaaacacaactgctgccattggaaagggctttgcaattggctcggctgccttggtgtcccttgctctctttggtgcctttgtgagccgtgctgggatcacgaccgttgatgtcctgacacctaatgtctttattgggctccttgttggcgccatgctcccatactggttctctgcaatgaccatgaaaagtgttggaagtgcggctctcaagatggtggaggaatgcggaggcagttcaacaccatccctgggctcatggagggcaccgccaagcccgactatgcgacatgtgtgaagatctccactgatgcgtccatcaaggagatgatcccaccgggtgctcttgtcatgctcacaccactcattgttgggaccttatttggtgttgagaccctctctggtgtccttgccggtgctctggtttctggtgttcagattgccatttcggcatcgaacaccggtggtgcatgggacaacgccaagaagtacattgaggctggcgcatctgagcatgcaaagagcctgggcccgaaaggctctgactgccacaaggccgccgtgatcggtgacaccatcggggaccctctcaaggacacctcgggcccctcgctcaacatcctcatcaagctcatggcggttgagtccctcgtgttcgcccccttcttcgccacctatggaggaatcctcttcaagattctgtagagcaagaagatcgactgtctagttttgacggttgggagcgcgctacttcatccacatgttatggagctccttcagttgatgaccctcttgtgttttacattttgttgttcctggtcttgcgcaatcatgtaacttgtctagtttttcattccggtagctgtagtagtggtagcagagggtagcgaaatggacggccattcgacaggtttgtattagagtgtcttgggagttatgttttgcctgtagatggatgatgacgacgacgacgacgatgaatcttgtatgcccattgcggatttcgtgtcttgaattttcaatgggagctactctt

SEQ ID NO: 1698 - DNA, 2801 bp, Triticum aestivum
  misc_feature (26)..(26): n is a, c, g, or t
cgtccgcctcgctctcgtactacctnatcctccgctgaaggtgggtgagcggaacggaaaagaaccggtcttgggcgcgtccggcgtaggcggagatggtggcggcggcgatcctgccggagctggccacgcagctggtggtgccggtggcggcggcggtcggcatcgcgttcgcggtgctgcagtgggtgctggtgtccaaggtcaaggtcgcccccgagccgcgcggcgagggcgggtcggcggccggaggaggagccggcgcgggggccaaggacggcgccagcgagtacctcatcgaggaggaggagggcctcaacgaccacaacgtcgtcctcaagtgcgccgagatccagaccgccatctccgaaggggcaacctccttccttttcactgagtacaagtatgctggagggttcatgaccgttttcgcggtcctgatcttcgtcttccttggctcgattgaggggttcagcaccaagagtcagccctgccattacagcgtgggcaagacatgcaagcctgctcttgctaacgccgcgttcagcacaattgcctttgtgctgggtgcggtcacctctctggtgtctggtttccttggaatgaagatcgcgacttacgcgaatgccaggacaactcttgaggcaaggaagggtgttgggaaggcgtttatcgttgctttccgctccggtgctgtgatgggcttccttcttgctgcaagtggcctttttgttctttacgttgcaatcaacttgtttgggctttattatggtgatgactgggagggtcttttcgaggctatcaccggttatggtcttggcggttcttccatggctcttttcggccgtgtaggcggtgggatttacaccaaagctgctgatgttggcgctgatcttgttgggaaagtagaaaggaacatccctgaagatgacccgaggaacccggccgtcattgcagacaatgttggtgacaatgttggagatattgctggaatgggttcagatctctttggttcctacgccgagtcatcttgtgctgctcttgttgttgcctcaatctcttccttcggaatcaaccgtgaattcactcccatgatgtacccactcctaattagctcagtgggcataatagcctgtttgataacaactctttttgcaaccgatttctttgaggtgaaggaggtagatcaaatagagcctgcccttaaaaaacagcttataatctccactgctgtgatgaccgttggcattgcactagtcagctggttaggcctcccatataccttcacaatattcaactttggtgcccagaagacggtgcatagctggcaactatttctatgtgtggcggttggtctctgggctggcctagtcattggatttatcacagagtactacacaagcaatgcatacagtcctgtgcaggatgttgctgattcctgcagaactggagctgcaaccaatgtcatctttggtcttgctctgggatacaaatcagttattatccctatcttcgccattgccttcagtattttcctcagcttcagccttgccgcgatgtatggtgttgctgtggctgctcttggaatgctcagcacaattgcgaccggtcttgccattgatgcctatggccctatcagtgacaacgctggaggcattgctgaaatggctggcatgagccacagaatccgtgaaagaactgatgctctggatgctgcaggaaacacaactgctgccattggaaagggttttgcaattggctcggctgccttggtgtcccttgctctcttcggtgcctttgtgagccgcgccgggatcacaactgttgatgttctgacaccaaacgttttcattggactccttgttggcgctatgctcccgtactggttctctgcgatgaccatgaagagtgttggaagtgcggctctcaagatggtggaggaagtgcggaggcagttcaacaccatccctgggctcatggagggcaccgccaagcccgactatgcgacatgtgtgaagatctccactgatgcgtccatcaaggagatgatccccccgggtgctcttgttatgctgacacctcttattgtcgggaccttcttcggtgttgagaccctctctggtgtccttgccggtgctctggtttctggtgttcagattgccatttcagcatcgaacaccggtggtgcctgggacaacgcaaagaagtacattgaggccggcgcgtctgagcatgcaaagagcctgggcccgaaaggctcagactgccacaaggctgctgtgatcggtgacaccatcggggaccctctcaaggacacctcgggcccctcactcaacatccttatcaagctcatggcggtcgagtccctcgtgtttgcccccttcttcgccacctatggaggcatcctcttcaagtatctttagagcatgaagatcgactatctagttttgccggtggggagcgtgctacttcatctacatgttatggagctccttcagatgatggccctcttgtgttttacatttcgttgttgctggtcttgcgcaatcatgttggaacttgtctagttttcattctggtagctgtagtagtggtagcagagggtagcgaaatgaacggccattcgacaggtttggactagagtgtcttgggagttatattttgcttgtagatgatgatgacgacgacgatgaatcttgtatgcacattgcagatttcatgtcttgaatttccaatgggagctactcattctgtaggtgatcggatggatgcaatgcctttgtgaggattatgtttttgcg

SEQ ID NO: 1699 - DNA, 2518 bp, Plantago ovata
tccgatggaagtgcggcgacgaagaacgggaagaatgggtacaatgcgaggttgattgaggaggaggacggcgtcgccgacgaggatgtggttggcaagtgtgctgagatccagaacgccatttctgagggggctacatctttcctgttcacaatgtaccagtatgttggtatatttatggttgcttttgcaatcctcatcttcctgttccttggttcagtcgagggttttagcacgaagagccaaccctgcacttatgccaaggagaatatgtgcaagccagctattgcaactgcacttttcagtaccgtagcctttgtgcttggtgctgtcacctctgtcatatctggtttccttgggatgaaaattgcaacctatgcaaatgctaggacaacattggaggctagaaaaggtgttggaaaagcttttattactgcatttaggtcgggtgcagttatgggtttcctccttgctgccaatgggttattggttctatatgttactattaatctgttcaagctctactatggggatgattgggaaggtctttttgaggctattactggatatggtcttggtggatcctccatggctttgtttggaagagttggaggtggcatatacacaaaggctgctgatgtaggtgctgaccttgttgggaaagttgaaaggaacattcctgaagatgaccccagaaatccagctgtgattgctgataatgttggtgataatgttggagatattgctggaatgggatctgatctttttggttcatacgctgaagcatcgtgtgctgctcttgttgttgcatccatttcttcttttggaacgagtcacgatttcacagcaatgttatacccattgctgattagttccgtgggaattttggtttgcttaattaccaccctctttgctaccgacttttttgaagtcaaggctgtcaaagaaattgagccagctttgaagaaccaacttattatctccactgtcctgatgaccgttgggattgcaattgtcacctggacctgcctcccatcatctttcacaatcttcaactttggcacacaaaaagttgtgaagaattggcaactgtttctctgcgtttgtgttgggctgtgggctggacttgttattggatttgtgaccgagtattacaccagcaatgcttacagccctgtgcaagatgttgctgattcctgcagaactggtgctgcaaccaatgttatctttgggcttgcattgggatacaaatcagttattattccaattttcgccattgcaataagcatttttgttagtttcacatttgctgctatgtacggtattgctgttgctgctcttggaatgctgagtacaattgctactgggctggccattgatgcttatggtcctatcagtgataatgccggaggtatagctgagatggctggtatgagccacacgattcgggagagaactgatgcccttgatgctgctggaaataccactgctgctattggaaagggctttgctattgggtctgctgcacttgtttcactggcactttttggcgcttttgtaagccgtgcaggaattgtcactgttgatgtgttgactcccaaagtctttattggtttgattgtcggtgcaatgcttccatattggttttctgccatgacaatgaagagtgtcgggagcgcagcattgaagatggttgaggaagtccgtagacagttcaacaccattcctggtctaatggagggcactgccaagccagattatgctacttgtgtaaagatctctactgatgcatctatcaaggagatgattcctccaggtgcccttgttatgcttaccccattgattgtgggaaccttattcggtgttgagaccctttctggtgttcttgccggctctcttgtctccggtgtccagattgccatatctgcatcgaacacaggtggtgcatgggacaatgctaagaagtacattgaggctggggcatcagcacatgcaaaatctcttgggcctaagggatcagatccacacaaggcagctgttattggtgacaccatcggagaccctctgaaagatacttcaggtccctcgctcaacatcctcattaagctcatggcagtcgagtcacttgtgtttgccccattctttgctactcacggtggtttgctgttcaagctattttgagtggttggtcagtttctcataatctccgcttcctggtacttggcttcggttgcttcattgatgttcttttgttcactgtttgtcctgattatcggaagttttaagtttagctcgtagctagtgagatcttaaattttgaagagctgattatgacgataattgttggcaaggatacgatgcaaatcgaagtccttactgcatgtacctcatatcacatgtattagattttgtctcaagtacttcaggaacatgttttcttttttgtatttgccttagaacatgaaaccattgggtcctaaattcattggtgaaactgaaatgtagtcttttgtacgcc

SEQ ID NO: 1700 - DNA, 2759 bp, Zostera marina
gaccttcatcactcatctcttgtttctgtttctccctctttctttctctctcactttctaggcagtgagcgtttccaaagtcgaaaccctagtgttcgagagatggaaggaacgttactttccgagctcgtgatggagatcttgatcccgctggtggcgatttgcggtatcgcgttttctttgttgcaatggtttattgtctcgcaagtcaagatgacgtcaatcgccgtacatcatccggacccgcaccatacgcattcagatcgccttattgaggaaggggaagatatgaacgaccacggcgtcgtcgctaggtgtgctgaaattcagacagctatttccgaaggtgccacttctttcctttttacagaatacaagtttgcaggactcttcatgagtggttttgcagttcttatctttctcttcctcggttctgtggaaggattcagcacaaaagaacaaccttgtacatataaaaaggatacgtactgcaagcctgctcttgcaaatgctgtatttagtactgtagcattcatacttggtgccgcaacatctctgttttctgggttttttgggatgaaaattgctacttatgccaatgctagaactacattagaggctaggaagggtgttggtaaggcttttatcactgcattcagatctggtgcagttatgggatttttgctggcttctagtggtctattggttctctacataactatacttttgttcaagttatactatggggatgattgggaaggtttgtttgaggctattactggttatggattgggtggatcttccatggcactctttggaagagttggtggaggtatttacacaaaggctgctgacgttggtgctgatcttgtgggtaaggttgagaagaatattcctgaggatgatccaagaaaccctgctgtgattgctgataatgttggtgataatgttggagatatagcagggatgggctctgatctttttgggtcatatgcagaatcgtcttgtgctgctcttgttgttgcctccatttcttctttcggaattaatcatgatctgactgctatgtgctttcccctgctcattagctccatgggtatcattgtctgtcttattactacgttgtttgcaaccgatttctttgaaataaaagaagaaaaggagattgaaccagcattaaagaaacagcttatcatctccactgttcttatgaccatcggtattgcaataattacttggattgcccttccatcgtctttcactatcttcaactttggagagcagaagattgtgaagaactggcaattattcttctgtgtggccattggtctatgggctggtctaattattgggtttgtgactgaatactataccagcaatgcatatagtcccgtgcaagatgttgccgattcctgcagaacaggagctgcaaccaatgtcatctttggacttgctttgggttacaaatctgtcattattccgatttttgcaattgcagttagtatttatgttagtttcagccttgctgctatgtatggtgttgctgtagctgcccttggtatgttgagtactattgctactggtcttgcaatcgatgcatatggtcccatcagtgacaatgctggtggtattgctgaaatggcatgcatgagccacaggattcgtgagagaactgatgctttggatgctgcaggaaataccactgctgccattggaaaaggatttgctattggttcagcagctttagtttcccttgcattgtttggtgcatttgtgagtcgagctgctattacaacagtcgatgtgcttaccccagaagttataattggattgttgatcggtgctatgcttccttattggttctccgcaatgaccatgaagagtgtgggtagtgcagcactcaagatggttgaagaggtccgtaggcagtttaacacaattcctggacttatggagggcacaagcaagcctgattatgctacatgtgttaaaatctccacagatgcgtcaatcaaggaaatgattcctcccggtgcgctggtcatgttgacaccacttattgttggtatcttcttcggcgtagatactttggctggtgtgcttgctggtgccctcgtctctggtgtacagattgccatttctgcttcaaactccggtggtgcttgggataatgccaagaaatatatcgaggctggtacgtcaaggcatgcgaaggagcttggaccaaagggttctgaaccacacaaagctgcagttatcggtgataccattggagacccactgaaggatacctctggaccatctctgaacatcctcatcaagctgatggcagtcgaatctctggtgtttgcacctttcttcgctgcacatggaggtcttctcttcaagttgttttaaataaaagtacttatacctttccactcttttttgcatcttttgtactcttcaagcaatatccctttttcatttcctttcattgagttcatccttttatagaaacttgaccaatgggtcgctaccgtttctcttcaatcatatccattcaaatccatccatcattgagttcgggttcagggagaatgttgggttcaaataaaagtatatttttcgaaatcaatgtttttttagggttgggtaactcttttgatttatgggttggattttattcttccatcaccatggaaactggaaaaagtctttaaaaacagagaaggttccacctagctttagaagaattatgatgctatgttttcttgaaa

SEQ ID NO: 1701 - DNA, 2694 bp, Podocarpus macrophillus
gttctcattgagattgggctcatataaatcagggagagctccacagcaagagtagctcatagcattgctatttttaggcctcccatcgagctgggttcgtgttctctcagccatatcagagagttatatagcttgtagaaaaatggggactcctatgctgagcgagatgctgacagagattctgatacctgtatccgcagttattggtatagggttcgcgcttctgcaatgggttttggtttctcgcgtcaaggttacgccgagttctgcgactagcaataatggatataatgagctgctgctcgaggagacggatgaggaggagggtgacggacgcattgctgttacgaaatgcgctgagattcagcacgccatttctgttggggctacgtcttttctctttacagagtacaaatatttgggaatatttatggtgggttttggaggtcttatatttttgttccttggctctgtggagggttttagcaccaaatctcaaccatgtacttatcagaaggaaaagatgtgcaaacctgctcttgcaaatgccttattcagcactgtagccttcctactcggtgcattaacttcagtcttatctggttttcttggtatgaagattgcaacctatgcaaatgcaagaaccaccttggaggccaggaagggtgttggtaaggctttcattactgctttcaggtctggagcagtgatgggtttcttgcttgctgccaatggccttctggtgctttacatctccatcaatgttttcaagatctactacggagatgattgggagggtctctttgaagctattactggttatggtcttggtggatcttcaatggctttgtttggaagagttggtggtggcatttatacaaaagctgctgatgttggagctgaccttgttggcaaaattgagcagaacattcctgaagatgaccctaggaacccagctgttatagctgataatgttggtgacaatgttggagatattgctggtatggggtcagatttgttcgggtcatatgctgaagcctcttgtgctgctcttgtggtggcatccatttcatcttttggcaacagtcatgatttcacttccatgtgctatcccttgcttatcagctcaatgggcattgtagtttgtttaatcacaactttgttcgccactgacatatttgaaatcaaagcagttaaggaaattgaaccttccctgaagaagcagctgatcatctccactgttttgatgacaattggtattgctgttgtaagtttcatcggattgccatcaacctttaccatctacaactttggttctgccaaagtagttaagaactggcagttgtttttctgtgtagctgttggattgtgggctggacttgtgatcggctatgttactgagtactatactagcaatgcgtacagtcccgttcaagaagtggcccaatcttgcaaaaccggagctgcaacaaacgtcatatttggccttgctttaggatataagtctgtcattatccccatttttgctattgcaatagccatatttgtcagctttagcttggctgctatgtatggaattgcagtagctgctttaggaatgctaagcaccatagcaactggattggctattgatgcttatggtccaattagtgataatgctggtggtattgctgagatggctggcatgagtcataaaattagggagagaactgatgcccttgatgcagcgggaaacactaccgcggcaattggaaaggggtttgccattggttctgctgcgctggtatctcttgccctgtttggagcatttgtaagccgagctgcaatcacaaaagtcgatgtccttactccaaaagtattcatcggtttaattgttggggcaatgttgccttactggttttctgctatgacaatgaaaagtgtgggtagtgctgcattgaaaatggttgaagaagttcgtaggcagttcagaaacatcccaggtctgatggaaggaactgcaaaaccagattatgcaacttgtgttaagatatcaacagacgcatcacttaaagagatgattcctcctggtgcccttgttatgctcacacctctcattgttggcatcttgtttggagtagaaacattgtcaggggttttggctggcgctcttgtctctggcgttcaggttgccatatcagcttctaacactggtggtgcatgggacaatgctaagaaatacattgaggctggggcatcaaaggttgcaagggatcttggtccgaagggatctgatgcccataaggctgctgtaatcggtgacaccattggagatcctttgaaagacacatctggaccatccctcaacattctgatcaagcttatggctgttgaatcacttgtgtttgcaccctttttcgccgcccatggaggcatcctgttcaaactgtgaaaggcctctgatttaatccctttcgaaatgtgaaaggctgatttggcccctaatatattaacggcagatacatatttacggagaaaagctttttcaatatttgaatgttttccctgtggtctgtgggttatgcctggccataaggcagttatattttcaaattgtttgaatcatagtataatgccagcctctggtagaactggatagcgtaaggatgtcatttcagttttgtatcacaatatttctataagatgagtaataac

SEQ ID NO: 1702 - DNA, 2799 bp, Pennisetum glaucum
attcctgcggacccgctcgtccgatctagagcgagacgcgtcgcctcctcccccacccccgccgccgcctcgcgcccgtgcgctccagcgcgtagggttagggttttgtccccgccgccgccgccgccgccatggcgatcctctcggcgctcgccaccgaggtgctcatccccattgccggcatcatcggcatcgccttcgccgtcgtgcagtgggtgctcgtgtcgaaggtgaagctctccccggccgcggcctcctcgggcggcagcaagaacggctacgcagactacctcatcgaggaggaggaggggctcaacgaccacaacgtcgtcgtcaagtgcgccgagatccagaacgccatctccgaaggagcaacatcgtttctcttcacggagtatcaatatgttggtattttcatgtcgatcttcgctgttgtcatcttcctcttccttggctcggttgagggattcagcaccaagagccagccctgcacctatagcaagggaaagtactgcaagcccgcactgttcactgcactcttcagcactgcatccttcttgcttggagctatcacctctttggtctctggtttccttggaatgaagatagccacatatgccaatgccagaaccaccctggaagccaggaaggggtggttggggaagggcattcattgttgctttccgctctggtgccgtcatgggctttttgcttgcatcaagcggtcttgtggttctctacatcaccattaacgtatttaagttgtactatggtgatgacagtctatcactgggtatggccttggtgggtcttccatggctctctttggaagagttggcggaggtatctacacaaaggctgctgatgtgggtgctgatcttgttggcaaagttgaaaggaacatccctgaggatgatcctaggaacccagctgtgatcgctgataatgtcggtgacaatgttggtgatattgctggaatggggtctgatctctttggatcatacgcagaatcttcctgtgctgcccttgttgttgcatctatttcatctttcggaatcgaccatgatttcactgggatgtgctacccactgcttgtgagctctgttggcatcatcgtctgcttgatcaccacactctttgccactgacttctttgagatcaaggctgtgaaagaaatcgaacctgcacttaagaagcagctcattatctctactgctctgatgactgttggtattgcgataatcagctggttggcccttccagccaagttcaccatcttcaacttcggtgctcagaaggaagtatccaactggggcttgttcttctgtgtttcaattggtctgtgggctggtcttattattggtttcgttacagaatactacaccagcaatgcatacagtcctgtgcaagatgttgcggattcctgcagaactggtgctgccaccaatgtgattttcggtcttgctctaggatacaagtcagttatcatcccaatttttgctattgctgtcagcatctatgtcagtttctctattgccgcaatgtacggcatagcagttgccgcccttggtatgctaagcacaattgcaactggccttgctattgatgcttatggtcccattagtgataatgctggtggcattgctgagatggctggaatgagccacagaatccgtgagagaactgatgctctcgatgcagctggcaacaccactgctgctattggaaagggatttgccattggatcagctgctcttgtgtccttggccctttttggtgcttttgtcagtagagctggagtgaaggttgtcgatgtcctgtcccccaaggtcttcattggcttgattgttggagccatgcttccgtactggttctctgccatgaccatgaagagtgttggaagtgctgctctgaagatggttgaggaggtccgcaggcagttcaacaccattcctgggctgatggagggaactggcaagcctgactacgctacctgtgtcaagatctctactgatgcttccatcaaggagatgattcccccgggtgctctggtcatgctcactcccctcattgttggaactctctttggtgtggagaccctctctggtgttcttgctggtgccctggttgcagattgccatctctgcttccaacactgggccaagaagtacattgaggctggtgccagcgaccacgctaagtccctgggccctaagggatcggactgccacaaggctgctgtgatcggcgacaccatcggtgaccccctgaaggacacctctggcccatccctcaacatcctcatcaagctcatggccgtggagtcccttgtgttcgcccccttcttcgccacccacggtggcctcatctccacaccaagcgcagcagaagtatacaccgatccatggacatcttgaataactcctgccagattgccagtctgtgtgtcgtgcgcagtgtttgcgccgctgtttttttggtctcattgtttcgggattgctgcaactgttcatctttctctttggggggcctcctggaggcattaccgttagccttactcttactgcttgtagctccacgtagaagagaagagatgtgtcctgtgtctggcaaattttcccagtccccttgacgatggcgatgatgttgaaatctttgaacaatgatacgtgattgttgcattgtactggtggcaaatcaaatcgctgttaatggctgccttctgtccattccaatgctgtgttatgtactatcgcccgcattgtagtgcaatgcaaggtaagcgctccttgccgtttg

SEQ ID NO: 1703 - DNA, 2672 bp, Populus trichocarpa
agttttatagggcagtgctcaaaactaagttcttgttctgtctgcatctgtgctggtataattctcactgttgaagagtcggaagtgaatgctagtgagccatctggaaatggggatgttgagtgaaggtcttacgcaggttttgatacctgttgctgctttgattgggattatttttgctttgcttcagtggtatttggtgtcaaaggtgaaggtttctggcgattctagtaacggtttaagtgataagttgattgaagatgaagaagatggtgttgataatcgtgaggcttctatcaagtgtgctgaaatccagaatgctatttctgtcggggcaacgtcattcctgtttactcagtacaagtacctcagtgtcttcatgtgtgtttttgctgccattattttcctcttccttggttcagttaagggattcagcaccaaaagcgaaccttgcacatacaacaaagggagtctttgtaaaccagctcttgccaatgctgcctttagcacagttgctttcttgcttggtgctcttacttctgtcctctcaggattcctaggcatgaagattgcaacctatgccaatgccaggacaactctagaagcaaggaagggtgtaggaaaggcctttgtcacagcttttcgttcgggggcggtgatgggtttccttcttgctgcgaatggtcttttggtgctctatatctccatcctcttattcaaactctactatggagatgactgggaaggactttatgagtccattactggttatggccttggaggttcatcaatggcactgtttggaagagttggaggaggaatatatacaaaagcagctgatgttggtgctgaccttgttggaaaagttgaactaaacatccctgaagatgatccaagaaatccagctgttattgccgataatgtgggtgacaatgtaggagacattgcagggatggggtctgacctgtttggatcttatgctgaatcatcctgtgcagcactttttgttgcatctatatcatcctttggtattaaccatgaccacacagccatgtcttttccactgattataagctcagttgggattgtagtttgcctgataactacactttttgcaaccgatctcttcaagatcaaggatgtaagtgaaatcgagccatcactgaagaggcaactcgttgtctcgacaattctcatgactgttgggattgccatggtcagcttctttgctttgccatcagaattcactatcttcaatttcggaactgagaaggttgtcaagaactggcaccttttcttttgtgttgccattggcttgtgggctggacttgtgattggatatacaacagagtattacactagcaatgcttacagtccagtgcaggatgtagcagattcttgcaggacaggtgctgcgacgaatgtcatttttgggttggctttgggctacaaatctgtcatcattccaatattttccattgccattgctatttttgtcagctttagcctggctgccatgtatggaattgctgtggctgcgttggggatgctcagtactattgctaccggtcttgctatcgatgcttatgggcccataagtgataatgctggtggcattgcagaaatggctggtatgagtcataagatacgtgaaagaacagatgctctagatgctgctggcaacaccactgctgcaattggcaagggttttgccattggatcagctgctctcgtttcccttgctttgtttggtgcctttgtcagcagggctgggatcaatactgtcgatgtcttgacccctaaggtcttcattgggctgattgttggggcaatgctcccatactggttctccgccatgacaatgaagagtgtaggaagtgcagcactcaaaatggtcgaagaggttcgtcgacaattcaaaactattccaggacttatggaaggtagagccaaaccagactacgcaaactgtgtcaaaatttcaactgatgcctccctcagggagatgatcccacctggtgccttagtcatgcttacaccacttatcaccggaaccttattcggagtcgaaactcttgctggtgttcttgctggttcacttgtttctggtgttcaggttgccatttcagcttcgaatactggaggggcatgggataatgccaagaaatacatagaggctggtgtatcagagcatgcgaaatcgttaggtccaaagggttcagatgcacacaaagctgctgtcattggtgacacaattggagatcccctcaaggacacttcaggtccatcacttaacatcctgataaagcttatggcagttgagtcactggtgtttgctccattcttcgcggctcatggaggtttgctgttcaaatatctctaaaatgagttctcattgtaatggtttccgaaatgtgaaggagtcggaaacagacatgttgagttttttcttcactatgatcaagcaagtttcttgtgaacgttaacttcttgctttatgttggtgatccttgctaagctactccataaatatagtgttttcgccctctgaaaagtgtggctgttagttaattttcactctcacagctcgtttgtgcatcgcattaaaagctttaattttatgcttttagtgcggtgcattgttctaataaacatgattttagttttttttt

SEQ ID NO: 1704 - DNA, 2723 bp, Vitis vinifera
caaaccaactggttttgacaaaatccaatggatgatggaatctgctataatacacacccaaccaacaatcaaaccaaccagttcacacatccctagaacctcatgcaaagccacaactttcagataatgggtctatagtttcagattttgtgctgcaaaccagtggtgctttttgggtgtttgttttgctataagagtttgaagactgggggtcatttctcatttgggttgtgtgtgcgctttagggagatgggtgtgatgggagatgcgtttactcagcttctgatacctgttgctgccttggtgggaattgggtttgctctgttgcagtggcttctggtgtctaaggttaaggtttctgctgattctgacctcaacaatgggtacagtgataggttgattgaagaagaggaggagggtattgaccatgaggatgttgctgctaagtgtgctgagattcagaatgccatctctgttggggcaacctcatttctgtttaccgagtataggtaccttagcatcttcatgggtgtttttggtgccatcattttcctctttctcggttcagttaagggcttcagcaccaaaagtgagccttgcacttataacacaggcagtctatgtaaaccagccttggcaaatgctctgtttagcacaattgccttcttgcttggtgctatgacctctgtcctctcgggttttcttggcatgaagattgcaacctatgccaatgcacgaacaactctggaagcaaggaagggtgtcgggaaggcattcatagtagcttttcgctctggtgctgtgatggggttcctacttgctgccagtggactcttggttctgtatgtgtccatccatttatttagtctgtactatggagatgattgggagggactttatgaatctattactggttatggccttggaggctcttcaatggcactctttggaagagttgggggaggtatatacacaaaagcagccgatgttggtgctgaccttgttggaaaagttgaacgaaatatccctgaagatgatccacgaaacccagctgttattgccgacaatgtgggtgacaatgtaggagacattgctgggatggggtctgacctgttcgggtcttacgctgaagcatcctgtgctgctctctttgttgcatcaatatcgtccttcggcatcagtcatgactacacagccatgtcttttcctttgattataagttcagttgggattgtggtttgcctgggaacaacgctttttgcaactgatttcgttgagattaagaatgttagtgagattgagccgtccttgaagagacaacttctcatctcaactattctgatgactgctgggattgctgtagtcagcttctttgccctaccatcagaattcactctctttaactttggaagcacaaagaccgtaaagaactggcatctcttcttctgtgtatcaattggcttgtgggctggacttgttattggatatattactgagtattacactagcaatgcttacagtccagtgcaggatgtggctgattcttgcaggactggtgctgcaacaaatgtgattttcgggttggctctgggatacaagtctgtcatcattccaatatttgccattgccattgctatctatgtgagtttcagcatggctgccatgtatggaattgcagtggcagctttgggaatgctcagcactatcgctaccgggcttgccattgatgcgtacggccccataagtgacaatgctggtggtattgctgaaatggctggaatgagccacaaaatacgtcaaagaactgatgctctggatgctgctggaaacaccactgctgccattggcaagggtttcgctattggatcagctgctcttgtttctcttgctctgtttggtgcctttgtgagcagagcagggatcgagactgttgacgtcttgactccaaaggtcttcattgggttgatcgtaggagccatgcttccatactggttctcagccatgacaatgaagagcgtgggaagtgccgctctaaaaatggtcgaagaggtccgccgccagttcaatactattccagggctgatggaaggaagagcaaagccagactatgctacctgtgtcaagatctctactgatgcttctctcagggagatgatcccacctggtgccctggtcatgcttactccactcattgccggaactctctttggagttgaaactcttgctggagttcttgctggttcactggtttctggtgtccaggttgccatatcagcttccaacacaggtggggcatgggataatgcaaagaaatatatagaggccggtgcttctgagcatgctcggagtttaggccccaaggggtcagacccccacaaggcagctgtgataggtgacacaatcggcgatcccctcaaggacacctctggcccttcactcaacatcctgatcaagctcatggcggtcgagtccttggtcttcgctccgttcttcgcagctcatggcggcctgctgttcaaattgctctgaacctgagccgttctttggtggagttgatcagtgatgaagcagcaatgtgaaatgaactgcagtaatgttaactgaacttttcctgtaatttgtagttctaagatgtaaaaaaatggacaaacaaggtgggggggacacggcttaacgagcgatgatccgcgattttacttcgaataaataagtttatgtgcatg

SEQ ID NO: 1705 - DNA, 2716 bp, Prunus persica
aaggttaagaagaatctaccccaagcctcacctgcctttcaaaccagccagctttatggactccaatggccatgcaatgcaaacccactaagatattatgatcatttggataatgcaaatctagattaagaggctgaagttcaaaacccagctttgtttgcttctttgccatatatatttgtgcatgctcagaaagctaaaaggaaccatttgtctttggagtttttggaaatgggtttgctaagtgaaggcctaactcagcttctgatccctttggctgctcttgttggacttgcttttgctttgcttcagtggtttttggtctcaagggtgaaggtctctggtagctatggtgaggggaatggctataaggacaagttgattggagaagcagaagagggtgttgacagccttgaggttaccatcaaggttgctgaaattcaaaatgccatttctattggggcgacctcttttctgtttacccaatacagataccttagcatcttcgtgggtgtatttagtgccataatcttcctcttccttggttcagtgaagggttttagtaccaaaagtgaaccttgcacatataacacgggcaatacatgtaaaccagcattagccaatgccttgtttactactattgccttcttgctcggcgctcttacctcagtcctctctggtttttttgggatgaagattgcaacatatgccaatgccagaacaactctagaagcaaggaggggtgtcgggaaggctttcattaccgcttttcgctctggtgctgtgatgggattccttcttgctgccaacggccttttggtgctgtatatcactatcaatctatttaagttgtattatggggatgactgggaaggactgtatgagtcaattactggctatggacttggaggttcttcaatggcactctttggaagagttggcggaggtatatacacaaaagcagctgatgttggtgctgatcttgtcgggaaggttgaacgaaatatccctgaagatgatccgcgaaacccagctgttattgcagacaatgtgggtgacaatgtaggagacattgcaggaatgggatctgacctattcggatcttatgccgaatcatcttgtgcagcattgtttgttgcatccatctcatcctttggtatcagtcatgactacacagccatgtcatatccattgatcataagctcaatggggattgtggtttgtctgataacaaccctttttgcaactgatctgtttgaaatcaagaaagtgaatgagatcgaaccgtccttgaagcgacaacttcttatctcaacagttttaatgactgctgggattgccgcggtcacttttgtagctttaccatcagaattcactctcttcagctttggaaccaataaggctgtcaagaactggtacctcttcttttgtgtagcaattggcttgtgggctggtcttgttattggatatactacagaatactacactagcaatgcttacagtccagtgcaggatgtggcagattcttgtaggactggtgctgcaacaaacgtgattttcgggctggctctgggttacaaatcagtcatcattcctgtatttgccattgcctttgctatatacgttagctttagcttggccgccatgtatggaattgctgtggctgcgttgggaatgctcagtactatctccacaggtcttgcaattgatgcttatggcccaataagtgacaatgctggtgggattgcagaaatggccggtatgagccatgagatacgcgaaagaacagatgctttagatgctgccggaaacacaactgcagctattggcaagggttttgctattggatcagccgctcttgtttctcttgctttgtttggtgcctatgttagcagagcaggcatagagactgttgatgtgctgaccccaaaagtcttcattggcttgcttgtgggagctatgcttccatactggttttcagccatgacaatgaagagcgtgggaagtgcagcactcaaaatggtcgaagaggttcgcagacaattcaatacaattccaggcctcatggaaggaacagcgaagccagattacgcaacatgtgtcaagatttccactgatgcttccctcaaggagatgatcccgcctggcgctttggtcatgcttacgccactcattgccgggaccttctttggagtagaaactcttgctgggatccttgctggttcacttgtttctggcgtgcagattgccatttcagcttcgaacaccggtggtgcatgggataatgcaaagaaatacatagaggctggtgcttctgaacatgctaaatcactaggtcctaagggttctgatcctcacaaggcggccgtgataggcgacacaatcggagaccccctcaaggacacttctggtccttcactcaacattcttatcaagctcatggcagttgagtccttggtgtttgctccattctttgcagctcatggaggcgtgctcttcaaatggctttgaaatctggagctgtaaaaaacaccatcagtttaacctccggtatataaattcactggtttgagcagtaaaatgtcaaatggagcttcaccctaatcagtactttcatgatgtaaagtagaagctacatatatatgtctttgctctaattcccaattttactttgaactaaataatatatgtatccctactgaattttgccatttct

SEQ ID NO: 1706 - DNA, 2691 bp, Populus trichocarpa
tccaaaactagttcttgttctgtttgcatttgtgctggtataattctacacactgctgaagaaactgaggtgagaggtagtgagccatttacaaatgggaatgttgagtgaaggcctcacacaggtattgatacctgctgctgccctggttgggatcgcttttgctttgcttcagtggtatttagtgtcaaaggtgaaggtttctggtgattctagtaatggttatagtggtaagttaattgaagaggaagaagatggtattgatagtcttgaggtttctatcaagtgtgctgaaatccagaatgccatttctgttggggcaacctcgttcctgtttactcagtacaagtacctcagtgtcttcatggtagtttttgctgccatcatattcttcttccttggttcagttaagggattcagcaccaaaagtgaaccttgcacgtacagccaagggaaactttgtaaaccagctcttgccaacgctgcctttagcacacttgctttcttgcttggtgctcttacttctgtcctctcaggcttcttaggcatgaagatcgcaacctatgccaacgccaggacaactctagaagcaaggaagggtgtaggaaaggcctttattacagcttttcgctcaggggcagtgatgggttttcttcttgctgcaaatggccttttggtgctctatatctccatcatcttattcaaaatctactatggagatgactgggaaggactttatgagtccattactggttatggccttggaggttcatcaatggcactctttggaagagttggaggaggtatatatacaaaagcagctgatgttggggctgaccttgtcggaaaagttgaacggaatatccctgaagacgatccaagaaatccagctgttattgctgataatgtgggtgacaatgtaggagacattgctgggatggggtctgacctatttggatcttatgctgaagcctcctgtgcagcactttttgttgcttcaatatcatcctttggtattagccatgactacacagccatgtcctacccgctgattataagctcagttggaattgtggtttgcctgataactacactttttgcaactgatctttctgagatcagggatgtaagtcaaattgagccatcattgaaaaggcaactcgttgtctcaacgattctgatgactgttgggattgccatggtcagctttttcgctttgccatcagaattcactctcttcaatttcggaaccgagaaggctgtcaagaactggcaccttttcttctgtgtcaccattggcttgtgggctggacttgtgattggatatacaacagagtattacactagcaatgcctacagtcccgtgcaggatgtagcagattcttgcaggacaggtgctgcgacgaatgtgattttcgggttggctttgggatacaaatctgtcatcgttccaatatttgccattgccattgctatctatgttagctttagcctggccgccatgtatggaattgctgtggctgctttgggaatgctcagtactattgccactggtcttgcaattgatgcttatgggcccataagtgataatgctggtggtattgcagaaatggctggcatgagtcataagattcgtgaaagaacggatgctctagatgctgctggcaacaccactgctgcaatcggcaagggttttgctattggatcagctgctcttgtttcccttgctttgtttggtgcctttgtcagcagggctggcatcaatactgtcgacgttttaacccccaaggtcttcattgggttgatcgttggggctatgcttccatactggttctctgccatgacaatgaagagtgtgggaagtgcagcactcaaaatggtcgaagaggttcgtcgacagttcaatactattccagggcttatggaaggtagagtcaaaccagactacgcaaactgtgtcaagatttcaactgatgcctctctcagggagatgatcccacctggtgctttggttatgcttacaccacttatcaccggaaccttattcggagttgaaactcttgctggtgttcttgctggttcacttgtttctggtgttcaggttgccatttcggcctctaacaccggaggggcatgggataatgccaagaaatacatagaggctggtgcatcggagcatgcaaaatcgttgggtccaaagggttcagatgcacacaaagctgctgtcattggcgacacaattggagatcccctcaaggacacttcaggcccatcacttaacatcctgataaagctgatggcagttgagtcactagtttttgctccattcttcgccgctcatggaggtttgctcttcaaatttctctaatcgagaccatcaagctgtcaggattattcaggtacatacgttgatcgctggtgaagcagcatcatcacctaattgagctctccttgtctggtgatggagcaaaaatacatatatggctttgataccgcaattgagagaacttcacaataattgaacaagtttctagtgtacattaatttcttgtttcatgtgtagaattctggtgatattgtcttcaccctatcaacaatgtgcacatgaagagtcaagcatgactacttcttcttaaataattttatgtctacttgaaataataaaaaaataatttttattttaactctcgc

SEQ ID NO: 1707 - DNA, 3220 bp, Eucalyptus grandis
cagaactaccggttttccatttcatgagattctagtggccctgacaggcttctgagatatttctggataagcctagtcctcaggatctgtagattttgcttcagaagcctggagggtgggtacaaaaagggtcctttttagcacattctctttagctgaatgtgttactagacgcaggctaaaaacacagcactgaaactttgttgggttcctcagaatggctgtgttgagtgaagctctgacgcagatcctgatacctgccagtgccttgattggcattggctttgctctgcttcagtggctgttggtctcgaaggtcaaggtctcggctgattatggcaagaaagatgggtacaaggacaagctgatcgaggatgaagaggagggtgctgagaatgccgatgccgtcatcaagtgcgccgagattcagaacgccatttctgtcggggcgacttctttcctatttactcagtacaagtacctcggcatcttcatggtcgccttcgccgtcgtcattttcctcttccttggttcagtcaaggggttcagcacccagagtgaaccctgcacttacaatccaggaaacctctgcaaaccggctctggccaatgcgatgttcagcaccatcgcctttttgcttggcgcgctcacctccgtgctctcaggttttcttggcatgaagattgcaacttatgcaaatgcaagaaccacgttagaagcaaggaaaggtgttggaaaggcattcataacagctttccgctcaggcgctgtgatgggatttcttcttgctgcaaatggtcttttggttctttatgttaccatcaatctgtttaagctgtactatggggacgactgggaggggctttatgaatctattacgggctatggtcttgggggttcttcaatggcactttttggaagagttggtggtggcatatacacgaaagcagccgatgttggcgccgaccttgttgggaaagttgaaaagaacatccctgaagatgacccaagaaacccagctgtcattgctgataatgtgggtgacaacgtgggggacattgccgggatgggttccgatctattcggttcttatgcagagtcatcttgcgctgcacttttcgtcgcctcaatttcatcctttgggataacccatgactactcagccatgtcttatcctttgaccattagcgcaatgggcattgtaatttgcttgatcactacactttttgccaccgaccttgctgagattagacacgtgagcgagatcgagccgtcgctaaagcgccaacttttgatctcgaccattttgatgactgctggcattgccgtggtcagcttccttgctttaccatctgagtttactctcttcaactttggtaccgagaaggctgtaaagaactggcacctcttcttctgtgtgtcgatcggcctgtgggctgggctagccattggatatataaccgagtattacacaagcaatgcttacagtccggtgcaggatgtagctgattcttgcaggactggtgctgcgacaaacgtgatatttggcttagctctcggatacaaatctgtcatcattcccatatttgcgatagccattgccatttacatcagcttcagcttggcggcaatgtatggagttgctgtcgctgcattgggaatgctcagcactattgccaccggtctcgcaattgacgcctatggacctattagtgacaatgccggcggtatcgcggaaatggctggaatgagccacaagatacgcgagcgaacagatgctctagatgctgcaggaaacaccacagctgcaattggcaagggctttgcgatcggatcagctgctcttgtctctcttgccttgttcggcgcctttgtaagcagagcaggcatcaagaccgtggatgtgctcacaccaaaggtcttcatagggctcatcgtgggtgccatgcttccgtactggttctctgccatgacaatgaagagtgttggaagtgctgcattgaaaatggtcgaagaggtcaggcgccaattcaatacgatcccagggctcatggaaggaagagcgaaaccggactatgccaactgtgtcaagatctctaccgacgcttcgctgagagaaatgatccctcccggcgctttggtcatgctcacccctcttatcgccggaaccttattcggcgtggagactctggcaggagttctcgccggttcacttgtctcaggcgtgcaggttgccatttcagcttccaatactggcggagcatgggacaatgctaagaaatacatagaggctggggcatctgagcatgcgaaatcactcggtcctaagggatccgactcgcacaaggctgctgtcatcggcgacacgatcggcgacccgctcaaggacacctcgggtccatcgctcaacatactgatcaagctcatggcggtcgagtcgctggtgttcgctccgttcttcgccgcccacggcggcttgttgttcaagctgctgtgagttggtagcatcgccttgactgtttcagcaggttcatatatatttttggatggagtatataatgagctaagccactaccctgtaactagaagatctgatctgtaattgatgcacctgatttatcatgaataagcaagtccatcatcctcaaagctagtctatcagcatacatatcttgtcttaggtgatggaagttcatatgttgtttgtcttgaaagtctttatgtccttgttctacttagttttgtcaactaattaggtcacttcagtcctcaattcggtaagagaaaaaggggatcgaatccggcccaaatgatcataacttttatttggcattcgtaattttcctcattaatgataatttacatgttgcgtaccaatttataactttttttggaggacgcaattttccttttgttgttgtatgtctacgggtcctataattcataatattctgaaaaaaaattaaaaaaaaaaatccctggatggcattgcttcttcttgagaaaagatgtttatcttctaactccatgcggcattgcttctagcaacatgtgtaatttatagtaaattttctttcttattgttagtaaattacctaaggaatcataactttcccgtcccatgtaagtgtccgcgctaatagttgtttatctataaaaatatcttttagcaaagggcttaacatggtaatccttagtcaaattaaaaattttactcgtg

SEQ ID NO: 1708 - DNA, 3292 bp, Theobroma cacao
tattcactgtgatgaaccagaaactagtgttgagctttgatgtagctgtagcaaacatatcttcaggaagcgcttgatatgactgctacagccaacatatatagaagttgcaggttctgtaaaatttcttatcttaaatacatgaaggatgaagatggttgatcaactcaataaagaaacagagggaaagagaaaagaaaggtagggaagaaaaggggaaaaattaactaagtagcgtgcagatttgtaaaaaggacatggtcaatatggtaaagaaacttcttgtgtgatatgttgtttgttgttctcaaatatttcttccttgttattgttattattgtttgacagtgatctcagaataacctgattggacatacagcatggtataccttggttgcttttaagaatctgaaatttttaatactagtttgtttaccatgtccttgtcagaacagtaagatctcaattgaagtaacaaattgaactgtgtcaaaccgtggacttccccatggtgtgttgatattcaagggacttttcctgaagatgcaaaacaggtaaagattgtagctagtcatcatttgcaaatgataaacggaagtgaagccaagaaaagcaaagtactgaagttgttgagagagtttgtggaaatgagtgccatgggtgagggtcttacccagatactgatacctgtagctgccttggtgggcattggttttgctttgtttcaatggtttttggtctccagggtgaaggtctcatcaaatgattccagcaatgaatacaaagaaaagctgattgaagctgatgaagaagaagagggtatcgacaatcttgaggtttccatcaagtgtgctgagattcagcatgccatttctgttggtgcaacctctttcctctttaccgagtacaagtacctcggtatcttcatgggtgtatttggtgccatcatcttcctcttccttggttcagttaggggcttcagcaccaaaagtgaaccctgcacatacaaccagggcaacacctgcaaaccagccctggcaaatgccttatttagcacgattgctttcttactgggggcgctaacctctgtcctctcaggttttctggggatgaaaattgcaacttatgccaacgctagaacaactctagaagcaaggaaaggtgttgggaaggcatttataacagcttttcgctcaggcgcagtcatgggtttccttcttgctgccaatggcctttttgtgctctatgtatccatcaatttgtttaagctttactatggtgatgactgggagggactttatgaatctattactggttatggtctcggtggttcttctatggccctctttgggagagttgggggaggaatatacactaaagcagctgatgttggtgctgatcttgtcggtaaagtggaacgaaatatccctgaagatgatccacgaaatccagctgtcattgctgataatgtgggtgacaatgtaggagatattgctggcatgggttctgatctattcgggtcttatgccgaatcatcatgtgcagcactttttgttgcatctatatcatcctttggtatcggtcatgactttacagcaatgtcttatcccttgatcataagctcaatgggaattgtggtttgcttgataactacactctttgcaactgatctgttcgagattaagaatgtcagtgaaattgagccgtccttgaaacggcaactccttatctccactgttctgatgactgctgggatcgctgtggtgagcttctttgcattgccatcagaattcactctttataattttggaaccgaaaaggaagtgaagaattggcaccttttcttctgtgttgctattggcttgtgggctggacttgtcattgggtatactacagaatattacacaagcaatgcttatagtccggtgcaggatgtggctgattcttgcagaacaggtgctgcaacaaatgtgatttttgggttggctctgggatacaaatctgtcatcattcccatatttgccattgcgattgctatctatgtgagctttagcctggctgcgatgtatggaattgctgtggccgctttgggaatgctcagtactatagccactggtctcgcaatcgatgcttatggtcccataagtgacaatgctggtggtattgcagaaatggctggaatgagtcacaagatacgtgaaagaacagatgctctagatgcagcaggaaacaccactgctgctattggcaagggttttgcaattgggtcagcagcactcgtttctcttgctttattcggcgcctatgttagcagagcaggcatcaagtcagtagatgtactgacaccaaaggttttcattgggctgatagtcggagccatgctcccctactggttttcagccatgacgatgaagagcgtgggaagtgcagctctcaaaatggttgaagaggttcgtcggcaattcaacacaataccaggactaatggaaggcaggacgaaaccagactatgcaaactgtgtaaagatttcaaccgatgcctcactcaaggaaatgatcccacccggtgctcttgtcatgcttactccactcattgctggaaccttctttggagtcgaaactcttgctggtgttcttgctggctcacttgtttctggtgtccaggttgccatctcagcttccaacacaggaggagcatgggataatgccaagaaatacatcgaggccggtgctagcgagcacgccaagtcgttgggtccaaagggttcggattgccacaaggctgcagtgattggtgacacaatcggagaccccctcaaggacacttccggaccatcactcaacatcctgatcaagctcatggctgtcgagtcattggtgtttgctcctttcttcgctgctcatggaggcttgctcttcaaattgctctgagtttttaagtcccggtacatatatgttcagcagagaaatggaacttttctgtaacatagtagttccaatatgtaaaggaaaaatctagcttgggtttggtgctgtcagttacccaattttaatgtcaatacaataagtttaattcatatcatgtttttctattacaaaatcatgcagtctttggttttgtttgattcacacaacacccaaaatatttgtttaatagctaatgcataaatctaattttatataattagataggcggtataagtcttattgatcgtacaactcattccaatgtggatggatgtatatagaagataatgttctaatctaacagccaataagcaattaattacaat

SEQ ID NO: 1709 - DNA, 2333 bp, Actinidia deliciosa
  misc_feature (1499)..(1499): n is a, c, g, or t
  misc_feature (1955)..(1955): n is a, c, g, or t
  misc_feature (2021)..(2021): n is a, c, g, or t
aatgaccacaacgtcgtcgccaagtgcgccgagatacagaacgccatctcagaaggtgcgacatcttttctatttaccatgtatcaatatgtggggttttcatggttgcttttgcaattttaatattcctattcttgggatctgttgagagctttagcacaaagagccagccctgcacctataacccgctgaagatgtgcaagccagcacttgccactgctatattcagcaccatctcattcttgcttggtgctgtcacctcggttgtctctggtttccttgggatgaaaattgcaacctatgcaaatgcaaggacaactttagaagcaagaaaaggtgttgggaaagcttttatcactgcatttaggtcgggtgcagtaatgggttttcttcttgctgctaacggtctcttggtcctgtatattaccatcaatctcttcaagctttattatggagatgactgggaaggtctttttgaggctattactggttatggccttggtggatcgtccatggctctttttgggagagtcggtggaggtatctataccaaggctgctgatgtcggtgctgatcttgtggggaaggttgaaaggaacattccagaagacgacccaaggaacccagctgtgattgcggacaatgttggtgataacgtgggagatattgctggcatggggtctgatcttttcggttcatatgctgaatcatcttgtgctgcacttgttgtgtcctctatctcctcctttggtataaaccatgaattcactgcaatgtgttatcccctactaattagttctgtggggatcattgtttgtttgatcaccaccctctttgcaactgatttctttgaaatcaaggctgttaaggagattgaaccagcattgaaaaagcagcttattatctccactattctaatgactgggggaattgcaatagttagctggattgcactgccatcatccttcacaattttcaattttggtgctcagaaagttgtgaagaactggcaacttttcttgtgtgttggtgtcgggctttgggctggacttatcattgggtttgtgacagagtattacactagcaatgcatacagtcctgtgcaagatgttgctgattcctgccgaactggagctgccactaatgttatctttggccttgccttgggatacaaatctgtcatcatccccatttttgccattgcaatcagtatttttgttagttttagctttgctgctatgtatggtattgcagtggctgcccttggcatgcttagcaccattgctacagggttggctattgatgcttatggccccattagtgacaatgctggtggaattgctgagatggctggcatgagccaccgaatccgtgagagaactgatgcccttgatgctgccggaaacaccactgctgccattggaaagggatttgctattggatctgctgcactggtgtcattggcactctttggtgcatttgtcagccgtgcaggaatntcaactgtagatgtactcacgccaaaggtgttcattggtttgcttgttggtgctatgcttccttactggttctctgccatgaccatgaagagtgtgggaagcgcagctctaaagatggttgaggaggttcggaggcagtttaacaccattccaggtatcatggagggcactgccaagcccgactatgccacttgcgtcaagatctctactgatgcttccatcaaggagatgattccacctggtgccctggtcatgcttacaccactcattgttggaaccttatttggtgttgagactctctctggtgttcttgctggctcccttgtttctggcgtacaaatagcaatatcagcgtccaacactggtggcgcatgggacaatgccaagaagtacattgaggctggtgcctcagaacacgcaagaacccttggccccaaggggtctgaaccacacaangcagctgtgattggtgacactatcggcgaccctctcaaggacacatcaggcccgtcactcaacatncttatcaagctaatggcagtcgagtcccttgtgtttgctcccttcttcgccactcacggtggcctactttttaagttcttctgagggagaggacgattgaatgccctctgaaggagaggttttacttctgccttgtatcagtatctccattcaagtcttttgtgcgtctctcacgattcttcctctgcatccttttcttccctaagtttggggatttttatgtttcctagtgcaatagggaccattatttttttgatgagctgatgatgatgataattgcaacggtatgatggttactgtaattgtcattca

SEQ ID NO: 1710 - DNA, 2672 bp, Manihot esculenta
gggttttgtattttttttatagggagaactggaacccatttgtgggttttggctatattggatgcaagatagttgaagaaattaccaagtgaagtgtgggttttttttggtttttttcttgggggaggagaaatgggtgtgttgagtgagggtcttacacaggttttgatacttgtagcttccctggttggtattgcgtttgctttgtttcagtggtttttggtatcaaaggttagagtctctggtgagtctggcaatggttatagtgatagactgattgaggaagaagaagaaggtgtcgataattttgatgtttctctcaagtgtgcagaaatccagaatgctatttctgttggggcaacttcattcctctttactgagtacaggtacctcagtatcttcatgggtgtttttggtgccatcatttttctctttcttggttcggttaagggctttagcacccaaagtgaaccgtgcacatacagcaaagggaatctttgtaaaccagctctagctaatgccacctttagcacaattgctttcttgcttggtgctctcacttccgtcctctcaggttttctaggcatgaagattgcaacctatgccaatgcaagaactactctgcaagcaaggaagggtgttggaaaagcctttatcacagcttttcgatctggggcggtaatgggtttccttctctctgccaatgggcttttggtgctatatgtatccatcaatttgttcaaactctactacggagatgactgggagggactttatgagtcaattactggttatggtcttggaggctcatcaatggcactctttggaagagttggaggcggtatatacacaaaagcagctgatgttggtgctgaccttgttggtaaagttgaaagaaatatccctgaagatgatccgagaaatccagctgttattgcagataatgtgggtgataatgtaggagacattgctggcatgggttctgacctatttggttcttatgctgaatcatcctgtgcagcactttttgttgcatcaatttcacaatttggtattggccatgattacacagccatgtcttatccactgattataagtgcaatgggaataatagtttgcttaataaccactctttttgcaactgatatgtttgaggttaagaatgtaagtgaaattgaaccatcattgaagagacaacttgttatctcaaccattctgatgactgctgggattgccttggtcagcttcttagctttaccatcagaattcactctctttgattttgggactgacaagcttgtaaagaattggcacctgttcttttgtgttgctattggcttgtgggctggacttgttattgggtatacaactgaatactatactagcaatgcttacagtccagtacaagatgtagcagattcttgcaggactggtgctgcaacaaatgtgatatttggattagctctgggatacaaatctgttataattcccatattttccattgcaattgctatctatgttagctttagcatggctgcaatgtatggtattgccatggctgctttgggaatgctcagtacaatttccaccggtcttgcaattgatgcttatggacctataagtgacaatgctggtggcattgctgaaatggccggaatgagtcacaagatacgtgaacgaacagatgcactagatgctgctggaaacaccactgctgcaattggcaagggttttgctattggatcagctgctttggtttctcttgctctattcggtgcctttgtaagcagagcaggcattaaagctgttgatgttttaacccctaaggtcttcattggcctgattgtcggcgccatgctcccatactggttctctgccatgacaatgaaaagtgtgggaagtgcagctctcaaaatggttgaagaagtccgtcgacaattcaatactattccaggacttatggaaggtagagctaaaccagactatgccaactgtgtcaaaatttcaactgatgcctcactcagggagatgatcccacctggtgctttggttatgcttacaccactcgtcgctggaaccttcttcggagtggaaactctcgctggcattcttgccggctcacttgtttccggcgtccaggttgccatttcggcttctaacaccggaggggcatgggacaacgccaagaaatacattgaggctggtgcatctgagcatgctagattactgggacctaaaggttcagatcctcacaaagctgctgttattggcgacacgatcggagaccccttgaaggacacttctggtccttcacttaatatcctgatcaagctaatggcagtggagtcattggtgtttgctcccttctttgctactcatgggggactgctgttcaagttgctatgaatatatccattaagcataatctgttagctaatgcagaagaaagaaatgcttagaagaagcattgtcgtgtaatcaagctcctgttgctgtttatgtttggagtttctacctgtaaatggatgaccaatgagatttgcttccgctacatcgccaagtttgccatgaataaattatgtagtttcatgtgtatgtttcttgtttctccaaaaaccctcttttcaatcatttcatgaatttatatctgaaatcatgggatttttgcagtc

SEQ ID NO: 1711 - DNA, 2415 bp, Ricinus communis
aaatggctatgttgagtgagggtattactcaagtttttatacttgtagcttctttggttggtatcgggtttgctttgcttcaatggtttttggtgtcaaaagtgagggtttcgggagattctggtaatgcttataatgataaattgattggagaagaagaggatggtattgataatcttgaggttactcttaaatgtgctgaaatccagactgcaatttctgttggggcaacctcattcttgttcactgagtacaagtaccttggtattttcatgggtgtttttggtgctatcatctttctcttccttggttcagttaagggctttagcacagaaagtgaaccttgcacatacaacaagggaaatctttgtaaaccagctctggccaatgccctctttagcacacttgctttcttgctcggtgctcttacttccgttctgtcaggttttctaggcatgaaaattgcaacctatgccaatgctaggacaactctacaagcaaggaagggtgtcggacaagccttcattgtagcatttcggtctggggcagtaatgggtttccttctagctgccaatggacttttggtgctctatgtatccatcaacttgttcaaaatctactatggagatgattgggagggactctatgagtcaattactggttatggtcttggagggtcatcaatggcactcttcggaagagttggcggaggtatatacacaaaagcagctgatgttggcgctgaccttgttggaaaagttgaacgaaatatccctgaagatgatccaagaaatccagctgtcattgctgacaatgtgggtgacaatgtaggagacattgctgggatgggttcagacctgtttggatcttatgccgaatcatcttgtgcagcactctttgttgcatctatttcgtcatttggtatcagccatgacgtcacagccatgtgttatccattgataataagttcaatggggataatcgtgtgcttgataactacactttttgcaactgatctatttgagatcaaggatgcaagtgaaattgaaccatctttgaagagacaacttcttatctccaccattttgatgactgctgggattgccatggtcagcttcttagctttaccatcagaattcactctcttcgattttgggactgaaaaggttgtaaagaattggcacattttcttttgtgtagcaattggcttgtgggctggacttgttattggatatacaaccgagtactatacaagcaatgcttacagcccagtgcaggatgtagcagattcttgcaggactggtgctgcgacaaatgttattttcgggttggctctaggatacaaatctgtcatcattcccattttcgcgattgccattgctatttatgttagctttagcatggcggccatgtatggcattgctatggctgctttaggaatgcttagtactatcgccactggtcttgcaattgatgcttacgggcctataagcgataatgctggtggcattgcagaaatggccggtatgagtcacaagattcgcgaaagaacagatgctctagatgctgctggaaataccactgcagcaatcggcaagggctttgctatcggatcagctgctcttgtttccctagctttatttggtgcatttgtcagcagggcaggcatcaaaactgttgatgtcttaactcccaaggtcttcattgggctgattgttggggcaatgcttccatactggttttctgccatgacaatgaagagtgtgggaagtgcagctctcaaaatggttgaagaagtccgtcgtcaattcaatactattccaggactcatggaaggcacagctaaaccagattatgccaattgtgtcaaaatttcaactgacgcttcgctcagggagatgatcccacctggtgctttggttatgcttacaccactaattgctggaaccttcttcggagttgaaactcttgctggtgttcttgctggttcacttgtttctggtgtgcaggttgccatttcagcttctaacacaggaggggcatgggataatgccaagaaatacattgaggctggtgcttctgagcatgctaaatcactaggtcctaaaggttcagaccctcacaaagctgctgtcattggcgacacaatcggcgaccctcttaaggacacttcgggtccatcacttaatatcctgatcaagctcatggcagtcgagtcattggtgtttgctccattctttgctgctcacggaggtctgctgttcaaattgctgtaatttaagcaagcaagttataacccgagcaaagatatgttgttacgacggaagcaatatcatgtaattgagttctcactgttatagtttcaacatgtaaaaagaatataaaaaagaaacagatatatggctttgctgcttc

SEQ ID NO: 1712 - DNA, 2594 bp, Eucalyptus grandis
  misc_feature (364)..(364): n is a, c, g, or t
  misc_feature (852)..(852): n is a, c, g, or t
  misc_feature (919)..(919): n is a, c, g, or t
  misc_feature (959)..(959): n is a, c, g, or t
  misc_feature (970)..(970): n is a, c, g, or t
  misc_feature (1060)..(1060): n is a, c, g, or t
  misc_feature (1111)..(1111): n is a, c, g, or t
  misc_feature (1132)..(1132): n is a, c, g, or t
  misc_feature (1537)..(1537): n is a, c, g, or t
  misc_feature (2503)..(2503): n is a, c, g, or t
  misc_feature (2509)..(2510): n is a, c, g, or t
cggccggggagctgaatgtgttactagacgcaggctaaaaacacagcactgaaactttgttgggttcctcagaatggctgtgttgagtgaggctctgacgcagatcctgataccaaccagtgccttgattggcattggctttgctctgcttcagtggctgttggtctcgaaggtcaaggtctcggttgattatggcaagaaagatgggtacaaggacaagctgatcgaggatgaagaggagggtgctgagaatgccgatgccgtcatcaagtgcgccgagattcagaacgccatttctgtcggggcgacttctttcctatttactcagtacaagtacctcggcatcttcatggtcgccttcgcngtcgtcattttcctcttccttggttcagtcaaggggttcagcacccagagtgaaccctgcacttacaatccaggaaacctctgcaaaccggctctggccaatgcaatgttcagcaccatcgcctttttgcttggcgcgctcacctccgtgctctcaggttttcttggcatgaagattgcaacttatgcaaatgcaagaaccacgttagaagcaaggaaaggtgttggaaaggcattcataacagctttccgctcaggcgctgtgatgggatttcttcttgctgcaaatggtcttttggttctttatgttaccatcaatctgtttaagctgtactatggggacgactgggaggggctttatgaatctattacgggctatggtcttgggggttcttcaatggcactttttggaagagttggtggtggcatatacacgaaagcagccgatgttggcgccgaccttgttgggaaagttgaaaagaacatccntgaagatgacccaagaaacccagctgtcattgctgataatgtgggtgacaacgtgggggacattgcngggatgggttccgatctattcggttcttatgcagagtcancttgcgctgcncttttcgtcgcctcaatttcatcctttgggataacccatgactactcagccatgtcttatcctttgaccattagcgcaatgggcattgtnatttgcttgatcactacactttttgctaccgaccttgctgagattagacangtgagcgagatcgagccgtcnctaaagcgccaacttttgatctcgaccattttgatgactgctggcattgccgtggtcagcttccttgctttaccatctgagtttactctcttcaactttggtaccgagaaggctgtaaagaactggcacctcttcttctgtgtgtcgatcggcctgtgggctgggctagccattggatatataaccgagtattacacaagcaatgcttacagtccggtgcaggatgtagctgattcttgcaggactggtgctgcgacaaacgtgatatttggcttagctctcggatacaaatctgtcatcattcccatatttgcgatagccattgccatttacatcagcttcagcttggctgcaatgtatggagttgctgtcgctgcattgggaatgctcagcactattgccacnggtctcgcaattgacgcctatggacctattagtgacaatgccggcggtatcgcggaaatggctggaatgagccacaagatacgcgagcgaacagatgctctagatgctgcaggaaacaccacagctgcaattggcaagggctttgcgatcggatcagctgctcttgtctctcttgccttgttcggcgcctttgtaagcagagcaggcatcaagaccgtggatgtgctcacaccaaaggtcttcatagggctcatcgtgggtgccatgcttccgtactggttctctgccatgacaatgaagagcgttggaagtgcagcattgaaaatggtcgaagaggtcaggcgccaattcaatacgatcccagggctcatggaaggaagagcgaaaccggactatgccaactgtgtcaagatctctaccgacgcttcgctgagagaaatgatccctcccggcgctttggtcatgctcacccctcttatcgccggaaccttattcggcgtggagactctggcaggagttctcgccggttcacttgtctcaggcgtgcaggttgccatttcagcttccaatactggcggagcatgggacaatgctaagaaatacatagaggctggggcatctgagcatgcgaaatcactcggtcctaagggatccgactcgcacaaggctgctgtcatcggcgacacgatcggcgacccgctcaaggacacctcgggtccatcgctcaacatactgatcaagctcatggcggtcgagtcgctggtgttcgctccgttcttcgccgcccacggcggcttgttgttcaagctgctgtgagttggtagcatcgccttactgtttcagcaggttcatatatatttttggatggagtatataatgagctaagccactacgctgtaactagaagatctgatctgtaattgatgcacctgatttatcatgaataagcaagtccatcatcctcanagctannctatcagcatatatatcttgtcctaggtgatggaagttcatgtgtcgtttgtcttgaaagtctttatgtccttgttctacttag

SEQ ID NO: 1713 - DNA, 2582 bp, Gossypium hirsutum
ttttttccattgagttcaaatttccaaacactagttttcttttactacattttgctaagacaagccgagaaacaaagtgaaatattgctgagagtttgtggagatgagtgccttgagtgagggtcttacccaaattctgatacctttagcttccttggtgggcattggttttgcagtgcttcaatggtttttggtctctagggtgaagctctcatcacaggattcaagcaatggatataaacaaaaactgattgaatctgatgaagaagaagagggtattaacaatcttgagatttccatcaagtgtacggagattcaacatgccatttctgttggagcaacctcttttctctttactgaatacaagtatcttggtatcttcatgtgtgtatttggtgctatcatattcctcttccttggttcagttaagggcttcagcaccaaaagcgaaccatgcacatacagccagggaaacacttgcaaaccagccctggcaaatgccatctttagcacaattgctttcttgctaggggctcttacttcagtcctctcaggttatctagggatgaagattgcaacttatgccaatgccagaacaacattagaagcaaggaaaggtgttggcaaggcatttataacagctttccgctctggagctgtcatgggtttcctgcttgcagccaatggccttttggtgctctatgtttccatcaatttgtttaaactctactatggtgatgactgggaaggactctatgaatctattacgggttatggtctaggtggttcttctatggccctgtttggaagagttgggggaggaatatatacgaaagcagccgatgttggtgctgatcttgtcggtaaagtcgagcggaatatccccgaagatgatccacgaaatccagctgttattgccgataatgtgggtgataatgtaggagacattgctggaatgggatctgatctatttggatcttatgctgaatcatcatgtgctgctctttttgttgcatccatatcatcctttggtatcagccatgagtttacagcaatgtcttatcccttgctcattagctcaatgggaattgtggtatgtttgataactacactttttgcaactgatctgtttgagatcaagaaagtaagtgacatcgaaccatcattaaaacgacaactgcttatctccaccgttctcatgactgctgggattgctgtcgttagcttctttgcattgccatcagaattcactctcttcaattttggaactgaaaaggaagtgaagaattggcacttattcttctgtgttgctatcggattgtgggctggactcattatcggttatactacagaatattatactagcaatgcttacagtccggtgcaggatgtagcagatgcttgcaggacaggagctgcaacaaatgtgattttcgggttggctctgggatacaaatcggtcattatccccatatttgccattgccatcgctatttacgtgagctttagcctggctgcaatgtatggaatcgcggtggccgctttggggatgctcagcactatagccaccggtcttgcaatcgatgcatatggtcccataagtgacaatgctggtggtattgcagaaatggccggaatgagtcacaagattcgcgaaagaaccgatgctttagacgctgcaggaaataccactgcagctattgggaagggtttcgcaatcggatcggcagcccttgtttcacttgctttatttggtgcctatgttagcagagcaggcatcaaaaccgtagatgtattgacaccaaaggctttcattggtctcataattggagccatgctcccttactggttttccgccatgacaatgaaaagtgtcggaagcgcagctctcaaaatggttgaagaggttcgtcggcaattcaatacaattccaggactaatggaaggcagggtaaaaccagactacgcaaactgcgtcaagatatcaaccgatgcctcactccgcgaaatgatcccacccggtgcactcgttatgcttactccacttatagtaggaatccttttcggggtcgaaactctcgctggtgtcctagctggtgcactagtttctggtgtccaggttgccatctcagcttcaaacacaggaggagcatgggataatgccaagaaatacattgaggcgggagttagcgaacatgcaaagtcattgggaccaaaaggttcagaatgtcacaaggcagcagtgataggagacacaataggggatccactgaaagacacttcaggtccatcactcaacatcctcatcaagctcatggctgttgaatctttggtctttgctcctttcttcgccgctcatggaggctttcttttcaaattcatctaaatttcaagctccttttaacaataaatacatacatgcatgcatatatatatatatcaacagtagagttgtaagttagaggatatggggaacttttgtattaagaataagatatgtaaaggaaagtcaggccttgcttctaagttagttcttatatcaacatggtaagtttatgattgaaataaaaatgattttgttt

SEQ ID NO: 1714 - DNA, 3127 bp, Fragaria vesca
cttgctgataagaccaaagtttgtccatggatgagaggaaagtatacatagcccattaatgctgtgataatacctctacctattattcaaaacaaccagtattaccaagtccaagcttagaataaaatctttccccaagtcctacctgcctttcaaacaagcttagctttgtagattcttatggccatgcaatgcaaatcccaaaacatatcatttggataacacgtttgtagtttttaagaggctaatagtctaatccttaggaacccaccattgtttctctgccatatatatgaatgctcaaagagaagcttagacaaacttagagaaatctacctttttgtgttgtttcaaatagttggaaatggctttgctgagtgaggggctaactcaggttgtgatacctgtggctgcctttgttggacttgcttttgctttgcttcagtggtttctggtttcaagggtgaaggtgtcttatggctctagtgatggaaatgactacaaggacaagttgatccctggagaagaagaagagggtattgacaacttttcagttaccctcaagtgtgctgaaattcaaaatgccatttctgagggggcaacctctttcttatataccgaatataggtacctcagtatctttatgggtgtatttggtgttgtcatcttcctcttccttggttctgttaagggcttcagcactcaaagtgaaccctgcacttacaacacagggaatatgtgtaaaccagctctagccaatgccttctttactactgttgccttcttgcttggtgctcttacatcagtcatctccggttttcttgggatgaagattgcaacatatgccaatgctagaacaactcttgaagctaggaagggtgtagggaaggcttttattaccgcttttcggtctggtgctgtgatgggattccttcttgctgccaatggcctgttggttctgtacatcactattaatttgtttaagctgtattatggggatgactgggagggactgtatgagtcgattactggttatgggcttggaggctcttcaatggcattgtttggaagagttggaggaggtatttacacaaaagcagctgatgttggtgctgatcttgttggcaaagttgaaagaaacatccctgaagatgatccaagaaacccagctgtcattgcagacaatgtgggtgacaatgtaggagatattgcagggatgggatctgatctgttcggatcatatgccgaggcaacttgtgcagcattgtttgttgcatctatatcctccttcggtatcactcatgactacacagccatgtcttatcccttgattataagctcaatggggattgtggtttgcttgataacaaccctttttgcaactgatctgtttgaaattaagattgcaagtgaggttgaaccatccttgaagcgacagcttattatctcaacagttctgatgactgctgggattgctgtagtcacttttgtagctttgccatcagagttcactatgtttagttttggaaccaataaaactgtcaagaactggtaccttttcttttgtgtatcaattggcttgtgggctggtcttgttattggatatactactgagtactatactagcaatgcttacagtccagtgcaggatgtggcagattcttgcaggactggtgctgcaacaaatgtgattttcggtttggctttaggttacaaatcagttatcattcctgtatttgccattgcatttgctatatatgtcagctttagcttggctgccatgtatggaattgctgtggctgctttgggaatgctcagtactatcgccactggtcttgcgatcgatgcttatggccccataagtgacaatgctggtggcattgcagaaatggctgggatgagccatgagattcgtgaaagaacagatgctttggatgcggctggaaacaccactgctgctattggcaagggttttgctattggatcagctgctcttgtttctcttgctttgtttggcgcctatgtcagcagagcaggaatagagacagttgatgtgttgacaccgaaagtgttcattggtttgcttgtgggggcaatgcttccatactggttttcagccatgacaatgaaaagtgtaggaagtgcagcactcaaaatggtcgaagaggttcgcagacagttcaatactattccagggctcatggaagggacggcaaagccagactatgccacatgtgtgaagatttctaccgatgcttccctgagggagatgatcccacctggcgctttagtcatgcttacgcctctcattgcaggaaccttcttcggagttgaaactctcgctggcattcttgctggttcacttgtttctggtgttcaggttgccatctcagcttcaaacaccggaggggcatgggataatgcaaagaagtacatagaggctggtaattctgagcatgccaaatcgctcggtcctaagggttcagatcctcacaaggcggctgtgataggtgacacaattggagatcccctcaaggacacttccggcccttcactcaacattctgatcaaactcatggcagttgagtccttggtgtttgcaccattctttgcggctcatggaggcctactcttcaaatggctatgagatcgagttgtaacagaaatcaggttaacttcagtaaatatgtatatatttactgggtgagcagtgtatcaagtatggctactaatttccaattttactacaactaaaatgatgcattggcatcccttctgaatctgcattctagaatttctgtttctcagtcactatttcatttatgtatatggagacctcttctatgtcgaatccatggctttaatatctcatgtttatcaacttgatcatctttcatgcgtagtaagaaagatctaggacactattttcatggttcgacttgagccctctaccttagttatgtcagatactgcttgcaatggcttattacagcaacactaccattctgaaacttgtgtgctcagtgctcacgactgaagcaaggtcaactctagcactagtagtgagaactggatttagctgggtgctctgtgactctttgacaataatataatgaggtttttgagt

SEQ ID NO: 1715 - DNA, 2717 bp, Quercus alba
atgggggatagagataaaatttaggataatgcagtttccaagtttgtaggtttctgctcagagactgtacttcaaaacccagcattggtttttgccatttttgctaagacaactcaagaaatcatttgagctttgatttttgaaaatgggtgtgctgagtgagggacttacacagattctgatacctgtggctgccttcattggacttgggtttgctttgtttcagtggttcttggtctccaaggtcaaggtctcaggtggctatggtgattatagtgggtataaagacaggttgattaatgaaggagagactgaagaaggtgttgacactcttgaggtttccatcaagtgtgctgaaattcagaatgccatatctgttggggcaacctcatttctgtttactgagtatagataccttggtatcttcaccgctgtatttggcattgtcatcttcctcttccttggttcagttaaaggcttcagcaccgaaagtgaaccttgcacttacaacaccgggaatatatgtaaaccagcattggcaaatgccttgtttaccaccattgcattctttcttggtgctcttacatcagtcctttctggttttcttggcatgaagattgccacctatgccaatgctagaaccactctagaagcgaggaagggtgttgggaaggcattcatcacagcttttcgctctggtgctgtgatgggtttccttcttgctgccaatggccttttggtgctgtgggtatccatcaatttatttaagctgtattatggggatgactgggaagggctttatgaatctattactggttatggacttggaggttcttcaatggcactttttggaagagttgggggaggtatttacacaaaagcagctgatgttggtgctgaccttgttggaaaagttgagaggaatatccctgaagatgatccacgtaacccagctgttattgcagacaatgtgggtgacaatgttggagacattgctgggatgggttctgacctctttgggtcttatgctgaatcatcctgtgcagcactttttgttgcctcaatatcttcctttggtaccagtcatgacttcacagccatgtcctatcctctgattgtaagctcaatggggattgtagtttgcttaataacaacactttttgcaactgatctttttgagattaagcgtgtgagtgagattgaaccaaccttgaagaggcaacttgtaatctcaactgtcttgatgactgccggtattgccatggtcaccttctttgctttgccatctgagtttactctctttaattttgggactgagatgtctgtaaagaactggcaccttttcttctgtgttgcaatcggcttgtgggctggacttgctattggatacactacagagtattatactagcagtgcttacagtccagtgaaggatgtggcagattcttgtaggactggtgctgcaacaaatgttatttttggattggctctgggatacaaatctgtcatcattcccatatttgccattgccattgccatttatgtgagctttagcttagctgctatgtatggaatttctgtgtctgctttgggaatgctcagcaccattgccactggtcttgcaattgatgcttatggccccataagtgacaatgctggtggaattgcagaaatggctggtatgagccatgagattcgagaaagaacagatgccttagatgctgctggaaacactactgctgccattggcaagggctttgctattggatcagctgctcttgtttcccttgctttgtttggtgcctttgtgagcagggcaggcatctacactgttgatgtgttgactccaaaggtcttcatcgggttgcttgtgggagccatgcttccatactggttttcagccatgacaatgaagagtgtgggaagtgcagctctcaaaatggttgaagaggttcgtcgacagttcaatactattcccggccttatggaaggaagagcaaaaccagactatgcaacctgtgtcaaaatctctactgatgcttcactaagggaaatgatcccacctggtgctttggtcatgcttacaccacttattgctggaaccttctttggtgtggagactcttgctggggttcttgctggttcacttgtttctggtgtgcaggttgccatctcagcttcaaacacgggtggtgcatgggataatgcaaagaaatacatagaggctggtggtaatgaacatgcaaaatcactaggtcctaaagggtcagatgctcacaaggccgctgtcataggtgacacaattggagatcctctcaaggatacttctggtccttcactcaatattctcatcaagctcatggcagtcgagtccttggtgtttgctccattctttgctgctcatgggggcttactcttcaaactattttaaaatggaggttctatgtagcaggtttaattccggtgtatcttcacttgtggagcagtgaagttgatgaagatttatataattagtagcttcaagttgtaaagaaaaagctatgcggctttacttaatagacaatttaccattaataaccatgaaatacataggtatatctcattatcttgtactgaattttgtttcagtttcagactttcagtcttgtagaagacatccttctcaacacacacacacacattccaagaaaatatggacatccttacaaggaatagtg

SEQ ID NO: 1716 - DNA, 2637 bp, Gossypium hirsutum
ctttgaattcggctttcgagcggccgcccgggcaggtacgcggggacttttttccattgagttcaaatttccaaacactagttttcttttactgcattttgctaagacaagccgagaaacaaagtgaaatattgctgagagtttgtggagatgagtgccttgagtgagggtcttacccaaattgtgatccctttagcttccttggtgggcattggttttgctttgcttcaatggtttttggtctctagggtgaagctattatcacaggattcaagcaatggatataaacaaaaactgattgaatctgatgaagaagaagagggtattaacaatcttgagatttccatcaagtgtactgagattcaacatgccatttctgttggtgcaacctctttcctctttactgaatacaagtatcttggtatcttcatgtgtgtatttggtgctatcatattcctcttccttggttcagttaagggcttcagcaccaaaagcgaaccatgcacatacagccagggaaacacctgcaaaccagccctggcaaatgccttctttagcacaattgctttcttgctaggggctcttacttcagtcctctcaggttatctagggatgaagattgcaacttatgccaatgccagaacaacattagaagcaaggaaaggtgttggcaaggcatttataacagctttccgctctggagctgtcatgggtttcctgcttgcagccaatggccttttggtgctctatgtatccatcaatttgtttaaactctactatggtgatgactgggaaggactctatgaatctattactggttatggtctaggcggttcttctatggccctgtttggaagagttgggggaggaatatatacgaaagcagccgatgttggtgctgatcttgtcggtaaagtcgagcggaatatccccgaagatgatccacgaaatccagctgttattgccgataatgtgggtgataatgtaggagacattgctggaatgggatctgatctatttggatcttatgctgaatcatcatgtgctgctctttttgttgcatccatatcatcctttggtatcagccatgagtttacagcaatgtcttatcccttgctcattagctcaatgggaattgtggtatgtttgataactacactttttgcaactgatctgtttgagatcaagaaagtaagtgacatcgaaccgtcgttaaaacgacaactgcttatctccaccgttctcatgactgccgggattgctgtcgttagcttctttgcattgccgtcagaattcactctcttcaattttggaactgaaaaggaagtgaagaattggcacttgttcttctgtgttgctatcggattgtgggctggactcattatcggttatactacagaatattatactagcaatgcttacagtccggtgcaggatgtagcagatgcttgcaggacaggagctgcaacaaatgtgatttttgggttggctctgggatacaaatcggtcattatccccatatttgccattgccatcgctatttacgtgagctttagcttggctgcaatgtatggaatcgcggtggccgctttggggatgctcagcactatagccaccggtcttgcaatcgatgcatatggtcccataagtgacaatgctggcggtattgcagaaatggccggaatgagtcacaagattcgcgaaagaaccgatgctttagacgctgcaggaaacaccactgcagctattgggaagggtttcgcaatcggatcggcagccctcgtttcacttgctttatttggtgcctatgttagcagagcaggcatcaagaccgtagatgtattgacaccaaaggctttcattggtctcatagttggagccatgctcccttactggttttccgccatgacaatgaaaagtgtcggaagcgcagctctcaaaatggtcgaagaggttcgtcggcaattcaatacaattccaggactaatggaaggcagggtaaagccagactacgcaaactgcgtcaagatatcaaccgatgcctcactccgcgaaatgatcccacccggcgcactcgttatgcttactccacttatagtaggaaccctttttggagtcgaaactctagccggtgtcctagctggtgcactagtttccggtgtccaggttgccatctcagcttcaaacacaggaggagcatgggataatgccaagaaatacattgaggcgggtgttagcgaacatgcaaagtcattgggaccaaaaggttcagaatgtcacaaggcagcagtgataggagacacaataggggatccactgaaagacacttcaggtccatcactaaacatcctcatcaagctcatggctgttgaatctttggtctttgctcctttcttcgccgctcatggaggctttcttttcaaattcatctaaatttcaagctccttttaacaatacatacatacatgcatgcatataattatatatatatatatatcaacagtagagttgtaagttggaggatatgggaaacttttgtattaagaataagatacgtaaaggaaagtcaggccttgcttttaagttggttcttatatcaacatattaagtttatgattgaataaaatgattttgttt

SEQ ID NO: 1717 - DNA, 2606 bp, Gossypium hirsutum
ctttgaattcggctttcgagcggccgcccgggcaggtacgcgggacttttttccattgagttcaaatttccaaacactagttttcttttactacattttgctaagacaagccgagaaacaaagtgaaatattgctgagagtttgtggagatgagtgccttgagtgagggtcttacccaaattgtgatccctttagcttccttggtgggcattggttttgctttgcttcaatggtttttggtctctagggtgaagctattatcacaggattcaagcaatggatataaacaaaaactgattgaatctgatgaagaagaagagggtattaacaatcttgagatttccatcaagtgtactgagattcaacatgccatttctgttggtgcaacctctttcctctttactgaatacaagtatcttggtatcttcatgtgtgtatttggtgctatcatattcctcttccttggttcagttaagggcttcagcaccaaaagcgaaccatgcacatacagccagggaaacacttgcaaaccagccctggcaaatgccttctttagcacaattgctttcttgctaggggctcttacttcagtcctctcaggttatctagggatgaagattgcaacttatgccaatgccagaacaacattagaagcaaggaaaggtgttggcaaggcatttataacagctttccgctctggagctgtcatgggtttcctgcttgcagccaatggccttttggtgctctatgtatccatcaatttgtttaaactctactatggtgatgactgggaaggactctatgaatctattacgggttatggtctaggtggttcttctatggccctgtttggaagagttgggggaggaatatatacgaaagcagccgatgttggtgctgatcttgtcggtaaagtcgagcggaatatccccgaagatgatccacgaaatccagctgttattgccgataatgtgggtgataatgtaggagacattgctggaatgggatctgatctatttggatcttatgctgaatcatcatgtgctgctctttttgttgcatccatatcatcctttggtatcagccatgagtttacagcaatgtcttatcccttgctcattagctcaatgggaattgtggtatgtttgataactacactttttgcaactgatctgtttgagatcaagaaagtaagtgacatcgaaccgtcgttaaaacgacaactgcttatctccaccgttctcatgactgccgggattgctgtcgttagcttctttgcattgccgtcagaattcactctcttcaattttggaactgaaaaggaagtgaagaattggcagtgttgctatcggattgtgggctggactcattatcggttatactacagaatattatactagcaatgcttacagtccggtgcaggatgtagcagatgcttgcaggacaggagctgcaacaaatgtgatttttgggttggctctgggatacaaatcggtcattatccccatatttgccattgccatcgctatttacgtgagctttagcttggctgcaatgtatggaatcgcggtggccgctttggggatgctcagcactatagccaccggtcttgcaatcgatgcatatggtcccataagtgacaatgctggcggtattgcagaaatggccggaatgagtcacaagattcgcgaaagaaccgatgctttagacgctgcaggaaacaccactgcagctattgggaagggtttcgcaatcggatcggcagccctcgtttcacttgctttatttggtgcctatgttagcagagcaggcatcaagaccgtagatgtattgacaccaaaggctttcattggtctcatagttggagccatgctcccttactggttttccgccatgacaatgaaaagtgtcggaagcgcagctctcaaaatggtcgaagaggttcgtcggcaattcaatacaattccaggactaatggaaggcagggtaaagccagactacgcaaactgcgtcaagatatcaaccgatgcctcactccgcgaaatgatcccacccggcgcactcgttatgcttactccacttatagtaggaaccctttttggagtcgaaactctagccggtgtcctagctggtgcactagtttccggtgtccaggttgccatctcagcttcaaacacaggaggagcatgggataatgccaagaaatacattgaggcgggtgttagcgaacatgcaaagtcattgggaccaaaaggttcagaatgtcacaaggcagcagtgataggagacacaataggggatccactgaaagacacttcaggtccatcactaaacatcctcatcaagctcatggctgttgaatctttggtctttgctcctttcttcgccgctcatggaggctttcttttcaaattcatctaaatttcaagctccttttaacaatacatacatacatgcatgcatatatatatatatatcaacagtagagttgtaagttagaggatatggggaacttttgtattaagaataagatatgtaaaggaaagtcaggccttgcttttaagttagttcttatatcaacatattaagtttatgattgaataaaa

SEQ ID NO: 1718 - DNA, 2610 bp, Castanea mollissima
gcagtttccaagtttgtaggtttctgctcagagactgtacttcaaaacccagtattggtgtttgccatttttgctaagacaactcaagaaatcatttgagctttgagttttgggaaatgggtttgctgagtgagggacttacacagattctgatacctgtggctgccttcattggacttgcgtttgctttgtttcagtggtttttggtctccaaggtcaaggtctcaggtggctatggtgattatagtgggtataaagataaagacaggttgattaatgaaggagacactgaagaaggtgttgacactcttgaggtttccatcaagtgtgctgaaattcaaaatgccatttctgttggggcaacctcatttctgtttactgagtatagataccttggtatcttcactgctgtatttggtgttgtcatcttcctcttccttggttcagttaaaggcttcagcaccgcaagtgaaccttgcacttacaacactgggaatatatgtaaaccagcattggcaaatgccttgtttaccaccattgcattctttcttggtgctattacatcagtcctttctggttttcttggcatgaagattgctacctatgccaatgctagaaccactctagaagcgaggaagggtgttgggaaggcattcatcacagcttttcgctctggtgcagtgatgggtttccttctttctgccaatggccttttggtgctgtgggtatccatcaatttatttaagctgtattatggggatgactgggaaggactttatgaatctattactggttatggactcggaggttcttcaatggcactttttggaagagttgggggaggtatttacacaaaagcagctgatgttggtgctgaccttgttggaaaagttgagaggaatatccctgaagatgatccacgtaacccagctgttattgcggacaatgtgggtgacaatgttggagacattgctgggatgggttctgacctctttgggtcttatgctgaatcatcctgtgcagcactttttgttgcctcaatatcatcctttggtatcaatcatgacttctcagccatgtcctatcctctgattataagctcaatggggattgtggtttgcttaataacaacactttttgcaactgatttttttgagattaagcgtgtgagtgagattgaaccaaccttgaagagacaacttgttatctcaactgtcttcatgactgccggtatcgccatggtcaccttctttgctttgccatcagagtttactctctttaattttggaactgagatgtctgtaaagaactggcaccttttcttctgtgttgcaattggcttgtgggctggacttgttattggatacactacagagtattatactagcagtgcttacagtccagtgaaggatgtggcagattcttgtaggactggtgctgcaacaaatgttatttttggattggctctgggatacaaatctgtcatcattcccatatttgccattgccgttgccatttatgtgagctttagcttagctgctatgtatggaatttctgtgtctgctttgggaatgctcagcaccattgccactggtcttgcaattgatgcttatggccccataagtgacaatgctggtggaattgcagaaatggctggtatgagccatgagattcgtgaaagaacagatgccttagatgctgctggaaacactactgctgccattggaaagggctttgctattggatcagctgctcttgtttcccttgctttgtttggtgcctttgtgagcagggcaggtatcaacactgttgatgtgttgactccaaaggtcttcatcgggttgcttgtgggagccatgcttccatactggttttcagccatgacaatgaagagtgtcggaagtgcagctctcaaaatggttgaagaggttcgccgacagttcaatactattcccggccttatggaaggaagagcaaaaccagactatgcaacctgtgtcaaaatctctactgatgcttcactaagggaaatgatcccacctggtgctttggtcatgcttacaccacttattgctggaaccttgtttggtgtggagactcttgctggggttcttgctggttcacttgtttctggtgtgcaggttgctatctcagcttcaaacacgggtggcgcatgggataatgcaaagaaatacatagaggctggtggtaatgaacatgcaaaatcactaggtcccaaaggatcagatgctcacaaggccgctgtcataggtgacacaattggagatcctctcaaggatacttctggtccttcactcaatattctcatcaagctcatggcagtcgagtccttggtgtttgctccattctttgcagctcatgggggcttactcttcaaactattttaaaatggaggttctatgtagtaggtttaattccagtgcatcttcacttgtggagcagtacagttgatgaagttttaagtaattagttgcatcaagttgtgaagaaaaaactatgcggctttacttaatagacaatttaccattaataaccatgaaatacatatgtatatctcgttatcttgaactgaattttgtttctgtttca

SEQ ID NO: 1719 - DNA, 2542 bp, Gossypium hirsutum
cttttactgcattttgctaagacaagccgagcaaataaagtgaaatattgctgagagtttgtggagatgagtgccttgagtgagggtcttacccaaattgtgatacctttagcttccttggtgggcattggttttgctttgcttcaatggtttttggtctctagggtgaagctctcatcacaggattcaagcaatggatataaacaaaaactgattgaatctgatgaagaagaagagggtattaacaatcttgagatttccatcaagtgtactgagattcaacatgccatttctgttggtgcaacctctttcctctttactgaatacaagtatcttggtatcttcatgtgtgtatttggtgctatcatattcctcttccttggttcagttaagggcttcagcaccaaaagcgaaccatgcacatacagccagggaaacacttgcaaaccagccctggcaaatgccatctttagcacaattgctttcttgctgggggctcttacttcagtcctctcaggttatctagggatgaagattgcaacttatgccaatgccagaacaacattagaagcaaggaaaggtgttggcaaggcatttataacagctttccgctctggagctgtcatgggtttcctgcttgcagccaatggccttttggtgctctatgtatccatcaatttgtttaaactctactatggtgatgactgggaaggactctatgaatctattactggttatggtctaggtggttcttctatggccctgtttggaagagttgggggaggaatatatacgaaagcagccgatgttggtgctgatctgtcggtaagcgagcggaatatccccgaagatgatccacgaaatccagctgttattgccgataatgtgggtgataatgtaggagacattgctggaatgggatctgatctatttggttcttatgctgaatcatcatgtgctgctctttttgttgcatccatatcatcctttggtatcagccatgagtttacagcaatgtcttatcccttgctcattagctcaatgggaattgtggtatgtttgataactacactttttgcaactgatctgttgagatcaagaaagtaagtgacatcgaaccgtcgttaaaacgacaactgcttatctccaccgttctcatgactgccgggattgctgtcgttagcttctttgcattgccatcagaattcactctcttcaattttggaaccgaaaaggaagtgaagaattggcacttattcttctgtgttgctatcggattgtgggctggactcattatcggttatactacagaatattatactagcaatgcttacagtccggtgcaggatgtagcagatgcttgcaggacaggagctgcaacaaatgtgattttcgggttggctctgggatacaaatcggtcattatccccatatttgccattgccatcgctatttacgtgagctttagcctggctgcaatgtatggaatcgcggtggccgctttggggatgctcagcactatagccaccggtcttgcaatcgatgcatatggtcccataagtgacaatgctggcggtattgcagaaatggccggaatgagtcacaagattcgcgaaagaaccgatgctttagacgctgcaggaaacaccactgcagctattgggaagggtttcgcaatcggatcggcagcccttgtttcacttgctttatttggtgcctatgttagcagagcaggcatcaagaccgtagatgtattgacaccaaaggctttcattggtctcatagttggagccatgctcccttaactggttttccgccatgacaatgaaaagtgtcggaagcgcagctctcaaaatggttgaagaggttcgtcggcaattcaatacaattccaggactaatggaaggcagggtaaaaccagactacgcaaactgcgtcaagatatcaactgatgcctcactccgcgaaatgatcccacccggtgcactcgttatgcttactccacttatagtaggaacccttttcggggtcgaaactctcgctggtgtcctagctggtgcactagtttctggtgtccaggttgccatctcagcttcaaacacaggaggagcatgggataatgccaagaaatacattgaggcgggtgttagcgaacatgcaaagtcattgggaccaaaaggttcagaatgtcacaaggcagcagtgataggagacacaataggggatccactgaaagacacttcaggtccatcactaaacatcctcatcaagctcatggctgttgaatctttggtctttgctcctttcttcgccgctcatggaggctttcttttcaaattcatctaaatttcaagctccttttaacaatacatacatgcatgcatgcatatatatatatatatcaacagtagagttgtaagttagaggatatggggaacttttgtattaagaataagatatgtaaaggaaagtcaggccttgcttttaagttagttcttatatcaacatattaagtttatgattgaataaaatgattttgttt

SEQ ID NO: 1720 - DNA, 2660 bp, Gossypium hirsutum
tgttgtcggagtttgcgacggaaatcgtggtgccagtgtgcgccgtgattggaattgctttctcgttggtgcagtggctgttggtgtcgcgcgtgaagcttaacccggagcggcatgcatcggggaatagcaacaagaacggttacagtgattacttgattgaggaagaggaaggacttaatgaccccagcgtcgcaccaagtgcgctgaaattcaaagcgctatctccgaaggtgcaacatcctttcttttcactgaatatcagtatgttggcatcttcatgattgcttttgctatcttgattttcctcttcctgggctctgtcgagggcttcagcatgaagagccagccttgcacctatgataaggagaagatgtgcaaaccagctcttgcgactgctatcttcagtactgtatccttcttgctaggtgccatcacttcagttctttctggattccttggaatgaaaattgctacctatgccaatgcaagaacaaccttggaagcaagaaaaggtgtcggaaaggcttttattgttgcgtttagatctggtgcagtaatgggttttctccttgcagcaaatggtttattggtactttacattgccatcaatctattcaagctgtactatggtgatgactgggaaggcctttttgaggctattactggttatggtcttggtggatcctctatggcactctttggaagagttggtggtggtatctatacaaaggctgctgatgtcggtgctgatctcgtaggaaaggttgaaaggaatattccagaagatgacccaagaaacccagctgtcattgctgataatgttggtgataatgtcggggacattgctggaatggggtctgatctatttggctcatatgctgaatcttcctgtgctgctcttgttgtagcttctatatcctcctttggaataaaccatgacttcacgggcatgttgtatcctctgctcattagttctgttggtattcttgtctgtttgatcacaaccctatttgctacggatttgttcgaaatcaaggttgtcaaggaaattgaaccagctttgaagaagcagctcatcatctccactattctaatgacagtaggaattgcaattgttacttggattggtgtgccatcttccttcaccatttacaattttggggttcagaaagttgttaagaattggcaactatttttgtgcgtgggtgttggtctctgggctggacttattattggttttgttactgagtactacaccagcaatgcttacagccctgtgcaggatgttgccgactcttgcaggacgggagcagcaaccaatgttatatttggccttgctttaggatacaaatctgtgatcatcccaatttttgccatagcaatcagtatttttgttagttttagctttgctgctatgtatgggattgcagttgctgcccttggaatgttgagcaccattgcaactgggttggctatcgatgcttatggtcccatcagtgacaatgctggaggtatagctgagatggctggtatgagccatcgcattcgtgagagaactgatgctcttgatgctgctggaaacaccactgctgccattggaaagggatttgccattgggtcagcggcgttggtgtctttggctctatttggtgcctttgtgagccgtgctgctatcacgaccgtagatgtcttgaccccaaaagttttcattggtttaatagttggagccatgcttccttactggttctctgcaatgaccatgaagagtgtgggaagtgctgctttaaagatggttgaggaggttcgcagacagttcaacaccattcccggtctcatggagggtcatgccaagccagattatgctacctgtgtcaaaatctcaactgatgcctctatcaaggagatgatccctcctggtgcccttgttatgcttactcccctcattgttggaactttctttggtgtagagactctttctggtgtccttgctggggctcttgtttccggtgttcagattgcaatttctgcatccaatactggtggggcatgggacaatgccaagaagtacattgaggccggtgtgtccgagcatgcaaggaccctaggtccaaagggatccgatcctcacaaggcagctgtcatcggtgacactgttggagaccctctcaaggatacctccggtccatcacttaacattcttatcaagcttatggcagtcgagtcacttgtgtttgctcccttctttgccacacacggtggtctactcttcaagatcttttagggaatggatggctggaaatgcacggtggaaggctggttagcatctctgtttaaatagtgttgtttccattcagtcattacttttagtttcttgcatgattgtatccatccacagtttgttatgaggtcttttttagttttgcatagttgctaatgatgataactgagatgggttaggattggacctggcacttcgtatcctgtttgtgtaatttgttacagtcgtaatttttgataggttaataaattgtatcatagattttgacatgcttgtgtttttcttcgcctcatattgtgtaattgtttcgtgtttgatattccggagtctctttaggggtatggatgaaaatgggagcttaaggatgagcttaatttga

SEQ ID NO: 1721 - DNA, 2302 bp, Manihot esculenta
tgaattgtgaaatgggtatgttgagtgaagggcatacacagattttgatacttgtagcttccctggttggcattgggtttgctttgcttcaatggtttttggtttcaaaagtgagagtctctggtgagtctggtaatatttataatgatatattgattggagaggaagaagaaggtgttgataagcatgatgtttctctcaagtgtgctgaaatccaaaatgctatttctgttggggcaacgtctttcctgtttactgagtacaggtatctttgtatcttcatgggtgtttttggggtcatcatctttctctttcttggttcagttaagggctttagcaccaaaagtgaaccatgcacatacaacaaggggaatctttgtaaaccagctttagccaatgctttctttagcaccattgcttttttgcttggtgctctcacttctgtcctctcaggttttctaggaatgaagattgcaacttatgccaatgctaggacaactctacaagcaaggaagagtgttggaaaagccttcatcacagcttttcggtccggtgcagtaataggtttccttctctctgccaatgggcttttggtgctctttgtatccatcaatttgttcaaactctactatggagatgattgggaaggactctatgagtccattactggttatggtcttggaggctcctcaatggcactctttggaagagttggaggaggtatctacacaaaagcagctgatgttggtgctgatcttgttggtaaagttgaaagaaatatccctgaagatgatccaagaaatccagctgttattgctgataatgtgggtgacaatgtaggagacattgctggcatgggttcagatctatttggatcttatgctgaatcatcttgtgcagcacttttcgtcgcatcaatttcacagttcggtgtcaaccatgactatacagccatgtcttatccattgattataagttcaatggggataatagtttgtctgataactacactttttggtactgacatgtttgagattaagaatgtaagtgaaattgaaccgtcattgaagaaacaactacttatctcaaccattctgatgacggttgggattgccatggtcagcttcttagccttaccatcagaattcactctctttgatttcgggacagacaagcttgtaaagaactggcagcttttcttttgtgtttccattggcttgtgggctggacttgttattgggtatacgaccgagtactatactagcaatgcttacagtccagtgcaggatgtagcagattcttgcaggactggtgctgcaacaaatgtgatatttggattagctctaggatacaaatctgtcataattcctatttttgcaattgcaattgctatctatgttagctttagcatggctgccatgtatggcattgccatggctgctttgggaatgcttagtacaatttcgactggtctagcaattgatgcttatggacccataagtgacaatgctggaggtattgctgaaatggctggaatgagtcataagatacgtgaaagaacagatgctttagatgctgctggaaacaccacggccgcaattggcaagggttttgctattggatcagctgctctggtttcccttgctctatttggtgcctttatcagcagagcaggcatcaaaactgttgatgttgctaaccccaaggtcttcattgggctgatcgtcggcgcaatgcttccatactggttctctgccatgacaatgaaaagtgtgggaagtgcagcactaaaaatggtcgaagaagtccgtcgacaattcaatactattccaggacttatggaaggtagaactaaaccagactatgccaactgtgtgaaaatctcaactgatgcctcactcagggagatgatcccacctggtgctttagttacacttacaccacttgtcgctggaaccttattcggagtcgaaactcttgctggtgttcttgctggttcactggtttctggtgtccaggtggccatctcagcttcaaacactggaggtgcatgggacaacgccaagaaatacattgaggccggtgcttctgagcatgctagatcactggggccaaagggttcagacgctcacaaagctgctgtgattggtgacacagttggggaccctcttaaggacacttctggtccttcacttaatatcctgatcaagcttatggcagtggaatcattggtgtttgctccattctttgctgctcatggaggcctgttgttcaaattgctttgaatctgaatcttaaacat

SEQ ID NO: 1722 - DNA, 2267 bp, Pennisetum glaucum
ggcgacgcaggtcgtaatcccggaggctgctgcgaccacactactctcgttcctctccgttctgcggaggggccgaagcttccgagaaaaaggaaccccagcgcggtcgcagcagcctccggcgatggcggcgatcctgccggagctggcgacgcaggtcgtaatcccggtcgcggcggccgtgggcatcgccttcgcggtgctgcagtgggtgctcgtctccaaggtgcggctcacccccgagcgcggccgcgccgacggcggggccgcgaagggcggacccagcgactacctcatcgaggaggaggaggggctcaacgaccacaacgtcgtcgtcaggtgcgccgagatccagagcgccatctccgaaggagcaacatctttccttttcactgagtacaagtatgttggattattcatgggcatctttgcaatccttatcttcctcttccttggatccgttgagggattcagcacaaagagtcagccttgccactacagcaaggacaagatttgcaaacccgctcttgcaaatgccatcttcagtactatagcttttgtgcttggtgcagtcacctcactggtgtctggctttcttggaatgaagattgcaacttatgcaaatgccaggacaactttagaggccagaaagggtgttgggaaagcatttattactgccttccggtctggtgctgttatgggcttcctgcttgctgccagcggtcttttggttctttacattgctatcaatttgtttgggatctattatggtgatgactgggaaggtctttttgaggctattacaggctatggccttggtgggtcttctatggctctttttggccgcgttggtggtggtatttatactaaggctgctgatgttggtgctgaccttgttgggaaggttgaaaggaacattcctgaggatgatccaagaaacccagctgtcattgcggacaatgttggtgataatgttggagatattgctgggatgggatcagatctctttggctcatatgctgaatcatcatgtgctgctcttgttgtggcctcaatctcatcttttggaatcaaccatgaatttactcctatggtgtaccccctgcttgtcagctctgtgggtattatagcatgtctcataacaacactgtttgcaactgatttctttgaaataaaggctgtgaatgaaatagagcctgctctgaagaaacaactcataatttccactgttgtgatgactatcggcattgcactcatcagttggctggccctcccgtacaccttcaccatttttaattttggagtccagaagacagtgcaaagctggcaattgtttttgtgtgtggcggttggtctctgggctggcctaatcattggttttattactgagtactacacaagtaatgcctacagccctgtacaagatgttgctgattcctgcagaactggagccgccaccaatgtcatttttgggcttgctttgggatacaaatcagtcattatacctatttttgctattgcttttagtatctttctcagcttcagccttgccgccatgtatggtgtcgctgtggctgctcttggaatgctgagcaccattgccacaggtcttgctattgatgcatatggtcctatcagtgataacgctggaggaatagctgaaatggctgggatgagccacagaattcgcgagaggacggatgctctagatgctgcaggaaacaccactgctgcaattggaaagggttttgccattggctctgcagccttggtgtcacttgcactcttcggtgcctttgtgagccgggctgctatctctactgttgatgttctgtctcccaagtattcattggacttattgttggtgctatgctcccatattggttctcagcaatgaccatgaagagtgtaggcagtgctgcactcaagatggtggaggaagtccgccggcagttcaacaccattcctgggctcatggagggcaccacaaagccagattatgcaacctgtgtcaagatctctactgatgcttccatcaaggagatgattcccccgggtgctctggtcatgctcactcccctcattgttggaactctctttggtgtggagaccctctctggtgttcttgctggtgccctggtttctggagtgcagattgccatctctgcttccaacactggtggtgcatgggataacgccaagaagtacattgaggctggtgccagcgaccacgctaagtccctgggccctaagggatcggactgcca

SEQ ID NO: 1723 - DNA, 2186 bp, Gossypium hirsutum
ggcacgagcggcacgaggaattttctattatatcttataataataataataataaaatacagaaatcttcattttcacactttgatttttagcttttacactgcaaaaactttttttttctgtatataaaccctcacttgtctcccatttttcctcactgggaaattttgttctttaccatcggtttgcagcttctcatttcgtttagtttgaagggtggttttatttacgtatgggggcttcgattttgtctgatttcggagccgagatcctgatcccggtttgcgccgtgattgggattgccttttcgctcgtacaatgggttctagtttccaaagtgaagctttctccgggccgggagtcggtgaacaatggttcgggcgccaaaaacgggtactccgattaccttattgaagaagaagaaggtcttaatgaccatagtgttgttcttaaatgtgctgaaattcaaagcgccatttctgaaggagcaacttcgtttcttttcactgagtatcagtacgttggcattttcatggttgcttttgcaatcttgattttccttttccttggctcagtagagcgtttcagttcaaagagccagccttgcacgtacggcaaatctaagatttgcaagcctgctctagccacagctgcattcagcaccatatctttcttgcttggtgccatcacttcagttgtttctggatttctcgggatgaaaatcgctacctatgcaaacgctagaaccaccctcgaggcaaggaagggagttggaaaggcatttataaccgcgtttagatctggtgctgtcatgggctttcttcttgctgcaaatggccttttggtgctttacattgccatcaacttattcaaactttattacggcgatgactggagtggtcttttcgaggcaatcactggttatgggcttggaggttcatccatggctctttttggcagagttggtggaggaatctataccaaagctgctgatgtgggtgctgatcttgtaggcaaggtggaaaggaacattcctgaggatgaccctagaaacccagctgtgattgctgataatgtcggagataatgttggtgatatagctggaatgggatctgatctttttgggtcctatgctgaatcatcttgtgctgcacttgttgttgcttccatctcttcttttggcatcaatcatgaattgactccaatgttatatcctctgatcatcagttccgttggtatcattgtttgtttaatcacaaccttatttgcaactgatttctttgagatcaaggctgttaaggaaatcgagccatcattgaagcggcaactcataatttcgactgttctcatgactattggaatcgggattgttagttggatagctcttccatcttcctttactattttcaattttcggagaccagaaagctgtgaagaactggcaactattcttatgtgttgctgttggtctttgggccggcctaattatcggtttcgtaactgagtactatactagcaatgcatacagccctgtacaagatgtcgctgattcctgcaggactggagctgcgactaacgttatttttggccttgcattgggttacaagtcttgcattattcctatttttgctattgcaatcagcatttcgttagtttagctttgctgctatgtatggcattgctgttgctgcccttggaatgctgagcaccatagctaccgggttggctattgatgcttatggtcccatcagcgataatgccggaggcattgctgagatggctggcatgagccacagaatacgggagagaactgatgctcttgatgctgcaggcaacaccactgctgctatcggaaagggtttcgccattggttcagcagcactggtttcccttgctctctttggtgcctttgtgagccgagctgctatctcaactgtcgatgtattgacccctaaagtttttatcggtttgcttgttggggcaatgcttccttattggttctctgctatgaccatgaagagtgtgggaagtgcagctttgaagatggtcgaggaagtgcgcagacagttcaacacaatccctggtctcatggagggcaccactaagcccgactacgctacctgtgttaagatctctactgatgcttccatcaagaaatgatcccaccgggtgctcttgtcatgctc

SEQ ID NO: 1724 - DNA, 2667 bp, Euonymus alatus
cggccgggggtcctttatacatttaaattgccatagaaaacatcataaacaaaagttttctttggataattgcccattactgggactggcagtttcaggttcaggtgttctcgaaaacgaagaattgtttttagttatattaggtctgaagaaatccaagaacttgagttgttgaaaaatgggtttgttgggtgagggcttaacacaggttctgatgcctgctgctgctttgcttgggattgggtttgctttgcttcagtggttcttggtctcaaaggtcagggtctctgatggttctggtgaagagagtggatacagtgagagtctgatcgaaggagaagaagagggtgttgacaatcttcaggtttccatcaaagttgctgaaatccaaaatgccatttctattggggcaacatcctttctgttcactcagtacaagtatcttggcatcttcatgggcatgtttggcgcaattatttttctcttcctcggctcagttaagggatttagcacgaaaagtgaaccttgcatatacaacaaggacaatctttgtaaaccagcacttgccaatgctgtctttagcacaatagctttcttgcttggtgctcttacttcagtcctttcaggatttctagggatgaaaattgctacatatgcaaatgctagaacaactatggaagcaaggaagggtattggtagggcattcactgctgcttttcgcgctggttcagtgatgggttttcttcttgctgccaatggccttctggtgctgtatatctccattaatttatttaaactctactatggggatgactgggaaggactttatgaatcgatcactggttatggtcttggaggttcttcaatggcactctttggaagagttgggggaggtatatacacaaaagcagctgatgttggtgctgatcttgtggggaaagttgagcagaatattcctgaagatgatccacgaaacccagccgttattgctgataatgtgggtgacaacgtaggagatattgccggtatgggctcagatctatttggatcttatgccgaatcatcttgtgcagcactctttgttgcatcaatatcgtctttcggtattagtcatgattacgtagccatgtcttatccactgattataagctcaatgggaattgttgtttgcttgataactacactttttgccactgatctctttgtgatcaagaatgtgagcgagattgaaccgtccttgaagagacaacttttaatctccactgttttgatgactgctgggattgccatggtcagcttctttgctttaccatcagaattcactctcttcaattttgggactgacaaggttgttaagaattggcaccttttcttctgtgtttcaattggtctttgggctggacttgccataggttatactacagagtactacacaagcaatgcttatagtccagtgcaggatgtagcagattcatgcaggacaggtgctgcaacaaatgtaatatttgggcttgctcttggatacaaatctgtgatcgttcccatatttgccattgccattgctatttatgttagctttagcttggctgctacgtacgggattgctgtggccgctttgggaatgcttagcaccattgccaccggtctagcaattgatgcttatggtcccataagtgataatgctggtggcattgccgaaatggcaggaatgagcagcaagattcgggaaagaacagatgctttagatgctgctggaaacaccacggctgcaattggcaaggggtttgctattggatcggctgctctagtgtctcttgccttgttcagtgcctttgtgagcagggctgggatccaggcagttgatgtattgaccccaaaggtcttcattgggcttattgtaggggccatgcttccatactggttttctgccatgacaatgaagagcgtgggaagtgcagctctcaaaatggtcgaagaagtaagaaggcagttcaaatccattccaggacttattgagggtagagccaaaccagactacgcgaattgcgtcaagatttccactgatgcctctctcagggagatgatcccacctggcgctttggtcattcttacacctctcatcgccggaaccttttttggcgtagaaactcttgctggtgttcttgctggttcactcgtttctggtgtccaggttgccatctccgcttccaacacaggaggggcatgggataatgccaagaaatacatagaggctggtgcatctgagcatgctaaagtactgggtcctaagggctctgatgctcacaaggctgcagtcattggtgacactattggagatccactcaaggacacttctgggccttcactcaatatcctgatcaagctcatggcagtggagtctctggtgtttgctccattttttgctactcatggaggcttgctcttcaaattgctgtaatttgttccatcatgctaattctagtgcatatatcttgttaataattagcactcataattatgtactctatatatatatatgcaccaaaaccagcaagtggatgctagtgagattatgtacatttaaaagtattattttcttatcttttttttcttcttctttgttgtatatgacttgaattctacttaaagtggaattgttgttttgtt

SEQ ID NO: 1725 - DNA, 3596 bp, Gnetum gnemon
tggagttctacttgtggcttaattacgctaagatgttggtattacaggcagggcttcttgtgaactgtgttcttccaaagtcctcaattcattggagccacagtcggagcttggctacaaggatatccagacagcaaaatgttgagtcggaagtccaagcagaccaacccacaatcatggaacaagaatacggagaagccgcagcagcagcaggtccagctccatcgtcttcaacatcttctccttcttcttccgcaggtgataacaattcaaaagcatccttcaccactgaatccaaagcttctttctcagcttccattgacaaaaacataaagaaggcagtgctgaaaacagcagcaacatttgccccgagggcttctgctccacagaagaacaagaaccctgcagtaccaggaactgcactctacactgtgtttgagctgcaagggtatgcttccatgttgcttggaggtgccctttcctacaatctgatctttccctccaatgagcctgatatctggaggctcatgggtatgtggtcaatctggatgttcacaattccttcgttacgggcacgagattgttcaaaggaagaaaaggagactttaaattatcttttccttctcatacccctgatcaatgttattttgccatttttttggaaatctttttctctggtttggtcagctgacacttttgccttcttctctatgtacgcatggaagatgaggtggctacaaaagactgagtagaacacgtttgaatatccaacgtccaagcttgcccttgaattagttgatagaaggaagcttcacctagcagtgatgagcagagataccgaatggttgcttgagtcttcaaatttgtttacgtctttaaaaaataatattgaaaatgtatagttttccttcttgaacatctgcaatcataccccttcggtaaatacgagccattttcatataagaatctccctcctgcattgttgtatttgactcaaggaaggaaggaagagaaggcatctaccatggagatggcgatggagaaggagaagcgagcgttgttgacagagaccctgacgcaagtgttcataccagtggctgccattatcggcatagcctttgcgcttgtgcagtggtttctggtttcccgagtgaaggtatcacctgcggcggcctctgccccggcggtccccgtgcgcagcagctatagctacggtgctgccggaggaggaggccgggccgagaggctcttggtggatgacgaggtggacgaggacggtggcgatggccgtcagaccgtcgcgaaatgtgccgagattcagaatgccatctctgtaggggctacttcgtttctgttcacggagtacaaataccttggaattttcatggtgtgttttgggctgatcattttcttatttctgggttccgtggaatcattcagtaccaagcctcggccatgcacttacgataaaaccaaaatgtgcaaacctgcactggccaatgcagtattcagcagcgtagcatttgtgcttggtgcactaacctctgttctttctggttatcttggcatgaaaattgcaacatatgctaatgcaagacacattggaagccagaaaggtgtgggtaaggcattcattacggcatttagatctggggctgtaatgggatttttgctggcagcaaatggattgttggtgctctacatatccatcaatgtgttcaggatctactacggagacgactgggaaggtctttttgaggccattacaggctatggtcttggcggttcttccatggctctgtttggacgagtgggtggaggaatttacaccaaagcagccgacgttggagctgatcttgttggaaaagtggagcagaacataccagaagacgacccccgaaaccctgctgttatagcagataacgtgggagataatgttggagacattgcaggaatgggttcggatttatttggttcatatgcagaatcatcttgtgctgctcttgttgtggcatcgatttcctcctttggcaacagccatgatttcacttccatgtgctaccctctgcttatcagttcaatgggtattatagtctgcttgattaccacattatttgccaccgatttcttcgaaatccgggacgtcaaacaaattgaaccttctttgaagaaacagctgataatttctacggtgctgatgacggttggaattgccgttgtaagcttgattggattgccatccaaattctacatctacaattttggagcatcaaaatcagtgaagaactgggagctctttttctgcgtgggtgttggattatgggcagggcttgtcattggttacgtcacagaatacttcactagcaatgcttacagtcctgttcaagaagttgctcagtcctgcaaaacgggagcagccactaatgtgatattcggcctggccttgggatacaaatctgttataattcccatctttgcaatcgcaattgccatatatgtgagttttaagttggctgccatgtatggaatcgcagtagcagccctgggaatgctgagcacaattgcaactggtttggctattgacgcgtatggtcctattagtgacaatgccggtggcattgctgaaatggctggcatgagccacaagatccgtgagagaacggacgcccttgatgctgcaggaaatactacagccgctattgggaagggttttgctattggttcagctgcattagtgtctcttgcactattcggagcttttgtcagccgagctgccattgccaaagttgatgtgctgacacccaaagtctttatcggcttaatagttggggctatgctaccctactggttttcggccatgacaatgaagagtgtgggcagcgctgcattgaaaatggtggaggaagttcgcaggcaattcaaattcattccaggattgatggaaggaaccaccaaacctgactatgccacatgtgtcaaaatatcaacagacgcttctatcaaagaaatggttcctcctggggctctggtgatgctgacccctctcatagtaggaattctgttcggagttgagacgttgtctggagtattagccggtgctctcgtctctggtgtgcaggttgccatatcagcttccaacaccggtggtgcttgggacaatgctaagaaattcattgaggctggggcctccaaagctgccagggagcttggacccaaaggatctgatgctcacaaagctgctgtaattggggatacaattggggatccattgaaagatacatcaggaccatcactcaacatcctaatcaaactcatggcagtagaatccttggtgtttgcacccttctttgctgctcatggcggattgcttttcaagatataacatgtatgccactcagtaacagctgctgatgctgctattttgacggtagattagtggccaatcttttatccctctgatcacctcaacactgtgagggcgaacgattggtttttttttggtttctcagatcatttgcaaaaactgcatgagctatttcactttcaaatcaagttttgtatctccaacccagtttttcaaaatgatttttttcttg

SEQ ID NO: 1726 - DNA, 2664 bp, Glycine max
ttcaactgctgcatttggaaatggttgtgctgagcgagggtcttacacaaattctaatacctgtgactgcgtttattggaattgggtttgctttgcttcaatggcttttggtgtcaagggtcagagtctcttctgctgatcacacggaagcagacaacggatatagaaaaagcttaatgggagattcagagttggagaatggtgttcagagtgttgaagttaccaataagtgtactgaaatccagcatgccatttctgttggagctacttcatttttgtttaccgagtataagtacctgactatcttcatgggagtgtttggtgcaataattttcgtctttctgggatctgtgaagggctttagtacacaaagtgaaccttgcacttacaatgaaggcaatatttgtaaaccagcacttgctaatgccatctttagcaccgttgcattcttgcttggtgctctaacctctgtcctttctggctttcttggaatgaagattgcgacctatgccaatgctagaactactcttgaagcaaggaaaggaataggaaaggcttttgttattgctttccggtctggtgcagtgatgggctttcttctttctgcaaatggcctgttggtgctatacatcaccatcaatttatttaaactgtattatggagatgactgggagggactttacgagtctatcaccggctatggccttggaggttcatcaatggcactctttggaagagttggaggtggcatatacaccaaagcagctgatgttggtgctgacctggtggggaaagttgaacacaatatccctgaagatgatccgcgcaacccagctgttattgcagacaacgtaggagacaatgttggagatatcgctgggatgggttcagacttatttgggtcttatgcagaatcatcatgtgcagctttatttgtagcatccatatcatcgtttggaacaaatcatgatcacacagccatgtcatatcctctcatcataagctccatgggaattgtggtttgcttgattacgactctttttgcaactgatctgtttgaaattaaaaacgtgagccaaatagaaccatccttgaaaagacagcttcttatctcaactatattaatgactgctggtattgccatagtcagcttcactgccttaccatcagaatttaccctctataactttggagccaaaaaggttgtcaaaaactggcaccttttcttctgtgttgctattggcttatgggctggacttgcaattgggtacattacagagtactacactagcaatgcttacagcccagttcaagatgtggcagattcctgcagaactggagcttcaacaaatgtgatttttggattggcactgggatataaatcagtcattattcccgtatttgctattgctattgctatttatgtaagcttcagcctggccgctatgtatggaattgctgttgctgcacttggaatgctcagtaccatggccactagtcttgccatcgatgcttatggtccaatcagtgataatgctgggggtattgctgaaatggctggaatgagacatgagatacgcgaaagaactgatgctctcgatgctgctggaaacaccacagccgctatagggaagggttttgctattggatcagctgcacttgtgtctcttgcattgtttggtgcttatgtgagcagagcaggcatcaaaacagtgaatgtgatgaccccaaaagtttttataggtttgattgtgggagcaatgcttccctactggttttcagccatgacaatgaagagtgtcgggagtgcagctctcaaaatggttgaagaagttcgtaggcaattcaataccattcccggtcttttagaaggaagagcaaaacccgattatgcaaattgtgtaaaaatttccactgacgcctcacttaaggagatgatccctcctggtgcattggttttgcttacgccacttattgccggaacattctttggggtagagactcttgctggggttcttgctggttcactcatttccggtgtgcaggtggcaatttcagcttcaaacactggtggtgcatgggataacgccaagaaatacatagaggctggtactaccccacatgctgtatcacttggtccaaaaggctctgatgctcacaaagcagctgtcataggtgacactgttggagaccctcttaaagatacttcgggtccctcacttaacattttgatcaagctcatggcagttgaatcattggtatttgctccattctttgcagctcatggaggcttaatctttaaattactctgatctggagcttttcatgcaatcatctaaatccgattatgcattaccttcaacagcatctaatggagctgtgagattgattgtgcttgcttatgtgattagtagtctagcaaaaaatacatggtttgctttgatttcaccaatgttatgccagttattatctggaataaaattacatgatgtagattatgcaagttgagagtaggatcccatcgttaattatgggaatagtaattttctttgatttcaccaattttattccagtggaataagattacttaatgtagattatgcaagttgggagtagtatctcattgttgattattaatagaatagtaataagtattcatggact

SEQ ID NO: 1727 - DNA, 2289 bp, Glycine max
atggttgtgctgagcgagggtcttacacaaattctaatacctgtgactgcgtttattggaattgggtttgctttgcttcaatggcttttggtgtcaagggtcagagtctcttctgctgatcacacggaagcagacaacggatatagaaaaagcttaatgggagattcagagttggagaatggtgttcagagtgttgaagttaccaataagtgtactgaaatccagcatgccatttctgttggagctacttcatttttgtttaccgagtataagtacctgactatcttcatgggagtgtttggtgcaataattttcgtctttctgggatctgtgaagggctttagtacacaaagtgaaccttgcacttacaatgaaggcaatatttgtaaaccagcacttgctaatgccatctttagcaccgttgcattcttgcttggtgctctaacctctgtcctttctggctttcttggaatgaagattgcgacctatgccaatgctagaactactcttgaagcaaggaaaggaataggaaaggcttttgttattgctttccggtctggtgcagtgatgggctttcttctttctgcaaatggcctgttggtgctatacatcaccatcaatttatttaaactgtattatggagatgactgggagggactttacgagtctatcaccggctatggccttggaggttcatcaatggcactctttggaagagttggaggtggcatatacaccaaagcagctgatgttggtgctgacctggtggggaaagttgaacacaatatccctgaagatgatccgcgcaacccagctgttattgcagacaacgtaggagacaatgttggagatatcgctgggatgggttcagacttatttgggtcttatgcagaatcatcatgtgcagctttatttgtagcatccatatcatcgtttggaacaaatcatgatcacacagccatgtcatatcctctcatcataagctccatgggaattgtggtttgcttgattacgactctttttgcaactgatctgtttgaaattaaaaacgtgagccaaatagaaccatccttgaaaagacagcttcttatctcaactatattaatgactgctggtattgccatagtcagcttcactgccttaccatcagaatttaccctctataactttggagccaaaaaggttgtcaaaaactggcaccttttcttctgtgttgctattggcttatgggctggacttgcaattgggtacattacagagtactacactagcaatgcttacagcccagttcaagatgtggcagattcctgcagaactggagcttcaacaaatgtgatttttggattggcactgggatataaatcagtcattattcccgtatttgctattgctattgctatttatgtaagcttcagcctggccgctatgtatggaattgctgttgctgcacttggaatgctcagtaccatggccactagtcttgccatcgatgcttatggtccaatcagtgataatgctgggggtattgctgaaatggctggaatgagacatgagatacgcgaaagaactgatgctctcgatgctgctggaaacaccacagccgctatagggaagggttttgctattggatcagctgcacttgtgtctcttgcattgtttggtgcttatgtgagcagagcaggcatcaaaacagtgaatgtgatgaccccaaaagtttttataggtttgattgtgggagcaatgcttccctactggttttcagccatgacaatgaagagtgtcgggagtgcagctctcaaaatggttgaagaagttcgtaggcaattcaataccattcccggtcttttagaaggaagagcaaaacccgattatgcaaattgtgtaaaaatttccactgacgcctcacttaaggagatgatccctcctggtgcattggttttgcttacgccacttattgccggaacattctttggggtagagactcttgctggggttcttgctggttcactcatttccggtgtgcaggtggcaatttcagcttcaaacactggtggtgcatgggataacgccaagaaatacatagaggctggtactaccccacatgctgtatcacttggtccaaaaggctctgatgctcacaaagcagctgtcataggtgacactgttggagaccctcttaaagatacttcgggtccctcacttaacattttgatcaagctcatggcagttgaatcattggtatttgctccattctttgcagctcatggaggcttaatctttaaattactc

SEQ ID NO: 1728 - DNA, 2982 bp, Sorghum bicolor
tccccgtgcgctcgaaggcacgaaattctccgcgtgaagtggtgggggaagcagcgaacccctagcagcgtgccccggatctcgccgcgggggggcaaggcaatggccgcgtcgtcggcgttcctgcccgagctgggcacgcaggtggtggtgcccgtcgcggccgtggtcggcatcgccttcgcggtgctgcagtgggtgctcgtctccaaggtgaagctcacccccgagccgccgcgccgcggggacggctccgccgggaagagcggcggcgccggcgccagcgagttcctcatcgaggaggaggaagggctcaacgagcacaacgtcgtcgtcaagtgcgccgagatccagaacgccatctccgaaggagcaacttctttccttttcactgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgcaacatatgcaaatgccaggacaactcttgaggctaggaagggtgttggaaaggcattcattactgctttccgctctggtgctgtgatgggcttcctgcttgctgctagtggcctttttgttctttatattgcaatcaacttgtttggaatttattacggtgatgactgggagggtctttatgaagctatcactggttatggtcttggtggttcttctatggctctttttggtcgtgttggtggtgggatatacaccaaagctgctgatgttggtgctgatcttgttgggaaagtcgaaaggaacatccctgaagatgatccgagaaacccagctgtcattgcagacaatgttggtgacaatgtcggagatattgctggaatggggtcagatctctttggctcctatgctgagtcttcgtgtgctgctcttgtcgttgcctcaatctcttcttttgggatcaatcatgaattcacccctatgttgtacccactcctcattagctctgtgggtatcatagcttgcttgataaccactctttttgcaacggatttctttgagatcaaggctgtagatgaaattgagccggctctcaaaaagcagcttataatttccactgctgtgatgactgttggcattgcacttgtcagttggttagggcttccatatacattcacaatctacaactttggtgtgcagaagacggtgtataactggcaattattcctatgcgtggcagttggtctgtgggcaggactagttattggatttgttacggagtattacacgagcaatgcatacagtcctgtacaggatgttgctgactcctgcagaactggagctgctactaatgtcatctttggccttgctctgggatataaatctgtcattatccctatttttgctattgcttttagtattttcctcagctttagccttgccgccatgtatggtgttgctgtggctgctcttggaatgctcagcacaatcgccaccggccttgccattgatgcctatggccctatcagtgacaatgctggaggaattgctgaaatggctggcatgagccacagaatccgtgagagaactgatgcccttgatgctgctggaaaataaatctgtcattatccctatttttgctattgcttttagtattttcctcagctttagccttgccgccatgtatggtgttgctgtggctgctcttggaatgctcagcacaatcgccaccggccttgccattgatgcctatggccctatcagtgacaatgctggaggaattgctgaaatggctggcatgagccacagaatccgtgagagaactgatgcccttgatgctgctggaaacactactgctgccattgggaagggttttgcaataggttcagcagccttggtgtctcttgccctctttggggcttttgtcagccgtgctgccatctcgactgttgatgttctgtcacctaaagttttcattggactgattgttggtgccatgcttccatactggttctcagcgatgacaatgaagagtgttggcagtgcagcactcaagatggttgaggaagtccgcaggcagttcaacaccattcctgggctcatggagggcactaccaagcctgactatgcgacgtgcgtcaagatctctactgatgcatctatcaaggagatgatcccccctggtgcacttgtcatgctcacacctcttattgttgggatcttgtttggtgttgaaactctctctggagttcttgctggtgctcttgtttctggtgtccagattgccatctctgcatccaacactggaggtgcctgggacaatgcaaagaaatacattgaggctggtgcatctgagcatgcaagaactttgggcccgaaaggttcagacccacacaaggctgctgtcatcggtgacaccatcggtgatcccctcaaggacacctcaggcccctcgttgaacatcctcatcaagctcatggccgtcgagtcccttgtctttgctcccttctttgccacccatggaggcatcctcttcaaatggctttagaggaagaatggaagatcgatgggtaatttatttttgccggggggagagcactagatacctatgtcatagagaagtttcagtttacccatatggtgcatttcttcctttttgtttcgcttgtactgtgtcgcagtcttgttgaacttgtcagccatggtatcacctagttttcgggtctagttgcagtagccgagtgcagcaaaaatgtagtagcattctacaggatggagtctggacatgggtgtattgggaagtgtgatattgcctgtagatatttcgatgatgatgatcaagaaatgcacaattcagatttcctgtcttcatga

SEQ ID NO: 1729 - DNA, 2993 bp, Taxus baccata
gggggggtctcggctgtgtagcgtttgctttgggatccgatagacctcggttcgagtcgcaggagcagctgcgtaaaccctgagaggatttggcaatggcgggtcctctgctgagcgaaatgctgacggaaatactggttcctgtagcggctgttattggaatagcgtttgcattgttgcagtgggtgtttgtgtctcgcgtcaaagtcacgccctccacggcgtcaaatgggtacaacgatcatttgctcgatgaggcggaggaagatggaattgatggccgccgggctgtcatcaaatgcgcagagatacagaacgccatctccgaaggggctacttctttcctgtttacagagtacaagtatctgggggtatttactgtgtgttttggggctattatatttttgttccttggttcggtggagaattttagcaccaaatctcaaccctgtacctatgcgaaggaaaagatgtgcaaacccgcgcttgcaaatgctatattcagtgctatagcctttctgctcggtgctttgacttcagtgttatctggttttctgggaatgaagattgcaacttatgcaaatgccagaactactttggaagctaggaagggtgttggaaaggctttcattactgcatttaggtctggggctgtgatgggatttttgcttgctgccaatggacttcttgtcctatacatcagcattaatgttttcaagatttactacggagatgattgggagggtctctttgaggccattactggctatggtcttggtgggtctgcaatggctctttttggaagagttggtggaggaatttacaccaaggctgctgatgttggtgctgatctagttggtaagattgagcagaacatacctgaagatgaccctcggaaccctgcagttatagctgataatgttggtgacaatgttggagatattgctgggatgggctcagatttgtttgggtcctatgctgaatcttcttgtgctgctcttgttgtggcatccatttcatcctttggcaactctcatgatttcacttccatgtgctatcctttgcttatcagctcaatgggtattgtgatatgcttaatcacaacattgtttgcaaccgacttctttgagatcaaggcggttaaggaaattgaacctgctttgaagaggcagcttattatctctactgtactgatgacaattggcattgctattgtaagctttgttgctttgccatcaaccttcactatcttcaactttggttctgccaaagtagtcaaaaactggtatgtaaaggaaattctgacactcataaagtgcattgtatttcaggttctcatctaggttcttctttgcagagacatttaggatttttgggtttggatatgttttattgcaatatgcaggcatctttttttctgcgtttctattggattgtgggctggacttgtgattggttacactacagagtactatactagtaatgcttacagtcctgttcaagaagtggcagagtcctgtaaaactggagctgcaacaaatgtcatatttggccttgcgttgggatataagtccgttattattcccatttttgctattgcagtagccatatttgtgagcttcagtttggctgccatgtatggcattgcagtagctgcacttgggatgctaagtaccatagcaactggactggctatagatgcttatggtcctattagtgacaatgctggtggtattgcggagatggcaggcatggatcataagattcgggagaggactgatgcccttgatgcagcaggaaacactactgctgcaattggcaaggggtttgccattggttctgctgccctggtgtctcttgcactgtttggggcttttgtaagccgagcggcaattacatcagtggatgtcctcacccccaaagtatttattggtttaattgtcggggcaatgctgccatactggttttctgccatgacaatgaaaagtgtgggtagtgctgcattgaaaatggttgaagaggttcgcaggcagttcagagacataccaggtctgatggaaggaactacaaaaccagactatgctacttgtgtaaagatatcaacagatgcatcccttaaagagatgattcctcccggggcccttgtgatgctcacgcctctcattgttggtatcttatttggagtagagaccttgtcaggagtgctggctggtgcgcttgtctctggggttcaggttgctatttcagcttctaacactggcggtgcttgggacaatgccaaaaaatatattgaggctggggcatcggcggctgcaagggaattaggtccgaagggatctgatgcccataaggctgccgttattggtgataccataggagatcctctgaaagacacatctggaccatcacttaacattctgatcaagcttatggctgttgaatcacttgtatttgcacccttttttgctgctcacggaggaatccttttcaaaatctaaagggaaatttgcaagcttataattagcggcagataaattttctctgagaaaggctggtccaatgtattaatgtttgctctgtagcctgtaggttaatgccctagcatagggcggttctgttttcaaattgtatcgtgcataggtatatttccagtctcttgtgaaactgggtaatggctaaagacctgattcagttttgtatcccaatttttatgaaaaggtaaataacgtacaagtctgaaaattacttgctgactagtgtatgatattttttattgtttgagtggctgttgttttgccgagttgggggcgaacttccaggtacacgtatataaatgtgcttgcagatgtcaagcattaaacttacatgttcagatatcgaatgggttttatggttaaaagatttgggagtaggatattcaatgaagaggacctagtaaatttttccactactgcaggaacttgcaccgtttgttagctggatatttggtattt

SEQ ID NO: 1730 - DNA, 1147 bp, Lippia dulcis
ttcttcttctccaccctcacccttattgtctctcaatttctgctgcaacgatgttgttgaaagctgccgtagcgtttagtttgttggattctcatggtgaaattccggccgctctgttttcatcttcttcatttccgccgaagagttttgccggcaggaggggaaatgtttctctggtttgtgtgactaaacagacaaacaccaagccgttaggcgtcgtttttgagccgtttgaagaagtgaagaaggagctcatgctcgtacctactctcccgcaggattcactcgctcgtcagaagttcgccgacgaatctgaagccgctatcaatgaacagatcaatgttgagtacaatgtatcgtatgtgtaccatgccatgtttgcgtattttgacagagacaacgttgcgctgaaaggacttgctaagtttttcaaggaatcaagtctcgaagaaagagaacatgcagaaaaattgatggagtaccagaacaagcgaggtggaaaggtgaagctgcaatctatcttaatgccactttcagaattcgagcatgctgaaaagggagatgctctctatgctatggagcttgcgttgtctttggagaagttaacaaatgagaagcttttaaacctacatgaggtagcctccaaaaacaatgatgtgcagctgactgatttcattgagagcgagtttctggctgagcaggtggaatccatcaaaaagatatcagaatgtgttgcacagctgagaagagtgggcaaaggccatggtgtttggcacttcgatcagatgctacttgaggaagccgttgcttgaaacaaggctcaacctgtttgcccctcaagagctgtctgcattgcatcccttgagattttgtgatgaattttcaatgagctgttggtcagaaatcaaagttgacatctgagaaagttgcagatgagattagtagtagtggtttatggaagtattattagttaaagagtatctcaaaattgcataacgtcagcaaaactttatctttagagttttatacccttcactttgagtcggttgagtacatcaagtttgatgtcgctgattatgcctgcccgagttcatcaaaataatcaggtttaccaactcctcgataaacataaatacaactcttgttt

SEQ ID NO: 1731 - DNA, 766 bp, Antirrhinum majus
actctgtatatttcagttcataaatcaacaaagatgcttctcaaatcagcgccagttttcggattgttgaacggctccggcgagaatctgaccgctctgttctcctcttcgttttcgcagaagaagagcggcaacggatgcgtggtttgcgcgacgaagcacacaaacaacaagcctttaaccggcgtcgttttcgagccgtttgaagaagttaagaaggaactcagtctagttccctctcttccaggagcttcacttgctcgacaaaagttcgctgatgaatctgaagccgcaatcaatgaacaaatcaatgtggagtacaatgtttcgtatgtgtatcatgctatgtttgcgtattttgatagagacaacgttgctctcaagggacttgctaagtttttcaaggagtccagcgaagaagaaaggcaacacgctgagaagttaatggaataccagaacaagcgagggggcaaagtgaagctgcagtctattttgatgccactttcggagttcgatcatgctgaaaaaggagatgcgttatacgccatggaactggcattgtctttggagaagctgacaaacgagaagcttctgaacctgcatgctgtagcctctaaaaacaacgatgctcagctgactgacttcgttgagagcgagttcttggctgagcaggttgaatcaatcaagaagatatcagaatatgttgcacagttgagaagagtgggcaaaggccatggtgtgtggcactttaatcagatgctgctct

SEQ ID NO: 1732 - DNA, 1218 bp, Gossypium hirsutum
tccaaatcaacctcgagtgacgaacctgcccgcctgcctgcctgccacgctcccttccctccacctcctcatcttcaccctccacgtttcatcccatccctctctcacgctttccctttgctttcctaatcgcacctctctttcctttctgctgcttcttccgctgtttgcatttgaaaaactctgtttcctttttttccttttcatcaaaagcttgggttcttttgcttcttttttgcgccatgttgctgaaagctgttccaactttttcttcgttaaatcctcaactggaaaatcagggtgccctgttttcccctttttcttcttcgattaatcatcagctatcttctctaagaaatggacctgggtctcttgtagtttgtgcagccaaaggagccaaccacaagccactaagtggtgttgttttccagccctttgtggaagtgaaaaaggaacttgatcttgtcccctccgtgcctcaactttctctggctcgccaaaagtttactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagctctttaacctacgtaatgtagccgtgcggaaccatgatgtgcagttgacggatttcattgaaggcgaattcttagctgagcaggtggaggccatcaagaaaatatcagaatatgtagctcaattgagaagagttggaaaaggacacggggtgtggcacttcgatcaaatgcttcttcatgagggagaggaagctattgcatgaagccccaacttgctgcttcgttccatgtcaaaagtttgtgcataaggtcttatttcagtagttctttgttgatatattttggctgtaagttgaaagatagtgccggatctttggtttgatgataaaagctcgtaagggatttatttttggtagtccttttaatcagagtagttatagattcgtggatttccta

SEQ ID NO: 1733 - DNA, 1119 bp, Manihot esculenta
aggagccttactcattgcttccattgccattttcaaatcctttcgtcttcttcgagatcaaaaagctctaatctcctttcttctctctttagaaatccataaaagtatgttgctgaaggctgctcctgctctctctttgattaacactcgtggggagaatctgggtcctctgttttcctctgtttcttcctcgtctaatcctccttttccaatgattcttcgtggaaaaactggaactgggtttgtggtctgtgcatcaaagggtgcaaatgacaagccattaactggtgttatttttgaaccttttgaagaggtcaaaaaggagctcaatttggtccctactgtccctcaagtttcccttgctagacagaagtatgctgatgagtgtgaagctgccattaatgaacagatcaatgtggagtataatgtctcctacgtgtaccatgccatgtttgcttattttgacagggacaatgttgctctcaagggtcttgccaagttttttaaggaatcaagtgaggaagaaagagagcatgctgagaaatttatggaataccagaacaaaagaggtggaaaagtgaagctgcagtcaatagtaatgcccctttcggagtttgatcatgtggaaaaaggagatgcattgtatgcgatggagcttgctttgtctctggaaaaattaacaaatgaaaagctcctgaacttgcagagtgtggctgagcggaaccatgatgtgcagttgggtgattttgttgaaagtgagttcttatcagaacaggtggaagccatcaaaaaaatttctgaatatgttgctcagttgagaagagtgggcaaaggacatggagcgtggcacttcgaccagatgcttctccatgaggaagaggcagttgttgcataatgatggagtcatcttatttgctgcttaagtaccattttgaaggttatcctaagctatctttttgggttagtagttgttgaaagatttttggaggtgtgcttagctcagacattagatggtgtttgataagatgagagacctttaaaaatgggtttaatccctcttccttgacaatgataatcctgtttaaaagcgtttgaaatatatgaatatcttttattcct

SEQ ID NO: 1734 - DNA, 1595 bp, Populus trichocarpa
acacgccacaccaatctctctttttaattcttcttcctcttcattagaaatttcaatacccgttatttcatctttgttcagtaaaaaaaaaaatcatgttacttaaggcagcaccagccttttctctattgaacgcgacaggggataatctgggttccctgtttccatctgtttcttctctgtctaacaaaaatctttctgtttccccttcatttcttcgctcaaaaactgggtctggattcgttgtttgtgcctcaaagggggctaataatagacctttaactggtgtcgtctttgagccttttgaggaggttaagaaagaactgaatctcgtgcctaatgtgccacaagtttctcttgccaggcagaaatttaccgatgagagcgaagccgccatcaatgaacagatcaatgtggagtacaatgtctcatatgtgtaccatgcgatgtttgcctacttcgatagagataatgtggcactcaagggccttgccaagtttttcaaggaatctagtatcgaagaaagagagcatgctgagaaattgatggaataccagaataaacggggtggaaaagtgaagctgcagtctattttgatgcccctctctgagtttgatcatgcggagaagggagatgcactgtatgcaatggagcttgccttgtctttggaaaaactaacgaatgaaaagctcctgaacttgcatagtgtggccgagaagaacaaagacgtgcagttgacagatttcgttgaaagtgagtttttagctgagcaggtggatgctatcaaaaagatctcagaatatgttgctcagctgcgaagagtgggtaaaggacatggagtgtggcacttcgaccagatgctcctccatggggaagaagtagttgcataatcatgaagccatcttgttttctaccttgcttgaagtaccatttaggagggcgttctgtgcctatctttttgtgttaatcattctagtttttgctaagggatttttggggtgtggttggttagcaaagatgctttgttgtccaggattgaacatgagtttagccatcgtttcaaaagcttgaaggtagttaaaaatatatggttgtcccccttcactcttaattttattgtaccttgttctgcaatggctaccacagcgaaaaatgaaaaagaagtgactagggaaatggtaatggaccaccagccgctgtactcatggtctgatgattcaagttcttggtggtcctgtatacctggaccatgatatgattctccagtattctcgatttttctcttcagccgctgaaaaggatggaaagcctagccgctgttgtttgggcggtggtctttttcgctgcatgacaactggcccttcgatttgccgataagttctcatcaatacggacaggatcttctatcactgtcaattagggggtaaggttgtgctgtattaattatctaaaatcaaccgctgatcttctttcgcgctgtcacttagtgggtaaggttgttttctattaatcaaccgtccccacgggataaagaagaggttaaccgtgtccgattaagcccccaaatataaagacatgagatgagatttacgtcc

SEQ ID NO: 1735 - DNA, 3698 bp, Theobroma cacao
gggttgaaatcttggaacttctgtcctttcctgtccgtatataaaccctgaggggactccaacagccgaccagacgtaaacactcttggtgacctgagctagacttattttaactagtcgtcatggcaataatctccgactaccaagaagaggaagcgaaaccctcaacttcttcatcgcagcctcgtaaaccggtgtcgtttaacgcgagcttggatccgtcgaaccctgtagggtttttggaaaaggttttcgattttctggggaaagagactgatttgcttcgaaaagagaacgtcgataaggagatcgcggcgatggtgagggttgcgaaggagaagagcgagaagaaggttgaagaggtagcgccgaaggtggagttaaagaagaaggaagtgaaggaagagaacgagatcaagaaagaagtgaacaaggaggcaatggacctcgataaaaaggatgataagaaggaggaagagactagctctggcttgagagttccaaacaaaggcaatggtcttgatctggagaaatactcttggacacagaccctgcaagaggtcaccgttaatgttccagttcctagtggaacaagatcaaggtttgttgtgtgcgagataaagaagaaccatctaaaagttggactcaagggccagcctcctgttattgatggggagcttttacagtctgtcaaacctgatgattgttattggagcatagaggataattgttccctctcaatccttttgacaaagcacaaccaaatggagtggtggaaatcattggtaaaaggtgatcctgaaattgacactcagaaagttgaaccagaaaacagcaaactatctgacttagatccagaaacacgacaaactgtggagaagatgatgtttgaccagagacagaaggccatgggccttccaaccagtgatgagcttcagaagcaggaaattctaaagaaatttatgtccgagcatcctgagatggacttttcaagggcaaagctcatgtaaacgggggcgcactccgcatctatctccagtcgcatatatgtaggagttttattgctttttcccagtgaaccttttgcgtggatcctttattttggttggggcagcagaaatagaaatgaatgaggaacggtttgaactttgttcatagggggtattataaaattttgtgacatcagcgtttttttagacttgaattgggagtaaatttaagcttttaattgctctcgtaatttcaatgctcctttttatctcgaagataattttgccttgagcatggtaaaaaaccggtagggacctacaactcctgccctaggagcgtgacaagcaccttgacccaagtggtaaaactgattgtccttttctaggaggtagtactgtattatatttgatgagaagcccttggctgctgcaaattagttgtacccctagtcgggggaccaattggtaaaattggctgagggggagttgaggcctgagggtcaaattaagttatagatacatgcctataaatatacaagtgtatattatgttgctagatgctagaatttgtatgccttgattgggagatcaacgatccccacacgctcttattatgttatactagtgcatgtgggcttttttctatctatttttttctttctctttctaccctactttttgtttcttttttctctttttttcttgccttccacgtggctaaatgaggaagctcctttgggtcttctttttatatatgttatagatttgaggcattgggtgccctggatacatctttaggcattggcttgggttaggcattagtggtaaggtgatggtggcctggtgtcaatccattaccgcgagagctacagtggaaaaaaaaaaaaaaaaggtagaagacttccttctttctgtgaagaatcaagaaaggtgtgccttgtgggtgagaaatgtatgcagagacagggctatttttcccttacatgcagaacttttgtcaagattttcagcagtttgaagagttctgcaaaacccagaaacccaatgcttcaatgaacaacttggttcagacatccacaatatctgaatatgacctgggaggagaaggtgatctgttcaaagctccagaacccatcattgaagaaccaattgtgggccttgatcccatgactgcagccatctcattaatctcctgtggtgaagatgtcattacttcacaaggacttaaggctgcagatatagaatcaattcaaaatgagcagcttttagaggttctctatgagtgcgagaaggatctcatggcgcaagcagcaatagaaacaccactgtcagacgtcttggatataaagattcctgttgtgaagacagatgaaaaccaaaatcaaggaaacaaattgctctgtgatgtaccattccagaaaagtgtcagttctggttgtttaagctcaatggaatggatgcaaggggctgcaatcaagcctagtttcctggatttctctggaatggattttggttctgtctatggaatgaggagagcatttagtgaaggagatataaagactcttggcaatggtaatacgactgtaatccactctccccttgagcgaccattaattgtcagcagctgttctactgaagatcgaagggagaagctttccagatacaggaataagaagacaaagaggaactttggaaggaaaatcaagtatgcttgcaggaaggctcttgctgacagtcaaccaaggatccgaggaaggtttgcaaggaccgaagaatctgacaactccaagaggcaagaacttttttctaattaaataattacaatgtaaaacaggaatgatgtagctaggtccaatgaagtaatggaaaagatgagtagtagtgtcaatttggcatatatagcctttgtggaaatcttagaatggtaaatgctaaataaaccagaacccagctcctgagaaacagttctgtcttatttgctgtaataacaccctgtgtatcggaaatggccaagtaggatgtacatagtgtctgttcaataaaatggcaaagcagaaatttgttcctgttcatatatgtcttataaaatgatgatgttttctccatctggtgattccacaaaaaagatggtatgatttgtatactccctgatcacgtttagtaattttctgaagcatccggttattttcttgtgcaacaatcaaggctcattactactcagtcgcaaggttgatgaaagaacgcataaaattggtgtgcgcaaatgtttctattccatcatgagctcatttggcaatctaatcgatctcctcttattggcctgccgtgtctgccaatccacttccacgcaatctctgatcatgaacataaaggttctggatttttcatgatgcgctaaatcaatacctgtcaaggaggtctttctccttctgattaggtgtcacgtgtccctttggtttcaatgcagggatgattgcgaaaactttcaataattttgtcaaagaggtattattacttgggagtttaatgtccaccagccataattctcacatgcggacaaaacactgaagaatttcaattgtagtgatatcattcttaatggtaagttgagctaacagtacttgttgggtacaccggagtcacaggaccagaaacgaatctttaaatcgttggactgtttcggtgaaacagtaaaagtacaaaagttca

SEQ ID NO: 1736 - DNA, 1277 bp, Heritiera littoralis
tggtcctatttcggccggggatcaaagccaaaaccaacctgatttctctctctccttttgggatgctgtgttttaagttggtactttcctccactttgaaactctgttgacaaagagagaagcagaacaaaagttattttctttatctggaagaatcaaagagagtgcgtggctgttgggtgagaaatgtatgcagagacagagctatttttccctcacatgcagaacttttctctagattttcagcagtttgaagagtactgcaaaacccagaaacccaatgcttcaatggacaacctggttcagacctccatgatatatgaatatgacctgggaggagaaggtgatctgttcaaggctccagaacccatcattgaagaaccaattgtgagccttgatcccatgactgcagccatatcattaatctcctttggtgaagatgtcattacttcgcaacgccttaaagctgcagatatcgaatcagttcaaaatcagaagcttttagaggtcctctacgagtgtgagaaggatctcatggcacaagcagcgatagaaactccactgtccgaggtcctggatatcaaggtttctgttgtgaagacagatgaaaaccaaaaccaagaaaacaatatgatctgtgatgtaccattccagaaaagcgtcagctcaggttctctaagctcaatggaatggatgcaaggggctgtaatcaagcctaattttctggatttccctggaatggatttcggttctgtttatggaatgaggagagcttttagtgaaggagatataaagactcttggcaatggtaacatgaacatcatccaatcttcccttgagcgaccattaattgtcagcagctgttctactgaagatcgaagggaaaagctttccagatacaggaacaagaagacaaagagaaactttggaagaaaaatcaagtatgcttgcaggaaggctcttgctgacagccaaccgaggatccgcggaaggtttgcgaggactgaagaatctgacaactccaagagggcaatagctgttgactaattaaagaactaccgtgtaaaacaggaatgaagtagctaggtttaatgaggtaatggaaaaaaaaatgagcagtagcctttggcgcaatcatagataatgctaaataaaccagaacccagctcctgagaaatagttctatcttatatgctgtaataaactccgaatggccaggcaggatgtacatagtgtttgttcaataaaatggccaagcagagatttgtacttgttct

SEQ ID NO: 1737 - DNA, 1360 bp, Gossypium hirsutum
tatcaacgcagagtacgatgggggcgctacttttggggactctgatttccaagagaagtgacataagagtgggggaagaaccaaagtttgtgttttgttctctctcaagaatcaaagaacattttgtgcttttgtgagtcaagaaatgtatgcagaaactgggctatttttcccttacatgcaaaaagtttctcaagaatttcaccagtttgaagagttctgcgaaacccagaaatccaatgcttcaatgaacaacatggttcagacctcagcaatatctgaatattacctgggaggcgaaggtgatctattcaaagctccggagcctatcattgaagaaccaattgtggaccttaatcccatgactgcagccatctcattaagcttttgtggtgaagatgttattacttcacaaggatttaaagctgctgatattgaatcaattcaaaacgagcagtttttagaggttctttatgagtgcgagaaggatctgatggcacgagcagtcatagaaacaccactatccgaggtcctggatgtaaagattcctttgaagacggatgaaaaccaaaatcatgaaaatgaagtgctctgtgatgtacagttccagaaaagtgtcagctcggattgtttaagctcaatggaagggatgcaaggggctgcaatgaagcctaattttctggatttccctggaatagattttggttctgcttatggaatgaggagagcatttagtgaaggagatatgaagactcttggcaatggtaatgcgagtgtcatccattctcctcttgagcaaccgataatcgtcagcagctgttctaccaaggatcgaagggaaaaactctctagatacaggaataagaagacgaagaggaactttggaaggaaaatcaagtatgcatgcaggaaggctcttgctgactgtcaaccgaggatccgtggaaggtttgcgaagactgaagaatccaacaactcaaagaggcaatagctgttgattaatcaagccagtaccaagtaaaacaggaatgaagtagctagattgaatgatgcaatgctaagaaaagaaagttttcgagtagtggtgtcaacttcgacatatataagcctttgtggagatcatcttatgacattaaaatgctaaataaaccataatccagctcctcagaaatagttccatgttatttgctgtaatcatccccactataatggaagtggccagttaggattgtacatagtgtttgttcaataaaatggcacagctgaaatttgtacttgttcatatatgtttttaaaagataagtagtttttaatgttatatgctatacgtgtttaattttttaataatatatttttaatt

SEQ ID NO: 1738 - DNA, 1306 bp, Gossypium hirsutum
tatcaacgcagagtacgatgggggcgctacttttggggactctgatttccaagagaagtgacataagagtgggggaagaaccaaagtttgtgttttgttctctctcaagaatcaaagaacattttgtgcttttgtgagtcaagaaatgtatgcagaaactgggctatttttcccttacatgcaaaaagtttctcaagaatttcaccagtttgaagagttctgcgaaacccagaaatccaatgcttcaatgaacaacatggttcagacctcagcaatatctgaatattacctgggaggcgaaggtgatctattcaaagctccggagcctatcattgaagaaccaattgtggaccttaatcccatgactgcagccatctcattaagcttttgtggtgaagatgttattacttcacaaggatttaaagctgctgatattgaatcaattcaaaacgagcagtttttagaggttctttatgagtgcgagaaggatctgatggcacgagcagtcatagaaacaccactatccgaggtcctggatgtaaagattcctttgaagacggatgaaaaccaaaatcatgaaaatgaagtgctctgtgatgtacagttccagaaaagtgtcagctcggattgtttaagctcaatggaagggatgcaaggggctgcaatgaagcctaattttctggatttccctggaatagattttggttctgcttatggaatgaggagagcatttagtgaaggagatatgaagactcttggcaatggtaatgcgagtgtcatccattctcctcttgagcaaccgataatcgtcagcagctgttctaccaaggatcgaagggaaaaactctctagatacaggaataagaagacgaagaggaactttggaaggaaaatcaagtatgcatgcaggaaggctcttgctgactgtcaaccgaggatccgtggaaggtttgcgaagactgaagaatccaacaactcaaagaggcaatagctgttgattaatcaagccagtaccaagtaaaacaggaatgaagtagctagattgaatgatgcaatgctaagaaaagaaagttttcgagtagtggtgtcaacttcgacatatataagcctttgtggagatcatcttatgacattaaaatgctaaataaaccataatccagctcctcagaaatagttccatgttatttgctgtaatcatccccactataatggaagtggccagttaggattgtacatagtgtttgttcaataaaatggcacagctgaaatttgtacttgttcatatatgtttttaaaagataagtag

SEQ ID NO: 1739 - DNA, 1174 bp, Theobroma cacao
gttcacttgagtgtacaaaataatagtctattatctaagtacggacatctagctatgctaccttaaccattatcgctcccaaagtccaaacccaaccttattcttagcccaaaaaaaggtccgacccaacccaaaccaaagtccatcttggccgttcataccaaagtgccacagacagccaataaacggttggcatttggcggtgtttccttttttaaaatttttttcccttgtctctcattggatgttttgtttttctttaatgctactttttgctttccctttctcactttcttccccgcagtcttgtcgtggcgaagtcccgctgttgttggagctctcgaaggagataataataaagaaaagaagaaaatggcgatgtgggtgtttgggtacggctctcttatttggaaagccgggtttaactatgatgatcgtcttgttggcttcatcaaagattatcgccgagtcttctaccaagggagtactgaccacagagggacgcctgagtatccaggcaggaccgtcacactggagcctgctgatggggaagtctgttggggagcggcgtacaagatatccaagaaagaagataaagaaaatgcgataatgcatttagaagtgagggagaagcagtatgacaagaaagcttatcttgatttcttcactgatcccacagctacaactccagccatttctggggtaatggtgtacatagcatctccagacaagaagcttaataagaactatttggggcctgcttctcttgaagagattgccaaacaaattattcatgctgagggcccctcaggaccaaacagagactatcttttccaactagaaaaggctcttcttcaacttggatgtaaagataaacatgtaattggtcttgcaaatgaagtgaggcgcattctttcggaaggacagctaattgcgtcatgatgcaaaaaggggggaaagggaaaagaaattaaaagagaaactcggggcagcatgatagatgtggacatcagcaccactacatggagtgacctgttcctacatgtttgctcgggattgggacgcagaaacgtagatttcatatagtgtgggatacagtcatcccaattctacaacaataaattcttctacccagattataaatagtgtggatgaatcaattttgattaatctg

SEQ ID NO: 1740 - DNA, 830 bp, Humulus lupulus
tcgagtgagagaaactagagagagaagggaagatcctgttccattactgtcatctcggggtcgagcttcgaccagaagaaacgaatcactgaaatggcgatgtgggtatttgggtacggctctctgatatggaaagccggcttcaacttcgacgaacgactcgccggtttcatcaaagattaccgccgagtcttctatcaaggcagtacggaccacagagggacaccggagtttccagggagaacggtgacgttggagcctgcggagggagaagtctgttggggagctgcctacaagattaccaagaaggaagaccaagaaattgcattgatgcatttagaagtgagggagaagcaatatgacaaaaaggcctatgttgattttttcactgagcctttggctactaccccagctgtgtcaggagtaatggtatacatcgcctctccggacaagaaagccaacgtgaactacttgggcccagcttccattgaggatattgccaaacaaatcgttcgagctgagggcccctcaggacccaatcgagactacctttttcagctcgagaaggctcttcttcaaattggatgtaaagatgaacatgtaataggtcttgcaaacgaagtgagacgaattctctccgaatcagagccaacttttgcatgatccattatcccatttctgtgaaattagaggattgcagactggattttccaagtttgcaaaatattacttctcaaaattaatttgtttagagttattgctgttgcattgaaaagaatgttaggatatagtcatgcaacatttgagtttgagtctaacactaataaatg

SEQ ID NO: 1741 - DNA, 1084 bp, Heritiera littoralis
ccctctgtccttcccacaatcttgtcgtggcaattaagtccctttcttgtgggagctccaagagataatactaaaggaaaaaagaaaatggcgatgtgggtatttgggtacggctctcttatttggaaagctgggtttaactatgatgatcgtcttgttggcttcatcaaagactatcgccgtgttttctaccaagggagtactgaccacagagggacgcctgagtaccctgggagaactgtcacattggagcctgctcatggcgaagtctgttggggtgctgcttacaagatatccgagaaagaagataaagaaactgcactgacgtatttggaagtgagggagaagcagtatgaccagaaagcctatgttgatttcttcactgatcccacagctacaactccggccgtttctggagtaatggtgtacataggatctgctgacaagaagcttaatgagaattatttggggcctgctcctgttgaagagattgccgaacaaattgttcatgctgaaggcccttcaggaccaaacagagaataccttttccaattagaaaatgctcttctgcaaattggatgtaaagataaacatgtaatggatcttgcaaaggaggttaggcgaattctttcagaaaggaagtgaactttgtcatggtgcgaaaatggggtaagtgaaaatgaattaaaatgagaaactcggggctgcattattgatgcaggcatcagcagcactacatagagtcacatgtcctacttgtttggtctgcattgggacgcagaaacatagatttcttatagtgtgggatacagtcatcccaattctacaataataaaccccagtccacagccaaacagtgtccagaaaaggatgttgccatattcttgtcatttcattcatccggagatttccctattgaacctgattgctcttgatgacgatgtcaagggcttttcattatttaaagctatcttaacgtttcatggtctcccatgagaatgagggattttgtttttgaagcttattaagttatcagcggcttctcggttgtgcttgaatagtagtggtgagtcatcctccatat

SEQ ID NO: 1742 - DNA, 1173 bp, Carica papaya
ctccgattctctctctctctctgcaccttctaccgcgaaacagagaaaaagccgagaaggccagaggaagagagggaaatggttatgtgggtgtttggatatggttctcttatatggaaagccggtttcaactacgatgagcgcctcgttggtttcatcaaggggtaccgccgtgtcttctatcaaggaagcaccgatcacagaggaacaatcgattatccaggaagaacagtcacattgattcctgcagatggggaagtctgttggggagctgcctacaagatttctaagaaggaagataaagaaactgcattcacgtatttagaagtgagagaaaaacagtatgacaaaaaggcttatcttgacttcttcactgagcctaatgcatcaactccagcaatttcaggagtcatggtatacatagcatctcctgacaagaagctcaacaaaaattatctagggccagcatctcttgaagatattgccaatcaaattgttaacgccgaaggcccctctggacccaacagagactaccttttccaacttgaaaaggctctcgttcaatcgggatgtaaagataaacatgttatagatctcgctaatgaagtaaggcgtattctcttggagagagaaaatactggttcatgatcctacagtttacagaaaattagatcaagttaccgtcatactaagcctcagtttattccccgaggcaatctattgaatcattatcttctgatggagagtccatttcactaagccaacttttaggttaatagttattgtctctgaccggaaggtatacctctgaatctggagcttgagaaggctgattctattgtttaaggttgaagatcattgcattcttatgcccttacatggaccaacatttctgggctgtatcaaaacaatgtattaccaccatgattggtgttaccaagggtgctttaatgctacaccccttaaaatacatccgaggactgtaaaactcaaaaaatattttttatctttcattaaaaaagtaataggtgtatactggatgttttcttttagaagacagttttaacgaaattatttttatttttgtcagaccaaaaaattgtacttgtttcttcagaaaaggacttttccctgtaaaaaccagtgaatttcctacttgttccctgatctgca

SEQ ID NO: 1743 - DNA, 1353 bp, Quercus alba
aacaaagccacaggcctaactgtatttcttaaaaacatcttctcttgtcctctgttgtctgcattggtagcaaacacaaactcctcttctgacttctcttctcttgtcctctgtaaaaaaagtctgtacctttgcgctaccaaactcaaacgaactatcatctctctctctctctctctcctttcattgtccattgtttttgggagagagagaaagcaagcagagagacgaagagtttgtattataactttgaaggacttttggaaagcaaaggaattaagtgagactttgagagatgtgggtgtttggttatggttctcttatatggaaagctggctttaactacgaccagcgcctcgttggtttcatcaaagactaccgccgtgtcttttatcaaggtagtactgaccacagagggacactcgattatccaggaagaactgtgacattggagcctgctgaaggggaagtttgttggggagctgcctacaaggtctctaagaaggaagatcaagaagttgcactaacgtatcttgaagtgagggagaaacagtatgaccagaaggcttatcttgatttcttcactgaacctactgctacgagtccagctgtttctggaataatggtgtacattgcatctccagacaagaagcttaacaggaattacttgggacctgcttctcttgaagatattgccaaacaaatcgttcatgctgaaggcccgtcgggacccaacagagaatacctttttcaacttgaaaaggctcttctgcaaattggatgtaaagacgaacatgtaatggatcttgcaaatgaagtgaggggtatcctttcccagggggaactgactgcttcatgatgtcatgataattggcaaaaaggttttatgaattggagcaatcttcaggattatctgctgaagatactaaacatttttttttttgatgagttgagaatcacttcttacatttagtttaaaggcaactgtattgtgaaaccatcattctcattgtaaacccttgttaatattgggtttctatgtcaatttcaagagttatgccaagtgttaacctcttgagactccactgtagcatgagcatgaacttccaccaaaaccaaggttcctcatgtaatggtcatgcataccctggcgcttctacattcccttgtagccaattgttgtaagattcgatcttatacttgactgtaatgtttcacagaatatgtttgtattgaagtccaatctttgctgaatttgcattgctaaattcagtattgttagaaaaataaaaaaaaaaaagtaaactctagcgttagataccactgcttaactctgcgttgaataccactgct

SEQ ID NO: 1744 - DNA, 600 bp, Manihot esculenta
cttcatcctgtggagggagatgtgggtatttgggtacgggtctctaatatggaaagcgggttttaactacgatgctcgccttgttggtttcatcaaaggctatcgccgtgtcttctaccaaggcagcactgaccatagggggactccagagaatcctggaagaactgtcactctagaacctgctgatggggaagtctgttggggagttgcatacaagatctccaagaaggaagatgaagaaactgcaataacatatttggaagtgagggagaagcagtatgatcagaaagcttatcttgatttcttcactgatcccacagctacaactccagcggtttcaggagtaatggtatatataggatcatcagacaagaagcataaccaaaattacttggggcctgcacctcttgaagagatagccaaacaaattgttcatgctgaaggcccttcaggacccaatagagactaccttttccaacttgagaaggctcttcttcaaattggatgcaaggacaaacacataatggatcttgcaaatgaagtgaggcgcattctttcagagagggaacctgaccttataatgccatgaataacaggctg

SEQ ID NO: 1745 - DNA, 854 bp, Humulus lupulus
ccacttcgagtgagagaaactagagagagaagggaagatcctgttccattactgtcatctcgggttcgagcttcgaccagaagaaacgaatcactgaaatggcgatgtgggtatttgggtacggctctctgatatggaaagccggcttcaacttcgacgaacgactcaccggttccatcaaaggttaccgccgagtcttctatcaaggcagtacggaccacagagggacaacggagtttccagggagaacggtaacgttggagcctgcggagggagaagtctgttggggagctgcctacaagattaccaagaaggaagaccaagaaattgcattgacgcatttagaagtgagggagaagcaatatgacaaaaaggcctatgttgattttttcactgagcctatggctgctaccccagctgtgtcaggagtaatggtatacatcgcctcgccggacaagaaagccaacgtgaactacttgggcccagcttccattgaggatattgccaaacaaatcgttcgagctgagggcccctcaggacccaatagagactacctttttcagctcgagaaggctcttcttcaaattggatgtaaagatgaacatgtaataggtcttgcaaacgaagtgagacgaatcctctcggaatcaaagcagccttttgcatgatccatactcccatttctgtgaaattagaggattgcagactggattttccaagtttgcaaaatattacttctcaaaattaatttgtttagagttattgctgttgcattgaaaagaatgttaggatacagccatgcaacatttgagtttgagtctaacactaataaatgtagaaaaagaaaaaaaagc

SEQ ID NO: 1746 - DNA, 936 bp, Fragaria vesca
ctgtaagatttctgatcggaaaagcatcaaagctcaaaatggtgatgtgggtatttggttatggctctctgatatggaaggccgggtttaacttcgatgaacgcgtcgttggtttcatcaaagactatcgccgtgtcttctaccaaggcagtactgaccatagagggacacccgagtttccaggaagaacagtcacattggaacctgcagagggtgaagtctgttggggagctgcctacaagatcagcaagaaggaagatcaggaaattgctttagagcacttagaagtgagggagaagcagtatgacaagaaggcttatcttgatttctttactgagccaacggctacgactccagctctttcaggagtaatggtatacattgcctctccagacaaaaagcgtaatgtgaactacttgggtcctgcatcaattgaagatattgccaaacagattgttgaggcaaaaggcccctcaggacctaatagagagtacctctttaaactcgaagaggcccttcttcaaattggatacaaagacaaacatgtattggatcttgcaaacgaagtgaggcgcatcatttcagaaagggatatggagctcactgctttatgacccgggaacaaataggaacaatgattattacaggccatcatccaacagagcaattggtcatgtacttgtcttggagaaaacactatatgtggttgtgtagcatctcgatttcttatgatggcactgcgaaattcttaatgtcattcttgattgttatgcatgtaacaagagtcatcgcattagtctgatgacactcatgacagtaaagagtcaggatgagatgtatgaacatattcaactgtatgttgcaggggctcattgccttgtcagcttctcgtatagactacccgactttggtaatgcatgtacttctttcgctagc

SEQ ID NO: 1747 - DNA, 785 bp, Euonymus alatus
ttttcttggtgctactttctctctccttgctgcatcgtctagagagagaaagagaggggaaatggtgatgtgggtattcgggtacgggtctctaatatggaaagctgggtttgactacgacgatcgacttattggtttcatcaaaggctatcgtcgtgtcttctaccaaggtagtactgaccacagaggcacacccgagtatccaggaagaacggtgactttggagcccgccgaaggggaagtctgttgggggattgcctacaagataaccaagaaagaagacaaagaaactgcattcacatatttagaagtgagggagaagcagtatgacatgaaggcttatcttgattttttcactgagccttcagctacgactccagcagttacaggagtactggtatacatagcatctccagacaagaagctgaacaagaactacttgggtccagaatctcttgaagagattgccaagcaaattgtctgtgctcaaggtccctcagggcccaatagagactaccttttccaacttgaaaaatatcttcttcaaattggatgcaaggacaaacatgttatggatcttgccaatgaggtgaggcgcatcatttcagatggtgagcaacaagaacaatagacaaagcatcatcattacttgtattgatacattctttcaattagtatttggatatttacttttctaaccggttgaaagcagtaatataggctgaactatgtagctttgacagtttatattgcagtctaaagatttctggagtactgattcagcc

SEQ ID NO: 1748 - DNA, 936 bp, Actinidia deliciosa
  misc_feature (735)..(735): n is a, c, g, or t
  misc_feature (802)..(802): n is a, c, g, or t
ctgaattgagaatctctctctctctctctctggtgactggtttcagagagggagagggaaatttctgttaatcggttaatcccacccctattattcgtaaaaaaactcaaaaagagtgggaaatttccaaaaatggtgatgtgggtatttgggtacggctctctaatttggaaagcaggctttcactacgatgatcgcctcttcggattcatcaaaggctatcgccgtgtcttctaccaaggtagtactgaccacagagggactcaggagtacccaggaagaacagtcactttggaggctgcagagagagaggtttgttggggagttgcctacaagatctcaaggatggaagatgaacaaattgcgctaacgtatttagaagtaagggagaagcaatatgacaagaaggcctatattgatttcttcactgacccaatggctttgacaccagctgtgtctggtgtaatggtatatatagcgtctccggacaggaagctcaacccaaactacctaggccctgcatcaattgaagaaattgccaagcaaattgttcgtgcagaaggcccctcaggacccaacagagactacctttttcaacttgaaaaggccctcattcaatatggatgcgaggacaagcatgtaatgggtcttgcaaatgaagtgaggcgtgtcctttcagagatggagcttattttttcgtgaccccgtgaaacacgaggcatgaaaatctttgcnattcaaggattcttctaattatttggaaatggagaaatattgttgcgacttgaacttgcgtatcacngggttatatatgaaaacgccccgtaacattttgtaaacttgtgagagttggctattcttattgtacgagcgtagcaatacttgcttaaatagacttcatctaatagaagatggtgcatggtatggcaccttcat

SEQ ID NO: 1749 - DNA, 673 bp, Prunus persica
agcttttctctagagaagagaagacccaactcactgtggcccactccggttgtggaggaagtgaagagttgagaaagaaattggattggaaaagctcaaaaatgatgtgggtatttgggtatggctctcttatctggaaggctggttttaactacgatgagcgcctcgtcggcttcatcaaaggctatcgccgtgtcttctaccaaggcagtacggaccacagagggacgcctgagtatccaggaagaacagtgacattggaacctgcagagggagaagtttgttggggagttgcctacaggatctcaaataaggaagatcaagaagttgctttaacgtatttagaagtgagggagaagcagtatgacaagaaggcttatcttgatttcttcaccgagccaaatgctacaactccagctgtttcagatgtaatggtatacattgcctctccagacaagaaacataatgtgaactatttgggccctgcatccattgaagagattgccaaacaaattattcaagctgaaggcccctcagggcctaatagagactacctgttccaacttgaagaggcccttcttcaatttggatgcaaagacgctcatgtaatggatcttgcaagcgaagtgaggcgcatcctttcagagagggagctgacttcaacatgaagcca

SEQ ID NO: 1750 - DNA, 907 bp, Malus domestica
aaaaacaaggttgcatcagcgctttacctaactcgctgtagtccacttctcctcctgctgtggaggaagtgacgagctgaggagaattttgatcggaatagctcaaaaatggctatatcgccgatatgggtatttgggtatggctctcttatctggaaggctggttttaactacgatgagcgcctggtcggcttcatcaaaggctatcgccgtgtcttctaccaaggcagtacggaccatagagggacgcctgaatatccaggaagaacagtcacattggaacctgcagaaggagaagtctgttggggagttgcctacaagatctcaaacaaggaagatcaagaagttgctataacgtatttagaagtgagggagaagcagtatgacaagaaggcttatcttgatttcttcaccgatccaatggcgacaactgcagctgtttcaggtgtaatggtatacatcgcctctccggacaagaaacataatgtgaactacttgggtcctgcatccactgaagagatttccaaacaaattgttcaggctgaaggcccctcggggcctaatagagactaccttttccgccttgaagaggcacttcttcaactaggatgcaaggacaaacatgtattggatcttgcaaacgaagtgaggcgcatcctgtcggagagggagctgacttcagcatgaggccaataagctttatgattttacaggtcccccggcataacagttatatgaatctgttaccagaacatgtagtccgataaaacattgtttcgcctttcgatttattttggatggcactttgatgtccatcatcaacaattactcatttgtaaactcttgttcatgttgaattagtctgcatgacgagagactcaattagttgggcgactggtttagcttg

SEQ ID NO: 1751 - DNA, 1044 bp, Populus trichocarpa
attaagcccatccagtaaaatggatccaatttatcctcagacgcaagattttattggatccgatatccaccaaacagccctcatcccatttgctctagttgctcaacaattggatcattttgcttcgcgaatttctctctcgatctccctccttgctgtgtgttctagagagaggaagttagagagaggcagaacgaaaagggaaaaaatggcgatgtgggtatttggatatgggtctctaatatggaaagcaggctttaactacgatgatcgtgtcgttggtttaatcaaaggatatcgccgtgtattttaccaaggcagcactgaccatagaggcacaccagagtatccaggaaggactgtgactttagaacctgctgatggggaagtctgttggggagttgcatataagatttccaagaaagaagatcaagaagtagctctgacgtatttagaagtaagagagaaacagtatgatgagaaggcatatcttgattttttcactgatcctgctgctacaactccagcagtttcaggagtaatggtatatataggatctccagacaagagacataatcaaaactatttggggcctgcacctctcgaagagatagccaaacagattttttatgctgaaggcccctcaggacccaacagagactacctcttccaccttgaatcggctcttcttcaaattggatgtaaagacaagcatgtaattgatcttgcaaatgaagtgaggcgcattcgtccagagacagggctggctgattcctgatgccctggataacaggcttcaagatttacttgttaattgaatcagcgcggttttttgtagccaactttcccagagaaaagatgttgataaatatgaagttatgaacaacaggcataaaaataccatgccgtccttggatttttgccgttaagatggttaaagatccatgtattcctcgaattggagcaatcattgtttgcggccaagaaacatctatgggactcgattatttaaatgaattgagttttagagccatttctcgtggg

SEQ ID NO: 1752 - DNA, 1026 bp, Malus domestica
tatttacccgtaagacaaaaacaaggttgcatcagcgctttacctaactcgctgtagtccacttctcctcctgctgtggaggaagtgacgagctgaggagaattttgatcggaatagctcaaaaatggctatatcgccgatatgggtatttgggtatggctctcttatctggaaggctggttttaactacgatgagcgcctggtcggcttcatcaaaggctatcgccgtgtcttctaccaaggcagtacggaccatagagggacgcctgaatatccaggaagaacagtcacattggaacctgcagaaggagaagtctgttggggagttgcctacaagatctcaaacaaggaagatcaagaagttgctataacgtatttagaagtgagggagaagcagtatgacaagaaggcttatcttgatttcttcaccgatccaatggcgacaactgcagctgtttcaggtgtaatggtatacatcgcctctccggacaagaaacataatgtgaactacttgggtcctgcatccactgaagagatttccaaacaaattgttcaggctgaaggcccctcggggcctaatagagactaccttttccgccttgaagaggcacttcttcaactaggatgcaaggacagacatgtattggatcttgcaaacgaagtgaggcgcatcctgtcggagagggagctgacttcagcatgaggccaataagctttatgattttacaggtcccccggcataacagttatatgaatctgttaccagaacatgtagtccgataaaacattgtttcgcctttcgatttattttggatggcactttgatgtccatcatcaacaattactcatttgtaaactcttgttcatgttgaattagtctgcatgacgagagactcaattagttgggcgactggtttagcttgaaggttccgctggacaatgagaacgagcttgtcccgttcaatgctggcatcgtggttcgccattgagtgtaaattgacgtggatatttgactaaattcaggta

SEQ ID NO: 1753 - DNA, 982 bp, Ricinus communis
gagttattcttccaaactgcctctgtctgcttcatacttcgtacttcctacctacagtaaagtataaagagacaagaccggaaaatggtgatgtgggtttttgggtatgggtccttgatatggaaagcaggctttaactatgatgatcgccttgttggtttcatcaaaggctatcgccgcgtcttctatcaaggcagcactgatcatagagggactcctgagtatcctggaagaactgtcactttattacctgctgatggagaagtctgttggggagttgcatataagatctcggataaggaagatgaggaaactgcactaacgtatctggaagtgagggagaggcagtatgatcagaaggcttatcttgatttcttcgctgatcctgcagctacaactccagctgtttcaagagttatggtatacataggatcggaagacaagaagcataataaaaattacttggggcctgcacctcttgaagacattgccaaacaaatcatccgtgcagaaggcccttcaggacccaatagagactaccttttccatcttgagacggcccttcttcaaattggatgcaaggacaagcatgtaatggatcttgcaaatgaagtgaggcgcatgctttcagatgagcaaaaagagccgacttcgtaatgcttctgtgggcataaagattcttcatattccttgaacaggcgcaatcatggaaattgtttgcagttcaagatacattgctggaacagcagtcatctaaaatccattttatcttgatttgaaacaaagatcaagagtcacccaggctgacattagatagctttttagtacgctaggatttgcatcagaagatgccacttaattactgctatggggcttaatgttttttgtatctttgaaatgtaattcgcatttatataaacacccatctgcagaaacattcacaactgtggctctggaatctaataaaaagaccttttgaagt

SEQ ID NO: 1754 - DNA, 1166 bp, Eucalyptus grandis
ggaacatcgggttgttctacgcgaagtttttctgcgaggctagcgcaacgacagggattggccgacattacaatctgatctttccaacagaaattacccttttggcatctgcaactgtaactgcaactgagagagagagacagagagatctgcaacagcaactgaaactctgagagagagagagagagagagagagagatggtgatgtgggtgttcgggtacggctctctcatatggaaagctgggttccactacgacgatcgcctcgtgggtttcatcaaaggctatcgtcgggtgttctatcaagggagtactgatcatagaggcacgccggagtttccgggacggaccgtcactctggagcctgcagagggagaattctgctggggagttgcgtacagaatttctgatgagcaagataaaagaactgcaataacgtatctcgaagtaagggagaagcaatatgatcagaaagcttctctcgactttttcactgacccagctgctgtaactccggctgtatctggagtaatggtatacattggttctccagataagaagatcaacatgaattatttgggccctgcacctcttgaagacattgctagacagatagtgctcgccgaaggaccgtcaggaccaaacagggattatcttttccaattagagaaggctcttcttcaaatagggtgtgaggataagcatataaaggatcttgcagatgaagtgagacgtctcctatcagagaggaaactgaaaggagaagaagtatgaagcatcttggctattcttccaaattactagagaagcccttcaacacacattgacgttgccgaagttatagacttggtcatacagtcgagtacttttattcggccattgttcagattttgatggtgttgatttcatctattcttttgcttgatcgccgttataaaactttaattagttgtcttccgcattcctgcccggtctgagcactgtcgcgagtttcgcaatgagaagcaacgcagagttcatgggcgacttatcgattttggttgcatgtgtcactatagtaggagaatcatagaaagaatcgacattaacgactctccaacatgtaaactgtttgaatcagatacaatgacgcaagacccaaaaagagccagggtgcaactcttttt

SEQ ID NO: 1755 - DNA, 636 bp, Euphorbia peplus
gtggagaatggtgatgtgggtattcgggtacgggtctctaatatggaaagcgggttttaattttgatgatcgactcgttggtttcatcaaaggctatcgccgactcttctatcaaggcagcactgatcatagagggactccagaatatcctggtagaactgtcactttagagcctgctgatggtgaaatctgttggggagctgcatacaagatttccaacaaagaagatgaagaaactgcacttacgtacttggaagtgagggaaaagcagtatgatgagaaggcttatgttgatttctacactgaatctacagcaacggctccggctattacaggagtaatggtatatataggatcatcagacaagaagcagaatccaaattacttgggtcctgcacctcttgaagacatagccaaacaaatagtcaatgctgaaggtccctcaggacctaatagagattatctttttcaactcgacatggcccttcatcaaattggatgcaaggataggcatgtgattgatctcgctaatgaagtgcgacgtattctttcagacgaggagcaaaaatagttggcttcttgatgtaacgagcatacaagattcctgatattcagaactagatttaatttttgaca

SEQ ID NO: 1756 - DNA, 2991 bp, Gossypium hirsutum
aagaaaacttaattgcttacgatcgatggaacattatgaagaggttgaagatcaattcattgctcattaaaatttaaagttagctgaaaatgttgccaatggtgttgctgacatccaccaagcatcaaggctttttccacgacaaccaatgtagacctccttggggactgatttcgaagctgtctcaactctcaccagctactaccttgaagattcttgattcggcatcagagtctaaggctgtgttcttcattgcttaagaaacgagcttttacttggaaaagtgcttttctttgaaaagcaatgaagaacaaccttcgtttgctagcaaattctcagaagttgagaagtgtttttggccagatggagaagtaaaaattttagcttttcagccaaaaagtacttttgggctggttcatttacttttttagccacacacgaacccccttctttgctctctgctctctactggttctttgccctcatctctgccctctgctggttctttgttcctctgccctcttccggtgagtttgcggcagaccgaagagagttaccaattgcagttggcgctggctttgcgggtttcttcgctggttgcttctgctgctgattccaacttcttggatttcaattctgacgttaacaccaacagagtttcctcatcctcatcctcttcttcttcttcaccacatcatgtgtctcatcgattctgggtaaatggcattctatcttactttgatagacttccagatggattttaccaagtcaatgggatggatccttatgcatggactataagtgctgatcaaggagagattggcctgatgccctccatcgagtcattgagggccattgatccgcatgctgatttgtctattactgttgttctgattgatagattaagggatcctagtttgaaggaacttcaaaattgggttctcaaaatatctagcagctggatcagcacaaaagatgcaattaatcagcttgcatgtcttgtctgtaaccgaatggggggtgcagcttcttctgaagaagatgtttatagccaatggaaggagtgcaccgaagttctgaaaaactgctcaggctctatcgtatttccaattggaagcctatctgttggcctttgcgtccatcgtgtgttactgtttaagatattagcagacttggttaatctaccatgtcgcatcacaaagggttgcaaatattgcaggagggaagatgcttcatcctgtcttgtgcagttgggtcctgacagggaatatttggttgatttgtttgaggagccaggagccttaagtcagcctgattcctcactcaatggtacttcacaattttagtttcttcaccgctgtgtcatccaagatttaaaccggttgagattgctacaaacatcaagacattggccaaactctatttcattgatgatcaatcccataaacatgcttgccttgatgcttcctcagacaatgctagcaatcaaaatgagcaaactggtccacagcctaggaaagcatttgatagaaactactttaacaagaacaaccccttttccaccttaagcaacaacaaagaatcttctctttcacctctgcaccagagcactttgtggaatattggctgtgataaagatcttcagatgctgaactcttcaaaattgttcccaaaagccatcaactcaacacacttgatcagaagtcctcctctgccaagttctgttacttctcacatgcacaaagatgtttatcaagcttttccatactcagatccaatgcaatgtactattaacttcaagcaatcagatgatccagtaatgagctttgaccaggaagatctaaatattccttggagcgaacttgttttaaaagagagaattggagcaggttcttttggaactgttcatcgggctgaatttcgtggttgcgaagttgctgtcaaaattctcatggagcaagattttcatatagaacgcttcagggaatttttacgggaggtttccatcatgaaatgtttacggcaccctaacattgttctgtttatgggtgctgttactcaaccaccaaagttgtccattgttactgaatatttgtcaagacggagtctctttcgacttttgcagatgcctgatgcttggaaggttttaaatgagaagcttcgcttgaacatggcattggatgtggcaaggggaatgaattatcttcatcaacttaagcctcccattgttcatcgggacttgaaatccccaaatcttttggtagacagtaattatacggttaaagtctgtgattttggtctttcacgttctaaggcaaatacatttctttcatcgaaaacagctgccggaacaccggagtggatggcacctgaagttctatgcaatgagaattcaaatgagaaatccgatgtttatagctttggagtggttctgtgggaacttatgacactccagcaaccatggaagcatttaaacccaccacaggttgtggcggctgtaggtttcaaaggtgaaaggcttgagatcccaagccatgtaaaccgagttgtagcttccttgattgaacagtgttgggctcgtgaggcttctgaacgccctcccttctcccatgtcattcaatgtttgcagcaagtcatccaaaatactgcatctcaagaacttaatggactgagtctttgatccacaacatatatgggtatgtccaatttttcatgcaaatatatgaaaactttagacaaaattcaacataattgtattaacgcatatccatattaaagacttgccctaatccaaatcacatgggtgatatcctcctaattatcaatttttattttaaaatatcatcaaacatctttgataggattagttcattaaataaggttgaatgcatgtagtcttgggagcaaatgtgcgattcttctaaatgttatttcgattaaaaagaattagtataatataatttattatttgctagtagctgacctgcgcgg

SEQ ID NO: 1757 - DNA, 1521 bp, Gossypium hirsutum
taggctgatatctttttccatttctcccactataaatatctaacctaaccgcacagttgttcttaaaccctcctccttctctgccatttcgaaaaccttatcttttgagaacgaagtttaaaggaaccacaccagccatgtctgcaacatctgcctcatctcttattctcccatcgctcaaacccaaagttttatctttatccgactcaactcccaattcactttccctcttctccctttctccaaccccccatgcaaagcctctcttttgttctgctcttccaagtttccagcttttaaccaaaaagtcctctttttcttccaggttccttacaaaagttgccgtttcttctgagtatgaccaggaagaggacttatttggcagcgatgatgaagaaaggtctcctactttctcccctgacttgaaactttttgtgggtaatcttccttttactgtggatagtgctcagcttgcgggtttatttgaaaacgccggaaacgttgagatggttgaggtgatttacgacaaggtaactaggagaagtaggggatttggatttgtaaccatgtccacaatcgaggaagtcgaagctgctactcaacagttcaatggctatgaattggaagggagagcattgagagtaaactcaggacctcctcctcctcgtagggaagaattttctcctaggggagcaagaggtggtccttcgatgggagcaaggggtggtcctccgatgggagcaaggggtggtcctcctatgggagcaagaggtggtcctcctatgggagcttcaaatcgtgtctatgttggtaacctttcatggggtgttgatgatatagcactcgagaccttgttcagtgagcaaggcagggttgtggaagcaaaagtcgtttatgacagggaaagcggtagatcaaggggttttggctttgtaacttacagatctgccgatgaggtcaacagtgccattaaatccttgaatggttgtgatttggatggaagaccaattcgggtcactgtagcagagtctaggccaaggcgccaattttgagtgcggatatttcctactgatgctgctaaaattctttggggacgcctaagatatgcagccggaagctggcaactgcagtattttcctgttcgtgggattctgctcggctgcatttggacgttatggttgatctggctgctttttacactaggaaaagctgataatatccatttaaatgtttttattgtatgtttcaagtatcttatgattgggtgactgacaatgtagcctaatgtttcgcctcgttggatatagttgcttcaaattattgacatgtttggctcccttgtacaaccttgtggtggaagaaggcctttttatgtttgttgcagtcgaggcaaaagccggtcctagattatttatttgagagtttcatttcatgctcgaggctcatttttgtcatcccgtggagtagtcaccattggtagcgtcgcctgggctctttacaataaggccttttaactggaac

SEQ ID NO: 1758 - DNA, 1062 bp, Gossypium hirsutum
gatgggtgaggagcagcagagaattcagattcctagaatcaaactgggaactcaaggacttgaggtttcaaagttggggtttggctgtatgggtctcactggaggttacagttgtccagtctctgaagaagttgggatatcgattatcaagcatgcattccacagaggaatcactttctttgatacatctgatatctatggacccaaaactaatgaaattttggttggaaaggcattgaagcagctaccaagagagaaggtacagttagccacaaagttcggtttcgaaaaactggattcaactggtatcaaaataaacggtacacctgaatatgtccgtgcctctatcgaggctagcctaaagcgcctagatgtggactatatagatctctactaccagcacagagttgacaccaacactcctatagaggatactatgtctgaactcaagaagttagtggaagaggggaaaattaagtacataggtttatctgaagctagccctgaaactataaagagagcacatgcggttcatcctataagtgctttccagacagagtggtcgctgtggactcgtgatatcgaggatgaaatagtccccctttgcagggaacttggaattgggattgttccttatagccctcttggtcgcggtttctttggtggcaaaggagtggtggaaactgtgcctgcaaatagtcatctgctatatttcccaaggtttcaaggagaaaacttggacagaaacaagatgttgtatttgaaagtggagaagttggctgagaagcatggatgtagccctgcacaattagcacttgcctgggttcttcatcaaggggatgatgtagcaccgattcccggaacaacaaagataaaaaatctggatagtaacattgattcagtaaaagtaaagctcacagcagaagatttgaaagaaatttctgatgcggttccgataaatgaggtagcaggtgatgttttgcctgatagatttagtcaattacactggaagtttggtaatacaccaccaaaggggagcaaggtttcaacctgaaaaaccat

SEQ ID NO: 1759 - DNA, 1398 bp, Gossypium hirsutum
catctgctaaatctcttatacttgctgattttttagctgtacgcaaacaagaaaagacctcagttcatttacacaagaaagtccaaaaaaaagaatgggtgaggagcagcagagaattcagattcctagagtcaaactgggaactcaaggacttgaggtttcaaagttggggtttggatgtatggggctcactggagtttacaatgatcctgtccctgaggaaattggcatatcgattatcaagcatgcattccatagaggaatcactttctttgatacatctgatttttatggacccaaaactaatgaaattttgattggaaaggcattgaagcatctaccaagagagaaggtacagttagccacaaagtttggaatcgaaaatatggattcgactggtttcatagtaaatggtactccccaatatgtccgtacctgtattgaagctagcctgaagcgccttgatgtagactatattgatctttactaccagcacagggttgacaccaacactccaatagaggatactatgtctgaactcaagaagctggtcgaagaagggaaaataaagtacataggtttatctgaagctagccctgaaactataaagagagcacatgcagtacatcccataactgctttacagatggagtggtcactgtggactcgtgatatcgaggatgaaatagtacctctttgcagggaacttggaattggcattgttccgtattcccctctcggtggcggtttctttgccggaagaggagtgatggaaactgttcctgcaaatagtatgctgacatatatctcaagatttcaaggagaaaacttggacaaaaataagatgttatatttgaaaaccgagaagttggccaagaagcatggatgtacctctgcacaagtagcacttgcctgggtccttcatcaaggggatgatgtagcaccgcttcccggaacaaccaagataaaaaatctggatagtaacattggttcactaaaagtaaagctcacagcagaagatttgaaagaaatttcggatgcagttccgataaatgaggtagcaggtaatcctatgccagatattttaagtcgattcagttggaagtttagcaatacaccaccaaaggggagcaaggtttcaacttgaaacaaccatggatgcaaagtctgcagcaaaatctgcggttggggtaaatggactctgcaacaactgaaactattgaaaaactagatgtttgtatcaataacttagtaagctttggttatataggagtggttcagttagataagaagagtgcattaccaaaataaaacaaataagcagggttgtatgattttgctgtatgtggtttgtagctagtgatcatctttggaaatgaaacaagttgtttatcacct

SEQ ID NO: 1760 - DNA, 1215 bp, Gossypium hirsutum
tgctgttttatgttgagctgaagcaaccctacctcttgactttccttctttctataaataaaccaaatttcaacaatcttacccaaactcaaacgaaaccttatcaacaaaactaacccaaaaaaacttctgttgttgtcttcaatggtactcttggtacaaaggcttagtaaattataccacaagctggaaaatcactaccaccaccaccaccaccaccaagcagaggttgatgctttgtcagcttctctacaggcttttcggtctgatgtttcgaattgtgtgaatcagttgttgcatccaaaacctggttcagaaatcttgtctttttcatggattcagcgatgttttgagttacttcctgttatcaacaaggcgtttctgaagctggttggggatatagactaccccatgagctgctgggatgttgcttccctcgatgagtatcttaactacggcttgcatttactggagcttctcaactgtgttacttcttctctttctcacttggcacaggctcggctttcctttgctcatgctttgaaccttgtggagagttcaccttctacggcgattgaacatctcaaagcaatccagtcccaaagttcaagcaaggacttaaagggactggtgagaaacaaggaaggtggtgaggggaaattgtcttcttgcaaggaaagggtagtccatgaagctttgatggaggtaaagagtgttgggttatgggtatttggggttgttttggctaccttgtctggagagaccaaaccatacttggagatcaaacaagtgattgtcaggttcaattctgctttgttaattgatgtagattcatgtgtttttaaggttatggtggagaaaggtgagacattaaaagaggttaaggagctgaacagtgcagcaaattccctagtatcagcaatcctttctgggaaaaccagtgttgcagccatggatttcggtggaaagttaggtgttttcgagaaggagatggatgctttagaaaagcaagtggatgccctgttttcgagtgtattggcagccagaaatgaactgcttaacggtgttcggcaacgcaagcaataacatcaaatccccagtttcttatgtaaatagaagaaaaaatatgcacatacagatttgtgtgacattttttttatatattgtatcttcaaaattattaatggaaatagaacagtttttcttgctaaaaaa

SEQ ID NO: 1761 - DNA, 2071 bp, Gossypium hirsutum
gtgggtttgacgtgtacaatgatgcctgtctgttagacgatttggttcaatgattgcgcttttaaaaccggaacccgaaactcttcttccatatcttcaatttgtttttgcagaaataatttttccagggggcttggatagctgagtatcaaagaggaagaaaaagagtttattgagctgaatatagatatatagtcattcacttcagctcaaagaaccaagtatggctgcagagtatagagagcccctgttaaagaagaagtactataagaactgccctggatgtaaggttgatgaaatgaaggaattggagcaaggcctcccaattcggccactgctttccatatggattattgtcttatgcactgctctgccgatatcatctctctttcctttcctatacttcatgataagggactttcatattgctgaaagagaggaagatattggctcctatgctggttatgtgggatctgcatttatgcttggaagagctttaacatccgtatcatggggaatatttgccgatcgttatggtcgaaagcctgtaataattatgggaactacttcagtggttattttcaacaccctttttggccttagtgtaaatttttggatggctgtaattacaagatttcttcttggaagtttgaatggcttacttggaccaataaaggcatatgcagtcgaaatttttcgagacgaataccaagcattaggcctatcaaccgttagcacagcttggggcataggattgatcattggccctgctctgggaggttttctagctcagccagctgagaagtatccaaatctcttttccagagattcattgtttggaagatttccatatttcttaccatgcttggccatatcaatttttgccttggcagtaaccattgctacctgctggcttccggaaacacttcataaacacaatgacaatgatcaatcatctgatgattcatacgatgctttggaagctgcatctaatgaatctaacacaaaagatataacagaaaaggaggaaggaagagaatccacttctaagcaaagcctcctaaagaattggcctttaatgtcatctatcattgtctattgtgttttctcccttcatgatatggcctacacagagatattttctctatgggctgttagccctagaaagtatggaggcttgagttattcgacggagcaagtcggggaagttcttgcagtctcaggtttcagccttcttgtctttcaaatgtccctatatccatttgtagagaggcttcttggacctgtaatggtgtctcggattggaagtatcttagccatacctctcttgcaaagttatccttggatagccatgttatctggcttcactcttaccttggtgataaactgtgcatcagtcctcaagaatgttctatcagtatcggtcataaccggattattcattctgcaaaatcgagctgtggaccagcaccaaagaggagctgctaatggcattgccatgactggaatgtctcttttcaaagcagttggccctgcaggaggtggtgcattgttttcttggtcggaaaagcgcctagacgcttcatttctgccaggtactcagatggtatttttcgtcttgaatatagttgaggcagttggatttttgttgacattcgaaccatttctagctcaacataggcaataaaacaagggatcccaaaggttgggataatgatcttttattttattttaagaatgcaaaaaagaagagaatactccaaaggcttaaatcttggtcaacaaagtatccagataccagctatgtcactcgggttcttaattctttttgaatattcatgtacgacactatgttaaatataggtatgaaaataacagccccccaaaaaatgaacacacctatgtcaagtcaaggcatatttgtatcgagtacttaccactgaatctgaataacgtagcttatgagtatatttattcttgtctattgatgatatttagtcatttattgctcccaacaaggttttggcaaaatgtgattgcttttaatataaagactgtttagcagtttttg

SEQ ID NO: 1762 - DNA, 4211 bp, Theobroma cacao
aattttctgcaaggtgatcttaataacgaaaaactattttcttcaatttattgaacacaaaagaaaacattagattttccggtataatattttttccaaccaaattaattttcgataaaagtgtcggacatggaaggacattatagtcaattcacgtatactccccctgattctacagatttaaaaattcaaaaagatccaacggtcatctccatccccctcccttcaacaacaaaaaccttttcttccccttcctctctctctacattcaaattcaaagcacactcttccctctctctctctctctctctctctctgagatctcaaatctctccttatctctccatttctcaaacccaaaaaggaaagaaagaaaggaaaacaatgaaatcaattaaagaaacagccgtcgccgagaatggccgtttcctgggaagcatttcgacgtcttcacttcggaatttgctcccgaaatcgaagcttaagagaagcacaaagaaacccagctctgaaaacactcctccaccagatcccaacattattgaagtaaataactcggcccagtttttccccaaatccccactgtccaaatcgcttacttccgacgccttgatcgtcccatctgacggtgaccgtgaaatgttgcctcctatggaaacttccatcaagaacgagattgttgaatctgagaaacagggtggagaattgggaaatttagatccatctgtgaaggtagtagtgagaattagacccataaatggtcaagaaaaagaagtggatcgaacagtgaggaagatttcttcagattccttatctgtttctgaccgcaaattcacattcgattctgttcttgattcaaattctaatcaggaggatgtttttcagttaattggtgttcctttggttaaaaatgcattgtctggttacaacacttcaatattgtcttatggacagactggaagtggaaagtcttacacgatgtggggtcctccaagtgcaatggtcgaggatccttcacctagaagccaccaggggattgttcctcgtatcttccaaatgctgttctctgagattcaaagagagcaagagaaccttgatgggaaacagataaattatcagtgccgttgctcctttctcgagatttacaatgagcacattggggatttactcgatccaactcaaaggaaccttgagataaaggatgacccaaaaaatggattgtatgttgagaacttgactgaggaatatgtttctagctatgaggacgtaactcagattttgattaaggggctttcaagtagaaaagttggagcaacaactgtaaattctaagagctctcggtctcatattgtgtttacttttgtcatagaatcttggtgcaagggagcctcatcaaaatgtttcagcagttcaaagacaagcagaatcagcctgattgatcttgccggactggatagaaacaaacttgaagatgtgggtaggcaacatgtccaggaaggaaaaaatgtcaagaagtccctatcacagcttggatatttggtgaacgctcttgcaaaagaaactcaacctgaagatgctccatatcaaggttcctgtttaacacgtatactcagagaatccctcggtggcaacgccaaactcacagttatttgcaacatttctgcagacaacagaaatagtggtgaagtactgagcactctcagatttgggcaacgaattaaatccataagaaatgagccagtaataaatgaaatatccgaagatgatgtcaatggcttgagtgatcagattcgacaactgaaggaagagcttataagagcaaagtctgatgtatacagttcagttgggagtaaaagtggatattttatagggcgaagtgcacgcgatagcttgaaccaattgagagtaagtcttaaccgttctttgctcctaccacacatagataacaattatgaggaagagctcaatattggtgaggaagacgtaaaggaactacgtcagcagctagattatttgcatagctctggtgaaacaaacttaagagatccatctgagaagagaggttccattcaatcttcttctgtagaagaatgttgtgagacagacttgctgagtgaagatgacattcattgcccagaagaaactgggatagaagaacttgatggggaagaacctcagaaggaacttcctcctaaggacattctagcatcagctgatgacctttcaattacaacaaaacccttgaaggctgttgatccttcaatcagaaatagcctctccatcagctcatgccatcggtcttcagtcctccaagagcctactttgtcagagtctccaaaaattggaaataatttaaggaaaagcatggccgtcccatcagcacttttggccagtcagaacaacgtgtcagagagttcggagtcagaacaatgtatacgagagtcactcaaacataatgagcacatcagatcctccttacgttcaagcaagatatttccaggacctacagaatctttggctgctagccttcaaagaggcttggagattatagattatcaccagagtagttcagcttccaacagatcttcagttgccttctctttcgaacacttgatgctgaaaccttgtccagaagcagacaaggccaatgcatctgttcaaacattaccagaaccttcttcagatggttcttctactcccttgctttgttcatcgtgtcaacgaaagtttgacaataaccctaatggggttcaggatagcttgaagacgtggattgtagcagttgataatcaacagacagatggcgataccacagctgcggcaaatgatttggcaaaagccactgaaagagagaaggagcttgaaagtgtctgtaaggagcaagcggccaaaattgagcagttaaataatctggtagagcaatacaaacataagggagaaaattctgccattgaacatggtcctgagtctctgaagaatgaaataataccatttgagcagtccaacaatgatgaaaatgggaacgaatattgtgatatgaatgagaaggaagcacttcttcaggaaacccaaacattaacgagcaaattgcagtcatctactgctgcatctccaaacagatcttctgaaaagctgagatcatctttgttgtcacgttccattcaattgcgaaaaagtgtagactgtcgtgataacagcgatgaagaacttgagagggaaaggcagagatggatggaaatggaaagtgattggatatcattgactgatgagctcaggatggaccttgaatccaaccgctgccgtgcagagaaagtagagatggaactgaaattagagaagaagtgcactgaggagttggatgatgctcttagcagagctgtccttgggcatgctagaatggttgaacactatgccgacttacaagaaaagtataatgatctggttgcaaagcaccgggcaataatggaagggatagcagaggttaagaaggcagcagcaaaggcaggagccaaaggtcacgggacacgttttgccaaatccctggctgctgagctttcagctcttagagttgagagggagagggagaaaaaactcctgaaaaaggagaacaaaagtctcagaatccagcttagagacacagcagaagctgttcatgctgctggagaactccttgttaggctcagggaagctgagcaagctgcctcagttgcagaggagaacttcactaatgtccaacaagagaatgaaaagttaaagaaacaagtggagaagctcaaaagaaaacacaagatggagatgatcaccatgaagcagtaccttgcagagagcagactgccagaatctgcactgaagccactatatcatgaggattcagaatctgcacacaacagctcaatcccagatgatgatcaggcatggagagcagagtttggagcaatttaccaagagcattactgattcagaggcagcctaagacaatcaaagagaccctccttgggtcaaaatgaaatactatatatactactattcctattctatgatagtactatatatactaccatgtgtgcattgcatttcttgtaatgttccttcaactatcattctttcgggtataataatagaattttctgtcgaaacttcctctatctcgtagtctctactgaccttaatcattcctttcccttaaaagtgaacaaatttaaacttgaaat

SEQ ID NO: 1763 - DNA, 1148 bp, Gossypium hirsutum
atttaacccaatcaacgctgcaatacttttcacacctcaaattttatttgaagcaaaaacaaatcccaaataacacaagcttagtttttgttttgaattctctgttaattagcaatgaatagcagcagcaaagaatcgcagcctaattaccccactatctcacctgatgaatataccaaccctttccatcaacagccgcacatggaacctgcagcggccaccgcggcggcacccgcatcaacatcgtcctcgcctcctccacctcctccagaacagtctgagaaatgggggactcatatcatgggaacaccagctgttcccacatgtcatccagacaacaagaaagcagcattgtggggtgctggtgaccaagctcaatactaccatcatccatacctccaatattcccccgtcgagaaatcaagcaataaccccatggattccatgcttcaagtcttcaacacctggagtcacaaagctgagaccatggccaataatatctggcacaatcttaaaacaggaccatctgtatcgggagctgcatgggggaagatgaacgtgacagccaaagcaatatcaggaggtggattcgaatcgctttataagcaaacattcggaacgtattcaaacgagaagctgaagaaatcattcgcatgctatttatcgacttcgacaggaccagtagcgggaacactttacctatccaatatccatgtagctttctgtagtgatcgccctttgtcattcacagcaccatcagggcaggaaacatggagctattacaaggtaatgataccactgagcaaagtagggataataaacccagtgataatgagggagaatccatcagagaaatatatacagattgtgacggtggatggacatgatttctggtacatgggatttgtgaattatgagaaagcgtcaaagcatctgtctgagagtgtttccagttttgtagcaactgggattgctgttcaaccttcacctgttgcatcgtaaacacaggattttattatatttttcttttcatatttacaggccttttcttttgttttgagattttgggttcggcttgtcttagatttattccatcgattgtaccatttttgtaaaataatttattatttcgtacaccttttgttcaa

SEQ ID NO: 1764 - DNA, 1499 bp, Theobroma cacao
acaaaaaacaccacctggtcaaaggaatccaactcaattgctagaagcagcaactgaaatgttttttcaacatgaattaaaaatggttagtgaagtttaacgaggaaggaaaccaatcgaagggacgcggctaagcaaccaagacgaatgatttcattgaacgtgtcttccctgcatcaagtcaaaggtttcgctttcacaccccccccacaaaagaaaatatgaattttcttgtgcttctagaactggtttaatgaactaatgcacgcaccttggccaccttttttctcatttataagcaacgctctcttccaaacgctgcaatattcacagccaaattgaagcagaaaccaagcaaagaagccttagtttgtgttgatattctgatatcaaaaatgaatagcagcagcaaagaatcacagcctctttacccctctatctcccctcccactggagaagacacaaaccctttccatcaaacagtcgctcaagaaaaacagccacagatgcaatctgcagctgcatcatcatcatcaccatcgcctccccctcctccaccagcatctgatccgaattctgagaagtgggggactcatatcatgggagcaccaagtgttccaacatgtcatccagacaacaagaaggcagccttgtggggtgccggtgaccaggctcagtaccaccatcacccatatgtccaatactcccctatagaaaagtcaagcaatagccccatggaatccattcttcaagtgttcaactcctggagccacaaaactgagaccttggccaacaatatctggcacaatttgagaactggatcatctgtatctggtgctgcctgggggaagatgaacgtgcaagcaaaagcactaacaggaggcggattcgaatccctttacaagcaaacatttgcgacttttccaaatgagaagctgaagaagtcattcgcctgctatttgtccacttcaaccggaccagttgctgggactctttatctatccactattcatgtcgctttctgcagtgatcgccccttgtccttcaccgcaccttcaggccaggaaacctggagctattacaaggtaatggtacctttgagcaaagttggcatcatcaacccagtgatcatgagggagaatccgtcagagaaatatatccagattgttacagtggatggacatgatttctggtacatgggttttgttaattatgagaaagcctccaagcatctctctgagagtctttccaattttgtagcatctgggattgctgttcaacctgcacctgttgcataaacagaggactacatttacaggattcttcatattcgagagcctttgttttcctttttatttagatttcagttggatttcatcatccgtttcatctgtattggacttgttcgcttgtaccatttttgtaaaataaaatgaaacatctctattctgatccttgctcatgtatttgcgatacacaaatgaaaaaacaaaaaaagg

SEQ ID NO: 1765 - DNA, 400 bp, Gossypium hirsutum
gcaagttagctaactactttagaaactcaaacaaaccttttacttctcaactctctcaaattcaccatggctgacaagtgcggcaactgcgactgctctgacaagagccagtgtgtgaagaaaggaaacgccttggtcattgagactgagaaaagctacatcagcactgtagtggtcgaggctgtggcagagaacgatggcaagtgcaagtgtggaactagctgcagctgcacaaactgcacatgtggcaatcattaagcagacatatatagaactgcacgatgttttagtccataattaaattaagttgaataattggtggcgtgttgcatgtttgtctccgcctcattgtataccatgatagaatggccatgtctatggactttgtctgattaatgaa

SEQ ID NO: 1766 - DNA, 495 bp, Gossypium hirsutum
agcggccagtatcaacgcagagtacatgggattgcaagttagctaactactttagaaactcaaacaaaccttttacttctcaactctctcaaattcaccatggctgacaagtgcggcaactgcgactgctctgacaagagccagtgtgtgaagaaaggaaacgccttggtcattgagactgagaaaagctacatcagcactgtagtggtcgaggctgtggcagagaacgatggcaagtgcaagtgtggaactagctgcagctgcacaaactgcacatgtggcaatcattaagcagacatatatagaactgcacgatgttttagtccataattaaattaagttgaataattggtggcgtgttgcatgtttgtctccgcctcattgtataccatgatagaatggccatgtctatggactttgtctgattaatgaatgattattagcacaaaaagaaaaaagtaccgactgcgactctgcgttgatacacctgcgcgg

SEQ ID NO: 1767 - DNA, 507 bp, Gossypium hirsutum
gcaagttagcttaactactttagaaactcaaacaaaccttttacttctcaactctttcaaattcaccatgtctgacaagtgcggcaactgcgactgctctgacaagagtcagtgcgtgaagaaaggaaatagcttggtcattgagactgaaaagagctacatcagcactgtagtggtcgaggctgtggcagagaacgatggcaagtgcaagtgtggagatagctgcagctgcacaaactgcacatgtggcactcattaagcagacatagaaccatgatgttttagtccatagcaatattaggacctaaaaataatgaatttgagttgaataaattggtgttttgttgttgagtttgagacattgagtgcgttttcatgcctgtttgtcttatgtctgagtctcattgtacactatgatggaatggtcatatctatggacttcgtatgattaatgaattattatcagtttaaaaagaaaaagtaccgactgcgactctgcgttgatac

SEQ ID NO: 1768 - DNA, 419 bp, Gossypium hirsutum
atgggattgcaagttagctaactactttagaaactcgaacaaaacttttacttctcaactctctcaaattcaccatggctgacaagtgcggcaactgcgactgctctgacaagagccaatgtgtttaagaagaaaggaaacgccttggtcattgagactgagaaaagctacatcagcactgtagtggtcgaggctatggcagagaacgatggcaagtgcaagtgtggagctagctgcagctgcacaaactgcacatgtggcaatcattaagcagacatagaaccatgatgtttagtactccataattaaattaagttgaataattggtggtgtgtttcatgtctgtctgccttatacctgcgtctcattgtataccatgatggaatggccatgtctatggactttgtctgattaatgaa

SEQ ID NO: 1769 - DNA, 456 bp, Vaccinium corymbosum
gaaactcctctgcaaacttcgatttctctctgttattttctcactcatcatgtcggacaagtgcggtaactgcgattgcgctgacaaaagccagtgcgtgaagaaaggaaacagccttgtcattgagaccgagagctacatcgagacctttgtcgcggatgctccagcggccgagaatgatggcaagtgcaagtgcggtactgcctgcgcttgtgtgaactgcacatgcggtcattaagcatataagcttactatgatgtgttaagagtccgagggtgccataacaatgttgttgtggtgaataatttgtgtctcaatttcgttcgtgttggtgtttctgtattttgagtaaaatgtgtctgtcaatcgtgtatgtgtcgtgtcttgttttcgtctgtgtaatggtcactctgtgaccatgttgtgtgtttataaaaaggactactattagtgtgt

SEQ ID NO: 1770 - DNA, 774 bp, Theobroma cacao
tcttctctttcggagaagagaaatgaagttgacatgagaggaggatatcaagccaagcgcccccctccattatcaagattccttcggactcttcctcgagaggcgtgtgctcctctcatgcccgtgtggaccccatgctagaacacccccggacctttcctagcggggtccacatggaggaaaccacacccctcccttttgcaccagtcgcacttcttctccatctataaatacatgaccatggtgctaagcttgggagatatagcaatccgttctacaaagcttagagcttcaaataccttcagcttttcacgttcaaaaactctctcaagatcaccatgtctgacaagtgcggaaactgcgactgcgctgacaagagccagtgcgtgaagaagggaaacaccttggtcattgagactgagaagagctacatcaccactgtcgcggtggaaactccagcagagaacgatggcaagtgcaagtgcggagccaactgcacctgcacagactgcacttgtggtcattaagcaaatcctgtgttccagttcctgagaacattgggacctaaacaataatgaaaagctgggttgaataatctgtgtcttttatgttatagtttgtgggtgtttgttttcctgtctgccagtcatgtttgtgtctccttatatactgtgatgaaatggccatgtctatggccttgtctgtttaaatgaattactattagagtaaactctttcggcctttattaaagcataagcattctcttcatagcta

SEQ ID NO: 1771 - DNA, 701 bp, Pteridium aquilinum
acaaagcttagagcttcaaataccttcagcttttcacgttcaaaaactctctcaagatcaccatgtctgacaagtgcggaaactgcgactgcgctgacaagagccagtgcgtgaagaagggaaacaccttggtcattgagactgagaagagctacatcaccactgtcgcggtggaaactccagcagagaacgatggcaagtgcaagtgcggagccaactgcacctgcacagactgcacttgtggtcattaagcaaatcctgtgttccagttcctgagaacattgggacctaaacaataatgaaaagctgggttgaataatctgtgtcttttatgttatagtttgtgggtgtttgttttcctgtctgccagtcatgtttgtgtctccttatatactgtgatgaaatggccatgtctatggccttgtctgtttaaatgaattactattagagtaaactctttcggcctttattaaagcataagcattctcttcatagctataatgatcagactccaaaagatatgctcctctctaaggtaacagataaatcagggtatcaagagttatatcaggaatgatgcatcctccaagtttcaacttcaacaacagtaacaaatggtggagcaatgaaattggcattcaataaatgttttattaacgttgaaatatacaagttatcatgttcttactcttaaaaaagaa

SEQ ID NO: 1772 - DNA, 701 bp, Theobroma cacao
tatcaacgcagagtacgcggggatagcaatccgttctacaaagcttagagcttcaaataccttcagcttttcacgttcaaaaactctctcaagatcaccatgtctgacaagtgcggaaactgcgactgcgctgacaagagccagtgcgtgaagaagggaaacaccttggtcattgagactgagaagagctacatcaccactgtcgcggtggaaactccagcagagaacgatggcaagtgcaagtgcggagccaactgcacctgcacagactgcacttgtggtcattaagcaaatcctgtgttccagttcctgagaacattgggacctaaacaataatgaaaagctgggttgaataatctgtgtcttttatgttatagtttgtgggtgtttgttttcctgtctgccagtcatgtttgtgtctccttatatactgtgatgaaatggccatgtctatggccttgtctgtttaaatgaattactattagagtaaactctttcggcctttattaaagcataagcattctcttcatagctataatgatcagactccaaaagatatgctcctctctaaggtaacagataaatcagggtatcaagagttatatcaggaatgatgcatccttccaagtttcaactttcaacaacagtaacaaatggtggagcaatgaaattggcattcaataaatgtttttattaacgtt

SEQ ID NO: 1773 - DNA, 434 bp, Heritiera littoralis
gcagtccattgcaagctaacactactgcagcaaactctaaaactttcagttctcacgttcagcaaccgttccaaattcaccatgtcagacaagtgcggcaactgcgactgcgctgaccagagccagtgcacgaagaaaggaaacaccttggtcattgagactgagaagagctacatcaacaccgtcgtggtggaggttccagcagagaacgatggcaaatgcaagcgcggagctaactgcagctgcacaaactgcacttgcggtcattaagaaacatagaataatgatgttttagtccacctaaaaaataatgaagtttggatggaataacttgtcttctgttgtactgtcagtcatgtttgtgtctccttatataccgtgatggaacggccatgtctttggccttgtctggttaatgaattaccgttagtatg

SEQ ID NO: 1774 - DNA, 2266 bp, Theobroma cacao
atcgcaagtaaccgcatcatcgcccagtccgaaatctgcacttgcactggtctctgatataaaagcagagttttgaagcaaaaagaccccccaaccaaaccaaacactactaacctacctaccatttccaaccaagagaagccaactactgccaacaactgctctattgctatttgcttaagccttgttccttacttacactaccaaaccgatcaccactctcccaatacccaaaaatggactctgatttcggcattcccagagaactttccgatcttcagaaactccgatctcaataccaaccaggactccctccttgcctcgagggaactactgtcagggttgagtttggtgatgccaccacagctttagacccagctgatgcccataccattagtcgtgcttttccacacacttatggtcagcccttggctcactttctcagggcaactgcaaaagtacctgatgctcagattataacggagcatccagctatgagggtcggtcttgtcttttgtgggagacaatcccctggtgggcataatgtcatatggggccttcataaagctctcaaaatccacaaccccaacagcactttgctcggctttttgggtggtactcaaggtttatttgcacagaaaactttagagatcacagatgacattctttcaacctacaaaaatcaaggtggttatgatttgctgggacgaacacaagatcaaattagaacgactgaacaagttaatgctgcattaactgcatgcaatgatttgaagttggatggccttgtcattattggaggtgtaacatcaaacacggatgctgctcaacttgctgaaacatttgctgaagctaaatgtcaaacaaaggtggttggtgttcctgttacactgaatggagacctcaagaatcaatttgtggaagctaatgttggttttgatacaatatgcaaggtcaattcccagctcatcagcaatgtctgcactgatgctctctctgcggaaaagtattattactttatccgtcttatgggaaggaaggcctcgcatgttgcactggaatgcaccctccaatctcatccaaatatggtaattcttggtgaggaggtggctgcgtcaaagcttactctttttgacataacaaagcaaatatgtgatgcggttcaagccagggcagagcaagacaagaaccacggggtcatccttctgcctgaagggcttatagaaagtattcctgaagtgtatgctctgttgaaggaaattcacagtttgctcaggcaaggtgtttctgctgaaaaaatttcttctcaactttcaccttgggcatcagctttgtttgaatttttgccaccttttataaggagacagcttctcctccatcctgaatcagatgattctgcacagttgtcacagattgagacagagaaacttctggcgcaccttgtagagactgaaattaataagcgcctgaaagcaggtacatacaaggggaaaaaatttaatgctatctgccactttttcgggtatcaggctcgtggatccttaccatcaaaattcgactgtgactatgcctatgttcttgggcatatctgctatcatattcttgcagctggtttaaatggttacatggcaactattactaacctaaaaaatccagtgaacaagtggcgctgtggtgctgcacctattgcagcaatgatgagtgtgaagcgctggtctcagaatcccaatgccttgtcaattggaaaacctgctattcatccagctactgtggatttgaaaggcaaagcatatgagctgctgagacaaaacgcagcaaggtttttgctggatgatatctacagaaatccaggaccccttcagtttgatggtcctggtgctgatgctaaggcggtgaccttgtgcgttgaagaccaggattacatgggccgcatcaagaaactccaggaatatcttgaaaaggtccgtaccattgtgaagccagggtgttctcaagaagttctgaaagcggctttaagcgtaatggcatctgtgacagaggttctctctgtgatgttttcgtcgtcatcaggcggacagacaaccctttgatacaataacttaggaacatgccagttattgtactcatgatatcaattttcttaattatcctgaacttataggcctgggcatgtgtgataaactgagtttccccctgttttcttgttttgggcgagatgataatagcatgtactctttaacagttttggaagattaaaagttttatg

SEQ ID NO: 1775 - DNA, 2234 bp, Theobroma cacao
  misc_feature (16)..(16): n is a, c, g, or t
  misc_feature (873)..(873): n is a, c, g, or t
  misc_feature (900)..(900): n is a, c, g, or t
cggggcccaaccaaancaaacactactaacctacctaccatttccaaccaagagaagccaactactgccaacaactgctctattgctatttgcttaagccttgttccttacttgcactaccaaaccgatcaccactctcccaatacccaaaaatggactctgatttcggcattcccagagaactttccgatcttcagaaactccgatctcaataccaaccaggactccctccttgcctcgagggaactactgtcagggttgagtttggtgatgccaccacagctttagacccagctgatgcccataccattactcgtgcttttccacacacttatggtcagcccttggctcactttctcagggcaactgcaaaagtacctgatgctcagattataacggagcatccagctatgagggtcggtcttgtcttttgtgggagacaatcccctggtgggcataatgtcatatggggccttcacaaagctctcaaaatccacaaccccaacagcactttgctcggctttttgggtggtactcaaggtttatttgcacagaaaactttagagatcacagatgacattctttcaacctacaaaaatcaaggtggttatgatttgctgggacgaacacaagatcaaattagaacgactgaacaagttaatgctgcattaactgcatgcaatgatttgaagttggatggccttgtcattattggaggtgtaacatcaaacacggatgctgctcaacttgctgaaacatttgctgaagctaaatgtcaaacaaaggtggttggtgttcctgttacactgaatggagacctcaagaatcaatttgtggaagctaatgttggttttgatacaatatgcaaggtcnattcccagctcatcagcaatgtctgcnctgatgctctctctgcggaaaagtattattactttatccgtcttatgggaaggaaggcctcgcatgttgcactggaatgcaccctccaatctcatccaaatatggtaattcttggtgaggaggtggctgcgtcaaagcttactctttttgacataacaaagcaaatatgtgatgcggttcaagccagggcagagcaagacaagaaccacggggtcatccttctgcctgaagggcttatagaaagtattcctgaagtgtatgctctgttgaaggaaattcacagtttgctcaggcaaggtgtttctgctgaaaaaatttcttctcaactttcaccttgggcatcagctttgtttgaatttttgccaccttttataaggagacagcttctcctccatcctgaatcagatgattctgcacagttgtcacagattgagacagagaaacttctggcgcaccttgtagagactgaaattaataagcgcctgaaagcaggtacttacaaggggaaaaaatttaatgctatctgccacttcttcgggtatcaggctcgtggatccttaccatcaaaattcgactgtgactatgcctatgttcttgggcatatctgctatcatattcttgcagctggtttaaatggttacatggcaactattactaacctaaaaaatccagtgaacaagtggcgctgtggtgctgcacctattacagcaatgatgagtgtgaagcgctggtctcagaatcccaatgccttgtcaattggaaaacctgctattcatccagctactgtggatttgaaaggcaaagcatacgagctgctgagacaaaacgcagcaaggtttttgctggatgatatctacagaaatccaggaccccttcagtttgatggtcctggtgctgatgctaaggctgtgaccttgtgcgttgaagaccaggattacatgggccgcatcaagaaactccaggaatatcttgaaaaggtccgtaccattgtgaagccagggtgttctcaagaagttttgaaagcggctttaagcgtaatggcatctgtgacagaggttctctctgtgatgttttcgtcgtcatcaggcggacagacaaccctttgatacaataacttaggaacatgccagttattgtactcatgatatcaatttttttaattatcctgaacttataggcctgggcatgtgtgataaactgagtttccccctgttttcttgttttgggcgagatgataatagcatgtactctttaacagttttggaagattaaaagttttatggaaggaatgatggcatggtaaccatggtttactgtggcagatttttacgtca

SEQ ID NO: 1776 - DNA, 2323 bp, Cucumis melo
ctcaaacaaacaaaaccctcacttactctacatcttctctctttcttcttcatcctccatctcccatggattctgattacggcattcctcgtcaactctccgatcttcagaagatccgatctctctaccaacctgaccttcctccttgtcttcagggaacagcggtcagggttgaatttggggatgccactacagctgtggatcctgctgatgcccctaccatttgtcgggcctttccccacacttacggtcagccattggctcactttctcagggcgactgctaaagtcccagatgctcaaattattactgaacatccagccatccgggtgggagtagttttttgtggaaggcaatcccccggaggtcataacgtcatttgggggcttcatgacgctctcaaaattcacaacccaaacagtatattgtttggatttctgggtggttctgaaggtttatttgcccagaaaactcttgagattaccgatgacattctttcaacgtacaaaaatcaaggtggttatgatttattgggacgaaccaaggatcaaattcgaactaaagagcaggttaatgctgcactgaaaacgtgcttagatttgaaattggatggtcttgtcataattggcggagtgacgtcaaacactgatgctgctcaacttgctgaaacctttgcggaagctaaatgccccacaaaggttgtaggagttccagttactttgaatggcgatctcaagaaccagttcgttgaaacaaatgttggttttgacaccatatgcaaggttaattctcagctaatcagcaatgtatgcactgatgccctgtctgcagagaagtattactatttcattcgactcatgggccggaaagcatcccatgttgctttggagtgcactcttcaatctcatccaaatttggttatccttggtgaggaggtagctgcatcaaaacttactctttttgatttgacgacacagatatgtgatgctgttcaggctagagcacaacaagacaagtaccatggggtcatcttactgcctgaagggctgattgaaagcattcccgaaatctatgcccttttgaaggaaattcacagtttactcaggcaaggagttctcgttgataatatttcttcccaactctctccttgggcatcagcgctatttgaatttctgccacctttcatcaggaagcagttgctacttcatcctgaatcagacgattctgctcagttgtctcagattgagacggagaaacttttggcacatcttgtggaggctgaaattaacaagcgtctgaaagaagggacttataaggggaagaaattcaatgcaatttgccacttctttggttaccaggctcggggatctttaccttcaaaatttgattgcgactatgcctttgttcttggccatgtttgctaccatatcttagctgctggtttgaacggttatatggcaactttaactaacctgaaaaatcctgtgaacaaatggcgctgtggtgctgctccaattgcagccatgatgactgtgaagcgttgggctcaaaatcctggagcatcgtccattggaaaaccagcaattcacccagcaaccgtggatttgaaagggaaagcatacgagctattgagacaaaatgcgagtcagtttctgatggacgatctctatagaaaccctggacctcttcagttcgatggtcctggtgctgatgccaagcccgtctccctttgcgttgaggaccaggattacatgggccgcatcaagaaattacaggaataccttgataaggtccgaaccatcgtgaaaccagggtgttcgcaggaggttcttaaagcagcattaagtgtcatggcatcagtgaccgacgtcctttctgttatgtcttccagttcattcagcggaaaagcatcactagaaggataattaaactcattttatgttggtgtttattttaccagagcaacaatgactgttctaaaaccttgtctacttcggctagcggaattgggttatagatgacctgataatgactgatgagttttcaatttgttgcgtaacattttttaatgaataagtacccatcctctgcagttttgggaatctgtaaagtactgtttttttttccttttccaccagtttgggtttgtaatacggaaggaactcttattttgcattctcctctcctgcggctttgcagtgtatctcgtattttttagcatttccatgtcgttttttaaaatttagttggtgtggaacagtggcccattctggattgtgttacccaagtgatgtgttttaaagaataataataatagctctaa

SEQ ID NO: 1777 - DNA, 2209 bp, Euonymus alatus
cgccgggtttttctttccccctactaaaaacggtacttctgaataccacaactactctcactcactcaccaaccacatcaaaactcacaaagaaattgtcaatggattccgatttcggcattccgagagaactctccgatctccagaagctccgatctcagtaccaaccggagctccctccctgtcttcagggaaccactgtcagagtggaatttggtgatgcaacaactgcacaagacccagcagatgcccacactattagtcgatccttcccgcatacatacggtcagcctttggctcactttcttagagcaactgcaaaggtccctgatgctcagattatcgcagatcatcccgcgattagggtaggaatagtcttttgtgggaggcaatctcctggaggacataatgtcatttggggacttcatgatgctcttaaaatccacaatccaaacagcacattgcttgggtttctgggtgggtctgaaggattgtttgcgcagaaaacacttgagatcacagatgacgttcttgcaacctacaaaaatcaaggtggttatgatttgctgggacgtacaagagatcaaataagaacaactgagcaagttaatgctgcattagctgcatgcaataacttgaaattggatggccttgtgattataggaggtgtcacatcaaacacagacgctgctcaacttgctgagacatttgctgaaacaaaatgcccaacgaagattgttggtgtacctgttaccttgaatggggatcttaagaatcaattcgtggaaactaatgttggttttgatacaatatgcaaggtcaattcccagctcattagcaatgtctgcactgatgctctctctgcagagaagtattattattttatccggcttatgggcagaaaggcatctcacgtggctttggagtgcactctccagtctcatccaaatatggtgatcctgggtgaggaggtagctgcatcaaaacttactctttttgatatcacgaaacaaatttgtgatgctgttcaagccagatcagatcaagataagtaccacggggtcatcttactgcccgaggggctcatagaaagcattcctgaagtttatgctctgttgaaggaaatacatggtttgctccggcaaggggtcactgttgacagcatttcatctcagctttcaccatgggcatctgcattatttgagtttttgcctccatttataaaaaaacagctgctcctgcacactgaatcagatgactctgcacagttatctcagattgagacagagaaacttgttgcacatctagtggaaactgaaatgaccaagcgcctgaaagaaggttcatacaagggcaaaaagttcaatgccatctgtcactttttcgggtatcaggctcggggatctttgccgtcaaaatttgactgtgactatgcctatgttcttggacacatatcataccatattttggcggctggtttgaatggctacatggcaactatcaacaatttgaagaaccctttgaacaagtggcgttgtggtgctgctccaattacagcaatgatgactgtgaagagatgggctcaaagtcctggtgcctcttcaattgggaaaccggctatccacccagccactgtggatttaaagggaaaagcatatgagctgctgagacaaaatgcagctaaattcttgatcgacgatatttacagaaatcctggccctcttcaatttgatggtcctggtgctgatgctaagcctgtaactctctgtgtcgaggaccaggattacatgggccgtatcaaggaattgcgggaatatctggacaaggtacgaaccattgtgaaacccggttgttcaccggaagttctgaaggcagctttgagtgtcatggcctctgtgacagaagtcctctctgtgatgtcatcttctagcaatcagaaaatcctttgagaaataatttccagaatcgactgtcctttggcaccctacgccctaatttgttgcatgttgagctgttcgtgcttttttttttctcctcctcgttcctcgcagatataattacagaacttttttttttttgcaagacttccttctgtgagaggttgatcaggtaactttattgagttttcaataagatcaaattttgtttattccaaactactgtgtgtgtggctgtttcattttgcaattaaagtctgtcaagtttgtcc

SEQ ID NO: 1778 - DNA, 2251 bp, Malus domestica
cgcagtagttttgctttacaccaaacaccacacccaccaaattctctctctctctctctctctctctctccccccaaatcggccggcgccatggattccgactacggcattcccagagagctctctgatcttcagaaactccgatcccaataccaacccgagcttcctccttgcctccagggagctaccgtgagggttgaatttggtgatacaaccacatctttagatcccaccgattcccacaccatcagtcgctactttccccacacttacggtcagcctttggctcactttctcagggcaactgccaaagtccctggtgctcaggttattactgagcatccccctgttagggtgggagttgtcttttgtgggagacaatcacccggaggacataatgttatatggggtcttcacaacgctctaaaagttcacaaccctaacaataccttacttgggtttttggggggttctgaaggtttgtttgcacaaaaaactcttgagataacagatgaaattcttgcaacctacaaaaaccaaggtggttatgatttgctgggaaggacaaaagaccaaattagaacagttgagcaagtcaacgctacacttaccgcatgcaaggatttgaaattggatggccttgtcattattggaggtgtgacctcaaataccgatgccgcccagcttgcagagacatttgcggaagcaaaatgctcaacaaaggtggttggtgttcctgtcactttgaatggagatcttaagaaccagtttgtcgaagcaaatgttggttttgatacaatatgtaaggtcaattcccaattaatcagcaatatgtgcactgatgctctttcagcagagaagtattattatttcattcgactcatgggccggaaggcatcacatgttgcgttggagtgcaccctccagtcccatccaaatttggttattcttggtgaggaggtggcggcatcaaagctaactctttttgacattacaacacaaatttgtgatgcagtggaagcccgtgcagcacaagacaagaatcatggtgtcatcctattacctgaaggactcatagaaagcattcctgaggtgtatgccctcttgaaggaaattcatggtttgcacaggcaaggagtatctgccgataaaatttctactcaactttcaccttgggcatctgcgttgtttgaattcttgccaccatttatcaagaaacaggtactacttttgcctgaatcagatgactctgcgcaactatcccagattgagacagagaaacttcttgcacatcttgtggagggggaaatgaataagcgtcagaaagagggcacatacaaggggaagaaatttaatgctatatgccacttcttcggttatcaggctcgggggtctttaccatcaaagttcgattgtgactatgcttatgttctagggcacattggctaccatattctcgcagctggtttgaatggttacatggcaactataactaacttgaggaatcctgtgaataagtggcgttgtggtgctgctccacttactgcaatgatgactgttaagcgttgggctcaaaatcctgggactgcttcaattggaaaaccagctattcatcccgctactgtagatttgaaaggcaaagcatatgacttgttgaggcaaaatgctacaaaattcctgcttgatgatatctacagaaacccagggcctctgcagtttgatggtcctggtgccgattctaaggctgtatcactatgtgttgaagaccaggattacatggggcgtatcaagaaactgcaggagtatcttgacaagattcgaaccattgtaaagcctgggtgctcgcaagaggttctgaaagcagctttgagtgtgatggcgtctgtgacagaagtcctctcggttatgtcctcatctcctatcaatggccaatcgaccctttaattgtatacttagtgttcaatagacctttactggtgctgataactattgtacactgaattctaaatttcttcggcatcgtcatgtctagtgttttttggccaagtatgcggaaatgtaggttcccaaccgtggaattactggaataatcaggttttgtttttgctttcgacgcaactttgttttccgtaaaataagtattgaggattgtactttgaaattttggaactgatgaaatgatgtttgtgagtcactaaggtttcttttgggttcagctctctcttaatattattgcactacattgatgaca

SEQ ID NO: 1779 - DNA, 2444 bp, Cajanus cajan
aagcaagaaaaaaattttaggtggtaggtgcgacataaaaaagggtaccctacccttcaccaacattcaacaacaccacaacaccaacaacaatagttacactcccacagtagctctcgaaacagcatcgacaacaccaacaacaacgttgtagtgtgttgttgtttcttagtgcactttttattattatttttttattggtattctctcaaagagggtgaatccatggattctgattatggtattcccagggaactctcagatcttcaaaaacttcggtctttgtaccagccagagctccctccttgtctccagggaaccactgtgagggttgagtttggtgatgcaaccaccactgctgaccccactgatgccctcaccatcagcagggcttttcctaatacctacggacaccctttggctcactttctcagggccactgccaaagtccctgatgctcagatcatcactgagttccctcctattagggtgggagttgtcttttgtgggagacaatctcctggagggcacaacgttatctggggtctccataatgctcttaaaattcacaattccaatagtgtcctgcttggatttcttggtggttcagaaggtctgtttgcccagaaaacattggagataactgacagtattctttccacatacaaaaatcaaggtggttatgatttgcttgggcggacaaaagatcaaattaggaccacagagcaagttaatgctgcccttgctgcatgcaacaatttgaaacttgatggccttgtcatcattggaggggtgacatccaacacggatgctgcacagcttgcagaaacatttgctgtagcaaaatgccccacaaaggtggttggtgttcctgtgactctgaatggagatcttaaaaatcagtttgtggaaactaatgttggtttcgacacaatttgtaaggtgaattctcagctcatcagcaatgtctgcactgatgctctctctgcagagaagtattattatttcattcgtcttatgggacggaaggcgtcacatgttgctctggaatgcactctccagtcccatccaaacatggtagttcttggtgaagaggttgctgcatcaaagcttaccctttttgaaattacaaaacagattactgatgcagttcaagctagagcagagcaagacaaataccatggagtaatcctccttccagaaggtctgattgagagtattcctgaagtatatgcactcttaaaggaaattcatggtttactcagacaaggtgttgctgttgacaatatatcatctcagctttcaccatgggcatctgctctatttgaatttctgccaccatttattaggagacagcttctcctttaccctgaatcagatgactcagcacagctatcacagattgaaactgagaaactactagcttaccttgttgaagtagagataaacaagcgtctgaaagaaggaacatacaaggggaagaagttcaatgccatttgccacttctttggttatcaagctcgtggttctctgccatcaaaatttgactgtgattatgcatatgtccttggacacatctgctaccatatactagctgctggtctaaatggatatatggcaactgtaactaaccttaagaatcctgttaataagtggaaatgtggggctgctccaatctcaagtatgatgactgtgaagcgctggtcaccaaatccaggagccacatcaattggaaaacctgctattcatcctgctaccgtggacttgagaggcaaagcatatgagctgttgagacaaaatgcagcaagttttcttatggatgatatctacagaaatccaggtccacttcagtttgatggtcctggtgcagatgccaaggttattactctttctgttgaagatcaggactacatgggccgtattaagaaacttcaggagtaccttgaacaggttcgaaccattgtaaagccaggatgccctcaggaagttttgaaagctgcactaagcgtcatggcatcagttaccgaagttctagctgcaatgtcatcatcttctacccattccctctcagccctttgaagggtaacggttggaagttgtattcttttcaaaattttctggcataaggttttagtttctacattttatagccatggaagtagttgttgattggaaataagagttagatttgacatggtgcatgtcaacgtgagattactgcaatcaaagttttggttctgtgttcccaactgggtactttttgtttattgtccctttattattattttttttcagacatgttccatgtggcattgtttgatattttagcttggtgcttgagattattatttttttcttaggacaactccttttatattccaaacttgtgttagaattttttttatagctataccgagggttactttatttggtattctagaatg

SEQ ID NO: 1780 - DNA, 2309 bp, Prunus persica
gacaccagacgcagcagcgcttttctactttacaccaaactcaatacccaccaaattctctctctctctctctctctctcttctctcttctctcttctctctcactcaattcatctccatggattcagactacggcattcccagagagctctctgatgttcagaaattccgatcccaatatcaaccagagcttcctccttgtctgcagggagctactgtaagggttgaatttggtgatacaaccacatctctagatcccacagatgcccacaccattggccgctactttccacacacttatggtcagcctctggctcactttctcagggcaactgcaaaagtccctggtgctcaggttattactgagcatccgccttttagggtgggagttgtcttttgtgggagacaatctcctggaggacacaatgtcatatggggtctccacaacgctcttaaagttcacaaccccaaaagcaccttacttgggtttttgggtggttctgaaggtttatttgcacaaaaaactcttgagataacagatgaaattcttgcaacctacaaaaatcaaggtggttatgatttgctgggaaggacaaaagatcaaattagaacagttgagcaagtcaatgccacgctaaccgcatgcaaggatttgaaattggatggtcttgtcattattggaggtgtgacatcaaataccgatgctgcccagcttgcagagacatttgctgaagcaaaatgccagacaaaggtggttggggttcctgtcactttgaatggagatcttaaaaaccagtttgtggaagctaatgttggttttgatacaatctgtaaggtcaattcccagctaatcagcaatgtctgcactgatgctctttctgcagagaagtattattattttattcgactcatgggccggaaggcgtcacatgttgcgttggagtgcaccctccaatcccacccaaacttggtaattcttggtgaggaggtggctgcatcaaagctaactctttttgacattacaacgcaaatttgcgatgcagtcgaagcccgtgcagcacaagacaagaatcatggtgtcatcctattaccagaaggacttattgaaagcattcctgaagtgtatgccctcttgaaggaaattcatgggttgcataggcaaggagtttctgctgataaaatttcttctcaactttctccttgggcatctgcgttgtttgaattcttgccaccctttatcaagaaacaggtgctccttttgcctgaatcagatgactctgcgcagctatcccagattgagacagagaaactcgtggcgcatcttgtagaggtggagatgaataaacgtgtgaaagaaggcacatacaaggggaagaaattcaatgcaatctgccactttttcggttatcaggctcgggggtctttaccatcaaaattcgactgtgactatgcatatgttctagggcatatcggctaccatattcttgcagctggtttgaatggttacatggcaactgtaactaacttgaggaatcctgtgaataagtggcgatgtggtgctgctccaattacagcaatgatgactgttaggcgttggtctcaaaatcctgggactgcttcaattggaaaacctgctattcatccagctactgtagatctgaaaggcaaagcatatgagctgttgagacaaaatgctacaaaattcctgctcgatgatatctacagaaatccaggccctcttcagtttgatggtcctggtgccgattctaaggctgtaacgctatgtgttgaagaccaggattacatggggcgtatcaagaaactgcaggagtatcttgacaagattcggactattgtaaagcctgggtgctcacaagaggttctgaaagcagctttgagtgtgatggcctctgtgacagaagtcctttccgttatgtcctcatctcctatcaatggccaatcgtccctttaatagtaaacttaatttctcttcttcaatcgaacttcactggtgttgatgccttttgtacactgaattttaaaattctttggcatcttcatgtccttttttcttggttagcatgcggaaatgtaggtttggaagtgtcaaattatgggaataatcagagtttgttttcccttttgatgcaactttttttgcaaaataattatgaggattgtatttcaaattttgggaaggataaaatgatgtttgtgaattagtaaggtgccgggtttaacttttggttctttacatctgtatgatcaagacatgtgacactgttatagagtttcattcctctgccata

SEQ ID NO: 1781 - DNA, 2348 bp, Vigna unguiculata
  misc_feature (65)..(65): n is a, c, g, or t
  misc_feature (2305)..(2306): n is a, c, g, or t
  misc_feature (2314)..(2314): n is a, c, g, or t
  misc_feature (2316)..(2316): n is a, c, g, or t
  misc_feature (2342)..(2342): n is a, c, g, or t
ggaccactcaacaactgcaccaaaccacaatagttacactcacacagtagtagcttagaacaacnacaacgtcggagtgtgtttctttcgtacgtttttttgttctctctgttgaggcatcaaaggggttgaatccatggattctgattatggtattcccagggagctttcagatcttcaaaagattcggtctttgtaccagccggagcttcccccttgcctgcagggaaccactgtgagggttgaatttggtgatgctaccaccactgctgaccccactgacgcccccaccatcgccagggcttttcctcacacctacggacaccctttggctcactttctcagggccactgccaaagtccctgatgctcagatcataaccgagttccctcctattagagtgggagttgtcttttgtgggagacaatctcctggaggacacaatgttatctggggtctccacaatgctctcaaaattcataattccaacagtgttttgcttggatttcttggtggttcagaaggtctgtttgcccagaaaactctcgagataaccgacagtgttctttccacatacaaaaaccaaggtggttatgatttacttggccggacaaaagatcaaattaggaccaccgagcaggttaatgctgcgcttgcaacatgcaacaatttgaaactggacggccttgtcatcatcggaggggtgacttcaaacacggatgctgcacaacttgcagaaacttttgctgtagccaactgccccactaaggtggttggtgtacctgtgactcttaatggagatcttaaaaaccagtttgtggaaacgaatgttggttttgatacaatttgtaaggtcaattctcagctcatcagcaatgtctgcactgatgcactgtctgcagagaagtattattattttatccgtcttatggggcgcaaggcatcacacgttgctttggaatgcactctccagtcccatccaaacatggtaattcttggtgaggaggttgctgcatcaaagctgaccctttttgaaataacaaaacagattactgatgcagttcagactagggcagagcaagacaaataccatggagtaatcctccttccagaagggctgatagagagcattcctgaagtgtatgcactcttgaaggaaattcatggattactcagacaaggtgttgctgttgacaagatatcttctcagctttcaccatgggcatctgctctatttgaatttttgcctccctttattaggagacagttgctcctttaccctgaatccgatgactcagcacagttatcacagattgaaactgagaaattactagcatatcttgtggaagcagagataaacaagcgcctgaaagaaggcacatacaagggaaagaagttcaatgccatctgccacttttttggttaccaagctcgtggatcgctaccatcaaaatttgactgtgattatgcatatgtccttggacacatctgctaccatatactggccgcaggtcttaatggatacatggcaactgtaaccaacctgaagaatcctgtaaacaagtggcgatgtggggctgctccaatcgcagctatgatgactgtgaagcgatggtctccaaatccaggagccacatcgattggaaaacctgctattcatccagctaccgtggacttgagaggcaaagcttatgagctgttgagacaaaaagcagcaagctttctcatggatgatatttacagaaatccaggtccacttcagtttgatggtcctggtgcagatgccaaagtcataactctctctgttgaagaccaggactacatgggccgcattaagaagcttcaggagtaccttgaacaggtccgaaccattgtaaaaccagggtgccctcaggaggttttgaaggcggcgctcagcgtgatggcgtcggtgactgaagttctggcagccatgtcaaccacttctacgaacagtctggcagccctttgagaggagcagatggaagttgtattcttttccaaaattttcaggcctaaggtttagtttcttcattttgtagccatggaagtagctgatgattggaaataagttagatctgacatggtgcatgtcaagggtgagattatactgtagtcaaagttttggctgtgttcccaaatatttttttgttttttcaagacatgagagttcattccatgtgagacaatgtttgataatttagcttggtgcttaagattgttactgttttgtttgttcttcctaggacatttcttttttgatcttatgtttttgttccaaacgttnntatcccanantgaaattccagccctttaaattctancattca

SEQ ID NO: 1782 - DNA, 2307 bp, Cucumis sativus
gttgaggttagttggtaattggtatcatcgccaaacaccaaacaaacgccaatacaggcgaagggttagcgtgagtgtgaagcctataaattgcctcatttcgaagtttgacggaaacgtattaacccaaaaccctcaaacaatcaaaaccctcactaactctacatcttctctctttcttcttcatccttcatctcccatggattctgattacggcattcctcgtcaactctccgatcttcagaaaatccgatctctctaccaacctgaccttcctccttgtcttcagggaacagcggtcagggttgaattcggggatggcactacagctgtggatcctgctgatgcccctaccgttagtcgggcctttccccacacttacggtcagcgattggctcactttctcagggcgactgctaaagtccctgatgctcaaattattactgaacatccagccatccgggtgggagtagttttttgtggaaggcaatcccctggaggtcataacgtcatttgggggcttcatgatgctctcaaagtccacaacccaaacagtatattgtttggatttctgggtggttctgaaggtttattttcccagaaaactcttgagatcaccgatgacattcttacaacatacaaaaatcaaggtggttatgatttattgggacgaaccaaggatcaaattcgaactaaggagcaggttaatgctgcactgaaaacgtgcttagatttgaaactggatggtcttgtcataattggcggagtgacgtcaaatactgatgctgctcaacttgctgaaacctttgcggaagctaaatgccccaccaaggttgtaggagttcccgttactttgaatggcgatctcaagaaccagtttgttgaaacaaatgttggttttgacaccatatgcaaggtcaattctcagctaatcagcaatgtatgcactgatgccctgtctgcagagaagtactactatttcattcgactcatgggccggaaagcatcccatgttgctttggagtgcactcttcaatctcatccgaatttggttattcttggtgaggaggtagctgcatcaaaacttactctttttgatttgacgacacagatatgtgatgctgttcaggctagagcacaacaagacaagtaccatggggtcatcttactgcctgaagggcttattgaaagtattcctgaaatctatgcccttttgaaggaaattcacagtttactcaggcaaggagttctggttgataagatttcttcccaactctctccttgggcatcagcgctatttgaatttctgccacctttcatcaggaagcagttgctacttcatcccgaatcagacgattctgctcagttatctcagattgagacggagaaacttctggcacatcttgtggaggctgaaattagcaagcgtctgaaagaagggacttataaggggaagaaattcaatgcaatttgccacttctttggttaccaggctcggggatctttaccttcaaaatttgattgcgactatgccttcgttcttggccatgtttgctaccatatcttagctgctggtttgaacggttacatggcaactttaactaacctgaaaaatccagtgaacaaatggcgctgtggtgctgccccgattgcagccatgatgactgtgaagcgttgggctcaaaatcctggatcatcgtccattggcaaaccagcaattcacccagcaactgtggatttgaaagggaaagcatacgagctattgagacaaaacgcgaatcagtttcttatggacgatctctatagaaaccctggacctcttcagttcgatggtcctggtgctgatgctaagcccgtttccctttgcgttgaggaccaggattacatgggccgcatcaagaaactacaggaataccttgataaggtccgaaccatcgtgaaaccagggtgttcgcaggaggttctgaaagcagcattaagtgtcatggcgtcagtgactgatgtcctttctgttatgtcttcgagttcattcagcggaaaagcatcactagaaggataattgaactcattttatgttgtgttttttcaccagtgacaatgacggtgtttggtgattttctaaaaccttgtctacttcggctaagcggaattgggttatagatatgatctgatgatgactgatgagttttcaatttatggcataacattttttatgaataagtaccgaccccctgcagtttttgggctatctgtaaagtactttttttttcctttttaccagagtttgggtttgtaatatggaaggaa

SEQ ID NO: 1783 - DNA, 2794 bp, Eucalyptus grandis
ggtgtcctaaaatctgctccccctccctccgtccccaccctaaagcaatcacataaaaacccgtcactccaacgagcacttctccgccatcttctgcttcactttctctctcaactactcctctctctctctctctctctctctctagagctttctctctcgccggagctccccgcccggatcggaaatggagtcggactacggcattcccagagagctctccgacctccagaagcaccgatctctctaccagcccgacctccctccttgcctccaggggacgaccgttcgtgtagaatttggcgatgctaccactgctgctgatccagctggttctcacaccatcagccgaagctttccacacacctatggtcagcctttggctcatttccttcgggcaactgccaaggttgctgatgctcagatcatcaccgagcatcctgctaagagggttggaatagtcttctgtgggagacagtctcctggaggacataatgtcgtatggggtctctacagtgctctcaaaatccacaaccccagtagtgtcctacttggttttttgggtggctctgaaggtttgtttgcccagaagactctagagatcacagatgaaattctctcgacctacaagaatcaaggtggttatgatttgttgggccgtacaaaggaccaaataagaacaaccgagcaagtcaatgctgcactgacaacatgcaagaacttgaaattagacggtcttgttattattggaggggtcacgtcaaatactgatgcagctcagcttgcagagacatttgctgaagccaaatgctcaacaaaggttgttggtgttccggttaccttaaatggagatctcaagaacccatttgtggagactgacgttggttttgatactatctgcaaggtgaattcccagctcatcagcaatgtctgcacggatgctctttctgcagagaagtactattattttattcggctcatgggacggaaggcatcacatgtggccctggaatgcactttacagtctcaccctaatatggtaattcttggggaggaagttgctgcgtcaaagcttactctttttgacctggcaaagcagttatgcgatgctgttcaagctagggcagaacaagataagaaccatggtgttatcctaataccagaagggcttattgaaagtattcctgaagtctattctcttttgaaggaaattcatggattgctcaggcaaggtgtctccgtggacaaaatttcctctcaactttctccttgggcgtcggcactttttgaatttttaccaccatttatcaagaagcagctactccttcatcctgaatcagatgactccgcacagttatcccagatcgagacagagaaacttttagctcatctcgtggaggtcgaaatgaacaagcggctgaaagaaggaacgtacaaggggaaaaagttcaatgcaatatgccacttttttggttatcaagctaggggatccttaccgtcgaagttcgactgtgattatgcctatgttttggggcacatttgctaccatatattggctgctggtttgaatggatacatggccactgtaactaatctaaagaatccacagaataagtggcgctgtggtgctgctcccataacagcaatgatgactgtcaagcgctgggcccaaaatcccaattcctcctttattggtaaacctgccatccatccagccactgtagatttgaaaggcaaagcatatgagctgctgcaacagaatgcagtcaaattcttgttggatgatctctacagaaatccaggacctcttcagttcgatggtcctggtgctgatgccaagcctgtaactttgtgtgtggaagaccaggactacatgggccgcatcaagttgcttcaggaatatcttgacaaggtccgcaccattgtgaaaccggggtgttcacaggaagttcttaaagcagctttgagttccatggcatctgtaaccgaagtcctctctgtcctgtccacgccttcatccaacggcatgaactccctctgagcacaccacagttagaacttgttgaactctgcatgcgccccccactcgtttttcttgacctattatcgacttgctgggtggatactgtgtgacgagaagcaataaaaaaggagaaattctccttctcgtgctactttatgcccatgcgaggataagattagtcttagaaggtgagaggttgaagttttgttttatcttctaatttataagccagtcatgttttttttcttgttttccccctttgcggtttcttaacttctaggcaggctgtgctgtgttttgcttcccaataatctgttcgccgaaaattgtattgattttggagtgttgtatgggcatcttaatgcaacataattggatccttccaacatagtgatgctttgcacctcaatgcatctggtatgcaggagagtatttaactcaggtgtagatgactaagtatctatcgatacctttgattagtgctatttgatccatctgaaatggtgagtgctatttgaacttagtttgtgcgtcggggtacaaatcaagtccagctgctcgtgaataaatcggattcagcttgatgactacttgagatcgacttgcctaatttcaagttgagcttgagttcgggttattgagtatcttgttcagtcaaagattgagcctataatcgagctttcattattgtttaacaaaaggttaacaacgataaaagtaaacgcaaaatacttaaaatcgtgtgaactcaagttattcgaagttgagctt

SEQ ID NO: 1784 - DNA, 2336 bp, Glycine max
agcattcaacattcacccacaaactcaacacaccaaacagaaatagttacactcagagtagtgaacaacaacagcaacaacaacaacaacgttgcagtgtgttgtattgtttcttagtgcacttttttttggcatcaaagaggttaaatccatggattctgattatggtattcccagggaactctcagatcttcaaaagattcggtcgttgtaccagccagagcttcctccttgtctccagggaaccactgtgagggttgaatttggtgatgcaaccaccactgctgaccccactgatgcactcaccattagcagggcgtttcctaacacctatggacaccctttggctcactttctcagggcaactgccaaagtccctgatgctcagatcataactgagttccctcctattagggtggggattgtcttttgtgggagacaatctcctggagggcataatgtcatttggggtctccacaatgctctcaaaattcacaatcccaacagtgttttgcttggatttcttggtggttcagaaggtctgtttgcccagaaaactctggagataactgaggatattctttcgacatacaaaaatcaaggtggttatgatttgcttgggcggacgaaagatcaaattaggaccacagaacaagttaatgctgcacttgctgcatgcaacaatttgaaacttgatggccttgtaatcatcggaggggtgacatcaaacacagatgctgcacagcttgctgaaacatttgctgtagcaaaatgccccacaaaggtggttggtgttcctgtcactctaaatggagatcttaaaaaccagtttgtagaaactaatgttgggtttgacacaatttgtaaggttaattctcagctcatcagcaatgtctgcaccgatgctctctctgcagagaagtattattatttcatccgtcttatgggacgcaaggcatcacatgttgctttggaatgcaccctccagtcccatccaaacatggtaattctgggtgaggaggttgctgcatcaaagcttaccctttctgaaattgcaaaacagattactgatgcagttcaggctagagcagagcaagataaataccatggagtaattctccttccagaagggctgatagagagtattcctgaagtgtatgcactcttgaaggaaattcatggtttactcagacaaggtgttgctgttgacaagatatcttctcagcttaccccatgggcatctgccctatttgaatttctgccaccctttattaggagacagttactcctttaccctgaatccgatgactcagcacagttatcgcagattgaaactgagaaattactggcatatcttgtggaagtagagataaacaagcgtctgaaagaaggcacatacaaggggaagaaattcaatgccatttgccacttttttggttatcaagctcgtggatctctgccatcaaaatttgactgtgattacgcatatgttcttggacacatctgctaccacatacttgccgctggtctaaatggatacatggcaactgtaactaacctgaagaatcctgtaaacaagtggcgatgtggggctgctccaatagcatctatgatgactgtgaagcgctggtctccaaatccaggagccacatcaattggaaaaccagctattcatccagctactgtggacttgagaggcaaagcatatgagctgttgagacaaaaggcacaaagctttcttatggatgatatctacagaaatccaggtccacttcagtttgatggtcctggtgcgggtgcgaaggttataactctttctgttgaagaccaggactacatgggccgcattaagaaacttcaggagtaccttgaacaggttcgaaccattgtgaagccaggatgcccccaggaggttttgaaagctgctctaagtgtcatggcgtcggttactgaagttctagctgcaatgtcaacatcttctactaacaccctgtcagccatgtgagagtaacaaatggatgttgtattctttccaaaattttctggcacgaggttttagtttctacattttattgccatggaagtagttgttgattggaaataagagttatagctgacatggtgcatgtcaacgtgagatgagatttactgtaatcaaagttttggctctctatgttccctactgggtcatttttttttttacaaaacatgagggttccgtgtgacactgataatttagcttggtgcttgagattattattgttgttctatttttaggacatatctttttgtgatatcccgaactttatattagaggtgtttttattcgtaacttt

SEQ ID NO: 1785 - DNA, 2331 bp, Glycine max
agcattcaacattcacccacaaactcaacacaccaaacagaaatagttacactcagagtagtgaacaacaacagcaacaacaacaacaacgttgcagtgtgttgtattgtttcttagtgcacttttttttggcatcaaagaggttaaatccatggattctgattatggtattcccagggaactctcagatcttcaaaagattcggtcgttgtaccagccagagcttcctccttgtctccagggaaccactgtgagggttgaatttggtgatgcaaccaccactgctgaccccactgatgcactcaccattagcagggcgtttcctaacacctatggacaccctttggctcactttctcagggcaactgccaaagtccctgatgctcagatcataactgagttccctcctattagggtggggattgtcttttgtgggagacaatctcctggagggcataatgtcatttggggtctccacaatgctctcaaaattcacaatcccaacagtgttttgcttggatttcttggtggttcagaaggtctgtttgcccagaaaactctggagataactgaggatattctttcgacatacaaaaatcaaggtggttatgatttgcttgggcggacgaaagatcaaattaggaccacagaacaagttaatgctgcacttgctgcatgcaacaatttgaaacttgatggccttgtaatcatcggaggggtgacatcaaacacagatgctgcacagcttgctgaaacatttgctgtagcaaaatgccccacaaaggtggttggtgttcctgtcactctaaatggagatcttaaaaaccagtttgtagaaactaatgttgggtttgacacaatttgtaaggttaattctcagctcatcagcaatgtctgcaccgatgctctctctgcagagaagtattattatttcatccgtcttatgggacgcaaggcatcacatgttgctttggaatgcaccctccagtcccatccaaacatggtaattctgggtgaggaggttgctgcatcaaagcttaccctttctgaaattgcaaaacagattactgatgcagttcaggctagagcagagcaagataaataccatggagtaattctccttccagaagggctgatagagagtattcctgaagtgtatgcactcttgaaggaaattcatggtttactcagacaaggtgttgctgttgacaagatatcttctcagcttaccccatgggcatctgccctatttgaatttctgccaccctttattaggagacagttactcctttaccctgaatccgatgactcagcacagttatcgcagattgaaactgagaaattactggcatatcttgtggaagtagagataaacaagcgtctgaaagaaggcacatacaaggggaagaaattcaatgccatttgccacttttttggttatcaagctcgtggatctctgccatcaaaatttgactgtgattacgcatatgttcttggacacatctgctaccacatacttgccgctggtctaaatggatacatggcaactgtaactaacctgaagaatcctgtaaacaagtggcgatgtggggctgctccaatagcatctatgatgactgtgaagcgctggtctccaaatccaggagccacatcaattggaaaaccagctattcatccagctactgtggacttgagaggcaaagcatatgagctgttgagacaaaaggcacaaagctttcttatggatgatatctacagaaatccaggtccacttcagtttgatggtcctggtgcgggtgcgaaggttataactctttctgttgaagaccaggactacatgggccgcattaagaaacttcaggagtaccttgaacaggttcgaaccattgtgaagccaggatgcccccaggaggttttgaaagctgctctaagtgtcatggcgtcggttactgaagttctagctgcaatgtcaacatcttctactaacaccctgtcagccatgtgagagtaacaaatggatgttgtattctttccaaaattttctggcacgaggttttagtttctacattttattgccatggaagtagttgttgattggaaataagagttatagctgacatggtgcatgtcaacgtgagatgagatttactgtaatcaaagttttggctctctatgttccctactgggtcatttttttttttacaaaacatgagggttccgtgtgacactgataatttagcttggtgcttgagattattattgttgttctatttttaggacatatctttttgtgatatcccgaactttatattagaggtgtttttattcgta

SEQ ID NO: 1786 - DNA, 2179 bp, Castanea mollissima
aaaaaaaaaaaggaactctcactcgcagacagagttagcgaacaccaaggaattctctgatggattcagattacggcattcccagagaactctccgaccttcaacaactccgatctctttaccaacctgaactccctccttgtctccagggaaccactgtcagggttgaatttggtgatgcagctgcagcagcagaccccgctgatgcccactccatagcccgttactttcccaacacttatggtcagcctttggctcactttctcagggccactgcaaaagtcccagatgctcagatcataaccgagcatccggcttttagggtgggaatagtcttttgtgggagacaatctcctggaggacataatgttgtatggggtctttacagtgctcttaaaattcacaaccccaagagtactttacttggatttctcggtggttcagaaggtttattcgcaaagaaaactcttgagattacagatgacattctttcaacctacaaaaatcaaggtggttatgatttgctgggacggacaaaggatcaaattagaacaaccgagcaagttaattctgccctaaatgcttgcaaagatttgaaattggatggccttgtcattattggaggagtgacatcaaacacagatgctgctcagcttgctgaaacgtttgctgtagcaaaatgcccaacgaaggtgattggtgtacctgttacactgaatggagatctgaagaaccagtttgtggagaccaatgttggttttgatacaatatgtaaggtcaattcccagctcattagcaatgtctgcactgatgcactctccgcggagaagtattattattttatccgactcatgggccggaaggcatcccatgttgctttggagtgcaccctccaatcccatcccaatatggttattcttggggaggaggtggctgcctcaaagcttacactttttgatattgcagcacaaatttgtgatgcagttcaagctagggcagagcaagacaagtatcatggagtcatcttactaccagaaggtcttatagaaagcatccctgaaatatatgccctattgaaggaaattcatagtttgctcaggcaaggtatttccactgacaacatttctactcaactttcaccctgggcatctgctttgtttgaatttttgccaccctttattaagaaacagctgctcctttaccctgaatctgatgactctgcacagttgtcccagattgagacagagaaacttctcgcacatcttgtggaggcagaaatgaacaagcgactgaaagaaggcacatacaaagggaagaaattcaatgctatctgtcacttctttggttatcaggctcggggatcattaccatcaaaatttgactgtgactatgcctatgttcttggacacatctgctatcatatgttagcagctggtttgaatggttacttggcaactgtaactaacttgaagaatcctgtgaataagtggcgttgtgctgctgctccaatgacagcaatgatgactgtgaggcgttggtctcaaaatccgggggccttgtcaataggaaaacctgctattcatccagcaactgtggacttgagaggcaaagcatatgatctgttgaggcaaaatgcagcaagatttctgatggatgatatctacagaaatccaggaccccttcagttcgatggtcctggtgctgatgctaaggttgtaactctatgtgttgaagaccaggattacatgggccgtatcaagaaactgcaggaataccttgacaaggtgcgaaccatcgtaaagccagggtgttcacaggaggttctgaaagccgctttgagcgtcatggcgtctgtgacagatgttcttactgcattggcttcaccttcaactaccacatccccttaaacacagttgttacctttctggttgcgatggccatggtacctgtcttccaaaatacctgttatcttcacttctctttgcttctttttctttttcccccaaatttaatatccttatattgtaggcggatctgatagatgatggtattaaactgagtttttctttgttatttaacatttttcttttggtaccaaataattatgggtggattgtattgcaagttttggaagagaaattttattgtttacgttatgataggaaggttgattatgttc

SEQ ID NO: 1787 - DNA, 2266 bp, Cucurbita pepo
ggaaaaccctcaaacaatcaaaaccctcactaactctacatcttctctctttcttcttcatccttcatctcccatggattctgattacggcattcctcgtcaactctccgatcttcagaaaatccgatctctctaccaacctgaccttcctccttgtcttcagggaacagcggtcagggttgaattcggggatggcactacagctgtggatcctgctgatgcccctaccgttagtcgggcctttccccacacttacggtcagcgattggctcactttctcagggcgactgctaaagtccctgatgctcaaattattactgaacatccagccatccgggtgggagtagttttttgtggaaggcaatcccctggaggtcataacgtcatttgggggcttcatgatgctctcaaagtccacaacccaaacagtatattgtttggatttctgggtggttctgaaggtttattttcccagaaaactcttgagatcaccgatgacattcttacaacatacaaaaatcaaggtggttatgatttattgggacgaaccaaggatcaaattcgaactaaggagcaggttaatgctgcactgaaaacgtgcttagatttgaaactggatggtcttgtcataattggcggagtgacgtcaaatactgatgctgctcaacttgctgaaacctttgcggaagctaaatgccccaccaaggttgtaggagttcccgttactttgaatggcgatctcaagaaccagtttgttgaaacaaatgttggttttgacaccatatgcaaggtcaattctcagctaataagcaatgtatgcactgacgccctgtctgcagagaagtactactatttcattagactcatgggccggaaagcatcccatgttgctttggagtgcactcttcaatctcatccaaatttggttattcttggagaggaggtagctgcatcaaaacttactctttttgatttgacgacacagatatgtgatgctgttcaggctagagcacaacaagacaagtaccatggggtcatcttactacccgaagggctcattgaaagtattcctgaaatctatgctctcttgaaggaaattcacagtttactcaagcaaggagttctggttgataagatttcttcccaactctctccttgggcatcagcgctatttgaatttctgccacctttcatcaggaagcagttgctacttcatcccgaatcagacgattctgctcaactatctcagattgagacagagaaacttttggcacatcttgtggaggctgaaattaacaagcgtctgaaagaagggacttacaaggggaagaaattcaatgccatttgtcacttctttggttaccaggctcggggatctttaccttcaaaatttgattgtgactatgcctatgttcttgggcatgtttgctaccatatcttagctgctggcttgaacggttacatggctactctaactaacctgaaaaatccagtgaacaaatggcgctgtggtgctgccccgattgcatccatgatgactgtgaagcgttgggctcaaaatcctggagcgtcatccattggaaaacctgcaattcacccagcaactgtagatttgaaagggaaagcatacgagctattgagagaaaatgcgagcaagtttcttatagacgatctctatagaaaccctggacctcttcagtttgatggtcctggtgctgatgccaagcctatctctctttgcgttgaggaccaggattacatgggccgcatcaagaaactacaggaatatcttgataaggtccgaaccatagtaaaaccagggtgttcccaggaggttcttaaagcagcattaagcgtcatgggatcggtgaccgatgttctctcagttatgtcatcgagttccttcagtggaaaggcatctttggaagcgtagtgaacttattttatgtgatgctcttccggtgacaatgtgattttctttaaccttgtttacttcagctggcagaattgggtagaggataactactgatgagttttcaatttatggtgtaacatttttctgtaataagtaccacagaggtatgtttcgcagttttgggagaatgtgaacattttcttatcattttcatatttagtctacagtagctatcattcatctggtttgttcccgaatgcgctactgtgtggtaattcgactcgtgtttcacttgcacaatgacaataacaaatataaataatgcaaccaagtagtgaacttagtgtgaac

SEQ ID NO: 1788 - DNA, 2199 bp, Eucalyptus grandis
gcagcagcagcagcagcagcagcagcacaaaaagccatcgagaaatggattccgattacggcattccccgcgagctctccgacctccagaagcaacgctccctctaccaccccgagctccctccttgcctccagggaacgaccgtcagggtggagtacggcgatgccacgacggcggcggatcctgccgacgttcattccatcagtagatacttcccgcacacctacggccagcctttggctcacttcctccgggcgactgccaacgtccctgacgctctgattataacggagcatccgcctatcagggtgggtatagtattctgtggcagacaatctccgggaggacataacgttatctggggtctttaccacgctctgaagatccacaaccctaagaatgtgttgcttggatttcttggtggttctgaaggtctttttgctcagaaaactcttgagataacggatgacatcctgtcaacttacaaaaaccaaggcggttatgacttgcttggtcggacaaaggatcaaataagaacaacggagcaagttaatgctgcactaatttcatgcaatgacttgaaattggatggacttgtcattattggaggggttacgtcaaacacggacgctgctcagcttgccgaaacatttgctgaagcaaaatgcccgactaaggtggttggtgttcctgtgacactgaatggagatttgaagaatcaatttgtggaaactaatgttggctttgatacaatttgtaaggtgaattcccaactcatcagtaatgtctgcacagatgccctttcagctgagaagtactattattttatccgactcatgggccggaaggcatcgcacgtagctttggaatgcactctccagtcccatccgaatatggtgattcttggagaggaagttgctgcatcaaagcttactctttttgacattacaaaacaaatctgtgatgcagttcaagctagagcagtgcaagaaaagtaccacggggtcatcctattgccagaaggactgatagagagcattcctgaagtttatgcccttttgaaggaaattcacggattgctcaagctaggtgtttctgctgataacatttcctctcaactttcaccctgggcatcagcattatttgagtttttgccacccttcatcagaaaacagctgatccttttccctgagtcagatgactctgctcagttgtcccagattgaaactgaaaaacttttagcacatctggtggaggcagaaatgaaaaagcggatgaaagaaggaacatacaaggggaagaaattcaatgctatatgccacttctttggttatcaagctcggggatctttaccatcaaaatttgattgcgactatgcttatgttcttgggcatatctgctaccatattctagctgctggcttgaatggttacatggctactgtaactaatttgaagaatcctgtcaataagtggcgctgtggtgctgcccccattgcatcaatgatgactgtcaaacgatgggcacaaaatccagcggcctcatccattgggaaacctacaattcatccagccactgtggacttgaaaggaaaagcctacgagttgctgagacaaaatgcaacaaaattcttgatggaggacgtctatagaaatccaggaccccttcaatttgatggccctggtgtggactctaagccagtaactctgtgtgtggaagaccaggactacatgggccgtattaagaagctccaggaacatctggataaggtccgaactattgtaaagccagggtgttcgcaagacgttctgaaggcagctctgagcattatggcttccgtcaccgacgttctctcggttatgtccatgcctacctccaatgggtcaccactttgagtgaccaaattttttggagtgcccagctcttgtacagttgtacattccttcactcttcgttttccttatgaatcaggattgcggtggagttactttaaggtggtggtaataaatttaggttagccgtctttctcagttgctgtatctggagggaaaatccagaggattgttccacgaactttgggagactcagattgttttgctaagttttaaagtactgtgagttcacgttctgaactataggtaaatctgtacaactgtctgtcggatttctcacccaggaaattcctagttgaagtgctac

SEQ ID NO: 1789 - DNA, 2276 bp, Quercus alba
caccaaaaacctcaaaaactaggtaaaacaaataaaactaaaaccaaaaaaaaaaaaactcaaagagtcgcagacagagttagcgaacaccaaggaattctctcatggattcagattacggcattcccagagaactctccgaccttcaacaactccgatctctttaccatcctgaactccctccttgtctccagggaaccactgtcagggttgaatttggtgatgcagctgcagcagcagaccccgctgatgcccactccatagctcgttactttccaaacacttatggtcagcctttggctcactttctcagggccactgcaaaagtcccagatgctcagatcataaccgagcatccggcttttagggtgggaatagtcttttgtgggagacaatctcctggaggacataatgttgtatggggtctttacagtgctcttaaaattcacaaccccaagagtactttacttggatttctcggtggttcagaaggtttatttgcaaagaaaactcttgagattacagatgacattctttcaacctacaaaaatcaaggtggttatgatttgctgggacggacaaaggatcaaattagaacaactgagcaagttaattctgccctaaatgcttgcaaagagttgaaattggatggccttgtcattattggaggagtgacatcaaacacagatgctgctcagcttgctgaaacatttgctgtagcaaaatgcccaacgaaggtgattggtgtacctgttacactgaatggagatctgaagaaccagttcgtggagaccaatgttggttttgatacaatatgtaaggtcaattcccagctcattagcaatgtctgcactgatgcactctccgcagagaagtattattattttatcagactcatgggccggaaggcatcccatgttgctttggagtgcaccctccaatcccatcccaatatggttattcttggggaggaggtggctgcctcaaagcttacactttttaatattgcagcacaaatttgtgatgcagttcaagctagggcagagcaagacaagtatcatggagtcatcttactaccagaaggtcttattgaaagcatccctgaaatatatgccctattgaaggaaattcatagtttgctcaggcaaggaatttccactgacaagatatctactcaactttcaccttgggcatctgctttgtttgagtttttgccaccctttattaagaaacagctgctcctctaccctgaatccgatgactctgcacagttgtcccagattgagacagagaaacttcttgcacatcttgtggaggcagaaatgaacaagcgtctgaaagaaggcacatacaaagggaagaaattcaatgctatctgtcacttctttggttatcaggctcggggatcattaccatcgaaatttgactgtgactatgcctatgttcttggacacatctgctatcatatgttagcagctggtttgaatggttacttggcaactgtaactaacttgaagaatcctgtgaataaatggcgttgtgctgctgctccaatgacagcaatgatgactgtgaagcgttggtctcaaaatccgggggctttgtcaataggaaaacctgctattcatccagcaactgtggacttgagaggcaaagcatatgatctgttgaggaaaaatgcagcaaaatttctgatggatgatatctacagaaatccaggaccccttcagttcgatggtcctggtgctgatgctaaggttgtaactctatgtgttgaagaccaggattacatgggccgtatcaagaaactgcaggaatatcttgacaaggtgcgaaccatcgtaaagccagggtgttcacaggaggttctgaaagcagctttgagcgtcatggcgtctgtgacagacgttcttactgcattggcatcaccttcaactaccacatccccttaaacacagttgttacctttctggttgtgatggccgtggtacttgtcttccaaaatacttgttatcttcacttctctttgcttctttttctttttcccccaaattttatgtccttatattgtaggcagatctgacagatgatgttattaaactgagcttttctttgttatttaacatttttcttttggtacaaaataattatgagtggattgtattcaagttttggaagagaaatttttttgtttaccttatgataggaaggttgattatgctctctgttttgaagcttctataagatcaatggcttcatggaatttgacgacgtgg

SEQ ID NO: 1790 - DNA, 2330 bp, Trigonella foenum-graecum
tttgaagtagttgttgttttaggtacaacataaaaagggttacccaacacaacactctcaaaaaacataacacaaacgttatacacacttcactctcctagtagaacttagtatctctcgccaccaccaactacgatggattctgattatggtattcctagagaactctcagatcttcaaaagttgagatctttgtaccaacctgaacttcctccttgtcttcaaggaacaactgttagggttgaatttggcgatggaacaacatctgctgatccatctgatgagccttctataagtagatctttccctaatacctatggacaccctttggctcactttcttagggctactgctaaagttcctgatgctcagatcataactgaacaccctcctattagggttggaattgttttctctggaagacaatctcctggtggacacaatgttatttggggtcttcactctgctctcaagattcacaatcctaacagtgttttgcttggatttcttggtggttcagaaggtctatttgctcagaaaactttggagataactgacgatattctctccacatacaaaaatcaaggtggttatgatttgcttggacggacaaaagatcaaattaggaccactgaacaagttaatgctgctcttgctgcatgcaacaatttgaaacttgatggccttgtcatcattggaggtgtgacatcaaacacggatgctgcgcagcttgcagaaacatttgctgttgcaaaatgccccacaaaggtggttggtgttcctgtgactttgaatggagatcttaaaaaccagtttgtggaaacaaatgttggttttgatacaatttgtaaggtgaattctcagctcatcagcaatgtctgcactgatgctctctctgcagagaagtattattatttcattcgtcttatgggacgcaaggcatcacatgttgcattggaatgcactcttcagtcccatccaaacatggtaattcttggtgaggaggttgctcaatcaaagcttaccctttttgaaatttcacgaaagatttctgatgcagttcaggctagagcagaacaagacaaatatcatggagtaatccttattccagagggtctgattgagagcattcctgaagtgtatgcacttttgaaggaaattcacggtttactcagacaaggtgttgcttctgaaaagatatctagtcagctttcaccatgggcttctgctttatttgaatttctaccaccatttatcaggagacagcttctactttatcctgaatcagatgactcagcacagttgtctcagattgagactgagaaacttctagcataccttgtggaagtagagataaacaagcgtcagaaagaaggcacatacaagggaaagaaattcaatgcgatttgccacttttttggatatcaagctagaggatcccttccatcaaagtttgactgtgactatgcatatgttcttggacacatcagctaccatatactagctgctggtttgaatggatacctggcaactgtaactaacttgaagaatcctgtaaacaagtggaaatgtggtgctgctccaatttctgctatgatgacggtgaagcgttggtctcctaatcctggagccacatcaattggaaaacctgctatccatccagctactgtggatttgagaggcaaatcatatgagctgttgcgtcaaaatgcgacaagctttcttatggacgatatttatagaaatccaggcccgcttcaatttgatggtcctggtgcagatgccaagcctatcactcttaatgttgaagaccaagactacatgggtcgcattaagaaacttcaggagtaccttgaacaggtacgaaccatcgtaaagccagggtgccctcaagaggttctgaaagcggctttgagcgtcatggggtcggttaccgaagttctaactgcaatgtcttcatcttccggcaacacgtcttccctctaagtgtgacattttggaagctgtattcttttcaaaattttctggcgtaacatttttgttttttagtttttaacattttattatagccgtggaagtagttaatggttgagaaataaagtattagatgagacaaggtgcatgtcgacatggaatttgtgagattactttattcaaagttttggttccatcactttctttatataataactgagtaattttttttagtgccaattgagaatttgtttgcatgagttgtattttatcttactcacatagtagccattgattatttttgcttagatcattatagcttgaggtataatattagacttttttgtccgaaaaaa

SEQ ID NO: 1791 - DNA, 2167 bp, Tripterygium wilfordii
atttcggcattccgagacagctctccgatctccagaagctccgatctcagtaccaaccggagctccctccctgtcttcagggaaccactgtcagagtggaatttggtgatgcaacaactgcacaagacccagcggatgtccacactattagtcgatccttcccgcatacatatggtcagcctttggctcactttcttagagcaaccgcaaaggtccccgatgctcatattatcgcagatcatccagcgattagggtaggaatagtcttttgtggaaggcaatctcctggaggacataacgtcatttggggacttcacgatgctcttaaaatccacaatccaaacagcacattgcttgggtttctcggtggatcagaaggattgtttgcacagaaaacccttgagatcacagatgacgttcttgcaacctacaaaaatcaaggtggttatgatttactgggacgtacaaaagatcaaataagaacaactgagcaagttaatgctgcattaactgcatgcaataacttgaaattggatggccttgtgattataggaggtgtcacatcaaacactgacgctgctcaacttgctgagacatttgctgaagctaaatgtccaacaaaggttgttggtgtacctgttaccttgaatggggatcttaagaatcaatttgtggaagctaatgttggttttgatacaatatgcaaggtcaattcccagctcattagcaatgtctgcactgatgctctctctgcagagaagtattattattttatccggctcatgggcagaaaggcatcgcatgtggctttggagtgcactctccagtctcatccaaatatggtggtcctgggtgaggaggtagctgcatcaaaacttactctttttgatattacgaaacaaatttgtgatgctgttcaagccagatcagatcaagataagtaccacggcgtcatcttattgcctgaggggctcatagaaagcattcctgaagtttatgctctgttgaaggaaatacatggtttgctccagcaaggggttactgttgacagcatttcatctcaactttcaccttgggcatctgcattatttgagtttttgcctccatttatcaaaaaacagctgctccttcaccctgaatcagatgactccgcacagttatcgcagattgagacagagaaacttgttgcacatctagtggagactgaaatgaccaagcgcctgaaggaaggctcatacaaggggaaaaagttcaatgcgatctgtcacttttttgggtatcaggctcggggatccttgccatcaaaatttgactgtgactatgcctatgttcttggacacatatcctaccacattttggtggctggtttgaatggctacatggcaactattaacaatttgaagaaccctttgaacaagtggcgttgtggtgctgctccaattacagcaatgatgactgtgaagagatgggctcaaagtcccggtgcctcttcaattgggaaaccatctatccacccagccactgtggatttaaaaggaaaagcatatgagctactgagacaaaatgcagctaaactcttggtggacgatatttacagaaatcctgggcctcttcaatttgatggtcctggtgctgatgctaagcctgtaactctctgtgtcgaggaccaggattacatgggccgtatcaaggaattgcaggaatatcttgacaaggtacgaaccattgtgaaacctggctgttcagtggaagttctgaaagcagctttgagtgtcatggcctctgtgacagaagtcctctctgtgatgtcgtcgtctcctggcaatcacaaaatcctttgagaaataatttccagaattgattgtcctttggcaccctctatgcactaatttattgtatcttcaactgttggtgtattggtcaagcttttctttttctaaataatttccagagttgattgtcctttggcaccctctatgcgctaatttattgtaccttcaactgttggtgtattggtcaagcttttctttttctttttcctagaagatataattgcaaaacttccttctgtgagagagtgaccaggcgactgtattttgagttttcattaggatcaaattttgtttatgccaaaccccagtgtgtgtgaatgtttcattttgcaatc

SEQ ID NO: 1792 - DNA, 2245 bp, Lotus japonicus
aacatcccaccaaatacaaacaacaatagttacttacactcttccatagtactcatcgccaacaacaacaacaacaacaacgtttgtgttgtgtttctcaccctctcttcttctgccatggattctgactatggtattcccagagaactctcagatcttcaaaagcttagatccttgtaccagcctgagcttcctccttgcctccagggaaccactgtgagagttgaatttggtgatgctaccacaactgctgacccttctgatgcccctgctataagcagagcttttccacacacctatggacaccctttggctcactttctcagggccactgctaaagtccctgatgctcagattattactgagcacccaccaatgagggtagggattgttttttgtggaaggcaatctcctggaggacacaatgtcatttggggtcttcacactgctctcaaaatccacaatcctaaaagtgttctacttggatttcttggtggttcagaaggtctatttgcccagaaaactctggagataactgacagtgttctttccacatacaagaatcaaggtggttatgatttgcttggtcggacgaaagatcaaattaggaccacagagcaagttaatgctgctcttgctgcatgcaacagcttgaaacttgatggtcttgtcatcattgggggggtgacatcaaacacagatgctgcccagcttgcagaaacgtttgctgaagcaaaatgccccacaaaggtggttggcgttcctgtgactttgaatggagatcttaaaaatcagtttgtggaaactaatgttggttttgataccatttgtaaggtgaattctcagctcatcagcaatgtctgcactgatgctctctctgcggagaagtattattatttcatccgtcttatgggacgcaaggcatcacatgttgctttggaatgcaccctccaatcccatccaaacatggtaattcttggtgaggaggttgctgcatcgaagcttaccctttttgaaattacgaaacagatttcggatgccgttcaggctagagcagagcaagacaaataccatggagtaatcctcctgccagaagggttgatagagagcatccctgaagtgtatgcactcttgaaggaaattcacactttactcagacaaggtgttgcggttggcaagatatcttctcagctttcgccatgggcatctgctctattcgaatttctaccaccatttattaggaaacagctactcctttaccctgaatcagatgactctgcacagttgtcacagattgaaactgagaaactactagcataccttgtggaagcagagataaacaagcgtcagaaagaaggcacatataaggggaagaaattcaatgccatttgccattttttcggttatcaagctcgtggatcccttccatcaaagtttgactgtgactatgcatatgttcttggacacatctgctcccatatactggctgcaggtttaaatggatacatggcatctttaaccaacctgaagaatcctgtgaacaagtggcgatgtggggctgctccaatttcttcaatgatgactgtgaagcgttggtccccaaatccaggagccacatcaattgggaaacctgctattcatccagctactgtggaattgagaggcaaagcatatgatctcttgaggaaaaacgcaacaagctttcttctggatgatatttatagaaatcctggtccacttcaatttgaaggtcctggtgctgatgccaaacctataactctttctgttgaagaccaggactacatgggtcgcattaagcaacttcaggtgtaccttgaacaggttcgaaacattgtaaagccggggtgccctcaagaggttctgaaagcagcgctgagtgccatggggtctgttactgaagttctgtctgtcatgacgtcgtcagctgctagtaacggcctttcatccctttaagagtaacagatggaacttgtattctttttgaaattttgtggcttaacgttgttctcttttatttacatttgatagccatggaggtagctgatggttggaaataagagttttgaaatgatgtgaacatgagattattgtattagaagttttgactctctttcatataacggtgattttttcgacatcagtgttccatgtggcattgtttgagattattcctgttcttattgggatagctcattttttgattttctatacttacatttttttt

SEQ ID NO: 1793 - DNA, 2384 bp, Glycine max
ttttcaaccaacacaacaccaaataatagttacactaacacacagtagtgaacaacaactccaacaacaacaatcaacaacaacaacaacgttgtagtgtgttgttttgttttttagtgcagtttatttttttggcatcaaagtggttgaatccatggattctgattatggtattcccagggaactctcagatcttcaaaagattcggtctttgtaccagccagagctccctccttgtctccagggaaccactgtgagggttgaatttggtgacgcaaccaccactgctgaccccactgatgcactcaccgtctgcagggcttttcctaacacttatggacaccctttggctcactttctcagggccactgccaaagtccctgatgctcagatcataactgagttccctcctattagggtggggattgtcttttgtgggagacaatctcctggagggcataatgtcatttggggtatccacaatgctctcaaaattcacaatcccaacagtgttttgcttggatttcttggtggttcagaaggtctatttgcccagaaaactctggagataactgacgatattctttcgacgtacaaaaatcaaggtggttatgatttgcttgggcggacgaaggatcaaattaggaccacagaacaagttaatgctgcacttgctgcatgcaacaatttgaaacttgatggccttgtcataatcggaggggtgacatcaaacacagatgctgcacagcttgctgaaacatttgttgtagcaaaatgccccacaaaggtggttggtgttcctgtcactctgaatggagatcttaaaaaccagtttgtagaaactaatgttggttttgatacaatttgtaaggttaattctcagctcatcagcaatgtctgcactgatgctctctctgcagagaagtattattatttcatccgtcttatgggacgcaaggcatcacacgttgctttggaatgcaccctccagtcccatccaaatatggtaattcttggtgaggaggttgctgcatcaaagcttaccctttctgaaattgcaaaacagattactgatgcaattcaggctagagcagagcaagacaaataccatggagtcattctccttccagaagggctgatagagagtattcctgaagtgtatgccctcttgaaggaaattcatggtttactcagacaaggtgttgaagttgacaagatatcttctcagctaacaccatgggcatctgctttatttgaatttctgccaccctttattaggagacagttgctcctttaccctgaatccgacgactcagcacagttatcacagattgaaactgagaaattactagcatatcttgtggaagtcgagattaacaagcgtctgaaagaaggcacatacaaggggaagaaattcaatgccatttgccacttttttggttatcaagctcgtggatctctgccatcaaaatttgactgtgattacgcatatgtccttgggcacatctgctaccatatactggccgctggtctaaatggatacatggcaactttaactaacctgaagaatccagtaaacaagtggaaatgtggggctgctccaattgcatctatgatgactgtaaagcgctggtctccaaatccaggagctacatcaattggaaaacctgctattcatccagctactgtggacttgagaggcaaagcatatgagctgttgagacaaaaggcacaaagctttcttatggatgacatctacagaaatccaggtccacttcagtttgatggtcccggcgcagatgccaaggttataactctttctgttgaagaccaggactacatgggccgcattaagaaacttcaggagtaccttgaacaggttcgaaccattgtcaagccaggatgccctcaggaggttttgaaagctgctctaagcgtcatggcgtcggttaccgaagttctagctgcaatgtcaacatcttataccaacaccctggcatccctgtgagagtagcagatggaagttgtattcttccataaaaattctacattttatagccatggaagtagtttttgattggaaataagagttatagctgacatggtgcacgtcaacgtgagatgagatttactgtaatcaaagttttggctctctatgttcccaactgggtaatttttttgttttttgttttttgttttttgttttcaaagacatgtgggatccatgtgaaattgtttgataacttagcttgctgcttgaaattattattgttctttttaggacatctcttttgatattccaaacattatatttgaggtgttttcttcctaactttatttggtatcccataatgaaattccgaccctttaaattctaactttca

SEQ ID NO: 1794 - DNA, 2366 bp, Glycine max
ccaaataatagttacactaacacacagtagtgaacaacaactccaacaacaacaatcaacaacaacaacaacgttgtagtgtgttgttttgttttttagtgcagtttatttttttggcatcaaagtggttgaatccatggattctgattatggtattcccagggaactctcagatcttcaaaagattcggtctttgtaccagccagagctccctccttgtctccagggaaccactgtgagggttgaatttggtgacgcaaccaccactgctgaccccactgatgcactcaccgtctgcagggcttttcctaacacttatggacaccctttggctcactttctcagggccactgccaaagtccctgatgctcagatcataactgagttccctcctattagggtggggattgtcttttgtgggagacaatctcctggagggcataatgtcatttggggtatccacaatgctctcaaaattcacaatcccaacagtgttttgcttggatttcttggtggttcagaaggtctatttgcccagaaaactctggagataactgacgatattctttcgacgtacaaaaatcaaggtggttatgatttgcttgggcggacgaaggatcaaattaggaccacagaacaagttaatgctgcacttgctgcatgcaacaatttgaaacttgatggccttgtcataatcggaggggtgacatcaaacacagatgctgcacagcttgctgaaacatttgttgtagcaaaatgccccacaaaggtggttggtgttcctgtcactctgaatggagatcttaaaaaccagtttgtagaaactaatgttggttttgatacaatttgtaaggttaattctcagctcatcagcaatgtctgcactgatgctctctctgcagagaagtattattatttcatccgtcttatgggacgcaaggcatcacacgttgctttggaatgcaccctccagtcccatccaaatatggtaattcttggtgaggaggttgctgcatcaaagcttaccctttctgaaattgcaaaacagattactgatgcaattcaggctagagcagagcaagacaaataccatggagtcattctccttccagaagggctgatagagagtattcctgaagtgtatgccctcttgaaggaaattcatggtttactcagacaaggtgttgaagttgacaagatatcttctcagctaacaccatgggcatctgctttatttgaatttctgccaccctttattaggagacagttgctcctttaccctgaatccgacgactcagcacagttatcacagattgaaactgagaaattactagcatatcttgtggaagtcgagattaacaagcgtctgaaagaaggcacatacaaggggaagaaattcaatgccatttgccacttttttggttatcaagctcgtggatctctgccatcaaaatttgactgtgattacgcatatgtccttgggcacatctgctaccatatactggccgctggtctaaatggatacatggcaactttaactaacctgaagaatccagtaaacaagtggaaatgtggggctgctccaattgcatctatgatgactgtaaagcgctggtctccaaatccaggagctacatcaattggaaaacctgctattcatccagctactgtggacttgagaggcaaagcatatgagctgttgagacaaaaggcacaaagctttcttatggatgacatctacagaaatccaggtccacttcagtttgatggtcccggcgcagatgccaaggttataactctttctgttgaagaccaggactacatgggccgcattaagaaacttcaggagtaccttgaacaggttcgaaccattgtcaagccaggatgccctcaggaggttttgaaagctgctctaagcgtcatggcgtcggttaccgaagttctagctgcaatgtcaacatcttataccaacaccctggcatccctgtgagagtagcagatggaagttgtattcttccataaaaattctacattttatagccatggaagtagtttttgattggaaataagagttatagctgacatggtgcacgtcaacgtgagatgagatttactgtaatcaaagttttggctctctatgttcccaactgggtaatttttttgttttttgttttttgttttttgttttcaaagacatgtgggatccatgtgaaattgtttgataacttagcttgctgcttgaaattattattgttctttttaggacatctcttttgatattccaaacattatatttgaggtgttttcttcctaactttatttggtatcccataatgaaattccgaccctttaaattctaactttca

SEQ ID NO: 1795 - DNA, 2187 bp, Populus trichocarpa
gaagcaaggaagactacaaaaaaaaaaaagcccgaccaacacacagctacctgcactcctactacctgactcctactacctgaactcaccaaccaaacaacaagaaggaaagggcaaagaggcatggattccgatttcggcatccctagagaactttccgatctccaaaaactccgatctctttaccagccaggactccctccctgtcttcagggaactaccgtgagggtagaatttggggatgtaaccacatgtgcggacccggctgatgtccacgccataagccgagcctttccccacacctatggtcagcccttggctcacttcctcagggcaactgctaaagtccctgatgctcagattataaccgaccatcctgctgtcagggtgggaatagtcttctgcgggagacagtctcctggaggacataatgtcgtatggggtcttcaaaacgctcttaaaatccataatcctaaaagcactttacttggatttctaggaggttctgaaggtttttttgctcagaaaacacttgaaattacagatgacattcttgagacctacaaaaatcaaggcggttatgatttgctgggacggacaaaagatcaaataagaacaaccgaacaggttagggcagcactaactgcatgcaaagatttgaaactggatgcccttgttatcattggaggagttacatcaaatacagatgctgctcagcttgctgaaacatttgctgtggaaaaatgccaaacaaaggtggttggtgttcctgttactttaaatggagatctcaagaatcaattcgtggaaaccaatgttggtttcgatactatatgcaaggttaattcccagctcatcagcaatgtgtgcaccgatgctctctctgcagagaagtattattatttcatccggctcatgggccgaaaggcatctcatgttgctctggaatgcacacttcagtctcatccaaatatggttattcttggtgaggaggtggctgcatcgaagcttactctttttgacttgaccaaaaaaatttgtgatgcagtccaagcacgagcagagcaagacaagaatcatggagtcattctactgccagagggactcatagaaagcattcctgaggtctatgctctcttgaaggaaatacacagtttactcaagcaaggtgttgctcctgacagcatttcatcacagctttcaccatgggcatctgctttacttgaatttttgccaccctttatcaagagagagctgctgcttcatcctgaatcagatgactcagcacagttatcccagattgaaacagagaaacttctagcacatcttgtggaggcagaaatgaacaggcggctgaaagaagggacatataaggggaagaagttcaatgctatatgccacttttttggttatcaggcccgagggtccttaccatcgaaattcgattgtgactatgcctatgttcttgggcacatctgctaccatattttagccgctggtttgaatggttacatggccacagtaagtaacctaaagaatccctcgaacaagtggcgttgtggtgctgctcctattacagcaatgatgacagtgaagcattgggctcaaagccctggtgcatcttcaattggaaaacctgctattcatccagctacagtggatttgaaaggcaaagcatatgagctgctgagagtaaatgcaggaagatttttgatggaagatctgtacagaaatccaggtccccttcaatttgatggtcctggtgctgattctaaggctgtatctctctctgttgaagacgctgattacatgggccggatcaagaaactgcaggaataccttgacaaggttagaaacattgtgaaaccagggtgctctcaggatgtcctgaaagctgcgttgagtgtcatgtcttctgtgacagaagttctctctgtgatgtcctcaacctcatccagtggcctaacaaccctttaagaggacagcttcaaattttcctttcctcgagctacctctgttgttccgtggtttggcaattacgtactcctgttggaacactttgtgccttttttcttaatttttatttggaacagtaggtaattagattggtaataagccaacttttcttcttctttaatcagctgtaactttcacgtgtgagaataatgaggcaaagttgaaattttg

SEQ ID NO: 1796 - DNA, 2236 bp, Medicago truncatula
aacataaaagggttacccaacacaacacactcaaaacaaacataacacaaacgttattcacacttcactctccatagtagaacatagtatctctcgccaccaacaacaactaccatggattctgattatggtattcctagagaactctcagatcttcaaaagcttagatctttgtaccaacctgaactccctccttgtcttcaaggaacaactgttagggttgaatttggtgatggaacaacaactgctgatccagctgatgagcctactataagtagatctttccctaatacctatggacaccctttggctcattttcttagggctacagctaaagttcctgatgctcagatcataacagaacaccctcctattagggttggaattgttttttctggaagacaatctcctggtggacacaatgttatttggggtcttcactctgctctcaagattcacaatcctaagagtgttttgcttggatttcttggtgggtcagaaggtctattttctcagaaaactttggagataactgacgatattctatccacatacaaaaatcaaggtggttatgatttgcttgggcggacaaaagatcaaattaggaccactgaacaagttaatgctgctcttgctacatgcaacaatttgaaacttgatggccttgtcatcattggaggtgtgacatcaaacacagatgctgcgcagcttgcagaaacatttgctgttgcaaaatgccctacaaaggtagttggtgttcctgtgactttgaatggagatcttaaaaaccagtttgtggaaacaaatgttggctttgacacaatttctaaggtgaattcccagctcatcagcaatgtctgcactgatgctctctctgcagagaagtattattatttcattcgtcttatgggacgcaaagcatcacatgttgcattggaatgcactcttcagtcccatccaaacatggtaattcttggtgaggaggttgctcaatcaaagcttaccctttttgaaatttcacgaaagattgctgatgcagttcaggctagatcagaacaagacaaatatcatggagtaatccttattccagagggtctgattgagagcattcctgaagtgtatgcacttttgaaggaaattcatggtttactcagacaaggtgttgatgttgagaagatagctagtcagctttcgccatgggcttctgctttatttgaatttctaccaccatttattaggagacagcttctactttatcctgaatcagatgactcagcacagttgtctcagattgagactgagaaacttctagcataccttgtggaagtagagataaacaagcgccagaaagaaggcacatacaagggaaagaaattcaatgcgatttgccacttttttggatatcaagctcgaggatcccttccatcaaagtttgactgtgactatgcatatgttcttggacacatttgctaccatatactagctgctggtttgaatggatacctggcaactgtaactaacttgaagaatcctgtaaacaagtggaaatgtggtgctgctccaatttcagctatgatgacggtgaagcgttggtctcctaatcctggagccacatcaatcggaaaacctgctatccatccagctactgtggatttgagaggcaaagcatatgagctgttacgacaaaatgcgacaagctttcttatggacgatatttatagaaatccaggcccacttcagtttgatggtcctggtgcagatgccaagcctatcactcttaatgttgaagaccaagactacatgggtcgcattaagaaacttcaggaataccttgaacaggtacgaaccattgtaaagccagggtgccctcaagaggttctgaaagcagctttgagcgtcatggggtccgttaccgaagttctgactgccatgtcatcatcttccggcaacacttcatcactctgaatgtgacattttggaagttgtattcttttaagaattttctggcgtgacattttagttttttagtttttaacattttatagccgtggaagtagttattggttgagaaataaagtattaggcgagacacttgcatgtcgacatggaatttgtgagattactttattcaaagttttgattccatctgtttctgtatacaataactgggtgattttttttagtgccaattaattttgtgtttgtcttgtatcataatcttatttttgttcacata

SEQ ID NO: 1797 - DNA, 2315 bp, Manihot esculenta
atggtcgtggcacgtcgtaataaaccctggaaagcaagggagaaggacaaaaaaggagacgcaggcatactcactcgtaccaactattctttgctcttactcaacaagcacctaccaccacctccaccactgaacaatacagccatggattccgacttcggcattcccagagaactttccgagcttcagaagctccgatctctttaccaacctgaccttcctccttgccttcagggaactactgtgagggtagaatttggagatggtactactgcagcagacgcagctggtgcccacaccataagtagatcgtttcctcacacttatggtcagcctttggctcactttcttagggcaactactaaagtacctgatgctcacatcatcactgagcatccagctatgagggtgggaattgttttttgtgggagacaatctcctggtggccacaatgtcatatggggccttctcagtgctcttaaaatccacaatcctaacagtaatttacttggattcctgggtggctctgaaggtttatttgcccagaaaactcttgaaataacagatgaagttcttgctacctataaaaatcaaggtggttatgatttgctgggtaggactaaagatcaaataagaaccactgagcaagtaaatgctgcactagccacatgcaaagatttgaaattggatgggcttgttataattggaggggttacatcaaatacggatgctgctcagcttgctgaaacatttgctgatgcgaagtgcccaacaaaggtggttggcgttcctgttactttgaatggagatctcaagaatcaatttgtggaaacaaatgttggttttgatacaatatgcaaggtcaattcgcagctcatcagtaatgtctgtactgatgctctctctgcagagaagtattattactttattcgtctcatgggtcgaaaggcatcacatgttgctttagagtgcacactgcaatcccatccgaacatggtaattcttggtgaggaggtagcttcatcaaagctcactctttttgacttaacaaaacaaatttgtgatgcagtccaagccagggcagaacaagacaaataccatggggtcattctacttccagagggcctcatagaaagtattcctgaaatttatgctctcttgaaggaaatacatggtttgttgaggcaaggtgttccccccaacaacatttcatctcaactctctccatgggcttctgctttgtttgaattcttgccaccttttatcaagaaacagctgctccttcaccctgaatcagatgattcagcacagttatcccagattgagacagagaaacttctggcacatcttgtggaggtagaaatgagcaagcggctgaaagaaggcacatacaaggggaaaaaattcaatgctatctgccacttttttggttatcaggcccggggttctgtgccatcaaaattcgattgtgactatgcctatgtgcttggacatatctgctaccatattctagcagctggtttgaatggctacatggcgacagtaactaacctgaagaatcctgtgaacaagtggcggtgtggtgctgctcctattacagcaatgatgactgtgaggcattgggctcaaagtccaggtgccacttcggttgggaaacctgctattcatccagctgcagtggatttgaaaggcaaagcatatgagctgctcagagaaaatgcaatgcagtttttaatggatgatctttacagaaatcctggacccttacaatttgaaggtcctggtgctgatgctaagccattaactctgtgtgttgaagaccaggattacatgggccggataaagaaattgcaggaataccttgaccaggtacgaactattgtgaaaccagggtgttcacaggaagttctgaaagctgctttgagtgtcatggcttctgtgacagatgtgctttctgcaatgtcttcaacttcgttcaatagccagacacccctttaagagcacaacttatgtgttcttgaactaacttggtgccgttgcatttagtgtgagaatatatccttcggcatgtctctctctctcctttttttttctcctccccttgatttatgtcatgaatatagatggcaataagctgaatttcacctttcttccggagaagaatgatcttcaattttacatagtttcttgtgcgatagtagtgtgaggattatgtaatgtaaaagattggcagagttgaagttttgtttatgctggtgggaatgagggacatgcatataatcgaagcctcagttgcagcaagcttttacgattat

SEQ ID NO: 1798 - DNA, 2316 bp, Vinca minor
gttccgtcctatataaatgctattttatcagaagctccgccctgagattcattatcattagagagagagattgaatcagtccttccattccctcatttggtttcttcggttctgagagatagacaaatcaatggattcagattatggaattccaagagaactttctgatctgcagaggcttcgctctcagtacaagcctgagctccctccttgccttcagggatcaactgtccgagtagagtttagtgatgccacaattactgcagattcaatgggtgcccacaccataagtcgtgcatttcctcacacttacggtcagccgttagttcactttcttagggtaactgcccaggtccctgctgctcaggttatcactgagcacccatcaattagggtgggtttggttttctgcggtagacaatctcctggagggcataatgtcatttgggggctctatgaagctatcaaaggtcataatcctaacagtactttgctgggttttctaggtggttctgacggtttatttgcgcagaagactttagaaataactgatgacgtgcttgcaacatacaaaaatcaaggtgggtatgatttacttggacgaacaaaagatcaaataagaactactgagcaggtcaatgctgcaatggctgcatgcaaggctttaaagttagatggtctcgttgttattgggggggtaacatcaaacacagatgctgcttatcttgctgaaacttttgcagaagcaaaatgtccaacaaaggttgtgggtgtcccagtcactctaaatggagatctcaggaatcaatttgttgaaacaaatgttggttttgataccatatgcaaggtcaattcacagctcattagcaacgtatgtacagatgcgctgtctgcagaaaagtattactatttcatccgactaatgggtcgaaaagcatcacatgttgctttagaatgtactctccagtcgcatccaaatatgttaattcttggtgaggaggtggctgcatctaagcttactctttttgacatcacaaaacaaatttgtgacgcagttcaagatagagctgaacaagataaataccatggtgtcattctcttgccggagggcttgatagaaagcatccctgaagtatatgccttattaaaggaaattcatggtttgctcaggcaaggtgtttcttctgacaacatctcctctcaactgtcaccttgggcgtctgcattgttcgaatttctaccacctttcataaaaaaacagcttctcctctatccagaatccgatgattctgcacagttatcccagattgagactgagaaacttcttgctcatcttgtggaagaagaaatgaacaaacgactgaaagaaggaacttacaagggaaagaaatttaatggtatctgtcacttctttggttatcaagctcggggatcccttccctcaaaatttgactgcgattatgcttatgttcttggtcatatctgctaccatattctggcagctggactaaatgggtatatggcaactgtaactaacctaaaaaatcccttgaacaaatggcgctgcggagctgctccaatcacagctatgatgactgttaagcgttatggtcatggccttggagccttacacgtaggaaaacctgctctgcatcctgctaccgtggatttgaaaggcaaagcatacgagttattgaggcaaaatgcaacaaaatttttgctggacgatgtctacagaaacccaggaccgcttcaatttgatggacctggtgctgattctaaggctgtaactttgtgcgttgaagaccaggactacatgggtcgtatcaagcaattgcaggaatatcttgacaaggtgcgtaccattgtgaaaccaggctgctcgcaagatgttctgaaagctgctttgagtgccatggcatccgtgacagacattctatccgtgatgtcgtcaccatcaaacggtggccacactcccttttaggagtataagatataatgacatttgtgcaaggaaattttgtgagtgagcgtggtcatcagctgcaaatgcctgttctgttctgatgcggagtctgctaagataccgtaccattagatgtttgatgacaataaaaacatagcatggagttttatttcttttcaggtcttatacctgttatttttcttctcgagtctgtggacagatgtgatttctattttctcctagaatgaagaggattttgtttgggctttaataattttggtaagactcttatgggctttgcatgggcctgacccatttatttcatatcagtcatgacatggcacccgaaa

SEQ ID NO: 1799 - DNA, 2182 bp, Tropaeolum majus
cggccggggacctacacttactatattatatactaatactaccaaccaacctcgacggataatttacgccatggattccgatttcggcatcccaagagaactttccgatctccaaaaactccgatcactttaccaccctgagctccctccttgtctccagggaactactgtacgtgtggaattcggtgatggaacaacaccttcagaccctgctgatggtcatatcattgctcgagcctttccacacacttatggtcaacctttggctcactttctaagaaaaactgcaaaagttcctgatgctcagattattaacgagcacccagagaaaagggtcggaatcttgttttgtgggagacaatctcctggtggacataacgtcatttggggtcttcatgatgcactaaaaactcacaatcccaagagcactttgcttggatttttaggtggttctgaaggattatttgctcagaagacccttgaaattactgatgatattctttcaacctatcaaaatcaaggtggttatgatatgcttggacggacaaaagatcaaattagaacaacagagcaagttaaagctgcactatcagcatgtcaaaatctaaaattggacagccttatcattgttggaggggttacatcaaacactgatgctgctcagcttgctgaaacatttgcggaagcaaattgcccaacaaaggtggttggtgttcctgttacattgaacggggacctgaaaaactcatttgtggaaacaaatgttggtttcgatacaatatgcaaggtcaattcacaactaattagcaatgtctgcactgatgctctctctgcagaaaagtattattacttcgtacgtctcatgggtcggaaggcatcacatgttgcactggaatgcactctccagtctcagccaaatatggtcattcttggtgaggaggttgctgcttcaaagcttactctttttgacttgacaactcagatctgtgatgctgtccaagcaagagctgaacaagataagaaccatggggtaattttattgccggaagggctcattgaaagcattcctgaagtctatgctttgttgaaggaaattcatggattgctcagactaggtgtgtctattgatatgatttcttctcagctttcaccttgggcggctgctttatttgaatttttgccaccttttatcaagaaacagctgctcctatatcctgaatccgacgattctgcacagttgtcccagattgaaacagagaaacttctcgcacatcttgtggaggctgaaatgaacaagcgccagaaagaaggcaaatacactgggaaaaagttcaattcaatttgtcacttcttcggctatcaagctcgtggttcgttaccatcaaagtttgactgtgactatgcttatgtacttggacacatctgctatcatattctcgtagctggtttaaatggttacatggcaacagtaactaatctgaagaatcctgttaacaaatggaaatgtggtgctgcaccaattacagcaatgatgactgtgaaacactggtctgaaagtccaggctctacttctatcgggaaacctgctattcatccgtctactgttgatttgaaagggaaagcatatgacttattgagacagaatgcacagaagtttttgttggacgatctatacagaaatccaggccccttgcaattcgaaggtcctggtgctgatgctaagcctgtaacactttgtgttgaagaccaggattacatgggtcgtatcaagaaactgcaggaatatcttgacaaggttcgaactattgtgaaaccagggtgctctcaagaggttctgaaagcagctttgagtgttatggggtccgtgacagaagttcttgcagccatgtcttctccatctggcaatctatcatatcattaagacctaagctcactccaacctatcttgtactcctgccattttgcagtctttggaactgtgagtctctgcgctacttgacccaggcccttaatttattgtcttaaacatttaggcgcattgaattttactaataagctgagtgcctggttcatgccttttaattgaagttttggtaaaatgaaagtttgtacttccgacatgatttttctcttttcacgagtgactcaaaggcattttattaatgtaaacgatcgaacttgt

SEQ ID NO: 1800 - DNA, 2227 bp, Euphorbia peplus
aaatctctctctgaactaacacctaccgccggcgagatggattcagatttcggtgttccccgagaactttccggccttcagaaactccgatctctttatcagcctgagctccctccttgccttgagggtactactgtgagggtggagtttggtgatacaactacagctgcagatgctgctgatgctcataccattagtagatcgtttccccacacttatggccagcctttggctcactttctccgtaaaactgctaaagttgctgatgctcacattataactgaacatccggttaagagggtgggaatagtcttttgcgggagacagtctccgggaggccataatgtcatatggggccttcaccatgctcttaaaactcacaatccgaagaatattttacttggatttctaggtggctctgaaggtttatttgcccagaaaactctggaaattactgatgatgttcttgcaacctataaaaatcaaggtggttatgatttgctgggacggaccaaagatcaaataaaaacaacagagcaagttaatgctgcactagccacatgcaacaatttgaaattggatggtcttgttatcattggcggggttacatccaacacggatgctgctcagcttgctgaaacatttgctgaggcaaagtgccccacaaaggtggttggtgttccagtcactttgaatggagatcttaagaatcagtttgtagaaaccaatgttggttttgatacaatatgcaaggttaattctcagctcataagcaatgtttgcactgatgctctctcagcagagaagtattattactttatccggctcatgggccgaaaggcgtcacatgttgctttagagtgcacactccaatctcacccaaacatggtaattcttggtgaggaggtagctgcatcaaagcttactctttttgacctgacaacacaaatttgtgatgcagttcaagccagagcagcacaagacaaataccatggagtcgttctcctgccagaggggctgatcgaaagcattcctgaggtttatgctcttttgaaggaaatacatagtttgctgaggcaaggtatcaactccaacaacatttcatctcaactctcaccatgggcatctgctctatttgaatttatgccactgttcatcaagaagcagctgctcctttaccctgaatcagatgactcggcacagttatcccagattgagacagagaaacttcttgctcatcttgtggaggtggaaatgaataggcggcagaaagaaggtacatacaagggaaaaaaattcaatgctatctgccacttttttggttaccaggcccgaggttctgtgccgtcaaagtttgattgtgattacgcctatgttcttggacatgtatgctaccatatattagcagctggtttgaatgggtacatggcaacaataactaacctcaagaatcatgtgaacaagtggcgttgtggtgctgctccaattgcggcaatgatgacagtgaggcgttgggctcaaagtccaggtgctacttcaattggaaaacctgccattcatcctgccactgtggatttgaaaggcaaagcatacgagctgcttagactaaatgcacacaagtttttggtagatgatctgtatagaaatccaggaccccttcaatttgacggtcctggtgctgattccaagccattaactctttgtgttgaagatcaagattacatgggcaggatcaagaaattgcaggaataccttgaccaggtaaaaactattgtgaaaccagggtgttctcaagatgttctgaaagctgctttgagcgtaatgggttccgtgactgaggtgcttacaacaatgtcatctaattcactcaatggccactcaaccctttaagttcacaatcaccggcgtctgttcagtctcaaaattggcggtttgctgcattacatttttttttcgctatttgtatcttcagccgtaggtgcagattactagatagatgatgaccattttacaataaagctgaatttttgttctctcgaatcgcggaaatgtgaaattctctaactgtactctgcttgtgtgataatatttgaggatgatataatggaagttttgcagaggtgagttgagatttttgtttattatttgctcattggcaccaaataagttgagaaaatatatgtaatgcaaatgtatgacctttaatcttttatgattatttttgtat

SEQ ID NO: 1801 - DNA, 2485 bp, Amsonia hubrichtii
gagggtagacttggttggtcttatcgccactcctcagtgtgctgctatatataaacggtgttctagcactagctgttctgagattcgagagagaagcgcacattgaattagtctggttttgttggtttcttcagttcggtaactactaagcctaagaaatatttcagagagagcgactctgttggtgatagacaatggattcagattacggaataccaagagaactttctgatctgcagaagcttcgcgctcagtacaagcctgagctccctccatgccttcagggaactactgttcgagtagagttaggcgatgctactactgctgcagattcagtgggtgcccacaccataagtcggtcattccctcacacttatggtcagccgatagctcactttcttagggcaactgccaaggtccctgctgctcagataattactgagcacccagtgatcagggtgggtttggttttctgcggtagacaatctcctggaggacataatgtcatctggggactccatgatgctatcaaaggacacaaccctaacagtactttgctgggatttttaggtggttctgagggtttatttgcacagaagactttagaaataacagatgatgtccttgcatcatataaaaatcaaggtggatatgatttactcggacggacaaaagatcaaataagaactactgagcaggtccatgatgcaatggctgcatgcaatgctttaaagttagacggccttgttgttattggaggagtaacatcaaatacggatgctgcttatcttgcggaaacctttgctgaagcaaaatgcccaacgaaggttgtgggggtccctgtcactctaaatggagatctcaagaatcagtttgttgaagcaaatgttggttttgacacaatatgcaaggtcaattcccagctcattagcaatgtatgcacagatgcattgtccgctgagaagtattactatttcatccgactcatgggtcggaaggcgtcacatgttgctttagaatgcactctccagtcacatccaaatatggtaattcttggtgaggaggtatctgcgaataagcttactctttttgacatcacaaagcaaatttgcgacgcagttcaagctagggctgaacaagacaaaaaccacggtgtcattctcttaccagagggccttatagaaagtattcctgaagtgtatgctttattaaaggaaattcatggtttgctcaagcaaggtgtttctattgataaaatttccactcaactatcaccgtgggcatctgccctgtttgaatttttaccacctttcataaagaaagaggttctcctctatccagaatccgatgattctgcgcagttgtctcagattgagacagagaaacttctagctcatcttgtggaagaagaaatgaacaaacggctgaaagaaggtacttacaagggaaagaaattgaatggcatctgccacttctttggttatcaagctcggggatcattaccatcaaagttcgattgtgattatgcctatgttcttggtcatatctgctatcatattctagcagctgggttaaacgggtatttggcaactgttactaacctcaaaaatcccctcaacaagtggcgctgcggtgctgctccaattacagctatgatgactgttaagcgttatggtcgtggccctggagcctcgtatattggaaaacctgctctgcatcctgctattgtggatttgaaaggcaaagcatacgagttgttgagacaaaatgcaacaaagtttttgctggacgatgtctacagaaacccagggccccttcaatttgatggtcctggtgctgattctaaggctgtctccttgtgtgttgaagaccaggactacatgggccgtatcaagcagttgcaggaacatcttgacatggtgcgcaccattgtgaaaccaggctgctcccaagatgttctgaaagctgctctgagtgccatgtcatctgtgacagacattctatctgtgatgtcatcaccatcgaacagcgggactcccttttagaagtacaaaatgccgttcgtgtaaggaaattttgtggtgacattggtcatcagctgcaaatacaaaataaacatggcttgggtttttgtcttatccttgctctttctctaactaaaacaagcaaaataattcttgggcgggactcttgcggtctgtagacatttgtggattttgttttcttctacaatgaggagtattttgtttcggcttgataattttggtacacgactcttattgttgcatcaaagtgccagtgccggaatgggactctgcattaattcgaaccattcgctaatccaacggccagcctcattcctttgctcctcctggacaggcagagctctttcaagaagatactacagttttttcatggttgcctaatcgggattttctaactttattcattgttttctcataaaaaaatcgccgaacaacataat

SEQ ID NO: 1802 - DNA, 2161 bp, Chelidonium majus
aataataatagtaagtaagaggaagttagtagttaaaaaaaaaaaaaaaatacagaacaagaatggattcagatttcggcattcccagagaactctcagatctgcaaaaacacagatctctctatcaaccagaacttcctccatgtctacagggaactacagttagggtggaattaggcgatgcaacgactgcaacagacctttccagttccaatatcattagccggggctttccacacacatacggtcagcccttggtgcatttctttagggcaaatgcacaggttcctgatgctaagatcattactgaacatccagtagtcagggtaggactggtattctgtgggagacagtctccaggaggacataatgtcgtatggggactccacgacgctcttaaggctcataatcctaagaacaccctgcttggttttcttggtggttctgaaggtttatttgcacagaaaactctggaaatcacagatgatgttctctctacctataaaaatcaaggtggttatgatatgctgggacggacaaaagatcaaataagaacaactgagcaagttaatgctgcactagctacatgcaaagctttgaaactggatggccttgtgattgtcggaggtgttacgtcaaacactgatgctgctcagctggcagagacctttgcagaagctaagtgctcgacaaaggttgttggggttcctgttactctgaatggagatttaaaaaatcagtttgttgaaactgatgtaggttttgatacaatttgtaaggtcaactcacaactcatcagcaacctctgcacagatgctctatctgccgagaagtattactactttgtccgacttatgggccgtaaggcgtcacacgttgctttggaatgcactcttcaatcacatccgaatatggttatccttggtgaggaggttgcctcatcaaaacttacaattttcgacatcacgaaacaaatatgtgatgcagttcaggctagggcagagcaagacatgaatcatggagtcatccttttgcccgagggactcatagagagtattcctgaagtgtatgcgcttttgcaggaaattcacagtttgcacaggcaaggtgtttctattgacaatatttcttcacaactttcaccctgggcatctgcgttattcgagtttttgccactctttattaagaaacagctgcttcttcatcccgagtcagatgactctgcacagctttcccagattgagacggagaaacttctagctcatttagtggagacagaaatgagtaagcggttgaaagaaggcacatacaagggaaagaagttcaatgctatatgccacttcttcggttaccaggctcgaggatctttaccgtcaaaatttgattgtgattatgcctatgttcttggacacatctgctatcacattttagcagctggtttgaatggttacatggcaactgttaccaacttgaaaaacccttcaaacaaatggcgttgtggtgctgccccgataacagcaatgatgactgtaaagagatgggctcgtggacctgggacctccttgattggaaagcctgctgttcatcctgctactgttgatttgaaaggcaaagcatatgagttgcttagagaaaatgcatcaacatttttgctggatgatgtctacagaaacccagcccccttacagttcgatggtcctggtgctgatagtaagaccatgactctatgtgtcgaagaccaagattacatgggtcggatcaagaagctgcaggaatatcttgacaaggtaaggaacatcgtcaaaccaggatgctctcaggatgttctcaaagcagctttgagttccatggcctccgtaacagaagttctttctataatgtctactccttcattcagtgggtcggcacccttataaagttacaaatgagtcatcctgaacttctttccaaagctgctgaccccctcgagttgaattccgaaagggtgtttgtgcctttgtccttccatttgtgttctttttaatggttgttttttattaggaacgtctatgtgtaaacttttattattgacaggatctccatgatctacattaggctttgaacttctagatatagttatcatgagtgtttttatgttctattttcatggaaagcataatac

SEQ ID NO: 1803 - DNA, 2159 bp, Manihot esculenta
ggtgaaacagtctttactggtactacctactctgctatcacacagcacaacccaacacctaactccaccaaaacaacaccgccatggattccgattatggcattcccagagaactttccgaccttcaaaaactccgatctctttaccagccagagctcccccccttgccttcagggaactgctgtgagggtagaatttggcgatgctactactgcagcagacgcagccggttcccacaccataagcagatcttttccccacacttatggtcaacctttggctcactttcttagggcaactgctaaagtacctgatgctcacatcatcactgagcatcctgctaccagggtgggaatagtcttttgtgggagacaatctccaggaggccacaatgtcatttggggccttcacaatgctcttaaaatccacaatcctaacaattctttatttggatttctaggtggctccgaaggtttatttgcccagaaaaccattgaaataactgatgatattctctcaacctacaaaaatcaaggtggttatgatttgctgggcaggactaaagatcaaataagaactactgagcaagttaatgctgcgctaaccacatgcaaagatttgaaattggatggccttgttataattggaggggttacatcaaatacagatgctgctcagcttgctgaaacatttgctgaggcaaagtgcccaaccaaggtggttggcgttcctgttactttgaatggagatctcaagaatcaatttgtggaaacaaatgttggttttgatacgatatgcaaggtcaattcacagcttatcagcaatgtctgtacggatgctctttcagcagagaagtattattattttatccgtctcatgggtcgaaaggcttcacatgttgctttagagtgcacactccagtctcatccaaacatggtaattcttggtgaggaggtagctgcatcaaagctcactctttttgacctaacaaaacaaatttgtgatgcagtccaagccagagcagaacaagacaagtaccatggggtcattctacttccagaggggctcatagaaagcattcccgaagtatatgctctcttgaaggaaatacatggtttgctgaggcaaggtgttatccccaacaacatttcatctcaactctcaccatgggcttctgctttgtttgaattcctgccgccttttatcaagaaacagctgctgctttaccctgaatcagatgactcagcacagttatcccagattgagacagagaaacttctagcacatcttgtggaggcagaaatgagcaagcggctgaaagaaggcacgtacaaggggaaaaaattcaatgccatctgccacttttttggttatcaggcccggggttcagtgccatcaaacttcgactgtgattatgcatatgtgcttgggcacatctgctaccacattctagctgctggtttgaatggttacatggcaactgtaacaaacctcaagaatcctgtgaacaagtggcgttgtggtgctgctccaattacagcaatgatgacagtgaagcgttgggctcaaagtccaggtgccacttcaattggaaaacctgctattcatccatctactgtggatttgaaaggcaaagcatatgagctgctcagacaaaatgcaatgaagtttttaatggatgatctctacagaaatccaggcccccttcaatttgaaggccctggtgcagatgccaagccattaactctctgtgttgaagaccaggattacatgggccgtataaaggagttgcaggaataccttgacaaggtacgaactattgtgaaaccagggtgttctcaggaagttctgaaagctgctttgagtgtcatggcttctgtgacggatgtgctttccacaatgtcttcaacttcgttcaatagtcagacacccctttaagagcacaaattatgtgttctcaaactaacttggtgccggtgcatagtttgagaattatctgctttctcttaatttgtaacttgaaactataggtgcagacttagttagataatggcaataagctgaattctgccctctttttcttttaaaatttgaaattttctgttacttgtgtgataatagcgcgaggattatataatattgaaagatttgctgagttg

SEQ ID NO: 1804 - DNA, 2103 bp, Raphanus sativus
  misc_feature (3)..(3): n is a, c, g, or t
  misc_feature (495)..(495): n is a, c, g, or t
  misc_feature (522)..(522): n is a, c, g, or t
  misc_feature (798)..(798): n is a, c, g, or t
  misc_feature (858)..(858): n is a, c, g, or t
  misc_feature (894)..(894): n is a, c, g, or t
  misc_feature (930)..(930): n is a, c, g, or t
  misc_feature (943)..(943): n is a, c, g, or t
  misc_feature (1209)..(1209): n is a, c, g, or t
  misc_feature (1251)..(1251): n is a, c, g, or t
  misc_feature (1257)..(1257): n is a, c, g, or t
  misc_feature (1263)..(1263): n is a, c, g, or t
  misc_feature (1266)..(1266): n is a, c, g, or t
  misc_feature (1296)..(1296): n is a, c, g, or t
  misc_feature (1311)..(1311): n is a, c, g, or t
  misc_feature (1316)..(1316): n is a, c, g, or t
  misc_feature (1320)..(1320): n is a, c, g, or t
  misc_feature (1326)..(1326): n is a, c, g, or t
  misc_feature (1341)..(1341): n is a, c, g, or t
  misc_feature (1849)..(1849): n is a, c, g, or t
  misc_feature (1851)..(1851): n is a, c, g, or t
  misc_feature (1892)..(1892): n is a, c, g, or t
  misc_feature (1951)..(1951): n is a, c, g, or t
  misc_feature (1954)..(1954): n is a, c, g, or t
  misc_feature (1998)..(1998): n is a, c, g, or t
  misc_feature (2094)..(2094): n is a, c, g, or t
ggnaaagctcactcaaaacacatctcaccaaacgcacacttacctccgcacagcaaccaaaagccaatggattcagatttcggaatcccaagagagctctctcctcttcagcaacttcgttctcagtaccagcccgagcttcctccttgtcttcagggaactgctgtccgcgtggagtttggtgatggaaccactgtgtctgaggcttctgattcccatatcatagctcgtgccttcccacataccttaggccagcctttggctcacttcctcagggaaaccgccaaagttcctgatgctcagattatcactcagcttccatctatcagagttggaatcgtgttttgtggaagacaagctccgggtggacacaatgtaatctggggtctttacgaggctcttaagatgcacaacgcgaaaagcaccttgcttggctttttgggtggttcggaaggtctgtttgcgcaaaagactctggagatcactgatgatatnctccagacttacaaaaaccaaggtggntatgatttgctgggaagaaccaaggatcagatcagaaccactgagcaggttaacgctgcactcaaagcttgcactgatttgaagctagatggccttgttatcattggaggtgtaacatcaaacacagatgccgctcatcttgctgagtttttcgctgaagcaaaatgctctacaaaggtggtgggtgttccagttactacaaatggcgatctcaagaatcagtttgtggaggcaaacgttggttttgacaccatttgcaaggtgaattcccagctnattagcaatgcctgcactgatgctctctctgcagagaagtactattatttcatccgtctnatgggtcggaagcattctcatgttgcccttgagtgnaccctccagtctcatccaaacatggtgatactgggngaggaggttgcancatctaagctcaccatttttgacatttctaagcagatctgtgatgcagttcaagcaagagcaggacaagacaagaatcatggagtcatcctcattcccgaagggatcatagagagtattcctgaagtctacgctctgttaaaggaaattcacgggctacttagggagggtgtagctgctgataagatctctactcagctctcaccttggtcatctgctttgtttgaatttcttcctccattcattaagaaacagctacttctccancctgagtctgatgattctgctcagctatcccagattgagacngagaancttctngcntatctcgtggagactgaaatgaacaagcgnttgaaagaaggcacntacangggnaagaanttcaatgctatatgncacttctttggttaccaagctcgtggatctctcccatcgaaattcgattgtgattatgcctatgtgcttggacatatatgttaccacatcctcgcagctggtctgaatggttacatggcaacagtgagcaacctaaagagtcctgtaaacaagtggaagtgtggtgctgcacctattacagcaatgatgacggtgaagaactggtcccaaaatgctagttctacttcaacttcaattggtagacctgcaattcacccggcaatggtggatttgaagggcaaagcatacgagctgttgagacagaacgcagacaaattcttgatggaagatctgtacaggaacccaggaccgcttcagtacgatggtccaggtgcagatgctaaagcagtgagtctgtgtgttgaagatcaagattacatgggacgtatcaagaagctgcaggaatatctagaccaggtgaggacgatagtgaagccaggatgttcgcaagacgtactgaaggcagcantnagcgtgatggcttcagttactgatgtcctcactaccatttnttcatcttcaaatgctggtcaacagtttgcttaaattaaaacacacaacaaagagagtnaanacaagacttttttattaagcttccatgaaactttgcttaaactntttcaaccattccacatttcgtgttctctttttaattcctttgagatgtaacttttgttgtcgttgttgttgagtttcgaaaacgagagattaaanaacaagttt

SEQ ID NO: 1805 - DNA, 2104 bp, Brassica napus
ccatggattcagatttcggaatccccagagagctctctcctcttcaacagattcgatctcagtacctgcctcagctccctccttgtctccaggggacaactgttcgcgttgaatttggtgatggaaccactgtggcaaaagctggtgatgctcacatcattgcacgtgccttcccgcatactctaggtcagcctttggctcacttccttagggcgactgccaaagttcctgatgctcagatcatcaccgagcatccagccattagggttggaattgtgttttctggaaggcaggctcctggtggtcacaatgtgatttggggtctttatgaggctctcaaagtgcataacgcaaagaacactctgctaggatttttgggtggttctgaaggtctatttgctcaaaaggccctggagatcactgatgatgtcctccaaacctacaaaaaccaaggtggctttgatttgcttggaagaaccaaggatcagattagaacaaccgagcaggttaatgctgctctgaaagcttgcacagatttgaagttggatggccttgttatcattggaggtgtaacatccaacacagatgccgctcatcttgctgaattttttgctgaagcaaaatgctcaacaaaggttgttggtgttccggtcactattaatggggatctcaagaatcagtttgtggaggcaaacgttggtttcgacactatatgcaaggtgaattctcaactcatcagcaatgtctgcaccgatgccctttcagcagagaagtattattacttcgtccgtctcatgggccggaagcattcacatgttgcccttgagtgtacacttcagtctcatccaaacatggtgatactgggtgaggaggttacagcatctaagctcacgatatttgacatcaccaaacaaatctgtgatgctgtgcaagcaagagcaggacaagacaaaaatcatggagtcatcctaattcctgaagggatcgtagagagtattcctgaactctatgctctgttgaaggaaattcatggactgcttaaggagggtgttcatgctgataacatttctactaagctgtcaccttggtcatctgccttgtttgagttcttgcctccattcattaagaaacagctacttctgcatcccgagtctgatgattctgctcagctctcccagattgagacagagaaactcctagcttatcttgtggagactgaaatgaacaagcgcacgaaagaaggaacatacaaggggaagaagttcaacgctatctgtcacttttttggttaccaagctcgtggatctctcccatcaaaattcgactgtgactatgcctatgtccttgggcatatatgttaccacatccttgcagctggtttgaacggctacatggcaactgtgactaacctgaagagtcctgtaaacaaatggaaatgtggcgccgcacctatgacggcaatgatgacggttaagcgctggtcccaaaactgtggttcaacctcaataggcagaccagcaattcatccagctacggtggacttgaaaggcaaagcatacgagctattgagacaaaatgagcagaaattcttgatggaagatatgtacagaaacccaggaccggttcagtacgatggtccaggtgcagatgtaaaggcggtaactctgtgtgttgaagaccaagattacatggggagaatcaagaagctgcaggagtatcttgatcaggtgaggacgctagtgaaaccgggatgctctcaagatgtattgaaagcggcactgagcgtaatggcttcggtgactgatgtgctctccacaatctcatcttcttccaccagcggtcaacaatttgcttaaatgattttccattactacatctcccaaactttgttttaaatctttcgtctttgaccttcccctctctatcactctcttcatagactcacgttttgattttgttttctgatttacacaactctattgttcaaagttgagtttagtaaaacaataagcaataatattttggatttgggtttgctttttatatagtgacacagcttttttttctgtaacaaaccgaaagtttcatgatcttccaaaactct

SEQ ID NO: 1806 - DNA, 2110 bp, Brassica napus
gaaagaaaaaaaacttaactcactctcaccaacctaaaacctctctcgaaaacctaaaaagcgatcgatcgatcgattcacccatggattcagattttggaatccctagagaactctctcctcttcaacagcttcgatctcagtaccagcctcagctccctccttgtctccaggggagaactgttcgcgttgaatttggtgatggaaccactgtggctaaatctggtgactctcatatcattgcgcgtgccttcccgcatactctaggccagcctttggctcacttccttagggcgactgccaaagttcctgatgctcagatcatcaccgagcatccagccattagggttggaattgtgttttctggaaggcaggctcctggtggtcacaatgtaatttggggtctttatgaggctctcaaagtgcataacgcaaagaacactctgctaggatttttgggtggttctgaaggtctatttgcccaaaagaccgtggagatcactgatgaagtcctccaaacctacaaaaaccaaggtggctttgatttgcttggaagaacaaaggatcagattagaacaaccgagcaggttaatgctgctctgaaagcttgcacatatttgaagttggatggccttgttatcattggaggtgtaacatcaaacacagatgccgctcatcttgctgaattttttgctgaagcaaaatgctcaacaaaggtagttggtgttccggtcactattaatggagatctcaagaatcagtttgtggaggcaaacgttggtttcgacactatttgcaaggtgaattctcaactcatcagcaatgtctgcaccgatgccctttcagcagagaagtattattacttcgtccgtctcatgggccggaagcattcacatgttgcccttgagtgtacacttcagtctcatccaaacatggtgatactgggcgaggaggttacagcatctaagctcaccatatttgacatcacaaaacaaatctgtgatgctgtgcaagcaagagcaggacaagacaaaaaccatggagtcatcctaattcctgaagggattgtagagagtattcctgaactctatgctctgctgaaggaaattcatggactgcttaaggagggtgtgcatgctgataacatttctacccagctgtcaccttggtcatctgctctgtttgagtttttgcctccgttcattaagaaacagctacttcttcatcccgagtctgatgattctgctcagctctcccagattgagacagagaaacttctagcttatctggtggagactgaaatgaacaagcgcacgaaagaaggaacatacaaagggaagaagttcaacgctatctgccacttttttggttaccaagctcgtggatctctaccatcaaaattcgactgtgactatgcctatgtccttgggcgtatatgttaccacatccttgcagctggtttgaacggctacatggcaactgtgactaacctaaagagtcctgtaaacaaatggaagtgtggcgccgcacctatgacggcaatgatgacggttaagcgctggtcccaaaactctggttcaacctcgataggaagaccagcgattcacccagctacggtggacttaaaaggcaaagcatacgagctattgagacaaaatgcgcagaagttcttgatggaagacatgtacagaaacccaggaccggttcagtatgatggaccaggtgcagatgcaaaggcggtaagcctgtgtgttgaagaccaagattacatggggagaatcaagaagctgcaggagtatctcgatcaggtgaggacgctggtgaaaccgggatgctctcaagatgtattgaaagcggcactgagcgtaatggcttcggtgactgatgttctctccacaatctcatcttcttccaccagcggtcaacaatttgcttaaatgattttccattactatcccaaactttgttttaaatcttttcatctttgaccttcccctctctcttcatagactcacgttttgattttgttttctgatttacacaactctattgttcaaagttgagtttagtaaaacaataagcaataatattttggatttaggtttgcttt

SEQ ID NO: 1807 - DNA, 2130 bp, Arabidopsis lyrata
ttctctgaatcctcctctctgagtctctctgacactctcaccaacctaatttctccaaaaacctaaaaagttatcccccatggattcagatttcggaatccccagagaactctctcctcttcaacaactccgatctcagtaccaccctgagcttcctccttgtctccaggggactactgttcgtgtggagcttggtgatggaaccactgtggcaaaggctggtgatgctcatatcattgcccgtgccttcccgcatactctaggccagcctttggctcacttcctgagggcaactgctaaagttcctgatgctcagatcattactgaacatccagcaaagagggttggaattgtgttttctggaagacaggctcctggtgggcacaatgtagtttggggtctttatgaggctctcaaagtgcacaacgcgaagaacaccttgcttggatttttgggtggttctgaaggtctatttgcccagaagaccctggagatcactgaagatgtccttcaaacttacaaaaatcaaggtggctatgatatgcttggaagaaccaaggatcagattagaacaaccgagcaggttaatgctgcactaaaagcttgcacggatttgaaattggatggcttagttatcattggaggtgtaacatcaaacacagatgccgcccatcttgctgaattttttgctgaagcaaaatgcccaacaaaggtagttggtgttccggtcactattaatggagatcttaagaatcagtttgtggaagcaaatgttggtttcgatactacttgcaaggttaattctcagctcattagcaatatctgcaccgatgccctttcagcagagaagtattattacttcgtccgtctcatgggtcggaagcattcacatgttgcccttgagtgtacacttcagtctcatcccaacatggtgatactgggtgaggaggttacagcatctaagctcacaatatttgacatcataaaacaaatctgtgatgctgttcaagcaagagcagaacaagacaaaaatcatggagtcatcctaattcctgaagggcttgttgagagtattcctgaactctatgctctgttgaaggaaattcatggattgcttaaggagggtgtgcaggctgataatatttctactcagctgtcaccttggtcatctgctttgtttgagtttttgcctccattcattaagaaacagctacttctccatcccgagtctgatgattctgctcagctatcccagattgagacggagaaacttctagcttatcttgtggagactgaaatgaacaagcgcttgaaagaagggacctacaaagggaagaaattcaacgctatctgtcacttttttggttaccaagctcgtggatcacttccatcaaaattcgattgtgactatgcctatgttcttggacatgtatgttaccacatccttgcagctggtttgaatggttacatggcaacagtgactaacctgaagagccctgtaaacaaatggaaatgtggggctgcaccgattttagcaatgatgacggttaagcgttggtcccaaaattctggttctacttcgattggtaaacctgtaattcatccagcttcagttgacttgaaaggcaaagcatacgatctattgagacaaaacgcgcagaaattcttgatggaagatatgtacagaaacccaggaccggtccagtatgatggtccaggtgcagatgcaaaggcggtaagtctgtgtgtagaagaccaggattacatggggaaaatcaagaagctgcaggagtatctggatcaggtgaggacgatagtgaagccgggttgctctcaagatgttttgaaagcggcattgagtgttatggcgtcggtgactgatgttctcactacaatctcatcttcttctaccagcggtcagcaatttgcttaagaattttaatttgttggttttcccttaaccataaactccattagctctctctttctctctttccctctttccattttgaagtcgtcttctgattggacggaaactttattgatcaaagttgagtttaggaaaagaatattcgaagttaaaggatttgggtaatgcttttaatggagaagtctgcgtgtcggttcact

SEQ ID NO: 1808 - DNA, 2152 bp, Arabidopsis thaliana
aaaaaaagtcacactcgaagtctcacaccacaccaaccacttcttcttcttcttcttcttctacataaaacctaacgccatggattcagatttcggaatccccagagaactctcccctcttcagcaacttcgatctcagtacaaacctgagcttcctccttgtctccaggggactactgtccgcgtggagcttggtgatggaaccactgtggctgaagctgctgattcacataccatggctcgtgctttcccgcataccttaggccagcctttggctcacttcctcagggaaactgctcaagttcctgatgcgcacatcattaccgagcttccttcagttagagttggaattgtgttttgtggaaggcaagctccaggtggacataatgtgatctggggtcttttcgaggctctcaaggtgcacaacgcaaaaagcactttgctaggatttttgggtggttccgagggtctatttgcacaaaagactctagagattacagatgatatacttcagacttacaaaaaccaaggtggttatgatttgctcggaagaactaaggatcagatcaaaacaactgagcaggttaacgctgcactcaaagcttgcacagatttgaagttagatggccttgttatcattggaggcgtaatatcaaacacagatgcagctcatctcgctgaattttttgctgctgcaaaatgctcaactaaggtggttggtgttccagttactacaaatggagatctcaaaaatcagtttgtggaggcaaacgtgggttttgacaccatatgcaaggtgaactcacaactcattagcaatgcctgcactgatgccctttctgcagagaagtattattatttcatccgcctcatgggtcgtaagcactctcatgttgcccttgagtgtacactccagtctcatccaaacatggtgatactgggcgaggaggttgcagcatctaagctcacaatttttgacattgctaaacagatctgtgatgctgttcaagcaagagcagtagaagacaagaatcatggagtcatcctcattcctgaagggcttatagtcagtattcctgaagtctacgctctgttaaaggaaattcacgggctgctgaggcagggtgtatctgctgataagatttctactcagctctcaccttggtcatctgctttgtttgaatttcttcctccattcattaagaaacagctacttctccatcctgagtctgatgattctgctcagctatcccagattgagacagagaaacttcttgcgtatctcgtggagactgaaatgaacaagcgcttgaaagaaggcacatacaaggggaagaaattcaatgccatatgtcacttttttggttaccaagctcgtggatctcttccatcgaaattcgattgtgattacgcctacgttcttggacatatatgttaccacatccttgcagctggtctgaatggttacatggcaacagtgaccaacctaaaaagtcctgtgaacaagtggaaatgtggtgctacacctattacagcgatgatgacggtgaagcattggtcccaggatgctagttatactttaacttcaattggtagacctgcaattcatccagctatggtggatttgaaaggcaaagcatacgacctcttgagacagaatgcacaaaaattcttgatggaagatctgtacagaaacccaggaccgctacagtacgatggtcctggtgcggatgctaaagcagtgagtctctgtgttgaagatcaagattacatgggacgtatcaagaagctgcaggaatatcttgaccaagtgaggacgatagtgaaaccaggatgttctcaagacgtattgaaggcagcactgagtgtgatggcttcggtgactgatgttcttactactatttcttcaaatggtggtcaatgatttgcttaaaacttaaggacaaagctcttatgaatcacacacgtcgtgtttgttctcttctttttgttttctttcttttgagatgtaacttttgttgtattttttaagttattgagtttggaaagacataaaaattgaaaaggtttggattatagaggcgctatttcaccatatcaatccttgtccaacttttatttttcagtttcactattattacaaacttttttt

SEQ ID NO: 1809 - DNA, 2148 bp, Arabidopsis lyrata
aaaaatagtcacactcaaagtctcacaccacaccaaccacttctctttcttcttcttcttcttcttcttcttctacataaaacctaacgccatggattcagatttcggaatccccagagaactctcccctcttcagcaacttcgatctcagtaccaccctgagcttcctccttgtctccaggggactactgtccgcgtagagcttggtgatggaaccactgtggctgaggctgctgattcacacaccatggctcgtgctttcccgcataccttaggccagcctttggctcacttcctcagggaaactgctcaagttgctgatgctcacatcattaccgagcttccatcagttcgagttggaattgtattttgtggaaggcaagctccaggtggacataatgtgatctggggtcttttcgaagctctcaaggtgcacaacacaaaaagcactttgctaggctttttgggtggttccgaaggactatttgcacaaaagactctggagattacagatgatatacttcagacttacaaaaaccaaggtggttatgatttgctcggaagaactaaggatcagatcaaaacaactgagcaggttaacgctgcactcaaagcttgcacagatttgaagttagatggccttgttatcattggaggtgtaatatcaaacacagatgcagctcatctcgctgaattttttgcggcagcaaaatgcccaactaaggtagttggtgttccagtaactacgaatggagatctcaaaaatcagtttgtggaggcaaatgtgggttttgacaccatatgcaaggtgaattcacagctcattagcaatgcctgcactgatgccctttctgcagagaagtattattatttcatccgtctcatgggtcgtaagcactctcatgttgcccttgagtgtacactccagtctcatccaaacatggtgatactgggcgaggaggtttcagcatctaagctcacgatttttgacattgcaaaacagatctgtgatgctgttcaagcaagagcagtcgaagacaaaaatcatggagtcattctcattcctgaagggcttatagtgagtattcctgaagtctacgctctgttaaaggaaattcatgggctgctaaggcagggtgtagctgctgataagatttctactcagctctcaccttggtcatctgctttgtttgaatttcttcctccatttattaagaaacagctacttctccatcctgagtctgatgattctgctcagctatcccagattgagacggagaaacttcttgcgtatctcgtggagactgaaatgaacaagcgcttgaaagaaggcacatacaaggggaagaaattcaatgccatatgtcacttttttggttaccaagctcgtggatctcttccatcgaaattcgattgtgattacgcctacgttcttggacatatatgttatcacgccctcgcagctggtctgaatggttacatggcaactgtaaccaacctaaaaagtcctgtaaacaagtggaaatgtggtgctgcacctattacagcgatgatgtcagtgaagcattggtcccaggatgctagttatactttaacttcaattggtagacctgcaattcatccagctatggtggatttgaaaggcaaagcatacgaccttttgagacagaatgcacaaaagttcttgatggaagatctgtacagaaacccaggaccgcttcagtacgatggtcctggtgcggatgctaaagcagtgagcctctgtgttgaagatcaagattacatgggacgtatcaagaagctgcaggaatatctagaccaggtgaggaagatagtgaaaccaggatgttctcaagacgtattgaaggcagcactgagtgtgatggcttcggtgactgatgttctcactactatttcttcaactggtggtcaatgatttgcttaaaagatagagtcaaaactctttttaatcccacacgtcgtgtttgttgttctcttctttttgtcttctttcttttgagatgtaacttttgttgttattttttaagttgttgagtttggaaagatataaaaaggtttggattatagaggcgctatttcaccataccaatccaccttttatttttcactattattacaaactttttt

SEQ ID NO: 1810 - DNA, 2134 bp, Arabidopsis thaliana
aaactttctctgaatcttctctgagtctctctgacactctcaccaacctaatttctcacaaaaacctaaaaagttatcgcccatggattcagatttcggaatccccagagaactctctcctcttcaacaactccgatctcagtaccaccctgagcttcctccttgtctccaggggactactgtccgtgttgaacttggtgatggaaccactgtggcaaaggctggtgatgctcatatcattgcccgtgccttcccacatactctaggccagcctttggctcatttcctcagggcaactgctaaagttgctgatgctcagatcattactgaacatccagtgaagagggtcggaattgtgttctgtggaaggcaggctcctggtgggcacaatgtagtttggggtctatacgaggctctcaaagtgcacaacgcgaagaacactttgcttggatttttgggtggttctgaaggtctctttgcccagaagaccctggagatcactgatgaggtcctccaaacttacaaaaaccaaggtggctatgatatgcttggaagaaccaaggatcagattagaacaaccgaacaggtcaatgctgcactaaaagcatgcacggatttgaaattggatagcctagttatcattggaggtgtaacatcaaacacagatgccgctcatcttgctgaattttttgctgaagcaaaatgctcaacaaaggtagttggtgttccggtcactattaatggagatcttaagaatcagtttgtggaagcaaatgttggtttcgatactacatgcaaggtgaattctcagctcattagcaatatctgcaccgatgccctttcagcagagaagtattattactttgtccgtctcatgggtcggaagcattcacatgttgcccttgagtgtacacttcagtctcaccccaacatggtgatactgggtgaggaggttacagcatctaagctcacaatatttgacatcataaaacaaatctgtgatgctgttcaagcaagagccgaacaagacaaaaatcatggagtcatcctaattcctgaagggcttgttgagagtattcctgaactctatgctctgttgaaggaaattcatggattgcttaaggagggtgtgcaggttgataatatttctactcagttgtcatcttggtcatctgctttgtttgagtttttgcctccattcattaagaaacagctacttctccatcccgagtctgatgattctgctcagctatcccagattgagacggagaaacttctggcttatcttgtggagactgaaatgaacaagcgcttgaaagaaggaacctacaaagggaagaaattcaacgctatctgtcacttttttggttaccaagctcgtggatctcttccatcaaaattcgattgtgactacgcctatgttcttggacatgtatgttaccacatcctcgcagctggtttgaatggttacatggcgacagtgactaacctgaagagtcctgtaaacaaatggaaatgcggggctgcgcctatctcagcaatgatgacggttaagcgttggtcccaaaattctggttctactacgattggtagacctgtaattcatccagcttcagttgacttgaaaggaaaagcatacgatctattgagacaaaacgcgcagaaattcttgatggaagatatgtaccgaaacccaggaccagtccagtatgatggtccaggtgcagatgcaaaggcggtaagtctgtgtgtagaagaccaggattacatggggaaaatcaagaagctgcaggagtatcttgatcaggtgaggacgattgtgaaaccgggttgctctcaagatgttttgaaagcggcattgagtgttatggcctcggtgactgatgttctcactacgatctcatcttcttccaccagcggtcagcaatttgcttaaagatttttttattgttttggttttccctttaaccataaacttcattagctctctctctctctctctctttccattttgaagtcgtcttctgatttacgcaaactttattgttcaaagttgagtttaggaaaaggatattcaaagttaaaggatttgagtaatgcttttttaatgaagaagtctgtgtttgggttcact

SEQ ID NO: 1811 - DNA, 2070 bp, Vinca minor
gaattcgaagagaactttctgatctgcagaagcttcgttctcagtacaagcctgatctccctccatgccttcagggatcaactgtccgagtagagttaagcgatgctactattactgcagattcaatgggtgcccacaccataagtcgtgcatttcctcacacttatggtcagccgttagttcactttcttagtgcaactgcccaggtccctgctgctcaggttatctctgagcacccatcaattagggtgggtttggttttctgtggtagacaatctcctggagggcataatgtcatttggggactctatgatgctatcaaaggtcataatcctaacagtactttgctgggttttctaggtggttctgagggtttatttgctcagaagactttagaaataactgatgacgtacttgcaacatacaaaaatcaaggtgggtatgatttacttggacgaacaaaagatcaaataagaactactgagcaggtgaatgctgcaatggctgcatgcaagactttaaagttagatggtctcgttgttattgggggggtaacatcaaacacggatgctgcttatcttgctgagacttttgcggaagcaaaatgtccaacaaaggttgtgggtgtccctgtcactctaaatggagatctcaggaatcagtttgttgaaacaaatgttggttttgatacaatatgcaaggtcaattcacagctcattagcaacatttgtacagatgctctgtccgctgagaagtattactatttcatccgactcatgggacgaaaagcatcacatgtttctttagaatgtactctccagtcacatccaaatatgttaattcttggtgaggaggtggctgcatctaagcttactcttttttgtacatcacaaaacaaatttagtgacgcagttcaagatagagctgaacaagataaataccatggtgtcattctgttgccggagggcttgatagaaagcattcctgaagtatatgccttattgaaggaaattcatggtttgctcaggcaaggtgtttcttctgacaacatttcctctcaactgtcaccttggacatctgcactgttcgaatttctaccacctttcataaaaaaacaggttctcctctatccagaatccgatgattctgcacagttatcccaaattgagactgagaaacttctagctcatcttgtggaggaagaaatgaacaaaagactgaaagaaggaacatacaagggaaagaaatttaatggtatctgccacttctttggttatcaagctcggggatcacttccgtcaaaattcgactgtgattattcttatgttcttggtcatatctgctatcatattctggcagctggactaaatgggtatatggcaactgtaactaacctaaaaaatcccttgaacaaatggcgctgcggagctgctccaatcacagctatgatgactgttacacgttatggtcatggcccaggagccttacaccttggaagacctgctctgcatcctgctactgtggatttgaaaggcaaagcttacgagttgttgaggcaaaatgcaacaaaatttttactggacgatgtctacagaaacccaggaccccttcaatttgatggtcctggtgctgactctaaggctgtaaccttgtgcgttgaagaccaggactacatgggtcgtatcaagcaattgcaggattatcttgacaaggtgcgcaccattgtgaaaccaggctgctcacaagatgttctgaaagctgctctgagtgccatgtcatctgtgacagacattctatctgtgatgtcatcaccatcaaacagcagccacactcccttttagaagtagaagataatgacattcgtgcataaggaaattttgtgagtgacagttgtcatcagctgcaaatgcaggattcttgatgttttcttcctccgcctgttctgatgcggagtgtgcttaggtgctgtaccattagatgtttgacaataaaaacgtagtacagttttttttttaaagtcttataactgctatttttttcttgggtatgtagacacatgtgattcttatt

SEQ ID NO: 1812 - DNA, 2331 bp, Setaria italica
gcgaggtgagagcgcatcgcatattcgccgcattggccgattggcgtgggcgagggattgcaggcaggggtcgcctccggtataaaaatcctcccgctccgcacccacatctgcccccatcacagtgcgccaccctcaccaccaccgtcaccaacaaagccaatcggaccggacgctgtaccggcgacgaggagcagcgctcgccggcgatggattcggactacggcgtgccgcgcgagctctcggaggtgcagaagaagcgcgccctctaccagcccgaggtccccccatgcctgcagggcactactgtgagggtggagtacggtgatgctgcaattgctgctgatcctgcaggcgctcatgtgatcagtcaggcgttccctcacacctatgggcaaccccttgcacattttctcaggaagacggctgttgtccctgatgctaaggtcatatctgagcaccctgcagtcagggttggcattgtcttctgtggaaggcagtcccctggaggccacaatgtcatttggggactctatgaggctatcaaggcccacaaccaaaacagcaaactcattggttttcttggtggatctgatggtctgctagcacagaaaaccttggagatcaccgatgaagttctttcttcatacaaaaaccaaggcggttatgacatgcttggtcgaacaaaggatcagattagaacaactgagcaggtcaaaggtgcaatggctagttgccaagcattgaagttagatgctctggtaatcattggaggtgtcacatccaatactgatgctgctcagcttgctgaaacttttgctgaggcaaagtgtgcaacaaaggttgttggtgttcctgtaactttgaatggagaccttaagaaccagtttgttgagactactgttggctttgacactatatgcaaggtgaactctcaacttatcagcaatatgtgcactgatgctctgtctgctgagaagtattactactttattcgcttgatgggacggaaggcttctcatgtggcattggagtgtagtcttcaatcacatccgaacatggttatccttggtgaggaggtggctgcatccaaacttacaatttttgatattacaaagcagatatgtgatgcagttcaggcgagggcagagaaagacaagaatcatggggtggttcttattccagagggccttgtggagagtattcctgaactatatgctttgcttcaggaaattcatggccttcacggtaagggtgtttccgctgagaacatctcttctcagctttcaccttgggcatctgcactatttgagtttttgcccccctttattgggaagcagctacttctccatcctgaatctgatgattcagctcaactttctcagattgagactgaaaagcttctagcccaattagtggagactgagatgaacaggcgcttgaaggaaggcacttacaaaggaaagaagtttaatgcaatctgtcacttttttggctaccaagctaggggtgcactgccttcaaaattcgactgcgattatgcctatgttttggggcatgtgtgctaccacatcatagctgctggtttgaacggttacatggctacagtgacaaatctgaagagtccagtgaacaaatggcgatgtggtgcggctcctatttcggctatgatgactgtgaagcagtggtcacgtggcccttctgctgctcaaattggcaagcctgctgttcatatggctagtgttgacttgaaaggaaaagcatacgagctgttgagacagaactcttcaagctttttgttggaagacatctacagaaacccaggcccactccaatttgaaggaccaggtgctgattcaaagcctatttcgttgtgtgttgaggaccaagactacatgggccggataaagaaattgcaggaatacttagagaaggtgaaaagcattgtgaagcctggatgctcacaggatgttcttaaagctgccctgagtgccatgtcttctgtgacggagacactgaacatcatgacttcatcgtccactggccaggcaccactctgagttaaacaaaaccatttggtgtgggattcacattttccatggtcgactgtcactgttggggttagaaacagcggccctgctatcccacgggctattctgttgtagcttttggggagttcaatcagttttgactaaagtagttccgagggtttgttgtttgattgagcttgcactggaataatttttcaaacaggctgattatgttgcgaccacttaataaactaaattttgtggcaactgtttctgtggtgtaattagttgagaaaatgtc

SEQ ID NO: 1813 - DNA, 2179 bp, Pennisetum glaucum
gtcccccatcacagtgcgccaccctcaccatccaccgccaccaacaaagccaatcggaccggacgctataccggcgacgaggagcggcgctcgccggcgatggattccgactacggcgtgccgcgcgagctctcggaggtgcagaagaagcgcacgctctaccagcccgaggtccccccatgcctgcagggcactactgtgagggtggagtatggtgatgtagcaattgctgctgatccggcaggcgctcatgtgatcagccatgcgtttcctcacacctatgggcaacccatcgcacattttctgaggaagaccgctgttgtccctgatgctaaggtcatatctgagcaccctgcagtcagggttggcattgtcttctgtggaaggcagtctcctggaggccacaatgtcatttggggactgtatgaggctatcaaggcccacaaccaaaacagcaaactcattggttttcttggtggatctgatggtctgctagcacagaaaaccttggagatcaccgatgaagttctttcttcatacaaaaaccaaggcggttatgacatgcttggtcgaacaaaggatcagattagaacaactgagcaggtcaatggtgcaatggctagttgccaagcattgaagttagatgctctggtaatcattggaggtgtcacatccaatactgatgctgctcagcttgctgaaacttttgctgaggcaaagtgtgcaacaaaggttgttggtgttcctgtaactttgaatggagaccttaagaaccagtttgttgagactactgttggctttgacactatatgcaaggtgaactctcaacttatcagcaatatgtgcactgatgctctgtctgctgagaagtattactactttattcgcttgatgggacggaaggcttctcatgtggcattggagtgtagtcttcaatcacatccgaatatggttatccttggtgaggaggtggctgcatccaaacttacaatttttgatattacaaagcagatatgtgatgcagttcaggcgagggctgagaaagacaagaatcatggggtggttcttattccagagggccttgtggagagtattcctgaactatatgctttgcttcaggaaattcatggccttcacggtaaaggtgtttccgctgagaatatctcttctcagctttccccttgggcatctgcactatttgagtttttgcccccctttattaggaagcagctacttctccatcctgaatcagatgattcagctcaactttctcagattgagactgaaaagcttctagcccaattagtggagactgagatgaacaggcgcttgaaggaaggcacttacaaaggaaagaagtttaatgcaatctgtcacttttttggctaccaagctaggggtgcactgccttcaaaattcgactgcgattatgcctatgttttggggcatgtgtgctaccacatcatagctgctggtttgaatggttacatggccacagtgacaaatctgaagagtccagtgaacaagtggcgatgtggtgcggctcctatttcgtctatgatgactgtgaagcggtggtcacgtggcccttctgctgctcaaattggcaagcctgctgttcatatggctagtgttgacttgaaaggaaaagcatacgagctgttgagaaagaactcttccagctttttattggaagacatctacagaaacccaggcccactccaatttgaaggtccaggtgccgattcaaagcctatttcgttatgtgttgaggaccaagactacatgggccggataaagaaattgcaagaatacttagataaggtgaaaagcattgtgaagcctggatgctcacaggatgttcttaaagctgccctgagtgccatgtcttctgtgacggagacactgaacatcatgacttcctcgtccactggccagacaccactctgagttaaagaaaatcatatgaaaatcatatggtgtgggattcgcgttttccatggtgaccgtcggggttgttaacagttgccctgccatcccacgggttattcttccgtagtttttggagagttcaatcagttttgacttaagtagttcgagggttttgttgttgattgagcttgaactggaataatttttcaaacaggctgattatgttgcgatcacttaataaactaaa

SEQ ID NO: 1814 - DNA, 2613 bp, Panicum virgatum
ctccggtataaaatcctcccactccgcccccgcatcggccccccattcacacacagtgcgccaccctcaccaccaccgtcaccaacaaagccaaatcggaagctagaccggcgacgaggagccggcgatggattctgactacggcgtgccgcgcgagctctcggaggtgcagaagaagcgcgcgctctaccagcccgaggttcccccatgcctccagggcactactgtgagggtagagtacggtgatgctgcaattgctgctgatccagcaggcgctcatgtgatcagccaggcgttccctcacacttatgggcagccccttgcacattttctcaggaagacggctgttgtccctgatgctaaggtcatatctgagcaccctgcagtcagggttggcattgtgttctgtggaaggcagtcccctggaggccacaatgtcgtttggggactctatgaggctatcaaggctcacaaccaaagcagcaaactcgttggttttcttggtggttctgatggtcttctagcacagaaaaccttggagatcaccgatgaagttctttcttcatacaaaaaccaaggtggttatgacatgcttggtcggacaaaggatcagattagaacaaaagagcaggttaacggcgcgatggctagttgccaagctttgaagttagatgctctggtaatcattggaggtgtcacatccaatactgatgctgctcaacttgctgaaacttttgccgaggcaaagtgcgcaacaaaggttgttggtgtccctgtaactttgaatggggaccttaagaaccagtttgttgagactaccgttggcttcgacactatatgcaaggtgaactctcaacttatcagcaatgtctgcactgatgctttgtcagcagagaagtattactacttcattcgcctgatgggacggaaggcttctcatgtggcactggagtgtactcttcaatcacatcctaacatggttattctaggagaggaggtagctgcatccaaacttacaattttcgatattacgaagcagatatgtgatgcagttcaggcgagggcagacaaagacaagaatcatggggtgattcttattcccgagggccttgtggagagtattcctgaactatatgctttgcttcaggaaattcatggccttcacggtagaggtgtttccgctgagaacatctcttctcagctttcaccttgggcatctgcactatttgagtttttgcccccatttattaggaagcagctacttctccatcctgaatctgatgactcagctcaactttctcagattgagactgaaaagcttctagcccaattagtagagactgagatgaacagacgcttgaaggaaggcacttacaaaggaaagaagtttaatgcaatctgtcacttttttggctaccaagctaggggtgcactgccttcaaaattcgactgcgattatgcctatgttttggggcatgtgtgctaccacatcattgccgctggtttgaacggttacatggctaccgtgacaaatctgaagagtccagtgaacaagtggcgatgtggtgcggcccctatttcgtctatgatgactgtgaagcgatggtcacgtggcccttctgccactcagattggcaagcctgctgttcacatggctagtgttgacttgaaaggaaaagcatacgagttgttgagacagagctcttccagctttttgttggaagacatctacagaaacccaggcccactccaatttgaaggaccaggtgccgattcaaagcctatttcgttgtgtgttgaggaccaagactacatgggtcggatcaagaaattgcaggaatacttagagaaggtgaaaagcattgtgaagcctggatgctctcaggatgttcttaaagcggctctcagcgccatggcttctgtgacggagacactgaacatcatgacttcgtcgtccactggccagacacaactgagttaaacaaaaccattttatggtgtgggattcacattttccatggtgactgttggggttagaaacagtagccctgctatcccacgagttatttttttcgtagttttgggggagttctatcagttttgacttaagtagttcatgagggtttgttgtcgatgaatttgcactggaataatttttcaaacagcctgattgtgttttgtggccacttaataaaccaaagtttgtggcaacataaatatttctgtggtgtaataagttgagaaatggtagaaattcgagagcgccccctcgatcaatgatggttaactgttgctttgtttgaacagtggtaacttaactggcaagactttaccgggtgtggtggctaacccctgacacgtctctattgactgatgagggttaagaaggttggtgctggactgccggtgaagggccgttctgttgtaaagtatttcgaccattttgtattagtaaatttggcatacgttgtcgagactaccatgacgttgccataggttaagaaggttaagaccctgtttgttttcatgggctaaaatttagccctatcacatcaaagtaaatgttgctatttaaaaatatcaaataaaaatatttataaatattttttggcg

SEQ ID NO: 1815 - DNA, 2288 bp, Oryza sativa
atcgcggcagcggcagcgtgcggtgccgacttgtgggaggagccgcctcctccgcctccgactatataacaaaaatcctcccgcacccccggcacatcgtccccgctagtcgccgccagtcaccaagccccgagcccacccccccaagctaccagcacagaacgaatcggagcgccgcgccgcgccgcgctgcgtcaccggcgatggactccgactacggcgtgccgcgcgagctctcggaggtgcagaagaagcgcgcgctctaccagcccgagctgcccccctgcctccagggcaccactgtgagagtggagtatggtgacgctgcaattgctgctgatcctgcaggcgctcatgtgatcagccacgcgttcccccacacatacgggcagcccctggcccattttctccggaagacggctaatgtccccgatgctactgtcatatcagagcatcctgttgtcagggttggtgttgttttctgcggaaggcagtccccgggaggccataatgtcatctggggactccatgaggcaattaaggctcacaacccaaacagcaaacttattggttttcttggtggaagtgatggtcttctcgcacagaaaactttggagatcaccgacgaagttctttcttcatataaaaaccaaggtggttatgatatgcttggccggacaaaggatcaaattagaacaacagagcaggtcaatggtgccatggctagttgtcaggctttgaagttggatgctttagtaatcattggaggtgttacatccaatacggatgctgctcaacttgctgagacttttgctgaggctaagtgtgcaacgaaggttgtaggtgttcctgtaactttgaatggggaccttaagaatcagtttgttgagacaaccgttggttttgataccatatgcaaggtgaactcacaacttataagcaatgtatgcaccgatgctctttcggctgagaagtattactactttattcgcatgatggggcggaaggcttctcatgtggcattggagtgtgctcttcaatcacatccgaatatggttatcctaggtgaggaggttgctgcatcaaaacttaccatctttgatatcacgaagcagatatgtgatgcagttcaggcaagggctgagaaggataagtatcacggagttgtacttattccggagggactcgtggagagtattcctgaattatatgctttgcttcaggaaattcatgggcttcacggcaaaggtgtttccatggagaatatctcctcacagctttcaccttgggcatctgcactatttgagtttttgcccccatttattaggaagcagctgcttctccatcctgaatctgatgactcagctcaactttctcagattgaaaccgaaaaacttttggcccaattagttgaggatgaaatgaacaggcgtatgaaggaaggcacttacaaaggaaagaaattcaatgcgatctgtcacttttttggctaccaagctaggggttcactgccttcaaagtttgactgcgattacgcctatgttcttgggcacgtgtgctaccacatcttagctgctggtttgaatggttacatggctactgtgacaaatcttaagagtcctgcgaacaaatggcgatgtggtgcggctccgatttcgtctatgatgaccgtgaagagatggtcacgtggtcctgcggctactcaaatagggaaacctgctgtccatatggctactgtcgacttgaaaggcaaagcattcgagctattgaggaacaattctaccagcttcttaatcgacgacatctacagaaacccaggaccactccaattcgaaggagcaggtgctgattcaaagcctatttcactgtgcgtggaagatcaagactatatgggcaggatcaagaaactccaggaatacttggagaaggtgaaaagcatcgtgaagcctgggtgctcgcaggatgttctcaaggcagcgctgagcgctatgtcatctgtgaccgagacattggcgatcatgacatcgtcttccactggccagggaaccccactctgagtcaaatggattactaaatccacattcgcttgtgtcatctgacatgtggggttagaaacagtgatgttgcaaccccacggctttctttttcgtgttttttctttggagagttttgccatttttgagccggtagcgtgagtctgctattgatgtgtttggttggactggaataataattgttcagacagcgatgttcttaaataaaccaaattttggtaggcaaaaaattac

SEQ ID NO: 1816 - DNA, 2361 bp, Sorghum bicolor
ccggaggtgaggcgagaccgcgagagcgcatcgcatattcgcattggcgtgggcgaggggttgcagcctctgcaggcagcgctcgcctccgcccttccggtataaaatcctctcacaccgaacccgcatctctccccatcacagtgcgccaccctcctcacccaccaacgaaaccaatcggtagctagaccggcgacgaggtgtggcactctccgcgatggattctgactacggcgtgccgcgcgagctctcggaggtgcagaagaagcgcgcgctctaccagcccgagctgcccccctgcctccagggcactactgtcagggtggagtatggtgatgctgcaattgcagctgacccggcaggtgctcatgtgatcagccatgtgttccctcacacctatggtcagcccctcgcacacttcctcaggaagacggctgttgtccctgatgctaaggtcatatctgaacacctggcggtcagggttggcattgtcttctgtggcaggcaatccccaggaggccacaatgttgtttggggactctatgaggctatcaaggcccacaaccaaaacagcaaactcattggttttctcggtggatcagatggtctactagcgcagagaaccttggagatcactgatgaagttcttgcttcatataaaaatcaaggtggatatgacatgcttggtcggacaaaggatcagattaggacgacagagcaggtcaatggtgcaatggctagttgccaggctttgaagctggatgctctggttatcattggaggtgtcacctccaacactgatgctgctcaacttgctgagacttttgctgaggcaaagtgtgcaacgaaggttgtaggtgttcctgtaactttgaatggggaccttaagaaccagtttgttgagactactgttggctttgacaccatatgcaaggtgaacgcacaacttatcagcaatatgtgcactgatgctctatctgctgagaagtattactactttattcgcctgatgggacgtaaggcttctcatgtggcattggaatgtgctcttcagtcacatccgaacatggtcatcctaggagaggaggtggctgcttctaaacttacaatttttgatattacgaagcagatttgtgatgcggttcaggcaagggctgaaaaagacaagaaccatggggttattcttattcctgagggccttgtggagagtattcctgaactatatgctcttcttcaggaaatccatggtctccacggccaaggtgtttctgttgagaatatctcttctcagctttcaccttgggcatctgcactctttgagtttttgcccccttttatcaggaagcagctacttctccatcctgaatctgatgattcagctcaactttctcagattgagaccgaaaagcttctagctcagttagttgagactgagatgaacagacgtttgaaggagggcacttacaaaggaaagaagtttaacgcaatctgtcacttctttggctaccaagctaggggagcgctgccttcaaagtttgactgtgattatgcctatgttttggggcatgtgtgctaccacatcatagctgccggtttgaatggttacatggctacagtgacaaatcttaagagtccagtgaacaagtggcggtgcggtgcggctcctatttcgtctatgatgactgtcaagcgatggtcgcgtggcccttcagccactcaaattggaaaacccgctgttcacatggctagcgttgacttgaaaggaaaagcatacgatgtgttgagacagaattcttccagctttttgttggaagatgtctacagaaacccaggcccgctccagtttgaaggaccaggtgctgattcaaagcctatttcattgtgtgttgaggatcaagactatatgggcaggataaagaaattgcaggaatacttggagaaggtgaagagcattgtgaagcctgggtgctcgcaggatgttcttaaagcggcgctgagtgccatgtcttctgtgacggagacactgaacatcatgacttcatcttcagctggccagactctactgtgagtcattaggtaccattttatggtgtggatcataatccccacttttttccatggtggcgattaacaagtttaggaacagtaacccgggtatcacacgggtacttttgtagctttttggagagctctatcagttttgatttcggtagtttatgaaggcttgtttttaatgagtttgagctcgaataatttttgaaacagccggattgtgaaatcttaataaaccaaattttgtgactgcattcacatttctgtgtcggtcatctgaatgagaaatctcttcatctgacgatgttt

SEQ ID NO: 1817 - DNA, 2365 bp, Saccharum officinarum
cgaccgacggatcgagaccaccggagtccggaggcgagagcgagccgcgaggcgagacgagaccgcgagagcgcatcgcatattcgcattggcgtgggcgaggggttgcaggcagcgctcgcctccgccctcttgtataaaatcctctcagaccgcgcccgcatctctcccatcacagtgcgccaccctcacccaccaacgaaaccaatcggaagctagaccggcgacgaggtgtagcgctcgccgcgatggattctgactacggcgtgccgcgcgagctctcggaggtgcagaagaagcgcgcgctctaccagcccgagctgcccccctgcctccagggcactactgtcagggtggaatatggtgatgctgcaattgcagctgacccggcaggcgctcatgtgatcagccatgtgttccctcacacctatgggcagccccttgcacacttcctcaggaagacggctgttgtccctgatgctaaggtcatatctgaacacctggcggtcagggttggcattgtcttctgtggcaggcaatccccaggaggccacaatgttgtttggggactctatgaggctatcaaggcccacaaccaaaacagcaaactcattggttttctcggtggatcagatggtctactagcgcagagaaccttggagatcactgatgaagttcttgcttcatataaaaatcaaggtggatatgacatgcttggtcggacaaaggatcagattaggacgacagagcaggtcaatggtgcaatggctagttgccaggctttgaagttggatgctctggttatcattggaggtgtcacttccaacactgatgctgctcaacttgctgagacttttgctgaggcaaagtgtgcaacgaaggttgtaggtgttcctgtaactttgaatggggaccttaagaaccagtttgttgagactactgttggctttgacaccatatgcaaggtgaacgcacaacttatcagcaatatgtgcactgatgctctatctgctgagaagtattactactttattcgcctgatgggacgcaaggcttctcatgtggcattggaatgtgctcttcagtcacatccgaacatggtcatcctaggagaggaggtggctgcttccaaacttacaatttttgatattacgaagcagatttgtgatgcggttcaggcaagggctgaaaaagacaagaaccatggggttattcttattcctgagggccttgtggagagtattcctgaactatatgctcttcttcaggaaatccatggtctccacggccaaggtgtttctgttgagaatatctcttctcagctttcaccttgggcatctgcactctttgagtttttgcccccttttatcaggaagcagctacttctccatcctgaatctgatgattcagctcaactttctcagattgagaccgaaaagcttctagctcagttagttgagactgagatgaacagacgtttgaaggagggcacttacaaaggaaagaagtttaatgcaatttgtcacttctttggctaccaagctaggggagcgctgccttcaaaatttgactgcgattatgcctatgttttggggcatgtgtgctaccacatcatagctgctggtttgaacggttacatggctacagtgacaaatcttaagagtccagtgaacaagtggcggtgcggtgcggctcctatttcgtctatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctacagaaacccaggcccgctccagtttgaaggaccaggtgccgattcaaaacctatttcattgtgcgttgaggatcaagactatatgggcaggataaagaaattgcaggaatacttggagaaggtgaagagcattgtgaagcctgggtgctcgcaagatgttcttaaagcggcgctgagtgccatgtcttctgtgacggagacactgaacatcatgacttcatcttccaacggccagactccactgtgagtcattaggtaccattttatggtgtggatcataatccccactttttccatggtggcgattaacaagtttaggaacagtaacccctggtatcacacgggttattcttttgtagctttttggagagttctatcagttttgaattcggtagtttatgaaggcttgttgatgagtttgagctcgaataatttttgaaacagccggactgtgacatcttaataaaccaatttttgtgactgcattcacatttgtgtcagtcatctgaatga

SEQ ID NO: 1818 - DNA, 2043 bp, Zostera marina
cttcatcttcctctgctccgatctcttgatttccacagggtggaagaatgagttcgaactacggaattcagagagacataccagatctacagaagaagagagctctttaccagcccgagctccctccttgcctccaggggactgatgtgagggtagagtttggtgacggcactacaactgccgatctaactggtcatcatgtgattagtcattccttcccttgcacatatggacagcctttggcacactttttgcgaccaacagccaaagttgcagatgcacagatcatcacagagcatccaacaataagagtgggattcgtgttctctggaagacaatctcctggtggccataatgttgtgtggggtctctataatgctcttagaattcacaacccaaatagttcattatttggatttattggtggcactgaaggcttgtttgcacagaaattcttgaaaatcactgaagaagtgctttctacttataaaaatcaaggtggttatgacatgttgggaaggacacaagaccagataagaacaactgagcaagtgaatgcagcgatggcatcatgtcaaactttaaaactgaatggtttagtaattgttggaggtgtaacctccaatactgatgctgcacaacttgcagagacatttgcttctgcaaaatgtccaacaaaggttgtaggggttccggttactcttaatggcgatttgaagaatcagtttgttgagactaatgttggttttgataccatatgcaaggtcaattcccagcttatcagtaatatttgcactgatgcactttctgcagagaagtattattattttgtccgtttgatgggtagaaaggcatctcatgtggcactcgaatgcaccctccaatcacatcctaacatggtaatcttaggtgaagaggtatcctcagcaaagctcaccctttttgatatcaccactcaaatatgcgatgctgtccaggagagagctgaacatggtaagagtcatggtgttgtcctcatacctgagggtctggtagaaactgtcccagaattgtatgctctactgcaggaaattcatggtttgcaaaagaatggagttcccactgataacatatccaagcaactatctccttgggcatctgcgctgtttaaatttctgcctccattttttagacgacagcttctactgcttccagaatctgacgagtcagcacaactgtcccagattgaaatggaaaaacttctcgcacaattggtcgagacagaaattaataagcgcttgaaggcaggcatctacaaaggaaaaaaatttaatgctatttgtcacttttttggctatcaagctcgaggatcgttaccttcaaaatttgatagtgactatgcttatgttcttggacacatatgttatcacattctagctgcgggtttgaatggctatatggcgaccatcacaaatctgaaaaatcctgtaaacaagtggaaatgtggagctgcaccaataacagcaatgatgacagtgaagcagtggtcttatggccctcgaaccaattcaatcggaaaacctgcaatccatcctgccactgttgacttaagagggaaagcatatgagttattgaggcaaaatgctgcgaattatttgatcgacgatgattacagaaaccctggaccccttcagtttgaagggcctggatctgatgccaaagcattcacattgtgtgtggaagatcaagattacatgggtcgaataaagaaactccaaagctatcttgataaggtaaagacaattgttaaacctggatgttcacaggatgttcttgtagctgcattaagttccatgtcttctgtaattgatgtactctctgtaatgacggctccatcctactccggtcagtcctacctttgagtttgagagcttgattaaccaagaagtgcaagtccttttttcttctttctttctttctttctttctttctttctttctttctttctttctttctttctttctttctttctttctttctttctttctttctttctttctttct

SEQ ID NO: 1819 - DNA, 2616 bp, Oryza sativa
ctctccgcactccgcacggcacgccgccgcatcggcgtgacgagttgttgttgttggcttgttgctggtgcagccgcgccgcgccgcgcgtgctcgggtataaatgccgcagccgatgcccgtttatttcgattattttttgttataggcgatcgatcgagccacctgtagccgaacgcctcactggccggcggcgagggagagacgagaaaaggcggcggcgccggcgggtgatgggcagcgtggcgatggactccgactacggcgtgccgcgcgagctgtcggcgctgcagaaggcccgcgcgctctaccgccccgacctcccgccctgcctccagggcaccacggtgaaggtggagtacggcgacgcggctatcgcggccgacgtggcgggcgctcatgtcatcagccacgccttcccgcacacctacggccagccgctggcgcatttcctcaggaagactgctgctgtgccggatgctaccgtcataacagagcaccctgttgtcagggttggtgttgtcttcagtgggaggcagtccccaggtgggcacaatgttatatggggactccatgatgctataaaggctcacaacgcaaacagcaagctcattggtttccttggaggaactgatggattgtttgcacagaaaactttggagatctccgatgaggtcctttcctcttataaaaatcaaggtggttatgatttgcttggacggacaagggatcagatcagaacaactgaacaagtgaatgctgcaatgactgcttgccaagccttgaagttggatgctcttgtaataattggaggtgttacatccaacacggatgctgctcagcttgctgagacttttgctgagtcaaagtgttcaacaaaggtagttggtgttcctgtaactctgaatggggaccttaagaaccagtttgttgagacaactgttggttttgataccatatgtaaggtgaattcgcagctcataagcaatgtctgcactgatgctctttctgctgagaagtattactactttgttcggctgatgggacggaaagcatctcatgtggctttggaatgtgctcttcaatcgcatccaaatatggttatactaggtgaggaggttgctgcatcaaaacttacaatttttgatatcacgaagcagatatgtgacgcagtccaggcaagggctgaaaaggacaaaaatcatggtgttgtacttattcctgagggacttgttgaaagtatccctgaattatatgctttgcttcaggaaattcatgggctacatgataaaggtgtttctgttgagaacatatcttctcatctttcgccttgggcttcagctctatttgaatttttgcctccatttattaggaaacagctacttcttcatcctgaatccgatgactccgctcaactttctcagattgagactgagaaacttctagcccaattagttgaagcagaaatgaacaaacgtctgaaggaaggcacttacaaaggaaagaagttcaatgcaatttgtcacttctttggctaccaagccagaggtgccctaccctcaaagttcgactgtgattatgcttatgttcttgggcatgtatgctatcacatcttagctgctggcttaaatggctacatggccactgtgacaaatcttaggagtcctgtgaacaagtggaaatgcggtgctgctcctattacttccatgatgaccgtaaagcgatggtcacgaggaccagctgccagtcaaattgggaagcctgctgttcacatggcgagtatcgacttaaaaggaaaaccatatgagttgttgagacaaaactcttccagcttcttgatggaagacatctacagaaaccctggtcctctgcaatttgagggaccaggtggagagacaaagccgatttcattgtgtgtcgaagatcgagactacatggggaggatcaaacaattgcaggagtatttggagaaggtcaaaagtattgtgaagcctggatgctcccaggatgtcctgaaggcagcgttaagcgccatggcctctgtgacagagatgctaaccatcatgtcttctccctctttcagtggccaagcaaccatctgagagccagtgaagctgaagcctgtcatatcctggtatccgtatctctctgttttgagtgtctcgtttttggacctgtgaatttgagtgtgatagagatgtgttgaggatgagttctggaacagcaataattgctcaaacaggtcactgcattgcgagtggtttgtgttcgattatattagatttgagcttaccgttttctttggcggcactattatgaaacgtgagctagcacctctgattcctctgggaatcgtagctatcttgcctgcacaggatgtgagctcagagaatttcgccgtgattcataactatcttttctgcagaaggatgttttttcactttactcaaaagttctcctggtgcttgtgaaataacttgccgagtgcggattaaaaataggggaagaaacagtcatgtatatcaaactgagcccaatgatagtgtaactaatccttaatctagagctcatgttaattcatcaaaagatgaatataaagttttgctatttggcact

SEQ ID NO: 1820 - DNA, 2297 bp, Zea mays
gagagctcatggcgtgagcgaggggttgcaggcagcgctcgcctccgcccttctggtataaaagcctctcacgccgcacccacatttctcacatcacagtgcgggcggcgggcgccactctcacacctaccaggaaaccaatcaaaacttaaaaccaatcgaaattagaccggcgacgaggattagcgctcgccggcgatggattctgactacggcgtgcctcgcgagctctcggaggtgcagaagaagcgcacgctctaccagcccgagctgcccccctgcctccagggcaccactgtcagggtggagtatggtgatgctgcaattgcagctgacccggcaggtgctcatgtgatcagccatgcattccctcatacctatgggcagcctattgctcattttctcaggaagacagctgttgtccctgatgctaaggtcatatctgaacaccaggcggtcagggttggcattgtcttctgtggcagacaatccccaggaggccacaatgttgtttgggggctctatgaggctatcaaggcccacaaccaaaacagcaaactcattggtttccttggtggatcagatggtctgctagcacagagaaccttggagatcactgataaagttattgcttcatataaaaatcaaggtggatatgacatgcttggtcgaacaaaggatcagattaggacgacagagcaggtcaatggtgctatggctagttgccaagctttgaagttggatgctctggttatcattggaggtgtcacttccaacactgatgctgctcaacttgccgagacatttgctgaggcaaagtgtgcaacaaaggttgtaggtgttcctgtaactttaaatggggaccttaagaaccagtttgttgagacaaccgttggctttgacaccatatgcaaggtgaacgcacaacttatcagcaatgtatgcactgatgctctatctgctgagaagtattactactttattcgcctgatgggacgcaaggcttctcatgtggcattggaatgtgctcttcaatcacatccaaacatggttatcctaggagaggaggtggctgcttccaaacttacaatttttgatattacgaagcagatttgtgatgcagttcaggcaagggctgaaaaagacaagaaccatggggttattcttattcctgagggccttgtggagagtattcctgaactatatgctctgcttcaggaaatccatggcctccatggcaaaggtgtttctgttgagaatatctcttctcagctttcaccttgggcatctgcactctttgagtttttgcccccttttatcaggaagcagctactactacatcctgaatctgatgattcagctcaactttcccagattgagactgaaaagctgctagcccagttagttgagactgagatgaacagacgtttgaaggagggcacttacaaaggaaagaagtttaatgcaatctgtcacttctttggctaccaagctaggggagcactgccttcaaagtttgattgcgattatgcctacgttttggggcatgtgtgctaccacatcatagctgccggattgaacagttacatggctacggtgacaaatcttaagaatccagtgaacaagtggcgatgcggcgcgactcctatttcgtctatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctacagaaacccaggcccgctccagtttgaaggaccaggtgccgattcaaagcctatttcattgtgcgttgaggatcaagactatatgggcagaataaaaaagttgcaggaatacttggagaaggtgaagaggattgtgaagcctgggtgctcgcaggatgttcttaaagcggcgctgagtgccatgtcttctgtgacggaaacactgaacatcatgacttcatcttctaccggccagactccactgagtcattaggtaccatttcatggtatggatcataatccccacttttttcagtggtggcgattaacgagtttaggaacagcaaccctggtatcatacgggttattcttttgtagccttttggagagttctatcggttttggattcggtagtttatgaaggcttgttgatgagtttgagctcgaatagcttttgaaacagccggatgatgccatctttaataaaccaaattctgtgactgcattcacatttct

SEQ ID NO: 1821 - DNA, 2245 bp, Panicum virgatum
gatcgcgagcgatccaacagaacctgctcctcctccatcgtgatccgcgagccgagcccgaggcggtggcggcgatgggcagcgtggccatggactccgactacggcgcgccgcgcgagctgtcggcgctccagaaggcgcgcgcgctctaccagccggatctcccgccgtgcctccagggtaccgcggtcagggtggagtacggtgacacagcgaccgcggcggatgttgctggtgcgcatgtcatcagccaggccttccctcacacgtacgggcagccgctggcgcacttcctcagcaagacggccaatgtgccggacgctaccatcataacagagcaccctgtcgtcagggttggtattgtcttcagtgggaggcaatccccaggagggcacaatgttatatggggcctgtatgatgctataaaggctcacaactcaaacagcaagtttattggttttcttggaggaactgatggattatttgcacagaaaactatggaaatcactgaagaagctctttcatcctataaaaatcaaggtggttatgacatgcttggtcggacaagggatcaaatcagaactactgagcaagtaaaggcagcaatggctacttgccaagcattgaagttggatgcccttgttataattggaggtgtcacgtccaatacagatgctgctcagcttgctgagacatttgctgagttgaaatgtccaacgaaaggtagttggtgttcctgtaactctcaacggagacctcaggaaccagtttgttgagacaacagttggttttgatactatatgcaaggtgaactcgcagctcataagcaatgtttgcactgatgctctttctgctgaaaagtattactattttattcgattgatgggacggaaatcatctcatgtggcattggaatgtgctcttcagacacatccaaatatggttatcctaggtgaggaggtatctatgtcaaaacttaccattttcgacattacaaagcaaatatgtgatgctgtgcaggcaagggctgaaaaagacaaatatcatggggttgtgctgattcctgagggtcttgttgagagtattcctgagctgtatgctttgcttcaggaaattcatgggctacataacaaaggtgtttcagttgagaacatctcttccagtctttcaccttgggcatctgcactgtttgaatttttgcctccatttattagaaagcagctgcttctccatcctgaatctgacgattctgctcaactttctcagattgagactgagaagcttctggcacaattagttgagattgaaatgaacaagcgccttaaggaaggcacttacaaaggaaagaagttcaatgcaatatgtcactttttcggctaccaagcaaggggagccctgccttccaaattcgactgtgattatgcttatgttcttgggcatgtgtgttatcacatcctagcggctggtctgaatggttacatggccactgtgacaaatctcaagagcccagtaaacaagtggaaatgtggtgctgctcctattacgtctatgatgactgtaaaaagatggtcccgtggtcctgctgccagccaaattggcaagcctgctgtccacatggccagtgtcgacttgaaaggaaaagcatacgaactgttgcgacaaaattcttccagcttcttgatggaagacatctaccgaaaccctgggccacttcagtttgaaggatcgggtgctgagacaaagccgatttcactgtgtgttgaagaccaagactacatgggaagaatcaaacaattgcaggagtacttggagaaggtgaaaagcattgtgaagcctgggtgttcacaggatgtcctcaaagcagcgttaagcgccatggcttctgtgacggagatgctgacaatcatgtcttccccggctttcagtggccaggcaaccatctgaacaccatgcaaagactgtatcgtctgaatgctggtctcgtgtactcggtctcagacatattttggttgtctgtatcatctgtctatctgaaaccaccgtcttgataggtcctctgctcaatatctgctgtgttttgggtgttttttcatctagacgtattttggaacaggaataatttgagcgtaatactacaaacttgttacaattttgagtggccagggtatataaaattctagagcaagtttttgcaacatatggggctcactgtcccagtgtttgagaatatctgtgcatcgatagc

SEQ ID NO: 1822 - DNA, 2277 bp, Zea mays
ggtcgcaggcagaagcagaactcacctccgcccggcccggctgtataaaaaaaaatcctctcacaccgcacacccgcatctctcccatcacagtgcgccacccgcacccaccaacgaggcaacgaaacccagtcggaagctagaccggcgacaagtgcagcgctcgccgcgatggattctgactacggcgtgccgcgcgagctgtcggaggtgcagaagaagcgcgcgctctaccagcccgaggtgcccccctgcctccaggggactactgtcagggtggagtatggtgacgccgcaattgcagctgaccaggcaggcgctcatgtgatcagccatgcgttccctcacacctatgggcagccccttgcacatttcctcaggaagacggctgttgtccttgatgctaaggtcatatctgaacacccggtggtcagggttggcattgtcttctgtggcaggcaatccccaggaggccacaatgttgtttggggactctatgaggctatcaaggcccacaaccaaaacagcaaactcattggtttcctcggtggatcagatggtttgctagcgcagagaacattggagatcactaatgaagttcttgcttcatataaaaatcaaggtggatatgacatgcttggtcggacaaaggatcagattaggacgacagagcaggtcaatggtgcaatggctagttgccaggctttgaagttggatgctctggttataattggaggtgtcacttccaacactgacgctgctcaacttgctgagacttttgctgaggcaaagtgtgcaacgaaggttgtaggtgttcctgtaactttgaatggggacctcaagaaccagtttgttgagactactgttggctttgacaccatatgcaaggtgaatgcacaacttatcagcaatgtctgcactgatgctctatctgctgagaagtattactacttcattcgtttgatgggacgcaaggcttctcatgtggcattggaatgtgctcttcaatcacacccgaacatggtcatcctaggagaggaggtggctgcttccaaacttacaatttttgatattacgaagcagatttgtgatgcggttcaggcaagggcagaaaaagacaagaaccatggggttgttcttattcctgagggtcttgtggagagtattcctgaactatatgctctgcttcaggaaatccatggcctccatggcaaaggtgtttctgttgagaatatctcttctcagctttcaccctgggcatctgcactctttgagtttttgcccccttttatcaggaagcagctacttctccatcctgaatctgatgattcagctcaactttctcagattgagacagagaagcttctagcccagttagttgagactgagatgaacagacgtttgaaggagggcacttacaaaggaaagaagtttaatgcaatctgtcacttctttggctaccaagctaggggagcactgccttccaagtttgactgcgattatgcctatgtcttggggcatgtgtgctaccacatcatagctgccggtttgaacggttacatggccacagtgacaaatgttaagagtccagtgaacaagtggcgatgtggtgcggctcctatttcgtctatgatgactgtgcagcgatggtcgcgtggcccttcagccacccaaatcggaaagcctgctgttcacatggctagcgttgacttgaaaggaaaagcatacgatgtattgaggcagaattcttccaggtttttgttggaagatgtctacaggaacccaggtccgctccagtttgaaggaccaggtgccgattcaaagcctatctcactgtgcgtcgaggatcaagactacatgggcaggataaagaaattgcaggaatacctggagaaggtgaagagcattgtgaagcctgggtgctcgcaggatgtccttaaggcggcgctgagcgccatgtcttctgtgacggagacactgaacatcatgacctcatcgtccaccggccagactgcactgtgactcgtttggtgccgttttgtggtgcggatcagaatccccactttttccatggtgtcgattgacaaagttaggagcagtaatcctggtgccacacgggtcattcttttgtagcttcttgggagagttctgtcagttttgaattcgatagtttattatggagaggcttgttggtgagtttgagctcgaataatttttgaaacagacggattgcggaatcttaataaaccaaaatttgtgactgcattcacatttctg

SEQ ID NO: 1823 - DNA, 2291 bp, Theobroma cacao
ctttctttctaagccaaacaccctctctctctctctctctctctcacagacacacacacactcacctgccctctttttccgtttccccccctacgtgtcatgatcttcactccacgtacccctctctcccttcccacctcacctccctaatcctttcaaacccttttagtcacgcgtcacttcctttacgtcccccaagagaagtctctcgttttcttcgaccccctttacgtgggacgatacaggaatacactcccctttctttcctcatttcgtggccctgttttcctacaaacgaaaaagaaggaatttcgcttcttcttgtatcattttttttttttttggagaagaaagtttggtagggtttcaatttcacagaagaagaagatggacgtgaaaccaaaaccaacctaactaaccaaacattccccattttgatttgattaaagtaaactcttttttgttaaaggtttttttctcttccccctagttgtctactctgtctctggtcctcagtttttctttatttttttttttcactcccagaaatcacgtggcaacatttccccttttttttccaatgtgtcgacttcatgcaacccccgctccccctgtttctacttccaactttgcttgccagcttgacgttacacgtgtacctttgtctacaggttacctcacctgtggccccattatcccgtactgtcctctctttgttgtaatggcggagatctgctgcggaatggtgagcgaaggcgaagcatcagctccgtgcgagccaagttcacgtgcagccaggaaacgtagaatggagattagacggataaaattcgtcactgacgtggctccatcagaggctgagaacggccggaaacgccagaagctccaaatttacacagcctcattgtctctagactgtgaaaacgctgttgacaattctgtatccgatgaagacgggaataaacaaaaggtaaaagttaaaaacggaagatcgaaaacgaaaggagcgatagtgaaaagtcactcgagcccttcccttttgtcgcctgtaaccgattcagagttatatccgaaattcggcgtcgcttcggtttgtggaaggcgaagagacatggaagacgccgtcgctattcacccgtcgtttcagcgccaaggccagttctctgcggccactgggtttcactattttggcgtctacgatggccacggttgctctcacgtggcgatgagatgcagagagcggttacatgagctggtgaaagaagagttgcagggtgaggaggaggaatggaaaggtgcgatggagcgtagcttcacgcgcatggataaagaagtgatcaagtggaacgagggcgtggttggagctaattgccgttgcgagttacagtcccccgagtgcgatgctgttggatctacagccgttgtcgctatcgtaacgcctgataagattattgttgctaactgtggtgattctagagctgttctgtgtcgtaacggcaagcccgttcctttatcgtctgatcacaagccggatcgtccggatgagctgaaccggatccaagcagcaggcggtcgggtcatttattgggacggccctcgggtcctcggggttctcgcaatgtctcgagccataggcgataactacttgaaaccttacgtgagctgtgagccggaggttatgatcacggaccgggcggcggaggatgattgtttgatccttgcgagcgacggtttatgggatgttgtgtcgaatgataccgcgtgcggggtggcgcgtatgtgtttgagggggaagggtaatctgcacgcgccgccgtattcgccggcggaaggagtggaacgggaggcggttttaggatccacaatgggagagatctcggacaaggcgtgcactgacgcgtccatgctgctgacaaagctggcgctggccaggcatagtacagacaacgttagcgtagtcgtggtggatctaaggcgagccacgtaggcattcggagtttcaatcgttttcccctctctctctctctctctctctctctattctgcttttctttttggcctttctagggtctagtctatgggcagtgaaaagcttaaggtccttttcctaattgtatttttagccccttttttgaaggagaagattttgggaggaagggggaaaatatcgagttatgaaagatagtgggggaaaaatgggatattagaaacacaaaatataccaaaaaaaaaatgaaaatgaggctggcttttgttggttggttctttttcaagaaatgaaaatcttttac

SEQ ID NO: 1824 - DNA, 1884 bp, Manihot esculenta
gatggtgtccgacgccagcaagaagaaggccgcacaaaagaaggcggcggcggcggccaagaggggtggaaaggcagctgcatcgtctaaagctgctgcttcggctgataatggaagtgtcgacaagttgtcgagtggagttggggctattcagatatcggatcggacttgtactggcgtgctatgttctcatcctctttccagagatattcgcattgagtctttatcagttactttccatggacatgacctcattgtggattctttgcttgagcttaactatggcaggcgatatggattgctgggattaaatggatgtgggaaatcaacactcttgactgcaataggttgccgtgagcttccaattccagaccacatggatatatatcacctctcaagagaaattgaagcttctgacatgtctgcacttcaggctgtcattagctgtgatgaggagaggttgaaactggagaaggaagctgaaattttatctgcacaggatgatggaggtggagagactcttgaacgtatatatgaacgtttggaggctatagatgcatctactgcggaaaaacgtgctgctgagatattgtatggtctgggtttcaacaagcagatgcaggcaaagaaaacccaggatttttccggtggctggaggatgaggattgcattggcacgggctcttttcatgaaccctacaatccttttgcttgatgaacctaccaatcatcttgatttagaagcttgtgtctggttggaggagactttgaagagatttgatcgcattctagttgtggtgtctcactcccaggatttcttgaatggtgtttgcacaaatattatacacatgcagagcaagaaattgaagatctacactgggaactatgatcaatatgttcagacccgatctgaactggaggagaatcagatgaaacagtacaagtgggagcaggagcagattgcttcaatgaaggagtacattgctagatttggacatggttcagcaaaattagcccgtcaagcacagagcaaggagaaaacacttgcaaaaatggagcgaggggggctcacagagaaggttgtcagagacaaggttctggtctttcgatttgttgatgttgggaagctgccaccacctgtgcttcagtttgtggaagttaaatttggatatactcctgataatctcatctacaggaaccttgactttggggtagatctggactctaggattgctctggttgggccaaatggtgctgggaagagcacattactgaaacttatgactggagatttggcccctagtgatggcatggttcggcggcacaatcacttgagaattgcgcaatttcatcagcatttggccgagaaacttgacttagatatgtctgccttacaatatatgataaaagaatatcctgggaatgaggaagaaagaatgagagcagcaattgggaagtttgggttgactggcaaagcgcaggtgatgccgatgaagaatttgtctgatgggcagaggagccgcgtgatttttgcatggttagcttataggcagccgcagctgctgctgttggatgagccaacaaaccatttggatattgagaccattgactctctggccgaggcattaaatgaatgggatggtggtctggttctcgtcagccatgattttaggcttataaatcaggtggcggaggagatatgggtgtgtgaaaatcaagctgttacccgatgggagggtgatatcatggacttcaaagagcacctcaagaagaaggctggcttatctgattgagaggaatgatgagattgctgtgataatcattatcgtattatcagcatgcctttttgtctatggttgataatcacagcacacggctacttaca

SEQ ID NO: 1825 - DNA, 2434 bp, Vitis vinifera
acccaacaaaggtcacacggtccgcctctccaaaaaccctagatctcacggtcctcctctcacctcagatcaggttgaagatggtgtctgacgcgagcaagaagaaggcggcggcgaagaaggccgcggcggccgccaagaggggaggcaagtctgctgctgccgcatcttcgaaggcggcggcgtctgcggcggccgccgatgtacagaacggcgttgacaagatggccgatatgaaaatatcagatcggacttgtactggtgtgctctgttcgcatcctctttcgcgcgatattcggatagagtctttatcggttactttccatggtcatgatcttatagtggatactgagctagagcttaactatggcagacgatatggtttacttggactgaatgggtgtggaaaatctaccctcctcactgcaattgggtgccgagaacttcccattccagaacacatggacatccatcatctaaccagagagattgaagcttctgacatgtctgcccttgaggctgtcataagctgtgatgaggagaggttgaaattggagaaagaagctgaagtgttggctgcacaggatgatggtggcggagaggcccttgatcgtgtatatgagcgtttggaagccatggatgcatcaactgcagaaaagcgcgctgctgaaatcttgtttggtcttggttttaataagacgatgcaagcaaagaaaacacaagatttctctggtggttggagaatgaggatagcattagctcgggctttgtttatgaatccaaccattctgttactcgatgaacccactaatcatcttgatttagaagcttgtgtctggttggaggagacattgaagaactttgatcgcatcttagttgtggtttcacactcccaggactttctgaatggtgtctgcacaaatatcatccacatgcaaaacaggaaactgaagctttacactggtaattatgaccaatatgttcaaacccgtgctgaactggaagagaaccagatgaaacagtacaagtgggagcaggaccagattgcttcaatgaaggagtatattgcccgatttgggcatgggtctgcgaaactagctcgccaggctcagagcaaggaaaaaactctggccaaaatggaacgtggaggccttacagaaaaagtggttagagacaagattcttgtctttcgcttcactgatgtgggaaagcttcccccgccagtactgcagtttgtagaagtcacatttggctatactcctgataatctcatttacaagaacattgactttggggtagacctggactcaaggattgctctggtgggacccaatggggctgggaagagtactttgctgaagctcatgactggggatctgtttcctattgatggcatggtccggcggcacaaccacttgagaattgctcagttccatcagcacctgactgagaaacttgacttggagatgtctgctctcctgtacatgatgagagaatacccaggaaatgaagaagagaagatgagggcagcaatcgggaagtttgggctgacaggtaaggcgcaggtgatgccaatgaagaatctgtcagatggtcaaaggagccgggtgatttttgcatggttagcttataggcaacctcacatgttgctgctggacgaaccaactaatcatttggatattgagacaattgactcactagctgaagcattgaatgagtgggatggtggtctggttcttgttagtcatgatttcaggctcataaaccaggtggctcaggagatatgggtgtgtgagaatcagaaggtgacccgctgggagggtgacattatggactttaaggagcatctgaagagcaaggctggattgtctggttgaaccagatagcagaggctgtgtcagcattataccattgtactagtctatctttgcttacattgatcatctatatcactacacgactggtaaatgatgcatctagtggacatgtgatctcccagaggattatgatgaaagcaaggaaagtggcaaacacaagtgatcaaggcaaggggttattgtttcaagctgatgtgttttgatacctgtctggttattatttactaggaggtgatatataattttttttcctttacaaatatacactgcccttatattattcttggttatcggctcagaaccaggaaatacctttttaacaatgtttcttctggtagacgagatgcctatgtgaacctccttatgattgtgcttcattccctttgaatgatgtgttgtaggccattatgatgttatcctatttttttttctcaagtgaaatttggtaatgcaactgctaattctcccttcaacttgtttgtatggttgtggattttatttttcagggtagtcaggtgatggtgatgctataaaattggaatgctgctgggttagtc

SEQ ID NO: 1826 - DNA, 2059 bp, Oryza sativa
gagagggttggaggaagaggaggagcggaggagatccccaaccacaactactctccctcccgccgccgccaccgtagtctaccctactcccgcaccgcagccatggtgtccgacgccagcaagaagaaggcggctcagaagaaggccgccgccgccgccaagaggggcgccaaggcctcctcctcctcctcctcttcctcctccgccgccgataaagcggccaacggtatcgccgcgcttaagctttccgatcgcacctgcaccggagtcctcgcctcccatccgctctcccgcgatatccacatagagtccctctcattaacatttcatggccatgaccttattgttgattctgagttggagctcaactatgggaggcgttacggtttgctcggcctaaatggctgtggcaaatctactctgctcacagccataggctgcagggaactccctatccctgaacacatggatatttaccatctctccagtgagattgaggcttcagatatgtctgcgctacaggctgttatctgttgtgacgaagagaggatgaagttggaaaaggaagctgaaattttgtctgctcaggatgatggtggcggtgatgctttggatcgtatatatgagcggttagaagcacttgatgcatctactgctgaaaagcgtgctgctgagatattgtttggtttgggctttaataaacaaatgcaggcaaagaaaactcaggatttttctggtggttggcgtatgaggattgctttggcaagagctttgtttatgaatccaaccatccttttgcttgatgagccaacaaaccatcttgatcttgaggcttgtgtctggctggaagagacactaaagaagtttgatcgtatacttgttgtcatatcacactcacaagatttcctaaatggagtttgcactaacatcatccatatgcagagcaagaagctcaagttatattctggtaactatgaccagtacgttcaaactcgttctgagcttgaagagaatcaaatgaagcagtacaaatgggagcaggaacagattgcttcaatgaaggagtacattgcacgttttggccatggatctgcaaagcttgctcgtcaagctcagagcaaagagaaaactcttgctaagatggaacgaggtgggctcactgagaaggttgtcagggacaaggtactggtgttccgctttacagatgttggcaaacttccaccaccagtgctgcagtttgttgaagtctcattcgggtataccccagataacctcatctacaagaatctcgactttggtgttgatcttgactctagaatcgcactggttggccccaatggtgcgggcaagagtactcttctgaagctcatgacaggtgacctagctccattagatggtatggtcaggcgccacaaccaccttcgaattgcgcagtatcatcagcatctcgcagagaagctggacctggacatgccggccctacagtacatgatgagggaataccctgggaatgaggaggagaagatgagggctgcaattggtaagtttggcctgtctgggaaggcgcaggtgatgccaatgaggaatctctctgatgggcagaggagccgcgtcatctttgcgtggctggcttacaggcagcctcaactgctgctgcttgacgagccgacgaaccatctggacattgagaccatcgattctctggctgaggcactgaacgagtgggacggtggtttggtcctggtgagtcatgacttcaggcttatcaaccaggttgctcaagagatttgggtgtgcgagaagcaggcggtgaccaggtgggaaggtgatatcatggacttcaaggagcacttgaggagcagggctggtctctctgactagttctatctgcccttcgtttttatcttcctctcttgacagctcctcggaggtttattataatagccaaaccaagttttgtcttgtatcttggagtctaatttatttgtagtagcctgctatcttaattatcactattgcacttggagagttataagagattatatatttttttctttta

SEQ ID NO: 1827 - DNA, 2221 bp, Setaria italica
gttccccttctcctacccctcacctcccgatcgccgccgccacacagcctccccaaccccaagcaccccccagctccccgtctcccggatcggcgccgccatggtttcggaggccagcaagaagaaggccgcccagaagaaggccgccgcggccgccaagaggggaggcaaggcagcggcggcgtcctcgtcctcgtcttcttcctccgcggccgcggccgcggagaaggcggcgaacggcgtcgcggcgctcaagctctccgaccgcacctgcaccggggtcctcgcgtcccacccgctctcccgcgatatccacatagagtctctttcattaacattccatgggcatgaccttattgtggattctgagttggagctcaactatgggaggcgatacgggttgcttggcttgaatggctgtggaaaatctactcttctcacagcaataggctgcagagaacttcctatccctgaacatatggacatataccatctcagccatgagattgaggcttcagatatgtctgcactacaagctgttgttagttgtgatgaagaaagagtccagttggaaaaggaagctgaaattttggctgcgcaggatgatggtggtggtgaagctttggatcgtgtgtatgagcgtctagatgcaatggatgccgcaactgcagaaaagcgggctgctgaaatattatttggtttggggttttccaaacagatgcaggcaaagaaaactaaagatttctctggtggttggcgtatgagaattgctttggcaagggcactgttcatgaatccaacaatccttttgcttgatgagccaacaaaccatcttgatcttgaggcatgtgtctggttggaagagatgctaaagaattttgaccgtatacttgttgtcatatcacactctcaagattttctaaatggagtgtgcacaaacatcatccatatgcaaaacaagaagctcaagttatacactggtaattatgatcaatatgtccaaacccgctctgagcttgaagagaatcaaatgaagcagtacaagtgggagcaggaacagattgcatcaatgaaggagtacattgcccgctttggtcatggttctgcgaagcttgcacgtcaggcacagagcaaagagaaaactcttgcaaagatggagcgtggtggtctcactgagaaggttgttagggacaaagtacttgtgttccgctttacagatgttggcaagcttccgccaccagtgctgcagtttgttgaagtcaagtttggatatacacctgataatctcatatacaagtgtcttgactttggtgttgatcttgactctagaattgcattggttggtcccaatggggcagggaagagcactcttctgaagctcatgactggtgatctagttccactagatggcatggtgaggcgccacaatcacctccgcattgcgcagtaccatcagcatcttgcagagaagctggacctggacatgtcggctctggcttacatgatgaaggaataccctgggactgaagaagagaagatgagatctgcagtcggcaggtttggcctgtcagggaaggcgcaggtgatgccgatgaagaatctctccgacgggcagaggagccgtgtcatctttgcatggctggcctacaggcagccacaactgctgctgcttgatgagcctactaaccatcttgatattgagaccatcgactccctggcagaggcgctgaacgagtgggatggtggtttggtcctggtgagccatgacttccggctgatcaaccaggttgctcaagagatctgggtgtgtgagaaccaggcagtgactaggtgggaaggtgatatcatggatttcaaggcacacttgaagagcaaggctggtctatccgattagaaagccttttatttttctcttcggagaattatagtcaaccatgagctttttaactctgtatcacgaagtcccagttttccagtagcaaattaccagagtttatgttattgtccagtagcaaattatcggagtttatgttattgtatcggattccttgtgactttcatcagaacatgagtattttatagtacctcaaatgctatatattttttggaatggtttgtgtatcgtaagtttgttgagtttatgtgttggaatttctccaagtttgtggatcctatagtagaccactggtaatgcacgagcacaaggttgaaggtgtgagat

SEQ ID NO: 1828 - DNA, 2277 bp, Sorghum bicolor
gttagtattagtacgcggccagccgccagaggcggggtcggagttgagcacttgagttccccttctcctacccttcacctccctagcgccgccgccagcaccgcgtccccaaccccaagcactccagcgcccccgaaccggatcgacgccatggtgtcggaggccagcaagaagaaggccgctcagaagaaggccgccgcggccgcgaagaggggaggcaaggccgcggtggcgtcctcatcgtcttcatctgcggccgcggccgccgataaggcggcgaacggcgtcgcggcgctcaaactatcagaccgcacctgcaccggggtcctcgcgtctcacccgctctcccgcgatatccacatagagtctctttctttaacattccatgggcatgaccttattgtggattctgagttggagctgaactatggaaggcgatacggtttgcttgggttgaatggctgtgggaaatctactcttctcacagcaataggctgcagagaacttcctatccctgaacacatggacatataccatctaagccatgagattgaagcttctgacatgtctgcactgcaagccgttgttacttgtgacgaagaaagagtaaagttggaaaaggaagctgaaattttggctgcacaggatgatggtggtggcgaagcactggatcgtgtttatgagcgtctagatgcaatggatgctggaactgcagaaaagcgagctgctgaaatattattcggtctgggttttaacaaagaaatgcaggcaaagaaaactaaagatttctctggaggttggcgtatgaggattgctttggcgagagcactgtttatgaatccaacaatccttttgcttgatgagccaacaaaccatctagatcttgaagcttgtgtctggttggaagagacactaaagaaatttgaccgcatacttgttgtcatatcacactctcaagattttctaaacggagtgtgcactaacattatccatatgcaaagcaagaagctcaagttatacaccggtaactacgatcagtatgttcaaactcgctccgagcttgaagagaatcaaatgaagcagtacaaatgggagcaggaacagattgcatcaatgaaggagtacattgctcgtttcggtcatggttctgcaaagcttgctcgccaggctcagagcaaagagaaaactcttgcaaagatggagcgaggtggtctcactgagaaggttgttagggacagagttctagtgttccggtttacagatgttggcaagcttcctccgcccgtgctgcagtttgttgaagtcaagtttgggtatacaccagataatctcatatacaagagtctggactttggtgttgatcttgactctagaatcgcattggttggtcccaatggggcagggaagagcactcttctgaagcttatgactggtgatcttgttccattagatggcatggttcggcgccataatcacctgcgcattgcacagtaccatcagcatctggcggagaagctggatctggacatgccagccctggcttacatgatgaaggaataccctgggactgaagaagagaagatgcgagctgctgttggcaggtttggcctgtcaggaaaggcgcaggtgatgccgatgaagaatctttctgatgggcaaaggagccgtgtcatctttgcatggctggcatataggcagccgcaactgctactgctcgatgagccgacaaaccatctggatattgagaccattgactccctggccgaggcactgaatgagtgggatggtggtttggttctagtgagccatgatttcaggctgatcaaccaggttgctcaagagatctgggtgtgtgagaatcaggcggtgacaaggtgggaaggtgatatcatggatttcaaggcacacttgaagagcaaggctggtttatctgattagaaggcttgtctagcaaccatgagctttttaactctgtatcacgaagtcctatttttccagtagcaaactatcggagatactgctattgtatcggattccttaagacatccatagcagccaccagccagagtaccttatactacctggaatgtttatttatatatttttttgaaatgctattatgtgttctgtaagttttgtagattttggaagtttggatttgtcaaagttactggattctatgatccttgtgaacatacaaacataaatttagtttcaaattcaactgaaattttatttcttcagaaaaaatgattttgttaagcatttgaaattttg

SEQ ID NO: 1829 - DNA, 2224 bp, Zea mays
gttagtctttagtacacggtcagccgcccgagccgggtcggagttgagcacttccccttctcctacccttcacctcccgtttgcccgcagccgccaccgcgtccccaagcactccagcgcccccgtccccgatcgacgccatggtgtcggaggccagcaagaagaaggccgcccagaagaaggccgctgccgccgcaaagaggggaggcaaggcctcggtggcgtcctcgtcgtcttcatctgcggccgcggccgccgataaggtggcgaacggcgtcgtggcgcttaagctatcagaccgcacctgcaccggggtcctcgcatctcaccccctttcccgggatatccacatagagtctctttctttaacattccatggacacgaccttattgtggattctgatttggagctgaactacggaaggcgatacggtttgcttgggttgaatggctgtggaaaatctactcttctcacagcaataggctgcagagaacttcctatccctgaacacatggacatataccatctaagccatgagattgaagcttctgacatgtctgcactgcaagccattgttagttgtgacgaagaaagagtgaagttggaaaaggaagctgaaattttggctgcacaggatgatggtggtggtgaagcattggagcgtgtttatgagcgtctagatgcaatggatgctggaactgcagaaaagcgagctgctgaaattttatttggtctgggttttgacaaacaaatgcaagcaaagaaaactaaagatttctctggaggttggcgtatgaggattgctttagcaagagcactgtttatgaatccaacaatccttttgcttgatgagcccacaaaccatctagatcttgaggcttgtgtctggttggaagagacactgaagaaatttgaccgcatacttgttgtcatatcacactcccaagattttctaaatggagtgtgtactaacattatccatatgcaaaacaagaagctcaagttatacaccggtaactacgatcagtatgttcaaactcgctccgatcttgaagagaatcaaatgaagcagtacaaatgggagcaggaacagattgcttcaatgaaggagtacattgctcgcttcggtcatggttctgcaaagcttgctcgtcaggctcagagcaaagagaaaactcttgcaaagatggagcgaggtggtctcaccgagaaggttgttagggacagagttctagtgttcaggtttacagatgttggcaaacttcctccacctgtgctgcagtttgttgaagtcaagtttgggtatacaccagataatctcatatacaagagtcttgactttggtgttgatcttgactctagaatcgcattggttggtcccaatggtgcagggaagagcactcttctgaagcttatgactggtgaccttgctccattagatggcatggttcggcgccacaatcacctgcgcattgcacagtaccatcagcatcttgcggacaagctggatctggacatgccggctctggcttacatgatgaaggaataccctgggaccgaagaagagaagatgcgagctgctgttggcaggtttggcctatcaggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggctgatcaaccaggttgctcaagagatttgggtgtgtgagaatcaggcggtgacaaggtgggaaggtgatatcatggatttcaaggcacacttgaagagcaaggctggtttatctgattagagggctttttccagcaaccatgagctttttaactctgtatcacgaagtcccagttttccaatagcgaactatcagagttactttattgtatcggatttcttttgacttgcattgcaacctgattaccttatactacctggaatatttatttatatatcttttgaaatgctattatgtgtattgttaagtttcgtagattttggaagttttgatttgtcaaagttactagattctatgatcattgtgaacatacaacttaaatttagttttcaattcaactgattttatttcttcag

SEQ ID NO: 1830 - DNA, 2572 bp, Zea mays
agtccacaaagcccagcaagcagcccaaccgatcccaatcccaaattcccaacacgaagcccagccagcccttccccactaggctagctagctagtagtatcttttttagtacgtggccagccgacaggcgcttgtcggagtcgagcacttgagtccccttctctccttcccttcacctcccgattgccgccgccaccaccaggcaccaggcccaccaccgcgtctcccaaccccaagcactcgacgccatggtgtcggatgccagcaagaagaaggccgcccagaagaaggccgccgcggctgccaagaggggaggcaaggccgcggcggcgtcctcctcgtcgtcgtctgcggccgcggccgcggccgtcgacaaggcggcgaacggcgtcgcggcgctcaagctatcggaccggacctgcaccggcgtcctcgcgtctcacccgctctcccgcgatatccacatagagtctctctctttaacattccatgggcatgaccttattgtggattctgagttggagctgaactacgggaggcgatacggtttgcttgggatgaacggctgtgggaaatctactcttctcacagcaataggctgcagagaacttcctatccctgaacacatggacatataccatctaagccatgagattgaagcttctgacatgtccgcactgcaagctgttgttacttgtgacgaagaaagagtgaaattggaaaaggaagctgaaattttggctgcacaggcgagctcctggaatcacagaattgatgatggtggtggtgaagctttggaacgtgtttatgagcgtctagatgcaatggatgctggaactgcagaaaagcgggctgctgaattattattcggtctgggctttaacaaacaaatgcagacaaagaaaactaaagatttctctggaggttggcgtatgaggattgctttggcaagagcactttttatgaatccaacgatccttttgcttgatgagcccacaaaccatctagatcttgaggcttgtgtctggttggaagagacactgaagaaatttgaccgcatacttgttgtcatatcacactctcaagattttctaaatggagtgtgcactaacattatccatatgcaaagcaagaagctcaagttatacactggtaactacgatcagtatgttcaaactcgctctgagcttgaagagaatcaaatgaagcagtacaaatgggagcaggaacagattgcttcaatgaaggagtacattgctcgcttcggtcatggttctgcaaagcttgctcgtcaggctcagagcaaagagaaaactcttgcaaagatggagcgaggtggtctcacagagaaggttgttagggacagagttctagtgttccggtttacagatgttggcaagcttcctccgcccgtgcttcaatttgttgaagtcaagtttgggtatacaccagataatctcatatacaagagccttgactttggtgttgatcttgactctagaatcgcattggttggtcccaacggggcagggaagagcactcttctgaagcttatgactggtgaccttgttccattagatggcatggttcggcgccacaatcacctgcgcattgcgcagtaccatcagcatctggcggagaagctggacctggacatgtcagccctggcttacatgatgaaggaataccctgggactgaagaagaaaagatgcgtgccgctgttggcaggttcggcctgtcaggaaaggcgcaggtgatgccgatgaagaatctttctgatgggcaaaggagccgcgtcatctttgcatggctggcatataggcagccgcaactgctactgcttgatgagccgacaaaccatctggatatcgagaccattgactcactggcagaggcgctgaatgagtgggatggtggtttggtcttggtgagccacgatttcaggctgatcaaccaggtcgctcaggagatctgggtgtgtgagaatcaagaggtgacaaggtgggaaggtgatatcatggatttcaaggcacacttgaagagcaaggctggtttatctgattagaatgcttttctagtaaccatgaactttttaactctgtatgatgaagtccctgttttacagtagcgaactatcaaatatactgttagggatagtttggtaactacaaatccggagggggttggaggggctagaatccccttcttattcaattttgaataagtctattctctccaatcctctccggttttctggctcccaaactaaccccttcgggattgaagggtattgaagaggaaattagttcatttccaccttaattccctcccaatcccgaaggggatttgaggttcacaaagtagcgaatgtgtcagactcctacttccctcgcaaccatactaccttgtactacctgaaatttttatttatatatatatttgaaatgttattatgtgttccgtaagctttgtaggttttgtaagtttggatttgtcaaagttactgcatattatgatcattgtgaacatacaacttaactttagtccaaaattcaactgaaattttattt

SEQ ID NO: 1831 - DNA, 2049 bp, Panicum virgatum
cttgagttccccttctaccactcacctcccgatcgccgccgccaccgcctccccaacccctagcacccccagctccccgtctcccggatcggcgccatggtctcggaggccagcaagaagaaggctgctgcgtcctcgtcctcgtcctcgtcttcttcctccgccgccgctgccgtggacaaggcggcgaacggcgtcgcggccctcaagctctccgaccgcacctgcaccggggtgctcgcgtcccacccgctctcccgcgatatccacatagagtctctttcattaacattccatgggcatgatcttattgtggattctgagttggagctgaactatgggaggcgatatgggttgcttggcttgaatggctgtggaaaatctactcttctcacagcaataggctgcagagaacttcctatccctgaacacatggacatataccatctcagccatgagattgaggcttcagacatgtctgcactacaagctgttgttagttgtgatgaggaaagagtgaagttagaaaaggaagctgaaattttggctgcgcaggaagatggtggtggtgaagctttagatcgtgtgtatgagcgtctagatgcgatggatgctgcaactgcagaaaagcgtgctgctgaaatattatttggtttgggttttaccaaacagatgcaggcaaagaaaactaaagatttctctggtggttggcgtatgagaattgctttggcaagggcactgttcatgaatccaacaatccttttgcttgatgagcccacaaaccatcttgatcttgaggcctgtgtctggttggaagagacactaaagaaatttgaccgcatacttgttgtcatatcacactctcaagattttctaaatggagtgtgcacaaacattatacatatgcaaaacaagaagcttaagttatacacaggtaattatgatcagtatgttcaaacccgctctgagcttgaagagaatcaaatgaagcagtacaaatgggagcaggaacagattgcttcaatgaaggagtacattgcccgttttggtcatggttccgcgaagcttgcacgtcagcacaaagcaaagagaaaactcttgcaaagatggagcgtggtggtctaactgagaaggttgttagggatagagtacttgtgttccgctttacagatgttggcaagcttccaccaccagtgctgcagtttgttgaagtcaagtttggatatacacctgataatctcatatacaagaatcttgactttggtgttgatcttgactctagaattgcattggtcggtcccaatggggccgggaagagcactcttctgaagcttatgactggcgatctggttccactagatggcatggtgaggcgccacaatcacctccgcattgcgcagtaccatcagcatcttgcagagaagctggacctggacatgtcggccctggcttacatgatgaaggaataccctgggactgaagaagagaagatgagagctgcggttggcaggtttggcctgtcggggaaggcgcaggtgatgcccatgaagaatctctctgatgggcagaggagccgtgtcatctttgcatggttagcatacaggcagccacaactgctgctgcttgatgagccgactaaccatctggatattgagaccattgactccctggccgaggcactgaacgaatgggacggtggtttggtgctggtgagccatgacttcaggctgatcaaccaagttgctcaagagatctgggtgtgtgaaaaccaggcagtgactaggtgggaaggtgatatcatggatttcaaggcacacttgaagagtaaggctggtctgtccgattagaaagccttttatttttctcttcggagaattatagtcaaccatgagcttttaactctgtatcacgaagtcccagttttccagtagcaaattatcggagtttatgttattgtatcggattccttatgactttcatctgaacatgagtattttatagcacttcagatgcttatatatttttttgaaatgttgtgtatcgcaagtt

SEQ ID NO: 1832 - DNA, 2279 bp, Silene vulgaris
actgtgagagacaattttaattctctctctttttttcttggtttgcctaactttcccaccgctccaaaccctaaccctagatctcactccgccgaattccttctttctctcattgcaccaaccctatttcgcactcaaaaatggtgtctgacgcaagcaagaagaaggcggcgcagaagaaggcggcggcagcggcgaagagaggtaacaaagcggcagcagcatccgcatcggcgaaagcggcttcgattggtcaaggtggtactgatcagttagctgatgaagttgaccaattacttttatctgatcgtacttgtactggaattctttgctctcatcctttatcacgagatattcggatagaatctttatccgttacttttcacgggcatgatctggtacttgattctttattggagcttaattatgggagacgttatggtttgcttgggcttaatggttgtgggaagtccacccttcttactgccataggattgcgggagcttccaattcccgatcacatggatatctatcatttgaccagagagatcgaagcctctgatatgtctgcccttgatgctgtaatatgctgtgatgaagagaggatgaagttagaacaagaagctgaagcattggcagcatcggatgatggtggaggtgacagacttgaccgtatatatgagcgtttggatgctctggatgcttcaactgcagaaaaacgtgctgctgaaattctgaatggtctcggtttcaacaaggagatgcaagcaaagaagaccaaggatttctctggtggttggaggatgagaattgcactagcacgttctttgtttatgaatcctaccattttgctcttggatgaacctaccaatcatctcgatcttgaagcttgtgtttggctggaggagagtctgaagaaattcaatcgtattctcgttgtagtttcacattcccaagatttcttgaatggtgtctgcacaaatatcatccacatgcaaagcaagcagttgaaaatttatactgggaactttgatcagtatcttcaaacccgcgccgagcttgaagaaaatcagatgaaacagtataaatgggagcaggaccaaatagctaacatgaaagagtacattgcccggttcggtcacggttctgctaagttagcccggcaagctcagagcaaagagaaaacccttgcaaagatggaaaggggaggattgactgagaaggttgcccgagaccaagttctggtgttccgtttcacagatgtcggaaagcttcctcctccagtcttacagtttgtggaggtgtcatttggctatacaccagagaatattttatacaaaaacctggactttggtgtggaccttgactcgaggattgctctggtgggtcctaatggggcaggaaagagtacacttctgaagctgatgacaggagaactggccccggttgaaggcactgtgaggcggcacaaccacctaaggatcgcccaataccatcaacatcttgcggaaaagcttgacatggagatgtcagctttacaatatatgatgagagagtacccggggacagaagaagagaaaatgagggcggcaataggaaggtttgggctgtcaggcaaacctcaggtgatgcccatgaaaaacttgtcagatggacaacgtagccgtgttatatttgcatggttggcatataggcagcctcaaatgttattgttggatgagcctactaatcatttggatatcgagacgattgattcattagctgaggccttgaatgagtgggatggtggtttggttcttgttagccatgactttaggctcatcaatcaggttgcacatgagatatgggtgtgcgaaaatcaaaccgtatcgcgctggggaggtgatatcattcagttcaaggagcatctcaagaagagagctggattataattgaagccaacaattttgatttttgatgggtgttgccaggtattatgaattatgcagttacattattagtgctatcgctcttggcgcctttttgagctctccacttattattatctgggatttggcgagacattgaaggctagaggccggcttaggccgggcttgggcccgccggtgaagcgactctttccctcattgttgagaggtgatattttgtttttgctttttttttatctattgaacctttgcataagagacctggtgctttgctaggaatactgtcctgtttctgtaaacgagtacggatgaacttgcatgttttagatgatcacattattaatagtatat

SEQ ID NO: 1833 - DNA, 2601 bp, Cycas rumphii
  misc_feature (1539)..(1539): n is a, c, g, or t
  misc_feature (1687)..(1687): n is a, c, g, or t
tggatccaaagcggaagcttggcgtttttttcttcttccagcgtcggcttctggttcaggtgttcaggcgtgtttgcggccgtgttttcttctaccgcaaacaaatttttaaaggcaggtattaggcgacatatttagagaaaatggtgtccgacgcaagcaagaagaaggccgccgccaagaaggctgcagcagctgcaaagaggggatcgaaatcagcagttgcggcttcatctaaggccgatgaatcgcagaatggaaacgcaaataaaggaaccaatgctgcgtcggtactaccaatatcggatcggacgtgtactggagtccttggttctcaccctatgtctcgagacattcatatagagtctctatcagttacattccatggccatgagttgattgtggattcagaactggaactgaattatggaaggcgctatgggttgcttggacttaatggatgtggcaaatctacactccttacagctataggacgtcgggagcttcccataccggaacatatggatatttatcatttgaccagggaaatagatgctactgatatgactgcacttgaagctgttatgaactgtgatgaagagaggctgcaacttgagaaagaagccgaaactttggcagcacaagatgatggaggtggagaggcgctcgatcgaatatatgaacgcctggaaatcttggatgctgcaacagcagaaaaacgagctgctgagattttatttggcttaggtttcaccaagaaaatgcaagcaaagaagacttgtgatttttctggtggctggcgcatgcggatagcattagcccgagctttatttatgaatcctacaattttgttgctagatgaacctacaaatcatcttgatcttgaagcttgtgtatggttggaggaaacacttaagaaatttgatcgcattctggttgtagtgtcacattcccaggattttcttaatggagtttgtactaacatcattcatatgcagaacaagaagttgaaattgtatactggaaattacgatcaatatgttcagactcgttctgagcttgaggaaaatcagatgaagcagtacaaatgggagcaggagcagatatcagcaatgaaggaatatattgccaggtttggtcatggttctgccaaacttgctaggcaggcacagagtaaagaaaagaccctggcaaagatggaaagaggtgggcttacagataaagtagtaagagataaagtgttagtgttccgatttaccgatgttgggaagcttcctcctccagtgctgcagtttgtggaggtaacttttgggtacacaccggaaaaccttatatacaaaaatgtggattttggagtggatctggactcgaggatagctttggttggtcctaatggagcaggaaaaagtacattattgaaattgatgaccggggatttggttcctttggatggcatggtaaggcgccataatcatcttcgaattgctcaatatcaccaacatttagcggagaagctgcatctggatatgtctgcattgnaatacatgatgagtgaatatccagggcttgaggaagaaaagatgcgtgcagcaattggaaagtttggtctcacaggaaaagctcagatcatgcccatgcaaaacttgtccgatggacaaaaaagccgggtaatttttgcatggcttgnttggaggcaaccgcaactcctcttgctagatgaaccaaccaatcatcttgatattgaaacaattgattcccttgcagaggcactaaatgagtgggatggaggactggttttggttagccatgatttccggctcataaaccaagttgccaaggagatatgggtgtgtgaaaacaagactgttacaagatgggaaggagatattatggatttcaagcagcatttgaagtctaaggctggtctgtgagtgcattgtattggtcatagtttgccacatcaaaccccggtgacaattctgtgcaggacacagaatatctgcgcagcaaagctagtgacctagtcatggatatttgtttttgggtttaaatgccttaacgtggcactgggtcaagtcaaatgtcatattgatcatggtagatgtcctcggatggcagaattatcctagattcatcgtaatcagaatgtcaacctctgattcatctatgtttagtgctacttatatggtttaatttctttcctactgcttcaaatttctcgtggtgttgttatttctgtaggatgcgctaaactcagttactttatgttcctaaatgtgtttgcctggatacttacgtacgtggcatggaacaaggcaaactgcaggctttgtggaacttacgcaaatcatacaaattcccattctatttttatcattttatgtctattcaggtattaacagaggatttattgttatcctattgtactctcagggatttaaatgcttgtttgatacttttggtatggttcataatagatgtcttcaagttggtgcttcggtgcagagctcaaaacaagctggaaccaaacattgcattttggttccattgtctttgtatagccaggtttctaagtattaatttcaagtgtttttttgggca

SEQ ID NO: 1834 - DNA, 2348 bp, Sciadopitys verticillata
ggctgattcaggtgtctgtgtctctgcaactgcccctcagatcccctgtccttcctaaggttgtaaaaatggtttcggacgcgagcaagaagaaggccgcggccaagaaggcagccgccgcagccaagaggggttctaagtcatccgccgccacagtgtccaagccagaaacgtcacaaaatggaaaggccagtgctagcgtggaaaaagcagccgatgacatggcagcaatgcatatatcagatcggacgtgtactggggtcctctgttctcacccgctctctcgagatattcatatagagtccttgtcagttacattccatggtcatgagttgattgttgattcagaactggagctaaactacggaagacgctatggattgcttggacttaatggatgtggcaaatctacacttcttacagctctagggtgtcgggaacttcccataccagagcacatggatatatatcatctgaccagggaaattgaggcaactgatatgactgcacttgaagctgttatgaattgtgatgaagagaggcttcggcttgagaaagaagctgaagcgctggctgcccaagatgatggaggtggagaggcactagatctaatatatgaacgtctggatctgttggatgctgcaacagctgaaaagcgagctgctgaaattttatttggcctaggttttactaagaaaatgcaagcacagaagacctgtgacttttctggtggctggcggatgcggatagctttggcacgagcattattcatgaatcctacaattttgctactagatgaacctactaatcatcttgatcttgaagcttgcgtgtggcttgaagaaactctgaagaaatttgatcgtattctggtggtagtgtcacattcccaagattttctcaatggggtgtgtacaaacattattcatatgcaaaatatgaagctgaaattgtatactggaaactatgatcaatatgttcaaacacgatctgagctagaggaaaatcagatgaagcaatacaggtgggaacaagagcagatatcttcaatgaaagaatatattgctaggtttggccatggttctgcaaagcttgccaggcaagcacagagcaaagaaaagaccttggcaaagatggaaagaggtgggctaacagaaaaagtagttagagataaagtactagtgttccgattcactgatgttgggaagctgccaccgccagtgcttcagtttgtggaggtggactttggctatactcctgagaacattatatacaagagtattgattttggagtggacctggattccaggatagctttggttggtccaaatggagctggaaaaagtacgttgttgaagctgatgactggtgaattgaccccattggacggcatggtaaagcgccacaatcatctccgtattgctcagtatcaccagcatctagctgataaactggatctggaagtgtctgcactgcaatacatgatgaacgaatacactggaattgaggaagaaaagatgcgtgcggcgatcggaaagtttggtctgacagggaaagcccagattatgcccatgacaaatttgtctgatgggcagagaagtcgtgtaatttttgcatggcttgcttggaggttgcctcacctccttttgcttgatgaaccgactaatcatcttgatattgaaactattgattcacttgctgaggcactgaatgagtgggatgggggacttgttttggttagccacgatttccggctcataaaccaggtggccaaggaaatttgggtgtgcgaaaataagtctgtcactagatggcaaggggatattatggactttaagcagcatttaaagagcaaggctggcctgtgagtgcatttgccttcggttgcatttgttcgacaggaagttagatttgagagacatacaaaaaatgtggttcatgttttttttgggagttaggaatgccttgctataggctttagctattctgttgtattaatcaatttaggtgttttagggtaatattagcaatcctttgcttatatcacctcgtcttaattgtttagggtctcaaaaggctaggtatgtcatcagatgtctttttgcttaagccagctgtgatatttctgtaggacctgcagcgttcaagatattcaatttcactgcactgagaatatttatatatggcttgtgtatgataagcatttggaatcgtgaaactgccttggaaaccagttcaaacgagacattatttccacgatacattatttttaactgtattcttacagtacttgaaggggagaatttttcaaggaacaaaagcagtaattttacaactttttttccttg

SEQ ID NO: 1835 - DNA, 2560 bp, Oryza sativa
gcatctagtatcttgttgttggaagaaaagccctttctctctctctcattcttgtgtttcttctcgatcgatctctcgatttctctctgtgcaccagcatcagctatggtgtccgacgccagcaagaagaaggcggcgcagaagaaggccgccgccgctgccaagaggggtgacaaggccaaggccgccattactctctccgagcgcacctgcaccgccgtcctcacctcccatcccctctcccgcgacatccacatcgagtccctctccctcacattccacggccatgacctgcttcttgacaccgacctggagctcaactacggcaggcgatatggtttgcttggcttaaacggctgtggaaagtcctgtctcctcaaagctataggatgccgggagcttcctatccctccacacatggacatctatcatctcacccatgagatcgaggcttccgacatgtctgcgctacaagctgtcatcagctgtgacgaacagagactccagctcgagaaggaggctgaaatcttggccgctcaagatgacggtggcggcgaagccctggaccgcgtttatgaacgcttagaagccatcgacgcatccaccgctgaaaagcgtgctgcagagattttgtttggcttgggttttaacaagcacatgcaggcaaagaaaacctgtgatttctctggcggttggcgcatgaggatcgctttggctagggcgctcttcatgaatccaactatccttttgcttgatgagcccaccaatcatctagatcttgaggcctgtgtctggctggaggaaaccttgaagaaatttgaccgtatacttgtcgtcatatcacactcccaggacttcctaaatggagtatgtacaaatatcatccacatgcaaaacaggaagctcaagctatacactggcaactatgaccagtatgtccaaacacgagccgagcttgaagaaaatcaaatgaaacaatacagatgggagcaggaccagattgcctcgatgaaggagtacattgcacggtttggtcacggatctgccaagctggcccgacaggctcaaagtaaagagaaaactcttgctaagatggagcgtggtgggctcacggagaaggttgtaagggataaggtattgacgttccgcttcactgatgttggcacgctaccacctccagtgctgcagtttgtggaggtcacatttgggtacacaccagacaacctgatctacaagaacctagattttggtgttgaccttgactcaagggtggcgctggttggtcctaatggggctgggaagagtacgctccttaaactcatgacaggtgatctcataccgctggacggcatggtgaggcgacacaaccatctcaggatcgcacaattccaccagcaccttgcagagaagctggacctggacatgtcagctctgcagtacatgatgaaggaatacccagggaacgaggaggagaggatgagggcagccatcggcaagtttgggttgtcagggaaggcacaggtaatgccaatgaggaacctgtcggacgggcagaggagcagagtgatatttgcatggttggcgtggagggagccacacatgctgctgctggatgagccaacgaaccatctggacattgaaacaatcgactctcttgcagaggcgctgaatgaatgggatggagggcttgtgctggtgagccatgacttcaggctgatcaaccaagtggcgcaggagatatgggtgtgcgaaaagcaggcggtgaccaggtgggaaggtgacatcatggagttcaaggagcacctgaggagcaaggccggagtggacgattgagttgagttgagttgagtagttttgatcttgctgcctggcccggagaggagataccatcactctgctagttactagtatttcttcggctgttactaaactatactgcccagcctaacggggacgacgactgcatcatcatctcttgatctctctctcttagttaagttggatgcttgtcacggatgtttgtacctgatctccatcaactacatctgatgctatagcccatatgatgtaccgtcctcttcttggggtctctggagaatgaggaaacagcaagatccagccagcatagcatgtatgtatagtgtaattagctggtttgttggcggtgcacatgcataagatatacttcctccgtttcatattataatactatctattattgcccacattcatatatatgtctagattcattagcatctatatgaatgtgggcaatgatagaaagtcttataatatgaaacggagggagtattatcttggtttgcacttgcatgatcacctgctgtagttattattatcagtgaccaagttcccctagctagcagtagcactccatgaaaagatatctacatgaaactgtaccacccccacgatattatatatgagattggattttaaactcttgaggggatgtctcatcgttgcttgtatgttaaattgagaagatgtattaacatgtgatatatcttattataagcattcaacttaaaatttaacttct

SEQ ID NO: 1836 - DNA, 2718 bp, Pinus pinaster
accaaaccatataatccaaaccctagacgcaaacgacttctgagttctgcggttaaaaaatgcgggcggatcgtgctgggatattttcgttggtgtggaaaagaaaagcggttcggtagcccaagtctgaggttcggttcacatatttcgcggacctataaatcctaccgcctgacaatttgttccgtctcttcaacatagggaaggaagcttgggaaccttttaactgtgagattgatcaggcgtcccccagcctctgcttcttatgcttcttattctcaacatccaatttttacctttcaatttcctcagcagatcatcggatcccctgctcttcagaaggtttttttcccctttttggagtagtttgttaaagaaaagaggagaagatggtgtcagacgcgagtaagaagaaggccgccgccaagaaagctgccgcagccgcaaagaggggatcgaagtccgcaacggcggcgacgtcgtcaaaggcaacgtcaacagaggtatcgcagaatggacacgccgagacggcggccgatcagctggcggatttgcagatatctgatcgaacgtgtactggggttcttacctctcatgccctctctagagacattcatatagagtccctatcagttacattccatggtcatgagttgattgtcgattcagagctcgaactgaattatggaaggcgctatggattacttgggctcaatggatgtggtaagtctacactccttactgctctgggatgtcgggagattcccataccagatcatatggatatttatcatttgaccagggaaatagaagcaactgatatgactgcacttgaggccgtgatgaactgtgacgaagagaggctaaaaatcgagaaggaagctgaagctcttgctgcacaagatgatggaggtggagaggcactagatcgattatatgagcgtctagaatccttggatgctgcaacagcagaaaagcgagcagctgaaattttatttggcttaggttttgataaaaaaatgcaagcgaaaaagacaagtgacttctctggtggttggcgtatgcgaatagctctggcacgagcgttattcatgaatcctacagttttgttactagatgaacctacaaatcatcttgatcttgaagcttgtgtatggctcgaggaaatgctgaaaaaatttgatcgcattttggttgtaatatcacattcgcaagattttctcaatggaatttgtactaacatcattcatatgcaaaataaaaagttgaaattgtatacgggaaattatgatcagtatgttcaaacaagaactgatcttgaggaaaaccagatgaagcagtacagatgggagcaggagcagatagcgtcaatgaaggaatatatagctagatttggtcatggttctgcaaaacttgctaggcaagcccaaagtaaagaaaagaccctggcaaagatggaaagaggtgggctaacggaaagagtggtcagagataaagtattagtgttccgtttcaccgatgttgggaagcttcctccacctgttctgcagttcgtggaagtagactttgggtacactcctgaaaaccttatatataagaatatagattttggagtggatctggattcaaggatagctttggttggtccaaatggagcaggaaagagcacattattaaagctaatgaccggagaattgaccccattggacggcatggtgaagcgccataaccatcttcgtattgctcagtttcaccagcatttggcagacaaactagacctgtctgtgtctgcgctccaatacatgatgaatgaatatccaggtattgaagaagagaaaatgcgagcggcaattgggaaatttggtttgacaggaaaaggtcagattatgccgatgcagaatttatctgatgggcagaggagtcgcgtgatttttgcatggcttgcttggagattaccacatcttctattgctagatgaaccaactaatcatcttgacattgaaaccattgattcactcgcagaggcactgaatgagtgggatggaggacttgttttggttagccacgatttcaggctcataaaccaagtggccaaagagatatgggtatgtgaaaataagaaagtcacgagatggggaggtgatattatggatttcaagcgacacttgaaaagcaaggctggcctgtgagtgcatttgctatcatcgtaggttaacgtgtatgccaccagaagatttttctggcgagacctagagaacgtgattaggatttaattatttttgtatttaggaatgcgccttagggcaagaaatatagtcaattcagttgtattgattaagtttgatgactttgggtaacatagtacatttatcttagctttctgtttcattggttataactcttatggtcccgcacaaaaattcattgcaaaagagggataacatttatttctcattaaatggcgctgctatattgataattgatgattgccttatttgttataaaaaaaaaaaagaaaatctcgagggggggcacggtacgcattggtataaatggttggtttggatagatagtattaacatattatactgttgggtgagaaaatagaaatattatagataagatgattaatattataagaattaatctactcagatatatgttatcatacactctacctatataaatatatattaatgagagtggtggggaggtggg

SEQ ID NO: 1837 - DNA, 2286 bp, Pinus taeda
gggaaccttttaactgtgagattgatcaggcgtccctcagcctctgcttcttatgcttcttattctcaccatctaatttttacttttcaatttcctcagcagatcatcggatcccctgctcttcagaaggttttttttcccctttttggagtagtttgttaaagaaaagaggagaagatggtgtcagacgcgagtaagaagaaggccgccgccaagaaagctgccgcagccgcaaagaggggatcgaagtccgcaacggcggcaacgtcgtcaaaggcaacgtcaacagaggtatcgcagaatggacacgccgagacggtggccgatcagctggcggatttgcagatatctgatcgaacgtgtactggggttcttacctctcatgccctctctagagacattcacatagagtccctatcagttacattccatggtcatgagttgattgttgattcagagctcgaactgaattatggaaggcgctatggattacttgggctcaatggatgtggtaagtctacactccttactgctctgggatgtcgggagattcccataccagatcatatggacatttatcatttgaccagggaaatagaagcaactgatatgactgcacttgaggctgtgatgaactgtgacgaagagaggctaaaaatagagaaggaagctgaagctctagctgcacaagatgatggaggtggagaggcactagatcgattatatgagcgtctagaatccttggatgctgcaacagcagaaaagcgagcagctgaaatattatttggcttaggttttgataaaaaaatgcaagcaaaaaagacaagtgacttctctggtggttggcgtatgcgaatagctctggcacgagcgttgttcatgaatcctacagttttgttactagatgaacctacaaatcatcttgatcttgaagcttgtgtatggctcgaggaaatgctgaaaaaatttgatcgcattttggttgtaatatcacattcgcaagattttctcaatggaatttgtactaacatcattcatatgcaaaataaaaagttgaaattgtatacgggaaattatgatcagtatgtacaaacaagaactgatcttgaggaaaaccagatgaagcagtacagatgggagcaggagcagatagcgtcaatgaaggaatatatagctagatttggtcatggttctgcaaaacttgctaggcaagcacaaagtaaagaaaagaccctggcaaagatggaaagaggtgggctaacggaaaaagtggtcagagataaagtattagtgttccgtttcaccgatgttgggaagcttcctccacctgttctgcagtttgtggaagtagactttgggtacactcctgaaaaccttatatataagaatatagattttggagtggatctggattcaaggatagctttggttggtccaaatggagcaggaaagagcacattattaaagctaatgacaggagaattgaccccattggacggcatggtgaagcgccataaccatcttcgtattgctcagtttcaccagcatttggcagacaaactagacctgtctgtgtctgcgctccaatacatgatgaatgaatatccaggtattgaagaagagaaaatgcgtgcggcaattgggaaatttggtttgacaggaaaaggtcagattatgccgatgcagaatttatctgatggacagaggagtcgcgtgatttttgcatggcttgcttggagattaccacatcttctattgctagatgaaccaactaatcatcttgacattgaaaccattgattcactcgcagaggcactgaatgagtgggatggaggacttgttttggttagccacgatttcaggctcataaaccaagtggccaaagagatatgggtatgtgaaaataagaaagtcacgagatggggaggtgatattatggatttcaagagacacttaaaaagcaaggctggcctgtgagtgcatttgctatcatcgtaggttaacgtgtatgccaccagaagattattctggcgagacctagagaacgtgattagatttaattatttttgtatttaggaatgcgccttcgggcaagaaatatagtcaattcagttgtattaattaagtttgatgactttgggtaacatagtacatttatcttagctttctgtttcattggttataactcttatggtcctgcacaaaaattcattgcaaaagagggataacatttatttctcattaaatggcactgctatattgataattgatgattgccttattgtt

SEQ ID NO: 1838 - DNA, 2278 bp, Picea glauca
gctctttgacattgcataggaagcttgggattttaacttgaagtttgatcaggtgtccctcagcctctgcttttcattcttcttattctcaccattcaattttttatccttcaatttcctcagcggatcatcgggatcccctgctcttcagaagattttttgcccttttaaggagtagtttcttaaagaaaagaggaagaaaatggtgtcagacgcgagtaagaagaaggccgccgccaagaaagctgccgcagccgtaaagaggggatcaaagtccgcaacggcggcgacctcgtcaaaggcagcgtcaacagatgtatcgcagaatggaaatgccgagagggtggccgatcagttggcggatttgcagatatctgatcgaacgtgtactggggttcttacttctcacgccctctctcgagacattcatatagagtccctatcagttacattccatggccatgagttgattgttgattcggagctcgaactgaattatggaaggcgctatggattgcttgggcttaatggatgtggtaaatctacactcctgactgctctaggatgtcgggaaattcccataccagatcatatggacatttatcatttgaccagggagatagaagcaactgatatgacttcacttgaggctgtcatgaactgtgacgaagagaggctaaaacttgagaaagaagcggaagcgctggcggcacaagacgatggaggtggagaggcactagatctattatatgaacgtctagaatccttggatgctgcaacagcagaaaagcgagctgctgaaattttatttggcttaggtttcgataaaaaaatgcaaaccaaaaagacaagtgacttctctggtggttggcgtatgcgaatagcactggcacgagcattattcatgaatcctacagttttgttactagatgaacctacaaatcatcttgatcttgaagcttgtgtatggcttgaggaaatgctgaaaaaatttgatcgcattttggttgtagtatcccactcccaagattttctcaatggaatttgtactaacattattcatatgcaaaataaaaagttgaaattgtatacgggaaattatgatcaatatgttcaaacaagaacggaccttgaagaaaaccagatgaagcagtacagatgggaacaagagcagatagcgtcaatgaaggaatatatagctaggtttggtcacggttctgcaaaacttgctaggcaagcacaaagtaaagaaaagaccctggcaaagatggaaagaggtgggctaacggaaaaagtggtcagagataaagtattagtgttccgtttcactgatgttgggaagcttcctccacctgttctgcagttcgtggaagtagactttgggtacactcctgagaaccttatatataagagtattgattttggagtggacctggattcgagaatagctttggttggtccaaatggagcaggaaaaagtacattattgaagctaatgactggagaattaaccccattggatggcatggtgaagcgccataatcatcttcgtatcgctcagtttcaccagcatttggcggacaaactagagctgtctgtctctgcactgcaatacatgatgaatgaatatcctggtattgaagaagagaagatgcgtgcggcaattggaaaatttggtttgacaggaaaagcccagattatgcccatggagaatttatccgatgggcaaagaagtcgtgtaatttttgcatggcttgcttggagattacctcatctcctattgctggatgaaccgacgaatcatcttgacattgaaaccattgattcacttgcggaggcactgaatgagtgggatggaggacttgttttggttagccatgactttaggctcataaaccaagtggccaaagagatatgggtgtgtgaaaataagagagtcacgagatggggaggtgatattatggatttcaaacgacatttaaaaagcaaggctggcctgtgagtgcttttactatcatcataggttcacctgtatgctaccagaagatttttctggcgagacataccgtatgtggttaggatttaattatttttgtatttaggaatgcgccttactgtgggcaagaaatatagtcaattcagttgtattgattaagtttgatgactttgggtaacattagtacaattatccttagctttctgtttcattggttataactctcacggtccagcacaaaatttcaatgcaaaacagtaataacatttatttctcattaaa

SEQ ID NO: 1839 - DNA, 2617 bp, Cedrus atlantica
tcgttgccgtggaaatagagaagcggttcggtagccaaggctgagttcggttcacagattggcggacctttaaaatcccaccgccttgcctaagctcttcctctttaacattatacagaaagcttgggattttaactccgatttcgatcaagcatccctcagcctctgtttctcaatcttcttattctcaccattcaattttgtaaccttcatttttctcagcagatctttgggatcgcctgctcttcagaagattttttgccctttttaaagagtagtttgctaaagacaagaggaagaagatggtatcagacgcgagtaagaagaaggccgccgccaagaaagctgctgcagctgcaaagagggggtcgaagtccgcaacggcggcgacatcgtccaaggcagcgtcaacagatgaatcccagaatggaaatgtagagaaggcggccgatcagatgggggaattgcatatatccgatcgaacgtgtactggggttcttacttctcacgccctttctcgagacattcatatagagtccctatcacttacattccatggtcatgagttgattgttgattcagagcttgaactgaattacggaaggcgctatggacttcttgggcttaatggatgtggtaaatctactctccttacttctctaggatgtcgagaaattcccataccagatcatatggacatatatcatttgaccagggagatcgaagcaactgatatgacttcactagaggctgtgataaactgtgacgaagagaggctaaaacttgagaaagaagctgaagcgctggctgcacaagatgatggaggtggagaggctttggatcgattatatgaacgtctagaagccttggatgctgcgacagcagaaaagcgagctgctgaaattttattcggcttaggttttgataaaaaatgcaggcaaaaaagacaagtgacttttctggtggttggcgtatgcgaatagcattggcacgagcattattcatgaatcctacagttttgttactggatgaacctactaatcatcttgatctcgaagcttgtgtatggctcgaggaaatgctgaaaaatttgatcgcattttggttgttgtatcacattcccaagattttctcaatggagtttgtactaacatcattcatatgcaaaataaaaagttgaaattgtatacgggaaattatgatcaatatgttcaaacaagaactgaacttgaagaaaaccagatgaagcagtacagatgggaacaagaacagataggggcaatgaaggaatatatcgcgaggtttggtcatggttctgcaaaacttgctaggcaagcacaaagtaaagaaaagaccctggcaaagatggaaaggggtgggctaacggaaaaggtagtcagagataaagtgttagtgttccgttttacagatgttgggaagcttcctccacctgttctgcagttcgtggaagtagactttgggtacactcctgacacccttatatacaagggtatagattttggagtggacctggattcaagaatagctttggttggtccaaatggagcaggaaaaagtacattgttgaagctaatgactggagaattgtccccattggatggcatggtgaagcgccataatcatcttcgtattgctcagtttcaccagcatttggcagacaaattagagttgagtgtgtctgcacttcaatacatgatgaatgaatatcctggtattgaagaagagaagatgcgtgcggcaattggaaaatttggtttgacaggaaaagcccagatcatgcccatgcagaacttatctgatgggcagagaagtcgcgtaatttttgcatggcttgcttggagattacctcatcttctattgctagatgaacctactaatcatcttgaccttgaaaccattgattcacttgcggaggcactgaatgagtgggatggaggacttgtattggtcagtcatgactttcggctcataaaccaagtggccaaagagatatgggtgtgtgaaaataagagagtcacaagatggggaggtgatattatggatttcaaacgacatttaaaaagcaaggctggcctgtgagtgcatttgctatgatcataggtacacgtgtatgccaccagaagattttctggcgagacatcggtcgtgattaggatttaattatttttgtatttaggaatgtgccttactgtgggcatttgaatatagtcaatttggttgtattgattaagtttgatgtctttgggtaactttagtacaagtgtcctagctttctgtttcattggttataactcttatggtcctccacaaaaattcaatgcaaaacagcagacacagcattagttgatgcctttcgtcatggtaactataatactcggcaagttgcagaacaggctttgaaacatctgaataaaattccgaagttctctggtgtctttaacaaaattggttaagcttattcttaatgcagtgaatgattgcgtggtaaagtgtaacgagttgtagagtagtgcaaagcaagaaaggacagcgatcaggagattatctatctgctttcattgtcaggaacagttcaaagggtatctatagcatatgg

SEQ ID NO: 1840 - DNA, 2300 bp, Arabidopsis lyrata
agaaaccaccattaaccctaatttttgccgaactcttgtcttctgctgaaaaccctagatctacagatctcccgaatctctcagggagatatttgaagatggtgtctgacgctagcaagaagaaggcagctcaaaagaaagccgccgccgccgctaaaagaggtggtaaagctgctgcttcttctaaatccgccgctacttcctccaatggagttgatagcttgtcgagcggtgtcgacgctcttcaaatttctgatcggacttgtaccggagttctctgttctcatccccaatctagggatattcgaatagaatctctgtctgtgacgtttcatggttatgaccttattgttgattcaatgttggagcttaactatggaaggcgttatggtctgcttgggttgaatggttgtggaaagtccactcttttaactgcaatcggacgcagagagataccgattccggatcatatggatatctatcatctttctcacgagattgaagctactgacatgtcctcccttgaggctgttgttagctgtgatgaagagaggttgaggttggagaaggaagttgaaattcttgttgagcaggatgctggtggcgagcgtcttgaatctatctatgagaggttagaagccatggatgctgcaaccgctgagaagcgtgctgctgaaattctgtttggacttggtttcgacaaggaaatgcaagctaagaagacgaaagatttttccggtggttggaggatgagaattgcattagcaagagctctcttcataatgccaactatccttttgcttgatgagccgacaaatcatttagatttggaagcttgtgtgtggttagaagagagcctgaagaactttgatcgcatccttgttgtggtatcacactcgcaggatttcttgaatggagtttgtacaaacatcatccacatgcagagcaagcagctcaagtactacactggtaactttgatcagtattgccagactcgttctgagctagaagagaatcagatgaaacaatacagatgggagcaggagcagatttctcacatgaaggagtacattgctaggtttggtcacggttcagccaaacttgctcgtcaagcacagagtaaggagaaaacattggcaaagatggagagaggtgggctcactgaaaaggttgccagagacagcgttctcgttttccgttttgctgatgttgggaagcttccaccgccagtgcttcagtttgtggaagtgtcttttgggtacacaccggactatctcatatacaaaaacatcgactttggtgtcgacttggactctagggtcgctctcgtgggacctaatggagctggaaagagtacacttttgaagctcatgactggtgaactgcacccaactgaaggaatggtgcgacgtcacaaccacttgaagattgctcagtaccatcagcatctggctgagaagctagacctggaattgcctgcacttctctacatgatgagggagttcccgggtaccgaagaggagaaaatgagagctgcgattggtagatttggtcttactggtaaggcccaagtaatgccgatgaagaatctatctgatggacaaaggagcagagtgatctttgcgtggttagcttataagcagcctaacatgcttctactggacgagccaactaaccatttggatatcgagacaattgactcactcgctgaggcattgaacgagtgggatggtggtctggttctggtgagtcacgacttcaggctgatcaaccaagtggcgcatgagatatgggtttgtgagaaacaatgcataactaaatggaacggtgacattatggacttcaagaggcacctcaaggctaaagccggacttgaagattgaagataaaggtcgagtcttcttctcttgatggataaaggaaaagactcagattgggtcatgccgagggagagagggaaggatatgtttttttgatggttttgggaatggtttttaacgagttctgaagccacacttgagagacagctaaaccatactcagtaatctctgcatttcttaagcattaagaggtcagagattctttctatattagtattatcatcattatcatgtctttttatttttattttgttattgttgttgaacgtttttttgaaggccaaacagagagagaaagtaatatttttggtggtatttgtaggatttttttttttgtttttaagaccgagatgttgacgattatggtatttatatttaatattaaagtgagaatcttctcataattatattcgtatattc

SEQ ID NO: 1841 - DNA, 2287 bp, Arabidopsis thaliana
agaaaccaccattaaccctaatttttgccgaactcgtcttctgctgaaaaccctagatctacagatctcccgaatctcccagggagataatttgaagatggtgtctgacgctagcaagaagaaggcagctcagaagaaagctgctgccgccgctaaaagaggtggtaaagctgctgctccatccaaatccgccgctacttcttccaacggtgttgatagcttgtcaagcggtgtcgatgctcttcaaatttctgatcggacttgtaccggagttctctgttctcatcctcaatctagagatatccgaatagaatctctgtctgtgacgtttcatggttatgaccttattgttgattcaatgttggagcttaactatggaaggcgttatggtctccttgggttgaatggttgtggaaagtccactcttttaactgcaatcggacgcagagagataccgattccggatcaaatggatatctaccatttgtctcacgagattgaagctactgacatgtcttccctggaggctgttgttagctgtgatgaggagaggttgaggttagagaaagaagttgaaattcttgtacagcaggatgatggaggcggagagcgtcttcaatctatctatgagaggttagacgccatggatgcagaaaccgctgagaaacgtgctgctgaaattctgtttggacttggtttcgacaaggaaatgcaggcgaagaagacaaaagatttctctggtggttggaggatgagaattgcattggcaagagcactcttcattatgccgacaatccttttgcttgatgagccgactaatcatttagatttggaagcttgtgtgtggctagaagagagcctgaagaattttgatcgcatccttgttgtggtatcccactcacaggatttcttgaatggagtgtgtacaaacatcatccacatgcagagcaaacagctcaagtactacactggtaactttgatcagtattgccagactcgttctgaacttgaagagaaccagatgaaacaatacagatgggagcaggagcagatttctcacatgaaggagtacattgctcggtttggtcacggttcagccaaacttgctcgtcaagcacagagtaaggagaaaacattggcaaagatggagagaggtgggctcactgaaaaggttgctagagacagtgttctcgttttccgttttgctgatgttgggaagcttccaccgccagtgcttcagtttgttgaagtgtcttttggttacacaccggactatcttatttacaagaacattgactttggtgtcgacttggactcgagggttgcccttgtgggacctaatggagctggaaagagtacacttttgaagctcatgactggtgaattgcacccaactgaaggaatggtgcgacgtcacaaccacttgaagattgctcagtaccatcagcatctggctgagaagctagacttggaattgcctgcacttctctacatgatgagggagttcccgggtactgaagaggagaaaatgagagctgcgattggtaggtttggtctaactggtaaggctcaagtgatgccaatgaagaatctatctgacggacaaaggagcagagtgatctttgcgtggttagcttataagcagcctaacatgcttcttcttgatgagcctactaaccatttggatatcgagacaatcgactcgcttgctgaggcattgaatgagtgggatggtggtttggttctggttagtcacgacttcaggttgatcaaccaagtggctcatgagatatgggtttgcgagaaacaatgcatcactaaatggaatggtgacattatggacttcaagaggcaccttaaggctaaagccggacttgaagattgaagatagagagtcgagtcttcttctcttgatggaaaatggaaaagactcagattggggtcacatgctaagagagagagagggaaggctttggtttttttgatgggtttgggaatggtttttaacgagttctaaagccacacacttgagagacagagaaaccatactcactaatctctgcatttccttaagaggtcagagattctttctatattagtattatcattatcatgtgcaccttctttttttttcgttattgttgttgaacgtttttttgaaggcgaaacagagagaaaagtaatattttttggtggtattgtaggattttttttttctgtttttttaaagactgagatgttgacgattatggtattatatttaatattaaagtgggaatattctcat

SEQ ID NO: 1842 - DNA, 3576 bp, Pennisetum glaucum
cggcgtcctcgtcctcgtcttcttcctccgcggccgcggccgccgcggagaaggcggcgaacggcgtcgcggcgctgaagctctccgaccgtacctgtaccggggtcctcgcgtcccatccgctctcccgcgatatccacatagagtctctttcattaacattccatgggcatgaccttatcgtggattctgagttggagctcaactatgggaggcgatacgggttgcttggcttgaatggctgtggaaaatctactcttctcacagcaataggctgcagagaacttcctatccctgaacacatggacatataccatctcagccatgagattgaggcttcagatatgtctgcactacaagctgttgttagctgtgacgaagaaagagtcaagttggaaaaagaagctgaaattttggctgcacaggatgatggtggtggtgaagcattggatcgtatctatgagcgtctagaatcaatggatgccgcaactgcagaaaagcgggctgctgaaatattatttggtttggggtttactaaacagatgcaggcaaagaaaactaaagatttctctggtggttggcgtatgagaattgctttggcaagggcactgtttatgaatccaacaatccttttgcttgatgagcccacaaaccatcttgatcttgaggcatgtgtctggttggaagagatgctaaagaagtttgaccggatacttgttgtcgtatcacactctcaagattttctgaatggagtgtgcacaaacatcatccatatgcaaaacaagacgctcaagttatacactggtaattatgatcaatatgtccaaacccgctcagagcttgaagagaaccaaatgaagcagtacaggtgggagcaggaacagattgcgtcaatgaaggagtacattgcccgctttggtcatggttctgcgaagcttgcacgtcaggcacagagcaaagagaaaactcttgcaaagatggagcgtggtggtctcactgagaaggttgttagggacaaagtacttgtgttccgctttacagatgttgggaagcttccgccaccagtgctgcagtttgttgaagtcaagtttggatatacacctgacaacctcatatacaagtgtcttgattttggtgttgatcttgactctagaattgcattggttggtcccaatggggcagggaagagcactcttctgaagctcatgactggtgatctagttccactagatggcatggtgaggcgccacaatcatctccgcattgcgcagtaccatcagcatctggcagagaagctggacatggacatgtcggccctggcttacatgatgaaggaataccctgggactgaagaagagaagatgagatctgcagtcggcaggtttggcctgtcagggaaggcgcaggtgatgccgatgaagaatctctcagacggccagaggagccgtgtcatctttgcatggctggcctacaggcagccacagatgctgctgcttgatgagcctactaaccatcttgatattgagaccatcgactcacttgcagaggcactgaacgagtgggatggtggtttggtcctggtgagccatgacttcaggctgatcaaccaggttgctaaagagatctgggtgtgtgagaacctggcagtgactaggtgggaaggtgatatcatggatttcaaggcacacttgaagagcaaggctggtctatccgattagaaagccttttatttttctcttcggagaattatagtcaaccatgagctttttaactctgtatcacgagtcccagttttccagtagcaaattactgtccagtagcaagttatcagagtttatgttattgtatcggattccttgtgactttcatcagatcatgagtattttatagtacctcaaaatgcaaaaagggtgcaaactggcacttgatcgattactgtttattcgtcaaaatagcgtatataataacttcagaaaaatggggctcttgccacagcagctcgagcaataatgtacaaagacatgcagctggagtggacaatttgccactgcctctcaatagattgagctgctgccatggcgctaattcacgacacagttggcgatctcagtgatgggagaggagctaagtaagcgaaggattaaaaagaaaatgggaatcagagtatgtatacacggtgtagaaaaattgtttcctggcctcagttttgggtcttctccaccttggccttgatcttctgctcaatgatcgccttctcggtatcgaggctgaacatccggttgagggcgtgcatgttctcaagcgtctcatccaaggtgcggctgtcactgccatcacacctcaggtgctgcagcgggccgtggaggagcttgttcacgatcccagtgctcagctcctcgatggctctccgcatcttcttgttaagattgtcttccccgatcttctgaaggcacttctcgagctctgaggcccggatcctgtcagcatatgacctcaacttcttgatggtcggcaccgtctccagtgagtccctccatgcctcaaaccgtttcagttcttgggtgatgattgtctgtgcttccattgcttttctgagacggtcctccttgttggcttccactacctctttcaagtcatcaacattgtatactcgtgcagaaccaacttcagacacacatgcactgacatttcttgggacagatatgtcgacaaacagacggacaccacccatagtatcagaaatatgggggagtgcctctgcgtgttcctttgtgaacaatggggtttcagatgcagtgctcgtgaacagtacatcagcttcagcagcagcttcatacatctctgagagaggcctgtacacaatttcaatatctttcatctcctcacgaatggcatccaccctttcaaccgagcggttcaccacaacaaccttcttgcatcctttggcaatgagatgcttgatcactaatttgcccatcttaccagcaccaatcagcagcattctagctgacagggcttcagtctttggaagcttcatcagggccaattcaactgcagctgaactgactgaaaccgcaccagatgatatgttggtctcgcatcggacacgcttaccagctgtgattgcgtccttgaacatcctgtcaatgttctttcccaggcctccactgttctgcccgctccttacaacttgcttaacttgagcaaggatttgtccttctccaaggaccaaagagtcaagcccagctgatacctcaaacagatggcgtgtagcatcactgtcacgcaacatgaacaggtgctccctgagctcagaagcaggaatgccgcttttctttgacatccagtctactacttctctgataccacggttccacgacagagccacgacataaatttccattctattacaggtactaagaacagcagcctcttcaatatggtttagattagtgagttcttgaatagcacggggccatagttcctctgcaaccgcaagtttttcacgcatttccactggggcagtgtgtacactgaggcctatcacagctatgctactcctttccttcatgtacc

SEQ ID NO: 1843 - DNA, 4557 bp, Pseudotsuga menziesii
aaattcatacacttataattacaaatacagcaaatacacttataattacaaaataacatgacaatttagcaaagcaaactatttaataaaatcgtaaacctgaatgcatgaacatgacaattacaaaataacatgacaatgtagcaaagcaaaccattaataaaatctaaatatgcaagcaaaccccagcactatacattcctgaaagtcaacttgaatgcagaatgaattcacatggtagagccagagcatagactatgaagtactcaatctatttattgacactactaggtaatttctactcaacaaactaaagttacataactatctatgcaactataaccaggcgttctcaagcaccaaattgatgacccttaagcatatcatatttaatgagccacctttatcatcattaggcttcagccctgtaacaaacatctccatcacagataactcctgcgggcttgcagttcttatccgtcgcagcatctgtgtcctggtttcccagatcctgttgttccttcaatgcacaagtcagatgaagattgtagtcacaatctgagcaataataggaccatgcagtgccactttcgttacatccatcacagacatatacacgcctctgtgccaatacaagcgggtgttcatgctgactgtacctcacctccttcggtgatttctccaccatctcttcaatttccttctccagcctttcaagatgagcatcagtgaagggataagccttggctccatgggtggacactgcacttctggcattatctgtcacagttttgccatctggaccaaccacaatcaaggatgggatgcctcttacacggaaaagtcgtgagaggtccttcttagttttatctccaaaaggaagagccagccatggcatgctgttgtagtattcttcaaaagcctcttgatctcggtcactagatatgaaaacaatctcaaacgcttctcccctttctttgagttcgttgtatacctgtacaagctttggagtgaaacctcggcaagggggacaccaatgggcagagaaatacaaagcaactgtcttgcccacaagctcagataccgggacctgggtacctccatgcttgagcacaaaattgcggtcatcagaaaccaaaagtgactcgagggtttgtgcttctcgtttggctttctcttcagcttcaagctcttccagccgctcttttgaaaatgggtaagcgctgattccatgttctcgtataaggcctactgcatcagtctgtaccgttttcccgtctggacctaaaataatcaaagttgggataccctcaactcggaagtagcgagacaagttcttttcagtgtggtctgcaaacggtaaagccagccaaggcatgctagcataatactcttcaaagtctttctcctctgtgtcacccgagagaaacacaatctcaaaggcctcccctttcttcagaagctcattgtaaatctctacaagctgtggagtaaaatttctacagggaccacaccagtgggctgagaaatacagacccactgtcttccccaaaagctccgctactggaacctttctacctccatggcctatgacaaaatctcgttcatcggacaccagaagagactgtacagtctgtgcagcccttaaggcctcttctttggcccttagctcatcaagtctctcagcagtgaacggatatccctcaataccatattcttcaatgatctccacaccttcggtggttataactctgccctctttgtccagaagaacaaggcacggaatgccttcaacatgaaaaacctcatcaagcttcttccttgtgttttcatctgaaaacggcagggccagccatggcatggtgtggtggtattcctcaaatgacttctcatcacgatctgcagaaatgaagacgatctcgaagtcccccttctccaataacgatttatagatttcggacaaaacgggggtgaaatacctgcatggagggcaccaatgggcagaaaagtacagacccacatatttcccttgcagttcttcaactttcaccttgtctccattgtttctggtcaagaaatcacgttcctcattacagagcaaagaggtcaaactctcgtaggtttcacccacatgggtgactgccttctcctggtcatttacctcggccatagtaatgctaaccaacaacgactcgttatgttttattcttcgacttcaaagcactgcagactctcctcttttacattgcaaaggaagctagggattttaactctaagcttgatcgggcgttctgagcctctgcttcttattctcacattcaattttttattcttcaatttcctctgcagatctacggatcccctgctcttcagaagatttttttctcttttaagagtggtttcttaaagaaaagaggaagaagatggtatcagacgcgagtaagaagaaggccgccgccaagaaagctgccgcagccgcaaagaggggatcgaagtctgcagcggcggcaacatcgtctaaagcagcgtcaacagaggcatcgcagaatggaaatgccgataaggccgccgatcagctggcggaattgcagatatctgatcgaacgtgtactggggttcttacttctcacgccctctcacgagatattcatatagagtccctctcagttacattccatggtcatgagttgattgttgattctgagctcgaactgaattatggaaggcgctatggtttgcttgggcttaatggatgtggtaaatctacacttcttactgctctaggatgtcgggaaattcccataccagatcatatggacatatatcatttgaccagggagatagaagcaactgatatgacttcacttgaagctgtgatgaactgtgacgaagagaggctaaaacttgagaaagaagctgaagcgctggctgcacaagatgatggaggtggagaggcactagatcgattatatgaacgtctagaatccttggatgctgcaacagcagaaaagcgagctgctgaaattttatttggtttaggtttgataaaaaaaggcaatccaaaaagacgagtgacttctctggtggttggcgtatgcgaatagcactggcgcgagcattattcatgaatcctacagttctgttactggatgaacctacaaatcatcttgatcttgaagcttgcgtatggctcgaggaaatgctgaaaaattttgatcgtattttggttgtagtatcacattcccaagattttctcaatgggatttgtactaacatcattcatatgcaaaataaaaagttgaaattgtatacgggaaactatgatcagtatgttcaaacaagaactgatcttgaggaaaaccagatgaagcagtacagatgggaacaagagcagatatcgtcaatgaaggaatatatagctaggtttggtcatggttctgcaaaacttgctaggcaagcacaaagtaaagaaaagaccctggcaaagatggaaagaggagggctaacggaaagagtggtcagagataaagtgttagtgttccgtttcactgatgttgggaagcttcctccacccgttctgcagttcgtggaagtagactttgggtacactcctgacaacctcatatataagagtatagattttggggtggacctggattcaagaatagctttggttggtccaaatggagcaggaaaaagtacattattgaagctaatgactggagatttgtccccattggatggcatggtgaagcgccataatcatcttcgtattgctcagtttcatcagcatctggcggacaaactagagctgagtgtgtctgcactgcaatacatgatgaatgaatatcctggtattgaagaagagaagatgcgtgcggcaattgggaaatttggtttgacgggaaaagcacagattatgcctatgcagaatttatcggatgggcagagaagtcgcgtaatttttgcgtggcttgcttggagactacctcatcttctattgctagatgaaccgactaatcatcttgacattgaaaccattgattcacttgcggaggcactgaatgagtgggatggaggacttgttttggttagccatgactttcggctcataaaccaagtggccaaagagatatgggtgtgtgaaaataagagagtcacgagatggggaggtgatattatggatttcaaacgacatttaaaaagcaaggctggcctgtgagtgcatttgccattatcataggtcacacgtgtatgccaccagaatatttttctggcgagccatactggacgtgatttggatttaattatttttgtatttaggaatgtgcctgtgggcatgaaatatagtcaatttagttgtattgattatgtttgactttggtagcagtagtaccattatcctagctttctgtttcattggctataactcttatggccctgcgcaaaaattcaatgcaaaacaggaataacatttatttctcattaaattgccgctatattgataattgatgattgcgttaattgttatatttttgtggttaatttgccacgtct

SEQ ID NO: 1844 - DNA, 2326 bp, Pinus taeda
ctctttaacataggaaaggaagcttgggaaccttttaactgtgagattgatcaggcgtccctcagcctctgcttcttatgcttcttattctcaccatctaatttttacttttcaatttcctcagcagatcatcggatcccctgctcttcagaaggttttttttcccctttttggagtagtttgttaaagaaaagaggagaagatggtgtcagacgcgagtaagaagaaggccgccgccaagaaagctgccgcagccgcaaagaggggatcgaagtccgcaacggcggcaacgtcgtcaaaggcaacgtcaacagaggtatcgcagaatggacacgccgagacggtggccgatcagctggcggatttgcagatatctgatcgaacgtgtactggggttcttacctctcatgccctctctagagacattcacatagagtccctatcagttacattccatggtcatgagttgattgttgattcagagctcgaactgaattatggaaggcgctatggattacttgggctcaatggatgtggtaagtctacactccttactgctctgggatgtcgggagattcccataccagatcatatggacatttatcatttgaccagggaaatagaagcaactgatatgactgcacttgaggctgtgatgaactgtgacgaagagaggctaaaaatagagaaggaagctgaagctctagctgcacaagatgatggaggtggagaggcactagatcgattatatgagcgtctagaatccttggatgctgcaacagcagaaaagcgagcagctgaaatattatttggcttaggttttgataaaaaaatgcaagcaaaaaagacaagtgacttctctggtggttggcgtatgcgaatagctctggcacgagcgttgttcatgaatcctacagttttgttactagatgaacctacaaatcatcttgatcttgaagcttgtgtatggctcgaggaaatgctgaaaaaatttgatcgcattttggttgtaatatcacattcgcaagattttctcaatggaatttgtactaacatcattcatatgcaaaataaaaagttgaaattgtatacgggaaattatgatcagtatgtacaaacaagaactgatcttgaggaaaaccagatgaagcagtacagatgggagcaggagcagatagcgtcaatgaaggaatatatagctagatttggtcatggttctgcaaaacttgctaggcaagcacaaagtaaagaaaagaccctggcaaagatggaaagaggtgggctaacggaaaaagtggtcagagataaagtattagtgttccgtttcaccgatgttgggaagcttcctccacggaagtagactttgggtacactcctgaaaaccttatatataagaatatagattttggagtggatctggattcaaggatagctttggttggtccaaatggagcaggaaagagcacattattaaagctaatgacaggagaattgaccccattggacggcatggtgaagcgccataaccatcttcgtattgctcagtttcaccagcatttggcagacaaactagacctgtctgtgtctgcgctccaatacatgatgaatgaatatccaggtattgaagaagagaaaatgcgtgcggcaattgggaaatttggtttgacaggaaaaggtcagattatgccgatgcagaatttatctgatggacagaggagtcgcgtgatttttgcatggcttgcttggagattaccacatcttctattgctagatgaaccaactaatcatcttgacattgaaaccattgattcactcgcagaggcactgaatgagtgggatggaggacttgttttggttagccacgatttcaggctcataaaccaagtggccaaagagatatgggtatgtgaaaataagaaagtcacgagatggggaggtgatattatggatttcaagagacacttaaaaagcaaggctggcctgtgagtgcatttgctatcatcgtaggttaacgtgtatgccaccagaagattattctggcgagacctagagaacgtgattagatttaattatttttgtatttaggaatgcgccttcgggcaagaaatatagtcaattcagttgtattaattaagtttgatgactttgggtaacatagtacattgctttctgtttcattggttataactcttatggtcctgcacaaaaattcattgcaaaagagggataacatttatttctcattaaatggcactgctatattgataattgatgattgccttatttgttatattttaatcttaaatatttttgaagttgatttggc

SEQ ID NO: 1845 - DNA, 2197 bp, Triticum aestivum
cacctcgcctcgccggccggcgccgtctgccatcacccaccacaccacaccacaccacaccacacatagctcggagaggagaggagatggtgtcggacgccagcaagaagaaggcggcgcagaagaaggccgccgcagccgcaaagaggggcgccaaggtgcccacctcctccgcatcatcttccgcctctaacaacaagacgacggataagggggccctcgccgccgttcagctgtccgaccgcacctgcaccgccgtcctcacctcccacccgctctcacgcgacatacacatagagtctctcactttaacattccacggccacgatctacttgtagacactgagctggagctcaactacggcaggcgctatggtttgcttggtctgaatggctgcggcaagtcctgccttctcaaagcaatagggtgcagggagcttcctatccctgaccacatggatatataccacctcagccatgagatcgaggcttcagacatgtctgcgcttggagccgtcattagctgtgatgaagaaagggtcaagctggaaaaggaagctgaagttttggctgctcaagatgatggcggtggtgcagctttggagcgcgtatatgagcggttagaagcaattgatgcatccaccgctgaaaagcgtgctgctgagattttgtttggcttaggctttaacaagcagatgcaggccaagaaaaccaggacttctctggcggttggcgcatgagaattgctttggcaagagctctcttcatgaatccaaccatccttttgctcgatgagcctaccaaccatcttgcatcttgaggcatgcgtgtggctggaagaaacactgaagaagtttgaccgtatacttgatgtgatatcacactcccaagacttcctgaatggagtatgtaccaacatcatccacatgcagaacaggaagctgaagctgtacactgggaatttcgaccagtatgtccagacccgatctgagctggaggagaaccagatgaagcagtacaggtgggagcaggaccagattgcgtcgatgaaggagtacatcgcgcgctttgggcacgggtccgccaagctggcacggcaggcccagagcaaggagaagacgctggccaagatggagcgcggcgggctgacggagaaggtggcgagggacaggatcctgacgttccggttcgccaatgtgggcaagctcccgccgccggtgctgcagtttgtggaggtgacgttcgggtacacgccggacaacctgatctacaagaagctggactttggcgtggaccttgactcgcgggtggcgctggtgggtcccaacggggcggggaagagcacgctgctgaagctgatgacgggggagctggtgccgctggacgggatggtgcggcggcacaaccacctgcggatcgcgcagttccaccagcacctggcggagaagctggacctggacctgtctgcgctgcagtacatgctgaacgagtacccgggtaacgaggaggagcggatgcgggcggcgatcggcaggttcgggctgtcggggaaggcgcaggtgatgccgatgcgcaacctgtcggacgggcagcggagccgggtgatcttcgcgtggctggcgtggcgcgagccgcagatgctgctgctggacgagccgacgaaccacctggacatcgagacgatcgactcgctggcggaggcgttgaacgagtgggacgggggcctggtgctggtgagccatgacttcaggctgatcaaccaggtggcgcaggagatctgggtgtgcgagaagcaggcggtgacgcggtgggagggggacatcatggagttcaaggagcacctgaagagcaagtcgggcggcatgtcggacgactgagcctatctatctatctatctatctatatctatctatctatgtgtcaatgtgtagaagatgtttgcattctgctgctgctgctgggtgagatgttctctagggtctactgtagttagtatttgatgaagagttgttatgatgaagatgaagttatccatgcatgcatgcatgcatatgacgggtgatgcctaaactcctcatgtttgtgcggcggcaaaggcaccaaacagatgcgtgtaagcaaggctactacagtactatttactatcaaagttgttgcttgtcacctaaactaaactctgtttttattaagttattct

SEQ ID NO: 1846 - DNA, 1974 bp, Zostera marina
gtagactgtgatggtgtcggatgcaagcaagaagaaggccgcacagaagaaggcagcagcggctgcgaagagaggaggaaagtctaaggcggcggtgtagcttcttcaaaagcgaatacttctagtttgacaaatcagattgagttgttgcagatttcggatcggacttgcactgggattcttggttcgcatcccctttctagagacatacatattgaatctttgtcggttacttttcatggccatgatctcatagtagattctgagttagagcttaattatgggaggcgatatggtctgcttggtctgaatgggtgtggtaaatcaacattattgactgctctagggtgcagagaactcccaattcctgatcatatggatatttaccacctcacgcgagagattgaagcttcgaacatgacttcacttgaagctgtcattaattgtgatgaggagaggctaaaattggagggggaggctgagttgttggcagcacaggatgatgggggtggtgaagccctggagaggatttatgagcgtctcgatgcattagatgcatccacagctgagaaacgtgctgctgaaattctgtttggacttggttttgataagaaaatgcaagagaaaaagactaatgatttttctggtggatggagaatgagaatagctctagctcgagctctttttatgaatccaaccatcttgttgcttgatgagcccactaatcatctcgatctagaagcttgtgtttggctggaagagacattgaaaaatttcgatcgcatcttggtggtggtgtctcattctcaggattttttgaatggtgtttgtaccaacataattcacatgcagagcaagaagcttaagttctacggtggtaattatgaccagtatgtgcagacaagaactgaacaagaagagaaccagatgaaacaatacagatgggagcaggatcagatttctgcaatgaaagagtatattgcacggttcggacatggttctgctaagctggcacgtcaagctcaaagtaaagaaaaacattagccaaaatggaaagaggagggcttacagaaagagtgactagagacaaagtgttagtgtttcgattcgttgatgttggtaatcttcctcctcctgtgctgcaatttgtacaagttacctttggatacacccctgacaaccttatctataacaagattgattttggagtggaccttgattctaggatagcattggttggtccgaatggagctggtaagagtacactccttaaactaatgacgggcgatctcacccctctggacggtatggttagacgtcacaatcgtctacaaatcgcacaatttcaccagcatctggctgagaagcttgacatggacatgtcagcactccagtatatgatgtcggagtacaaaggaattgatgaagagaaaatgagatctgtggtgggtcggtttgggttaaccggtaaagcacagataatgccaatgaaaaacctctcagacggccagaggagccgtgttatttttgcctggcttgcttatagagaaccacacatgcttctactagatgaaccgactaatcatctggacatcgaaacaatagactccctggccaatgcactcaaagagtggaatggtggtctggttttggtcactcatgattttagactcatcaatcaggttgctgaggaaatatgggtgtgtgagaaccaagctgtaacgcgttggaatggtgatattatggggttcaaggaacatttgaaagacaagactggtttataagtcataccaatttacatgatcatctatcattatatatttttatcatctcaaatcatagacttatgcttctctcatgtaatcttattatattatgtaattttgacaccgtgtgttgtttgtgcatatatcgagtctataattgaacaatcaaagtgggttagtactaattgaaaaataacattacttgtgg

SEQ ID NO: 1847 - DNA, 2167 bp, Brassica napus
cacttctctcattaaccctaaagcatctgcgaaactcgatctacagcagatctctctctcccagctcctcccaatctccaacagggagattcgaagatggtgtccgacgctagcaagaagaaggctctccagaagaaagccgccgccgccgccaaaagaggcggtaaagccgccgccgccgccgccgcttcgaaatccgccgccacttcctcaaacggagttgacgccttgtcgagcggcgtcgatgctatccatatatcggaccggacctgtaccggaatcctctgctctcatccacagtccagagatattcgtattgaatctttgtctgttacgtttcatggttacgacctgattgttgattcgatgctggagcttaactacgggagacgctacggtctcctcgggctgaacggatgtgggaagtctactcttttaacttcgattggactcagggagctcccgattcctgatcacatggatatctaccatctctcccacgagattgaggccactgacatgacttcccttgaggctgtgatgagctgtgacgaggagaggttgaagttggagaaggagattgagactcttgttgaacaggatgatggaggcggagagaggcttgacactatctatgagaggttggaagctatggatgcttctacagcggagaagcgtgctgctgagattctgtttgggcttggtttcgataaggagatgcaggctaagaagactaaggatttttctggtgggtggaggatgagaattgcgttggcgagagctctcttcattatgccgactatccttttgcttgatgagcccactaatcatttagatttggaagcttgtgtctggttagaagagagcctgaagaactttgaccgtatccttgtggtggtatcccattcacaggattttttgaacggagtgtgtaccaacatcatccacatgcagagcaagcagctcaagtactacactggtaacttcgaccagtactgccagacccgttccgagcttgaagagaatcagatgaaacagtacaggtgggagcaggagcagatctcccacatgaaggagtacattgctcggttcggtcacggttcagccaaactagctcgccaagcacagagtaaggagaagactttggctaaaatggagaggggtgggctcacggagaaggtggcaagagacagtgttctcgttttccgttttgctgacgtcgggaagcttccaccgccagtgcttcagtttgtggaggtctcttttgggtacactccggactaccttatatacaagaacatcgactttggtgttgacttggactcgagggtggccctgttggtcccaatggagctgggaagagtactcttttgaagctcatgactggtgagctgcacccgactgaaggaatggttaggcgtcacaaccacttgaagattgctcagtaccatcagcatctagctgagaagctagacctggaagtccctgcactcatctacatgatgaacgagtttcccggcaacgaagaggagaagatgagagctgctattggcaggtttggtctaaccggtaaggcacaagtgatgccgatgaagaatctatctgatggacagaggagccgtgtgatattcgcgtggttggcttacaagcagcctaacatgcttctgttggatgagccgactaatcatttggacattgagacaattgactctcttgccgaggcgttgaacgagtgggatggtggtctggttctggtgagtcatgacttcaggttgattaaccaagtggctcatgagatatgggtgtgtgagaagcagtgcatcactaaatggaatggtgacattatggacttcaagaagcatctcaaggctaaagctgggattgaagattgaagataaagtcaagtcagaggacttgattgggtcagggctagagagtgagggggattttgtttggtgatggttttgggaatgacaccacactcgtgatctctgcacttcttgctcattaagaggtcagtgattcttctatattagtattattattatcatcaatctgcacttttattttattgtttttggcctttttgaaggagacacagagatgtattttttttataattattaaaagactgaaatgttgaagattatggtactatttaatatta

SEQ ID NO: 1848 - DNA, 2096 bp, Brassica napus
aagcatctgcgaaactcgatctacagcagatctctctctccagctcctccccaatctccaacaggggagattcgatcgaagatggtgtccgacgctagcaagaagaaggctctccagaagaaagccgccgccgccgcaaaaagaggcggtaaagccgccgccgccgccgcttctaagtccgccgccacttcctcaaacggagttgacaccttgtcgagcggcgtcgatgctatccagatatcggaccggacctgtaccggaatcctctgctctcatccacagtccagagatattcgtattgaatctttgtctgttacgtttcatggttacgacctgattgttgattcgatgctggagcttaactatgggagacgctacggtctcctcgggctgaacggttgtgggaagtctactcttttaacttcgattgggctcagggagctcccgattcccgatcacatggacatctaccatctctcccacgagattgaggccactgacatgacctcgcttgaggctgtgatgagctgtgacgaggagaggttgaagctggagaaggaaattgagactcttgttgaacaggatgatggaggcggagagaggcttgacaccatctatgagaggttggaagctatggatgctgcaaccgcggagaagcgtgctgctgagattctgtttggtcttggtttcgacaaggagatgcaggctaagaagactaaggatttttctggtgggtggaggatgagaattgcgttggcgagagctctcttcattatgcctactatccttttgcttgatgagccgactaatcatttagatttggaagcttgtgtctggttagaggagagcctgaagaactttgaacgtatccttgtggtggtatcccactcacaggattttttgaacggagtctgcacaaacatcatccacatgcaaagcaagcagctcaagtactacactggtaacttcgaccagtactgccagacccgttccgagctagaagagaaccagatgaaacagtaccgatgggagcaggagcagatctcccacatgaaggagtacattgctcggttcggtcacggttcagccaaactagctcgccaagcacagagtaaggagaagactttggcaaaaatggagaggggtgggctcacggagaaggtggcaagagacagtgttctcgttttccgttttgctgacgtcgggaagcttccaccgccagtgcttcagtttgtggaggtctcttttgggtacactccggactaccttatatacaagaacatcgactttggtgttgacttggactcgagggtggcccttgttggtcccaatggagctgggaagagtactcttttgaagctcatgactggtgagctgcacccgactgaaggaatggtgaggcgtcacaaccacttgaagattgctcagtaccatcagcatctagctgagaagctagacctggaagtccctgcactcatctacatgatgaacgagtttcctggtaatgaagaggagaagatgagagctgctattggtaggtttggtctaaccggaaaggcacaagtgatgccgatgaagaatctgtctgatggacagaggagccgtgtgatattcgcgtggttggcttacaagcagcctaacatgcttctgttggatgagcctactaatcatttggacattgagacaattgactctcttgccgaggcgttgaacgagtgggatggtggtctggttctggtgagtcacgacttcaggttgattaaccaagtggctcatgagatatgggtgtgtgagaagcagtgcatcactaaatggaatggtgacattatggacttcaagaagcatctcaaggctaaagctgggattgaagattgaagataaaaagtcaagtcagaggacttgattgggtcagggctagagagtgagaggggttttgtttggtgatggttattaacgacaccacactcgtgatctctgcacttcttgctcattaagaggtcagtgattcttctatattagtattattatcatcaatctgcacttttatttttattgtttttgacttttttgaaggagaaacagagatgtattttttt

SEQ ID NO: 1849 - DNA, 2233 bp, Abies balsamea
cttactaggaagcttgggattttaattgttgagttttatcaggcgttcataagcttccgcttctcgttcttcttattctcaccattcaattatttacccttcaatttcctcagtagatcttcgggatctcctgctcttcagaagtttttttgcgcttttaaggagtagtttgctaaagaaaagaggaaaagatggtatctgacgcgagtaagaagaaggccgccgccaagaaagctgccgcagccgtaaagaggggatcgaagtctgcaacggcggcgacatcgtccaaggcagtgtcaacagatgcatcacagaatggaaatgctgagaggctagccgatcagatggcggaattgcagatatccgatcgaacgtgcactggggttcttacttctcacgccctctctcgagacattcatattgagtccctatcacttacattccatggtcatgagttgattgttgattcagagctcgaactgaattatggaaggcgttatggactgcttggtcttaatggatgtggtaaatctacactccttacttctcttggatgtcgagaaattcctataccagatcatatggacatatatcatttgaccagggagatagaagcaactgatatgacttcacttgaggctgtgataaactgtgacgaagagaggctaaaacttgagaaagaagctgaagcgctggctgcacaagatgatggaggtggagaggcactagatcgattatatgaacgtctagaagccttggatgctgcaacagcagaaaagcgtgccgctgaaattttgtacggtttaggttttgataagaaaatgcaagcaaaaaagacaagtgacttttctggtggctggcgtatgcgaatagcattggcacgagcattattcatgaatcctacagttttgctactagatgaacctacaaatcatcttgatcttgaagcttgtgtatggctcgaggaaatgctgaaaaactttgatcggattttggttgttgtatcacattcccaagattttctcaatggaatttgtactaacatcattcatatgcaaaataaaacgttgaaattgtattcgggaaattatgatcaatatgttcaaacaaggactgagcttgaagaaaaccaaatgaagcagtacagatgggaacaagagcagatatcagcaatgaaggaatatatagctaggtttggtcatggttctgcaaaacttgctaggcaagcacaaagtaaagaaaagaccctggcaaagatggaaagaggtgggctaacggaaaaagtagtcagggataaagtgctagtgttccgtttcactgatgttgggaagcttcctccacctgttcttcagttcgtggaagtggactttgggtacactcccgacaaccttatatacaagggtatagattttggagtggacctggattcaagaatagccttggttggtccgaatggagcaggaaaaagtacattattgaagcttatgactggagaattgagcccattggatggcatggtgaagcgccataatcatcttcgtattgctcagtttcaccagcatttggcagacaaattagagctgagtgtgtctgcactgcaatacatgatgaatgaatatcctggtattgatgaagagaggatgcgtgcggcaattggaaaatttggtttgacaggaaaagcccagattatgtccatgcagaacttatctgatgggcaaagaagtcgtgtgatttttgcatggcttgcttggagattacctcatcttctattgctagatgaacctactaatcatcttgaccttgaaaccattgattcacttgcggaggcactgaatgagtgggatggaggacttgttttggtgagccatgactttcggctcataaaccaagtcgccaaagagatatgggtgtgtgaaaataagacagtcactagatggggaggtgatattatggatttcaaacgacatttaaagagcaaggctggcttgtgagtgcatttgctatgatcatacacgtgtatgccaccggcatatttttctggcgagacataccagacgtgattaggatttaattatttttgtatttaggaatgcgccttaccgtgggcaacaaatatagtaaaatttagttgtattgattaaggttgacgatttcagtaacattagcacaactatcctactttctgtttcattggttataactcttattgtcctgcacaaaaatttaatataaa

SEQ ID NO: 1850 - DNA, 2147 bp, Brassica napus
cttctctcattaaccctaattcacaccctttgcatctgcgaaactcgatctacagatctctccaagctcccaatctccagcagggagattcgaaagatggtgtccgacgctagcaagaagaaggctctccagaagaaagccgccgccgccgccaaaagaggcggtaaagccgccgccgctaaagccgccgcctcttcttcaaacggagctgatagcttgtcgagcggcgtcgacgctattcagatatccgaccggacctgtaccggaatcctctgctctcatccgcagtccagagacattcgtattgaatctctgtctgttacgtttcatggttacgacctgattgttgattcgatgctggagcttaactacgggagacgctacggtctcctcgggctgaacggttgtgggaagtctactctcttaaccgcgattggactcagagagcttccgattcctgatcacatggacatctaccatctctcccacgagattgaagccaccgacatgacttccctcgaggctgtcatgagctgtgacgaggagaggttgaagctggaaaaggagattgagactcttgttgagcaggatgatggaggcggagagcgtcttgacacaatatatgagcggttagaagccatggatgcttcgacggctgagaagcgtgctgctgagattctgtttggtcttggtttcgacaaggagatgcaggctaagaagacgaaggacttttctggtgggtggaggatgaggattgcattggcgagagctctcttcattatgcctactatcctttggctggatgagcccacaaatcatttagatttggaagctggtgtctggttagaggggagcctgaaaaactttgaccgtatcctcgtcgtggtctcccactcgcaggattttttgaacggagtctgcaccaacatcatccacatgcaaagcaagcagctaaagtactacaccggtaacttcgaccagtactgccagacacgttccgagctagaagagaatcagatgaaacagtacagatgggagcaggagcagatctcccacatgaaggagtacatcgcccggttcggtcacggttcagcgaaactcgcccgccgagcgcagagcaaggagaagactttggccaagatggagagaggtgggctcacggagaaggtggcgagagacagtgtcctcgttttccgattcgccgacgtcggaaagcttccaccgccggtgcttcagtttgtggaagtctcgttggggtacactccggactaccttatatacaagaacatcgacttgggtgttgatttggactcgagggtggctcttgttgggcctaatggagctgggaagagtactctcttgaagctcatgactggcgagctgcaaccaactgaaggaatggtgaggcgtcacaaccacttgaagattgctcagtaccatcagcatctagctgagaagctggaccttgaagtgcctgcgcttatctacatgatgaacgagtttccgggtaacgaagaggagaagatgagagctgctattggtaggtttggtctgaccggtaaggcgcaagtgatgccgatgaagaatctgtctgatgggcagaggagccgtgtgatattcgcgtggctggcttataagcagcctaacatgcttttactggatgagccgactaatcatttggatattgagacgattgattctctcgctgaggcgttgaacgagtgggatggtggtttggttctggtgagtcacgacttcaggttgattaaccaagtggctcatgagatatgggtgtgtgagaagcagtgcatcactaaatggaatggtgatattatggacttcaagaagcatctcaaggctaaagctgggcttgaagactgaggatgaagtcaagtcagatgacttgattgggtcacagggctagagagtgagagggattttgtttggtgatggttttgaagccaacacgttaaagagagagggagacaccatactcgtaatctctgcacttcttgctcatttaagaggtcagtgattcttctatattagtactataatcatcaatctgcacttttatttttattgttttgacgtttttggaggagagacagatatgaaaaacgaaatattttggttgtattgtagga

SEQ ID NO: 1851 - DNA, 2145 bp, Artemisia annua
tactccgacggggtcagcaaaggcggcggccgtcgggatgaacgggagttcgagtagtgataatttgagtaatggaatggggaatttggtgatatctgatcggacttgtactggtgttttgtgttctcatcctttgtctagggatattaggatcgagtctctgtcacttactttccatggacatgatctcattgttgatgctgagctggagcttaactatggaagacgatacggtttgcttggattgaatggctgtgggaaatcaactcttctcacctcaattggaatgcgtgaacttcccatccctgaacacatggatatattccatctcactagagaaattgaggcttctgacatgtcctcacttgaggctgtcatgaattgtgacgaagagaggctgaaattagaagctgaagctgaacgtttggctggacaggatgatggtggtggtgaagcactcgagcgtatctatgagcgtttggatgctttggatgcatctactgctgaaaaacgtgcagctgagattttgaatggtctcggttttgacaagcagatgcaagcaaagaagaccaaagacttctctggtggttggagaatgcgaattgctttagcacgtgctctgtttatgaacccaaccatcttgttgctcgatgagcccacaaatcatcttgatcttgaagcatgtgtgtggctggaagaaaccctgcagaagtttgagcgtatactcgttgttgtctcacactctcaagatttcctgaatggtgtctgcaccaacatcatacacatgcaaagtaagacgttgaagatttattctggtaattttgaccaatatgttcagacccgttcagaacttgaagagaatcagatgaaacaatacaaatgggagcaggaccagattgctaacatgaaggagtacatagctcggtttggacacgggtctgctaaactggctcgtcaggctcagagtaaggagaaaacgctagcaaagatggaacgtggtggtctgacagagaaggtttctagggacagtgtactggtgttccggttcgttgatgtgggcaagcttccgccaccagttcttcagttttcagaggtcaagtttggttacacacctgataacctcatctacaagtgtcttgactttggagtcgacttggattctcgtgtggcgttggttggacccaatggagctggtaagattctgaagctgatgacaggggaattgactcctcttgaaggcatggtgaagcgtcacaatcacttgaggattgctcagtatcaccaacatttggctgaaaaacttgatttggatatgtcagctttgttatatatgatgagggagtatccgggcaatgaagaggagaagatgagggcttctattggtagatttggtctgaccgggaaagcccaagtgatgcctatgaagaatttgtcagatggtcaaaagagtcgtgtgatttttgcatggttagcctttaggcaaccccagatgctgctgttggatgagccgactaatcatttggatattgaaacgattgactcattagctgaggctttgaatgaatgggatggtggaatggtgcttgttagccacgactttaggctcattaaccaggttgctcgtgagatctgggtgtgtgaaaaccagactataacgcgatggaatggtgatattatgggtttcaaagagcatttgaaggctaagtctggtctatctagttagatcagttgagtggttttgttatcatagggtccatattacaccgagctcaagtggcgtattgttatggcaacttgtgcttggtttggcatgtcaagtggcttgagtagagtatatggtacatgctgagatgggacttatgattgtaaaccgtaaaggagtcgttagaggatgatgggggtaaggttgcctcgtgatatctttaggggattttgaacccttaccatccctttggcttcttctttctaatctaggtttgttttcgtgcactatatttttgaatttagttttataaacaagaacatatgcccccggcactgctacctattattgttacaattttattcaaagagtgtaatgacagtacgtctaagctataatttgattttcttattgatatctctgtgacccggacccaattgggg

SEQ ID NO: 1852 - DNA, 1879 bp, Sorghum bicolor
ccaatgggtttccgcggtggtttcaggccgctcgtgacgttggtcctcctgtgcctgtgcgcctcgcgcctctgctccttgtcccatgccaagaggacgccgcggcctacgcctactccagcgaagaagccaccgccatcgtcgccgtcccagcagagcccgccgccgccggcctcgtatccgcctctccccgtccgggcggtgtgcctcggcggttggctcgtcaccgaaggctggatactgccatccctcttcgacggcatccccaacaaagatctcctggatggcacgcaggtgcagttcaagtcggcgctgaggaagacgtacctgacggcggaccagggcggcggcggcgccgtggtggccaaccggacgcaggcctccgactgggagaccttcaagctgtggaggatgaacgagacgacgttcaacttccggacttctggcaaccagttcgtgggcatcggcgccagcgacggcctcatcgtcgcgacggccaccacgccgaccctgccggagacgttccagatagtgcgctgccccttcgacaagaacagggtccggatcaaggcagccaacggctacttcgtccaggcaatagcaaccggcgaagtgatagcggactacggtgaacccacacggtggtccgacttcgacgcgtcggtcttcctgatgaccaaggttggggagcagctgcaaggggagtaccagctctgcaacggatacggcaccgacaaggccacgccactgctcagggaccattggagcacctacatagttgaggacgatttcaagttctttgcatcaagtgggctgactgcagtgaggatcccagtaggatggtggatcgctagtgaccccaaccctcctgctccatacgtcggaggttccctccaagccctggacaacgccttcaaatgggcagagaagtacaagctgggtgtcatcattgacttgcacgctgctcccggatcacagaacccctgggagcacagctcctccagagacggcacgcaggaatggggaacaacagatgccaacattgcgcagacggtgcaagtcatcgatttcctcgcatccaggtacgcgacgagctcgagcctgtttgccgtggagctgatgaacgagccgctggcgcctggagcgacactggacagcctcaccaagtactaccgcgacggctacgacgccgtccggaagcactcgccgacggcctacgtggtcatgtccaaccgcctgtcgtcggggaactccacggagcttctccagttcgccagcgggctccagggcgcggtcatcgacgtgcattactacaccgtgttcaacaggatgttcaacaacttcaccgtgcagcagaacatcgacttcatcaggaccaacttctccggcgagctcaccaccgtcaccacccacaatggcccgctcaccttcgttggagagtgggttgcggagtggaaggtgccaaacgcaactaaggaagagtaccagaagtacgcaacggcgcagatgaatgtgtatggacaggccacgtttggatggtcctattggactgccaagaatgccaacaaccattgggatctcgagtggatgattaaaaatggatacatctcattgaaaggctaggacaaaaaaccaacatgtttctagtctttgggatttatttataagtaagtttggaggcaaatacgttctcttaaattgtagtctattgacgtcaaattaggaaacaggggagccggagatatattgtaattaattaaggcgaagttcgtgctatgaacaatgttgattcttatgtacttgagcaaaccgctgtgcctatcgcgttggggatatttaacttgttgctgtctttatgcatgtcgcctcttcatttgct

SEQ ID NO: 1853 - DNA, 532 bp, Triticum aestivum
  misc_feature (344)..(344): n is a, c, g, or t
  misc_feature (363)..(363): n is a, c, g, or t
  misc_feature (406)..(406): n is a, c, g, or t
  misc_feature (415)..(415): n is a, c, g, or t
  misc_feature (428)..(428): n is a, c, g, or t
  misc_feature (457)..(458): n is a, c, g, or t
  misc_feature (497)..(497): n is a, c, g, or t
  misc_feature (519)..(519): n is a, c, g, or t
  misc_feature (531)..(531): n is a, c, g, or t
ccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcaaggcgcacccggcgacctgcttctgccagtacaagaggaaccccagcatgcagcgctacgtcaactcccccaacggcaagaaggtcttcgccgcctgtaaggtgtccctgcccangtgctgatctgagtagtcntctgccgccccatcaagtcgatgtccattcatcctgctcgatngattcgatnatgctactacttnaacactttgggcaaagtttaatatgctcnnagaataataaacggagactacatccaagtacttggtaantgtgagttcgatttgctctccncaagaaaacttng

SEQ ID NO: 1854 - DNA, 1695 bp, Sorghum bicolor
catcatcgtccagtccagcgcggcgcagcgcggcgcccaaccagaacagaacgacgaagcggagccagccagccagccaaccaactaaccaacggacggaagaggcgaggcaaggccgccgcgaagccgtgccaatccggccgcaacccgctttctcctctcctgcctcctcgggatctgcccgccagccttgtgtgatctcgactccccgcgcccgcgattggagctccggctgcacgccgccatgaacccctgcgcgtagaggccgggagggagggagcggggaacgaagttaagctaagtggggggaggccagagcagggtcgctgttacgccggcgagatggacgggagcgccggctccttcgtcgccgtgcgccggctctccggctccgaccgcgccgccgccttccaccactcctcttcggcggaggtcgtgacgggatcaagcgcatggatcgggagggggctctcatgcgtctgcgcgcagaggagggacagcgatgcgcgcctctccttcgatttgacgcctgtgcaggaagaatgcctacagaggttacaaaaccggatagaagttcagtatgacagtgcaaacagagagcatcaggaagcactacaggccctttggtgtgcttcttttcctggcaccgagcttcgggggctaatatcagaacaatggaaggagatgggttggcaagggaaagacccatctacagactttagaggtggaggcttcatctccttggagaatctattgtacttttctaggaactatccaaaatctttccaggaacttcttcgcaagcagaatggtgaccgtgcaatctgggagtatccatttgctgtagctggtgtaaatataaccttcatgctcattcagatgcttgatctccaagcagttaaaccgaggtcattgtttggagcagttttcctaaagcttctttcagaaaacgatcgagcttttgacattctctactgcataaccttcaagctgatggaccagcaatggcttgacatgcatgctacttacatggactttaacacggtcatgaagtctacacggcgtcagctagaaagggagctgttgattgaagatattcagaggattgaggacatgccatcatacaggcttctgggccggtagctagaagaaactgaaatcttaacatggctacatgttgcaaggcttgagatgctaatggattgcaacttgtgtccacagccggtgacagtcttgaaatgtagatgcatatgtatccttgtgtgttaggtacttgtggtctctggtaatctgatctctgaaatttacaaggtagggtttttcctggtgatagaatgccacgtagggtgactgaagtgtctgatcagctgccatggcaaaagtttgtagggtgtgttattacaatctggtcgttgtccatcataccacgaaaagaagtgttcctagggttgtcgttgtaaacaggaggatttgggaaagatgatctgagttgtctcccatatataagaggctagttctttaagtgcgcactgcgcagcaactatatgtcgttcattggtttttctaagatctgtttgccctggttcgtgccaagcctgccctgtacaccagttggcaattttcttctcatcccactggtttagatgcatgcgtgcagttttctgtaattctttgtggttcatggctaatgccgcg

SEQ ID NO: 1855 - DNA, 1551 bp, Saccharum officinarum
gcgcagcgcggcgcccaaccagaacgacgaagcggagccagcaaaccaaccaactaaccaacgaacggaagaggcgaggcaaaggccgccgcgaagccgagccaatccggccgccctgccctaccttctctctcctgccttctcgggatctgcccgcccgccttgtgtgatctcgccgcccccgcccgcggttggagcttccggctgcacgccgccatgaatccccgcgcgtagaggctcggagagagggagggagcggggaacaaaagctaagttaagtgggggaggccagagcagggtggctgttacgccagcgagatggacgggagcgccggctccttcgtcgctgtccgcaggctctccggctccgaccgcgccgccgccttccaccactcctcttcggcggaggtcgtgacggggtcgacggcgtggatcgggaaggggctctcctgcgtctgcgcgcagagaagggacagcgatgcgcgcctctccttcgatttgacgcctgtgcaggaagaatgcctacagaggttacagaaccgcatagaagttcagtatgatagtgcaaacagcgagcatcaggaagcactacaggccctttggtgtgcttcttttcctggcacagagcttcgggggctaatatcagaacaatggaaagagatgggttggcaaggaaaagacccatctacagattttagaggtggaggcttcatctccttggagaatctattgtactttgctaggaactatccaaaatctttccaggaacttcttcgcaagcagaatggtgaccgtgcaatctgggagtatccatttgctgtagctggtgtaaatataaccttcatgctcattcagatgcttgatctccaagcagttaaaccgaggtcattgtttggagcagttttcctaaagcttctttctgaaaatgatcgagcttttgacattctctactgcataaccttcaagctgatggatcagcaatggcttgacatgcatgctacttacatggacttcaatacggtcatgaaatctacacggcgtcagctagaaagggagcttttgattgaagatattcagaggattgaggacatgccatcgtacaggcttctgggccggtagctagaagaaactgaaatcttaacatggctacatgttgcaaggcttgagatgctaatggattgcaacttgtgtccacagctggcggcaatcttgaaatgtagatgcatatgtatccttgtgtgttaggtacttgtggtctctggtaacctgatctctgaaaattacaaggtagagttttttttttcctggtgatagaatgccaaatagggtaactgaagtgtctgatcagctgccatggcaaaaaattgtagggcgtgttattacaatctggtcgttgtccatcatactacgaaaggaagtgctcctagggttgtcgttgtaaacaggagggtttgggaaagatgatctgagttgtctcccatttgcatgaagataagaggctagttttctaagtgcgcactgcgcagcaactatgtcgttcattggtttttc

SEQ ID NO: 1856 - DNA, 1493 bp, Panicum virgatum
gcggagccagccagccagccaaccaacaaaccaacggacgacggaagaggcgaaggcccgccgcgaagccgagccaatccggccacgctgccctgccccgcgctccgccgctcctctcgggatccgcccgcccgcccggcgtgatctcgccgcctcgcccgcggttggggctccggccgcacgcccccatgtgtcccggagcggatcgccgcgcgtagaggccgggtggggagagggagtttagtgttggggcaggccaggcagggaagcgtcgccttgccgtgtcccgcggcgagatggacgcgagtgccggctccttcgtcgccgtccgccggctctccggctccgaccgcgccgccgccttccaccactcctcctcggcggaggtggtgacggggtcgtcggcgtggatcgggagggggctctcctgcgtctgcgcgcagaggagggacagcgatgcgcgcctctccttcgatttgacgcctacgcaggaagaatgcctacagaggctacagaatagaatagaagttcagtatgatagtgcaaacagagagcatcaggaagcattacgggctctttggtgtgctgcttttcctggaaccgagcttcggggtctaatatcagaacaatggaaagagatgggttggcaagggaaagacccatctacagattttagaggcggaggcttcatctccttggagaatctgttgtactttgcaaggaactatccgaaatcttttcaggaacttcttcgcaagcagaatggtgaccgtgcaatctgggagtatccatttgctgtagctggtgtaaatataaccttcatgctcattcagatgcttgatctccaagcagttaaaccaaggtcattgtttggagcagttttcctaaagcttctttcagaaaatgatcaagcatttgacattctctactgcataaccttcaagctgatggatcagcaatggcttgacatgcatgctacttacatggacttcaatatggtcatgaaatcaacacggcgtcagctagaaagggagcttttgatcgaggatattcagcggattgaggacatgccatcatacaggcttctagcccggtagctagaagaaactgaaaatcttaacatggctacacgttgcaagccttgagttgctgatggattgcaactggcacccacagcctgagagaatcctggaatgtagatgcatctgtatccctgtgtttaggtactctggtaacctgatctctgaaatttacaaggtagggtttttcttggtgatagaatgccgcttagggtaactgaagtgtctgatcagctgccaaggcaaagtatttgtagggtgtgttattgcaatcgggctgttgcccatcataccacgtaaagggagtgttccagttcctagagtttgcgatgtaaacaggaggattttgggaaagctgatctgagttgtctcccattcgcataaagaaagaggctagttctttgagtgtgcacc

SEQ ID NO: 1857 - DNA, 1459 bp, Setaria italica
ccgctcgccgcgcgcccgctcgcccggtgtgacctcgccgccccgcccgcggttgtgactgcggctgcacggccatggatccccgcgcggatcgccgcgcgtagaggcaggcagggagcgcgtgggggagagagggttaaggggggaagcgaagccagggtagggttgccgttccgcggcaagatggacgggagcgcgggctccttcgtcgccgtccgccggctctccggctccgaccgcgccgccgccttccaccactcctcttcggcggaggtcgtgacggggtcgacggcgtggatcgggagggggctttcctgcgtctgcgcgcagaggagggacagcgatgcgcgcctctccttcgatttaacgcctatgcaggaagaatgcctacagaggttacagaacagaatagaagttcagtatgatagttcaaacagagagcatcaggaagcacttcatgctctttggtgtgcttcttttcctggaaccgagcttcggggtctaatatcagaacaatggaaagagatgggttggcaagggaaagacccatctacagattttagaggtggaggcttcatctccttggagaatctgttgttctttgctaggaattatccaaaatcttttcaggaacttcttcgcaagcagaatggtgatcgtgcaatctgggagtatccatttgctgtagctggtgtaaatataaccttcatgctcatccagatgcttgatcttcaagcagttaaaccgaggtcattgtttggagcggttttcctaaagtttctttcagaaaatgatcaagcttttgacattatctactgtataaccttcaagctgatggatcagcaatggcttgacatgcatgctacttacatggacttcaacacggtcatgaaatctacgaggcgtcagctagaaagggagcttttgatcgaagatattcagcggattgaggacttgccatcatacaggcttctggcccggtagcagaagaaactgaaatcttaacatggtacatgttgcaaggctcgagttgctaatggatttgcaaatggcacccacagctagcgagaatctcggaatgtagatgcatctgtatccttgtgtttaggtactctggtaacctgatctctgaaatttacaaggtagggtttttcttgatgatagaacgccacgtagggtaactgaagtgtctgatcagctgccatggcaaaatatttgtagggtgtgttattacagtcgggttgttgcccatcataccacgagaaagggagtgttcctagagttttcgttgtaaacaggaggattttgggaaagctgatctgagttgtctcctatttgcataaagatagaggctagttctttgagtgcgcagcaaccatgctgttcgttgcttttccaagatctgttggtgctagtcctgccctgtgcaccagtttgcagtttctttccattggttaga

SEQ ID NO: 1858 - DNA, 1287 bp, Triticum aestivum
cccgccgccgagactcgagctccggccggcgcatggacccccgccgtcgcgcggatcgcgccgagtagcgggaggtagaggtggcagagacgccggcgccaaggggcgaggcgggcatggacaccaacgccggctccttcgtcgccgtccggcggctcgccggctccgaccgcgcggccggcgccgtcgcgttccatcactcgtcctcagcggaggtcgtgaccggctcgacggcatggatagggagggggctctcctgcgtctgtgtgcagagtagggacagcgacgcccgcctttccttcgatttgactcccgttcaggaagagtgcctactgaggttacagaaccggatagaaattcagtatgatagttcaaacatagagcatcaggaagaactgaaggccctttggtgcgcctcctttcctggaactgagcttaggggcctaatatcggaacaatggaaagagatgggctggcaagggaaagatccatccacggattttagaggtggaggcttcatctccttggagaatttattgttcttcgccaggaactatccgaaatcttttcaggaacttcttcgtaagcagaatggtgaccgtgcaatttgggagtatccatttgcggtagctggtgtaaatataacattcatgctcattcagatgcttgatctacaagcagtcaaaccaaggtcattgttgggagctgttttcctaaagctactttcagaaaatgatcgagcctttgatatcctgtactgcataaccttcaagctgatggatcagcaatggcttgacatgcatgctacttacatggacttcaatacagtcatgaaatccacacgacggcagctagaaagggagctgttgattgaagatattcagcgggttgaggatatgccatcgtacaagcttctagcccgctagctagtaactgaaaccttaacatggcttacatgtcgccgcgaggcttgaattgctgaacgatgcaaccagtgtccttatacagtgagagaattccaagatgtagatgcccctgtatcttgttgcgttttaggtactctgataacccgggctctcatgtatttacatagtagggttttcttggccagcatgtcacgtagggtgactccagtatccgaccaactaccaggagggcagagtatttgtagggtgtgtgtgtgtgtgctgttaaagtttggttattgcccataataccacggaatgtagtccttgtctctgtccttgtaaccaggagcctcttgtgaaagctaatctgagtgcgcag

SEQ ID NO: 1859 - DNA, 1414 bp, Triticum aestivum
  misc_feature (647)..(647): n is a, c, g, or t
acggacggaagagaccgccgcgaagcctcgccaatccggcccccttccctccttttcctctcccgcctacttgggatccgctcgcgcgatcccgccgccgagactcgagctccggccggcgcatggacccccgccgtcgcgcggatcgcgccgagtagcgggaggtagaggtggcagagacgccggcgccaaggggcgaggcgggcatggacaccaacgccggctccttcgtcgccgtccggcggctcgccggctccgaccgcgcggccggcgccgtcgcgttccatcactcgtcctcagcggaggtcgtgaccggctcgacggcatggatagggagggggctctcctgcgtctgtgtgcagagtagggacagcgacgcccgcctttccttcgatttgactcccgttcaggaagagtgcctactgaggttacagaaccggatagaaattcagtatgatagttcaaacatagagcatcaggaagaactgaaggccctttggtgcgcctcctttcctggaactgagcttaggggcctaatatcggaacaatggaaagagatgggctggcaagggaaagatccatccacggattttagaggtggaggcttcatctccttggagaatttattgttcttcgccaggaactanccgaaatcttttcaggaacttcttcgtaagcagaatggtgaccgtgcaatttgggagtatccatttgcggtagctggtgtaaatataacattcatgctcattcagatgcttgatctacaagcagtcaaaccaaggtcattgttgggagctgttttcctaaagctactttcagaaaatgatcgagcctttgatatcctgtactgcataaccttcaagctgatggatcagcaatggcttgacatgcatgctacttacatggacttcaatacagtcatgaaatccacacgacggcagctagaaagggagctgttgattgaagatattcagcgggttgaggatatgccatcgtacaagcttctagcccgctagctagtaactgaaaccttaacatggcttacatgtcgccgcgaggcttgaatcgctgaacgatgcagccagtgtccttatacagcgagagaattccaagatgtagatgcccctgtatcttgttgcgttttaggtactctgataacccgggctctcatgtatttacatagtagggttttcttggccagcatgtcacgtagggtgactccagtatccgaccaactaccaggagggcagagtatttgtagggtgtgtgtgtgtgtgtgtgtgtgtgctgttaaagtttggttattgcccataataccacggaatgtagtccttgtctctgtccttgtaaccaggagcctcttgtgaaagctaatctgagtgcgcagcaactaccatagctgttgttgctagtc

SEQ ID NO: 1860 - DNA, 1136 bp, Pennisetum glaucum
ggctccgaccgcgccgccgcgttccaccactcctcttcggcggaggtcgtgacggggtcgacggcgtggatcgggagggggctctcctgcgtctgcgcgcagaggagggacagtgatgcgcgcctctccttcgatttgacgcctatgcaggaagaatgcctgcagaggttacagaacagaatagaagtccagtatgatagttcaaacagagggcatcaggaagcactacacgctctttggtgtgcttcttttcctggaaccgagcttcggggtctaatatcagaacaatggaaagagatgggttggcaagggaaagacccatctacagattttagaggcggaggcttcatctccttggagaatctgttgtacttcgctaggaattacccgaaatcttttcaggaacttcttcgcaagcagaatggtgatcgtgcaatctgggagtatccatttgctgtagctggtgtaaatataaccttcatgctcattcagatgcttgatcttcaagcagttaaaccgaggtcattgttcggagcggttttcctaaagcttctttcagaaaatgatcaagcttttgacattatctactgtataaccttcaagctgatggatcagcaatggcttgacatgcatgctacatacatggacttcaacacggtcatgaaatctacacggcgtcagctagaaagggagcttttgattgaagatattcagcggattgaggatttgccatcatacaggcttctggcccggtagcagaagaaactgaaatcttaacatggtacatgttgcaaggctcattgctaatggatttgcaactggcaccccacaggcagcgataatctcggaatgtagatgcatctgtatccttgtgtttaggtactctggtgacctgatctctgaaatttacaaggtagggtttttcttgatgatagaacgccacgcagggtaactgaagtgtctgatcagctgccatggcaaaatatttgtagggttgtgttattacagtcgggttgttgccccatcataccacgaaaaaaagagtgttgctagagttttcgttgtaaacaggaggattttgggaaagctgatccgagttgtctcccatttgcataaagatagaggctagttctttg

SEQ ID NO: 1861 - DNA, 1936 bp, Oryza sativa
gcccttaatctgccacatcaggacgaaatcatgcagatctgcatctctgtacagaaattccatcctctcaattaaaacgcatatgccccaaatcgaacaaaagaaaaaaaaaaaaagaaaagaagaggggagaggagagggagcggcgaatcgaagcgaagcaagcagcagcagcagcaactcgcgctgttcatttattcgcaccaaaccgaaaggcgagacgaggcgaggcgaggcgcggtggcagaggcagccaaaccaactgacggacgcgagcgaagcgaagaagttcttgaagttgaagcagccgcctcgctcgcctcgcggccctcgcttgcctaatcaggaggggggctatctctttctctctcttttttcctttcctttcctgcgtccttgggatccgcccgtgcgatctcgccgtgggtggagcgccgccgtccatccgtccccatggatccccgcagtcgcgcggatcgcggcgagtagggagggaggaggggaggggagggggaagcgggttccgggaggagaggcgtcctgctcgagcaaggagcttgtggggggaggtagatggacgcgaacgcgggctcattcgtcgccgtccgccggctcgccggctccgagcgcgccgcgggagcggccgccttccaccactcgtcttcggcggaggtcgtgacggggtcgacggcgtggatcgggaaggggctgtcttgcgtgtgcgcccagaggagggacagcgacgcgcgcctctccttcgatttgacgccagttcaggaagagtgcctacagaggttacagaaccggttagaagttcagtatgatagttcaaacagtgatcatcaggaagcattgaaggacctctggcgtgcttcttttcctggagctgagcttcggggactaatatcagaacaatggaaagagatgggctggcaagggaaagatccatctacagattttagaggtggaggcttcatctccttggagaacttagtgtacttctccaagaacttcccaaaatcttttcaggaacttcttcggaagcagaatggtgaccgtgcaatttgggagtatccatttgctgtggctggtgtaaatataacattcatgctcatccagatgcttgatcttcaatcagttaaaccaaggtcgttcatcggagcagtttttctaaagctactttctgaaaatgatcaggcttttgacattctctactgcataaccttcaagttgatggatcagcaatggcttgacatgcatgccacttacatggacttcaatacggtcatgaagtccacacgacgtcagctagaaagggagctcttgcttgaagatattcagcggattgaggacatgccatcatacaagcttttggcccgctagctagtaactgaaccataacatggctacgtgctgcaaggcttgagttgcataagggttgcaactagtgcccacaaacagtgtgaattccaaaacgcagatgcacttgtttcctctcaagtttaggtactctgttaacctgtctccaaattacaagatagaggtctcttggtcatagcacgccacgtagggtaactgaagtgtccgatcagctgccagggcagagtgtttgtaggttgggtgttttgttgcagtttggttgatgcccgtcataccacgaaatgaagtgcttctaggttttcctttttcctttataaacaagaggctcttgtgaaagctaatctgagtgtcttctgtagtgtaccatatttgcataattgatagtgttcagttctccgagtgtgcagaaatcatgctagctgtttctgctagctccgcaatgatgcaaatctgttgtttccttagttgtcctggggcatgaagtttgttcctatatagtgcagaccatttttgtggtacagcacgcctttcttgattgaatggattctgagtgctc

SEQ ID NO: 1862 - DNA, 1400 bp, Brachypodium distachyon
cttttcctttcctgcctccttgggatccgcccgcgcaatcccgccgccgagattggagctccggccggcccatggacccctgtcgtcgcgcggatcgcggcgagtagcgacgagcgggaaggggggagacaccagggccgtgccgtgccgtgccgcgggctggggcagatggacacgaacgcaggctccttcgtcgccgtccgacggctcgctggctccgaccgcgccgccggcgccgtcgcgttccaccactcgtcctcggcggaggtcgtgacggggtcgacggcgtggatcgggagggggctctcctgcgtctgcgcgcagggcagggacagcgacgcccgcctttctttcgatttgacgcctgttcaggaagagtgcttactgaggttacagaaccggatagaagttcagtatgacagttcaaacagagagcatcaggaagaactgaaggccctttggtgtgcttcctttcctggaattgagcttcaggggctaatttcagaacaatggaaagaaatgggctggcaagggaaagacccatctacagattttagaggtggaggcttcatctccctggaaaatttattgttcttcgccaggaactatccgaaatcttttcaggaacttcttcgtaagcagaatggtgaccgtgcaatttgggaatatccatttgctgtagctggtgtaaatataacattcatgctcattcagatgcttgatctacaagcagttaaaccaaggtcattgtttggagctgtttttctaaagctactttcagaaaatgatcgagcttttgatattatctactgcgtaaccttcaaggtgatggatcagcaatggcttgatatgcacgctacttacatggacttcaatacggtcatgaaagctacacgacgtcagatagaaagggaactgttgcttgaagatattctgcggatcgaggatatgccatcatacaagcttctagcccgctagctagtaactgcaccttaacatggcttacatgtctcaaggttttagttgccaaaggattgcgaccagtgcccttacacagtgaggattctcaaatgtagatgcacctgtatcgtcatgttttaggtactctggtaacctgagctctcgggcagggttttcttggtcatagcatgccgcgtagggtaactgggtgactcaaagtgttcgaccagctgcccaggcgggcagactatctgtagggtgtgtgtgtgtgttattgcccatcataccacgatatgaagcgcgtcctagtctttggctctttgcctttgtaaacatgaggctgttctgaaatctaatctgagttgtgatttgggagtactggcgccctggcggtttgttctcgagcaacaactatcctagctgttcctgctaattcccag

SEQ ID NO: 1863 - DNA, 1030 bp, Festuca arundinacea
  misc_feature (746)..(746): n is a, c, g, or t
ggcacgagggcgcgatcccgccgccgcgattggtgctccggccggcccatggatccccgccctcgcgcggatcgcggcgagtagcttggaggaagcggggaggtgggagcgacgccagggccgtgcctcctcggccgaggtggtagacatggacacgaacgccggctccttcgtcgccgtccgacggctcgctggcaccgaccgcgcggccggcgccgtcgcgttccaccactcgtcgtcggcggaggtcgtgacggggtcgacggcgtggatcggcaggggactctcctgcgtatgcgtgcagagcagggacagcgatgcccgcctctcgttcgatttgacgcctgttcaggaagagtgcctactcagattacagaaccggatagaagttcagtatgacacttctaacagagagcaccaggaagagctgaaggccctttggtatgcctccttttctggaactgagcttcgtggcctaatatcagaacaatggaaagagatgggctggcaagggaaagacccatctacagattttagaggtggaggcttcatctccttggagaatttattattcttcgccagaaactattcgaaatcttttcaggagcttcttcggaagcagaatggtgaccgtgcaatttgggagtatccatttgctgtagctggtgtaaatataacattcatgctcattcagatgcttgatctacaagcagttaaaccaagatccttgtttggagctgttttcntgaagctactttcagaaaatgatcgagcttttgatatcctttactgcataaccttcaagctgatggaccagcaatggcttgacatgcacgccacttacatggacttcaatacggtcatgaaatctacacgacgacatctagaaagggagttgttgcttgaagatattcagcggattgaggatatgccatcatacaagcttctagcccgctagctagtaactgaaaccttaacatggcttacacgttgcacggcttgaaatattgctaaacgactgagaattcca

SEQ ID NO: 1864 - DNA, 1421 bp, Leymus cinereus x Leymus triticoides
  misc_feature (8)..(10): n is a, c, g, or t
  misc_feature (84)..(84): n is a, c, g, or t
  misc_feature (105)..(105): n is a, c, g, or t
  misc_feature (109)..(109): n is a, c, g, or t
  misc_feature (113)..(113): n is a, c, g, or t
  misc_feature (125)..(125): n is a, c, g, or t
  misc_feature (131)..(131): n is a, c, g, or t
  misc_feature (152)..(152): n is a, c, g, or t
  misc_feature (173)..(173): n is a, c, g, or t
  misc_feature (178)..(178): n is a, c, g, or t
  misc_feature (183)..(183): n is a, c, g, or t
  misc_feature (205)..(205): n is a, c, g, or t
  misc_feature (226)..(226): n is a, c, g, or t
  misc_feature (250)..(250): n is a, c, g, or t
  misc_feature (286)..(286): n is a, c, g, or t
  misc_feature (310)..(310): n is a, c, g, or t
  misc_feature (352)..(352): n is a, c, g, or t
  misc_feature (361)..(361): n is a, c, g, or t
  misc_feature (381)..(381): n is a, c, g, or t
  misc_feature (427)..(427): n is a, c, g, or t
  misc_feature (433)..(433): n is a, c, g, or t
  misc_feature (440)..(440): n is a, c, g, or t
  misc_feature (448)..(448): n is a, c, g, or t
  misc_feature (513)..(513): n is a, c, g, or t
  misc_feature (817)..(817): n is a, c, g, or t
  misc_feature (907)..(907): n is a, c, g, or t
  misc_feature (930)..(930): n is a, c, g, or t
  misc_feature (1030)..(1030): n is a, c, g, or t
  misc_feature (1039)..(1039): n is a, c, g, or t
  misc_feature (1067)..(1067): n is a, c, g, or t
  misc_feature (1070)..(1076): n is a, c, g, or t
  misc_feature (1083)..(1083): n is a, c, g, or t
  misc_feature (1090)..(1090): n is a, c, g, or t
  misc_feature (1094)..(1094): n is a, c, g, or t
  misc_feature (1096)..(1096): n is a, c, g, or t
  misc_feature (1098)..(1098): n is a, c, g, or t
  misc_feature (1105)..(1106): n is a, c, g, or t
  misc_feature (1108)..(1110): n is a, c, g, or t
  misc_feature (1127)..(1129): n is a, c, g, or t
  misc_feature (1134)..(1134): n is a, c, g, or t
  misc_feature (1181)..(1181): n is a, c, g, or t
  misc_feature (1189)..(1189): n is a, c, g, or t
  misc_feature (1198)..(1198): n is a, c, g, or t
  misc_feature (1207)..(1207): n is a, c, g, or t
  misc_feature (1210)..(1210): n is a, c, g, or t
  misc_feature (1216)..(1216): n is a, c, g, or t
  misc_feature (1270)..(1270): n is a, c, g, or t
  misc_feature (1291)..(1291): n is a, c, g, or t
  misc_feature (1296)..(1296): n is a, c, g, or t
  misc_feature (1300)..(1300): n is a, c, g, or t
  misc_feature (1312)..(1315): n is a, c, g, or t
  misc_feature (1317)..(1318): n is a, c, g, or t
  misc_feature (1320)..(1320): n is a, c, g, or t
cagaaagnnnaagaggcaggcagcagagccaaaccaaccaactaaccaacggacggaagagaccgccgcgaagcctcgccaatncggcccccttcccttttcctntccngccnccttgggatccncccgcncgatcccgccgccgagattgnagccccggccggcgcatgganccccnccgtngcgcggatcgcgccgagtagcnggaggtagaggtgggagagangccagtgccgcgggcgaggtgganatggacacgaacgccggctccttcgtcgccgtccgncggctcgctggctccgaccgcgcngccggcgccgtcgcgttccatcactcgtcctcagcggaggtngtgaccggntcgacggcgtggataggganggggctctcctgcgtctgtgtgcagagtagggacagcgacgcccgnctttcnttcgatntgactccngttcaggaagagtgcctactgaggttacagaaccggatagaaattcagtatgatagttcaaacanagagcatcaggaagaactgaaggccctttggtgtgcctcctttcctggaactgagcttcgggggctaatatcggaacaatggaaagagatgggctggcaagggaaagacccatccacggattttagaggtggaggcttcatctccttagagaatttattgttcttcgccaggaactatccgaaatcttttcaggaacttcttcgtaagcagaatggtgaccgtgcaatttgggagtatccatttgctgtagctggtgtaaatataacattcatgctcattcagatgcttgatctacaagcagtnaaaccaaggtcattgtttggagctgttttcctaaagctactttcagaaaatgatcgagcttttgatatcctgtactgcataaccttcaanctgatggatcagcaatggcttgncatgcatgctacttacatggacttcaatacagtcatgaaatctacacgacgccagctagaaagggagctgttgcttgaagatattcagcgggttgagganatgccatcntacaagcttctagcccgctagctagtanctnnnnnnnttaacanggcttanacgncntnaggcttnnannnctaaacgatgcaaccannntcctnatacagtgagagaattccaaaatgtagatgcccctgtatcctggtgntttaggtnctctgatancccgagctntcntatttncatagtagggttttcttggtcagcatgccacgtagggtaactccagtatccgancaactgccaggagggcagagnatttntagngtgtgtgttgtnnnngnntngttattgcccataataccacggaatgtagcctttgtctctgtccttgtaaacagcagcagggctcttgtgaaagctaatctgagttttagcggtttgcgta

SEQ ID NO: 1865 - DNA, 1058 bp, Pennisetum glaucum
gggagacagccctcgtggttgatccgtccgtgggatctcgcgcacgccaggattggagcgccgcggcctccctccgccccagccatccatggtttcccgcgcggatcgcggcgcgtaggtggagaagggagagagaacgggggaggagggcgaggtcgaggaggagagcagcgcgcgcgcgcgctcgttcggcatggaccacaatgccggctccttcctcgccgtgcgccgcctctccggcgccggcatcgtccaccaccgccactcccactcctcgccggcggaggtcgtgggcgtgtccacggcgtggatcgggaaggggctctcgtgcgtctgcgcgcagagaagggatagcgacgcgcgcctctcattcgatctgagccccattcaggaagagtgcttgcagagattgcagaaccggatagaagtgcagtatgataattcaaatctagagcatcagaaagcactgaaggccctttggcgtgcttcttttcctggaactgaacttctaggattagtatcagaccagtggaaggagatgggatggcaagggaaagatccatctacagatttcagaggtggtggttatatatctttggagaatttactgtacttttctaggacctatccaaaatccttccaggagctcctttgtaagaagaacggtgacagagccttgtgggaatatccctttgctgtggctggtgtaaatattacattcatgctaattcagatgcttgatcttcaagcagctaaaccaacatcattgattggagcagtattcctaaatctacttgtagaaaacgatcgagcctttgacgttctttactgcataacctttaagctgatggatcagaaatggcttgacatgcacgccacttacatggatttcaattcggttattaaatctactaggcgccagctcgagagggagctgttgctcgaagacattcagagaatcgaggacatgccatcattcaggtttctcgcccgctagcaactggactcggtcgcacctaacatttctgcagatagtgcagctccatacacctcatgaa

SEQ ID NO: 1866 - DNA, 1462 bp, Zea mays
cgcggggacggaagccaggccaaactagagaagcgccaagttgccagccaaacgaacaaagctaaaacagggcgggggcgtcccttcgtggggacagccctcgtggtcgatccgcccgtgggatctcgcgcacgccaggattggagagctgcggcctccctccgccccaaccagccatgggttcccgcgttgattgcggcgcttagacgcggaggaggagagagacacggggagggggggaggccgaggcctaggaggcgtagcgctgtgcagggcgcgagcgcgttcgttcggcatggaacagaacgccggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttggcgttcttcttttcctggaactgaacttctagggttagtatcagaccagtggaaggagatgggatggcaagggaaagatccatctacagatttcaggggcggtggttttatatctttggagaatttactgtatttctctaggaactatccaaaatccttccaggagctccttcgtaagcagaatggtgatagagcattgtgggaatatccctttgctgtagctggtgtaaatattacattcatgctgattcagatgcttgaccttcaagcagctaagccaacgtcgttggttggagcggttttcctaaatctactcttagaaaatgatcgagcgttcgacattctttactgcataaccttcaaactgatggatcagaaatggcttgaaatgcacgccagttacatggatttcaatacggttattaaatcaacacggcgccagctcgagagggagctgttgctagaagatatccagagaatcgaggacatgccatcgtacaggtttctcgcctgctagcaattgaacctcctggtcgtaccgaacattgccacaagatagtgcagctccatacactcgaagaagaagctgagaggttggaaccacgtacaccgagcgaagggtgaatctaggttcatggactgtggatgtgttgttgctttgaattgcgctgtcgtgtttacctactccgagtccgacaacagcctcgacgccgagtgccttttcgtttcaacgatgtgctatatcttggggccacggaacggcagatcctagctttctttgtaaacaagaggatgtggaaagttggctgcgtatgctttgtggccatgtgcatggataatcttgctgctcgcctgaaagaaaaaaaggccgatcttaagactg

SEQ ID NO: 1867 - DNA, 1108 bp, Panicum virgatum
  misc_feature (496)..(496): n is a, c, g, or t
  misc_feature (542)..(542): n is a, c, g, or t
gaggcggggagcagcgcgcgcgcgcgctcgttcggcatggaccagaatgtcggctccttcgtcgccgtgcgccgcctctccggcgccggcgccgtccaccaccaccgccaccactcctcgcctgcggaggtcgtgggcgtgtccacggcgtggatcgggaaggggctctcgtgcgtctgcgctcagagaagggatagcgacgcgcgcctctcgttcgatctgaccgccattcaggaagagtgctggcatagattgcagaaccggatagaagtgcagtatgatggttcaaatctagagcatcagaaagcactcaaggccctttggcgtgcttcttttcctggaactgaacttctagggctagtatcagatcagtggaaggagatgggatggcaagggaaagatccatctacagatttcagaggtggtggttttatatctttggagaatttactgtacttctctaagaactttccaaaatccttccaggagctccttngtaagaagaatggtgatagagcgttgtgggaatatccctttgctgnagctggtgtaaatattacattcatgctaattcagatgcttgatcttcaagcagcaaagccgaagtcattgattggagcagtgttcctaaatttacttaaagaaaatgatcgagcatttgacattctttactgcataactttcaaattgatggatcagaaatggctcgacatgcacgccagttacatggattttaattcggttattaaatctacgcggcgccagctcgagagggagctgttgctcgaagacattcagagaatcgaggacatgccatcatacaggtttctcgcccgctagcaactgaactcggtcacacacctaacattgccacatacagcgccgcagctccatatacgtgaagaattacaacgttggaaccacgtacactgaggtcaacgctagaggaatctaggataaatgtggacactgtggatgtgcttcattggattgtgttacctgtttagctaccctgacagacccaacagctgggatgttattactggcttttacccttgtataagggtgccttttcttttgaacgacataccggcagatcctaggtttc

SEQ ID NO: 1868 - DNA, 1273 bp, Sorghum bicolor
cgcggcgcgtcgtggggacagccctcgtgatcgatccgcccgtgggatctcgcgcacgccaggattggagagccgcggcctccctccgcccccaacgttcccgcgcggattgcggcgcttagacgcggagcggtggaggagagagacggggggaaggggaggccgaggccgaggcctaggaggcgtggtggtgcagcgagcgagcgagcgagcgcgttcgttcggcatggaacagaacgccggctcgttcctcgccgtgcgtcgcctctccggcggcgccatccaccacaatcgccaccactcttcgcccgctgaggtcgtgggcgtgtccacggcgtggctcgggaaggggctttcgtgcgtctgcgcgcagaggagggagaccgatgcgcgcctctccttcgatttgagtcccattcaggaagagtgctttcataggttgcagaaccggatagaggtgcagtatgatggttcaaatttagagcatcagaaagcactggaagccctttggcgtgcttcttttcctggaactgaacttttaggattagtatcagaccagtggaaggagatgggatggcaagggaaagatccatctacagatttcaggggtggtggttttatatctttggagaatttactgtatttctctaggaactatccaaaatccttccaggagctcctttgtaagaagaatggtgatagagcattgtgggagtatccctttgctgtagctggtgtaaatattacattcatgctaattcagatgcttgatcttcaagcagctaagccaacgtcgttgattggagcagttttcctaaatctactgttagaaaatgatcgagcgtttgacattctttactgcataaccttcaaactgatggatcagaaatggcttgaaatgcacgccagttacatggatttcaatactgttattaaatctacacggcgccagctcgagagggagctgttgctagaagacatccagagaatcgaggacatgccatcatacaggtttctctcctgttagaacttggtcatacctaacattgccacaagatagtgcagctccatccactcgaagatgttgcgacgttggaaccacgtatacagagggggcgatctaggatcatggactgtggatgtgctcctttgaattgtcgtgtttacctacttgattgacaacgacctcaacgctggagtgccttttcgttttgaacgatgtgctacatcttggtgccatataatggcagatcctagctagctttcgtttttt

SEQ ID NO: 1869 - DNA, 1196 bp, Triticum aestivum
cgcccgcgcgccgcatggaagcagaatggtggctccttcctcgccgtgcgccggctctccggccaccaccacccatcgccggcggacgtcgtgtcggggtcgacggcgtggatcgggaggggattctcctgcgtctgcgtgcagaggagggacagcgacgcgcgcatttccttcgatctgacccccattcaggaagagtgcctacaaagattacagaaccggattgaggtgccttatgatagtcaaaatggagagcatcaggaagcactcaaagccctctggcatgcttcttttcctgggactgaacttctaggactagtatcagatcaatggaaggagatgggatggcaagggaaagatccatccacagatttcaggggtggtggctttatctctttggagaatttactttacttcgctaagaactatccaaaatccttcgaggagctcctttgtaagcaaaatggtgacagagcattatgggaatatccatttgctgtagctggagtaaatattacatttatgctcattcagatgcttgatcttcaagcagctaagccaaggtctttgattggagcagtgttcctaaatttacttatagaaaacgatcgagcttttgatattctttactgcataacctttaagctgatggatcggaaatggcttgaaatgcacgccacatatatggatttcaatactgttattaaatccacacgccgccagcttgagagagagctattacttgaagatattcagcaaattgaggacatgccgtcatacagttttctcgcccgttagcaactgaagtcttgcctaacatcgccacgtgtagtaaagttcttgacacatgcttctaaagagtggaatgtaggaatcagggactcgtgcttgtgtggtttttgctaccgtgcttaggtactctgatatcctgagcgcatgtttgggtcttcttggatctgacctctagagtaactggctacctgaacagcagttgggccatgctagtgccggtaggatgtactttcggaaacaatttgtcctggcgcggagtcttcgtgctaggaaatacgtagtaagttctgaaactcctcagtactcaagacagctttgtagccaagtgcataaatgatattggtgcactcttgttttgcactaaacacacacgttttgtgtgatttatccatggattgtactga

SEQ ID NO: 1870 - DNA, 1245 bp, Triticum aestivum
cgcccgcgcgccgcatggaagcagaatggtggctccttcctcgccgtgcgccggctctccggccaccaccacccatcgccggcggacgtcgtgtcggggtcgacggcgtggatcgggaggggattctcctgcgtctgcgtgcagaggagggacagcgacgcgcgcatttccttcgatctgacccccattcaggaagagtgcctacaaagattacagaaccggattgaggtgccttatgatagtcaaaatggagagcatcaggaagcactcaaagccctctggcatgcttcttttcctgggactgaacttctaggactagtatcagatcaatggaaggagatgggatggcaagggaaagatccatccacagatttcaggggtggtggctttatctctttggagaatttactttacttcgctaagaactatccaaaatccttcgaggagctcctttgtaagcaaaatggtgacagagcattatgggaatatccatttgctgtagctggagtaaatattacatttatgctcattcagatgcttgatcttcaagcagctaagccaaggtctttgattggagcagtgttcctaaatttacttatagaaaacgatcgagcttttgatattctttactgcataacctttaagctgatggatcggaaatggcttgaaatgcacgccacatatatggatttcaatactgttattaaatccacacgccgccagcttgagagagagctattacttgaagatattcagcaaattgaggacatgccgtcatacagttttctcgcccgttagcaactgaagtcttgcctaacatcgccacgtgtagtaaagttcttgacacatgcttctaaagagtggaatgtaggaatcagggactcgtgcttgtgtggtttttgctaccgtgcttaggtactctgatatcctgagcgcatgtttgggtcttcttggatctgacctctagagtaactggctacctgaacagcagttgggccatgctagtgccggtaggatgtactttcggaaacaatttgtcctggcgcggagtcttcgtgctaggaaatacgtagtaagttctgaaactcctcagtactcaagacagctttgtagccaagttcataaatgatattggtgcactctcgttttgcactaaacacacgttttgtgtgatttatccatggattgtactgacattgtcgagttggttcagccaaataagagaggtcggctagaccgaacttc

SEQ ID NO: 1871 - DNA, 1312 bp, Oryza sativa
atgggtgcccgcgcggatcgcggcgcgtaggcagccggagagagagagagagagagagagagagagagagagagagagagggagggagggagaagacggcgggagagcagcgccaccgcccgcgcggcatggaccggaatgccggttccttcgtcgccatgcgccgcctctccggcggctcctcctgccacgacccctcgccgaacacgtacgcggaggtcgtggcggggtcgacggcgtggatcgggagggggttctcctgcgtctgcgcgcagaggagggacagcgaccagcgcatctccttcgatttgagccccgctcaggagtgttgtctgcagagattacagaaccggatagaggtaccgtacgatggttcaaatggagagcatcaggaagcattaaagaccctttggcatgtttcctttcctggaactgaacttttaggactagtatcagaccagtggaaggagatgggatggcaagggaaagatccatctacagatttcaggggcggtggctttatctctttggagaatttactgtactttgctaagaactatactaaatccttccaggagctcctttgtaagcagaatggtgatagagcattgtgggaatatccatttgctgttgctggtgtaaacattacattcatgctcattcagatgcttgatcttcaagcagctaaaccaaggtcgttgattggatcggtgttcttaaatctacttttagaaaatgatcgagcttttgacattctctattgcataacctttaagctcatggatcacaaatggcttgaaatgcacgccaattatatggatttcaatgcggttatcaaatctacacgacgacaacttgagagggagttactgcttgaagatatccaacgaattgaggacatgccatcgtacaggtttctcgaccgctagcaactgaattctcagtttctcacttaacctcgccacaggtagtaaatctcaatatacagtcacctgcaaaccaagtacagcgaactcgattcgtggggactccaggaccatggacgtgtaacgtgtgccaaatggtttgtgttttcacgttgaaactgtaacaggccttgtttgttttggtctgcttgtttataaaaggcaccactcagggttaacagggtatctgatcagccgatggtttaactagtgtatgtagagtgtccagattttcaacgagagggtttcacaatgcagagcgacaagttcttagatttctctgtaaaaaggaagatcatgtaagctaatctgagtctgaaatgcttcctaggtccatttttttcatc

SEQ ID NO: 1872 - DNA, 1443 bp, Sorghum bicolor
cacagttcacactcgcgtcgcgtgcgggcgtgcgcgcgcgtctctctctcgctctctcctttgattccgcatatatatcggccgctttgccagcccaacgaaacgtgagtcgtcgagagagagaagctagctagctagctagagataaaaccagccggctgctgcgggcgacgacgacgagcatggcggcgatccggcaccggacggtggaggcgaacggcatctcgatgcacgtggcggagtcgggcgccgaaggggaccccgcggttgtgttcctgcacggcttcccggagctctggtactcgtggcgccaccagatggcgcacctggccgcgcggggctaccgctgcgtggcgcccgacctccgcggctacggcggcaccgccgcgccgaccgacgtcgcgtcctacaccgccttccacgtcgtcggcgacgtcgtggcgctgctcgacgcgctcggcatccaaaaggtgttcgtggtgggtcacgactggggcgccatcatcgcgtggtacctgtgcctgttccggccggaccgggtcacggcgctcgtcaacaccagcgtcgccttcatgcgccatgtcttcatccgcgccggcgcctccgccgtcaagcccaccgactacttctgccgcaactacgggcccacctactacatctgccgcttccaggagcctggtgtcgcagagaaggagttctcgccggcgaccgcccggtacctgatgaagccgatcctgtgcaaccgcttcacctcctcggcggcaggcggcgagaagccagcagacacggcggcgcccgccgcccccgtcgaggaaccgctgccgccgtggctgacggaggaggacgtgggccactttgtgtcggagttcgagcggacgggcttcacggggcccatcaactactaccgcaacatggaccgcaactgggagctggcggcgccgtgggcggacgccaaggtgcaggtgcccaccaggttcatcgtcggcgacggcgacctcacctaccactacccgggcatccaggactacatccacaagggcgggttccaggccgacgtaccggggctcgacagcgtcgtcgtcatccccggcgccggccacttcgtccagcaggagaaggccgacgaggttagccagcatatctacgacttcatctccaagttctgatggatggatcgacgaccatcgtcagcttggctgctgtctgctgaaaactgaaatcaacctcgatcatgttgccaatttgttttgtattttgaatttaaattaacaataagtgtatgcacaatacgtgtttttaattatttgtgacttcgatatggagtgagttgttccaagtttcagcgtacatacattgtatgatcgatgtgaaatgaataaaccatgtatttcagaaaattgaaatgcacaggcctaatcgatctcattatcaattgcaagcaag

SEQ ID NO: 1873 - DNA, 1334 bp, Panicum virgatum
acactcttcagttccttcctccccttcccaagcaaaagccaggacgctactacgctaggctccaccataaatagcagccagaggcagcagctcggcgggcagaccggcagagcaagaccaagatcgatcgacaccacggcttgagagagaggagaagcaagtgagcgagcgacctgcctgttactactagcatggacggggcggcggcggcggcgattcggcaccggacggtggaggcgaacggcatcgcgatgcacgtggcggagtgcggcggcgaggaggaaacgagcccgcgggcggtggtggtgttcctgcacggcttcccggagctctggtactcgtggcgccaccagatggagcacctggccgcgcggggctaccgctgcgtggcgcccgacctccgcggctacggcggcaccggcgcgccgcccgacgtcgcctcctactccgccttccacgtcgtcggcgacgtcgtcgcgctcctcgacgcgctcggcctcgccaaggtgttcgttgtgggtcacgactggggcgccatcatcgcgtggtacctctgcctgttccggccggaccgcgtgacggcgctggtcaacaccagcgtggccttcatgcgccacatcttcatccgcgccggcgccggcgccgccgccgtcaaaaccaccgacttcttcaaccgcacctacgggcccacctactacatatgccgcttccaggagcctggggttgcagagaaggagttctctccggccaacgcccggtacatcgtgaggcagatcctgtgcaaccgcttcacctccgaggcggccggcggcgccaagccggcggcggcggcggccgacgaggagccgctcccgccgtggctgacggaggcggacgtggaccggttcgcgtcggagttcgagcggacagggttcacgggcggcatcaactactaccgcaacatggaccggaactgggagctggcggcgccgtgggcggacgccaaggtggcggtgcccaccaggttcgtggtcggcgacggcgacctcacgtaccactacccgggcatccaggactacatccacaagggcggcttcaaggccgacgtgccgctgctggaggacgtcgtcgtcatccccggcgccggccacttcatccagcaggagaaggccgacgaggtcagccaccacatctacgacttcatctcaaagttctgatggatgcctagacatccagtatgtaattgggtgttgtgtttcgaattacgggcagctggatgcatgtatgttcatttggttaattgttaacttcaatcattagtgtgttcgagtattcgagttcgaattatgggcgcc

SEQ ID NO: 1874 - DNA, 2109 bp, Sorghum bicolor
gcactagtcctgtcctatataaacactgctagtagtagtcctactagacgcgagtgggcgatccaccacaaaggaaccgagaagagcacccgctcgatccgggagtggcaggtcggcgaggagacgaaaggcggtcggcgacaacagacgcagctgcggcggagagttttgcaggcgcgggagatcacgcaagtctgttgcgcttgaaacggaggggggaaaaaaacaagcagcggggagtcccgttcgttgccggtaccacaacacgcaactgctgccccagcagcagcagcaggaggaggaggcgccggagtcgcgccgtcgccgccgtgctgcaggcagaggaggacggcgccggccatcatgggccggtacgagctcgtcaggagcgacgacgcggcggcgggcgccacgggaaccgatctcgagtgcggcgccagcgccagcaaggcgtcgacgacgtcgcccgcggcaccgtcgacgacgtcgcccgcggcccggcagccgcggctcgtctccctcgacgtcttccgcgggataaccgtcctgcttatgattattgttgacgatgctggaggcttcctcccgtcactgaaccactctccttgggatggcgtaacaatagctgatttcgtcatgccgttcttccttttcatagttggagtctcgctaacactagcgtacaagcgggtaccagataaactggaggcaactaagaaggcagtacttcgtgccctcaagttgttctgccttggtcttgttctccaaggtggattttttcatggtgttcacagtctcacatttggcgttgatctaacgaaaattcggttgatgggcatacttcagaggattgcaatagcctatcttctggctgcaatatgtgaaatctggctcaagggagatgatgatgtagattctggatatggtttgctaaggagataccgctaccaattatttgtaggattggtcctctctatagcctatactatacttttgtacggtatatacgttccagactgggagtacaagatatcaggccctggttccacagagaaatcattctctgtgaaatgtggagtaagaggagacaccggaccagcttgcaatgcagttggaatggttgaccgtacaattctagggatcgatcacctctacagacggccagtctatgcgcgcacaaaggaatgtagtataaattatccagagaatggacctcttccacccgatgctccatcatggtgccaggcaccatttgatcctgaaggcctcctcagctccgttatggcaattgtcacttgcttgattggacttcagtttgggcatataattatacattttgagaaacacaggggaagaatcaccaattggttgatcccttccttcagcatgttagctctagccttcttaatggacttcagcggaatgcgcatgaataaaccattatacacaataagctacactttggctactgctggcgctgcgggtcttctttttgctggaatttatgctcttgtggatctgtacgggttcagaaaacctaccattcccatggagtggatggggaagcacgccctgatgatatatgtcctggtggcatgcaacatcctgcccatgttcatccgtggcttctactggagggaccccaacaacagccttctgaaagtcattggtatcggcgcgtgaagccatgatcttctacatgttcaggcctaaacttggacacggatttttcttcttaatataaggatgcacagctctctcgcgtgttcgagaaaattagacttagatacggacgggatgcagaagtaggtcctcaggccaagttttgctatgcggttagagcacgatagtgctcagctcatcgccatggggctgcctattctatcagcactcccgggctggctgttgccaaggagagtccattctccctgatcactttgtatatggtggagttgagcatgtatatgacatcatacgagtaatacgatgggattcagatgaaatatagtacatatccaaacaagttctcactggaaacttcaacttttcttgttacaagatggaatgcaagattcagttctccaagtggtttgtcgtgcttcatcttag

SEQ ID NO: 1875 - DNA, 1875 bp, Pennisetum glaucum
gagatcacgcgggtttgttgcgctcgaaaggaaaaaaacacacaccaggggaggcctcccgcctcctccctcccgagatcaagagagagtccaagtccaagtccctcccgggccagaaagccgaggggcgggcggcaggcacgcaactgcacccagcagcagcagtagcagcattgcccggcggcggcggcgtaccatcggcgttgtgctgccggcagaggacgaggaggacggctgcgtcggccatgggcgggtacgagctcgtcaggagcgacgacgcggcgggcgccccgggccccgatctcgagtccggcgccggcgccaacagcaaggccgcgccttccccgcccaccgccgcgccgcgcggccagccgcggctcgtctccctcgacgtcttccgcgggatcaccgtcctgcttatgatcattgttgatgacgcgggaggctttgtcccagcactgaatcactctccttgggatggcctaacaatagctgatttcgtcatgccattctttcttttcatcgttggagtcgcactaacactagcgtacaagcgtgtgccagacaaattggaggcaactaagaaagcggtacttcgagccctcaagttattctgccttggcctcgttctccaaggtggattttttcatggtgttcacagtctcagttttggtgttgatctggcgaaaataaggctgatgggaatacttcagaggattgcgatagcttatctccttgctgcaatatgtgagatttggctcaaaggagatgatgatgtagattctggacttgatttgctaaggagataccgctaccaactgtttgtaggattggtcctttctttcacatatactgttcttttatatggaatatacgttccagactgggagtatcagatatcaggtcctggttccgtagagaagtcattctctgtgaaatgtggagtcagaggagatactgggccagcttgcaatgcagtaggaatggttgaccgtacagttttagggatcgatcatgtctacagacggcctgtttatgcacgtacgaagcaatgcagtataaattatccgcagaatggaccgctaccaccagacgccccatcatggtgccaggcgccattcgatcctgaaggccttctgagctctgtcatggcaattgttacttgcttgattggtctgcaattcggtcatataattatccattttgagaaacaccggggaagaattaccaattggctgatcccttccttcagcatgttagcagtagcctttttaatggacttcgttggggtgcgcatgaataaaccactatacacgataagctacactttggctactgctggttctgcagggctcctttttgctggaatatacactctggtggacgtgtatgggtttagaagacctaccattaccatggagtggatggggaagcacgccctgatgatatatgtgctggtggcatgcaacatcctgcccatgtttatccgtggcttctactggagagaccccaacaacagccttctgaagttcatcggtatcggggcctgaagccatgatcttctacaaggtgtaaaatcagttagagccacatacattggtatatagattctaggccttaaaaatgactgagaggatgcaaaagtaggccgttgggcccagttttgctgtgcagttataacatgatggtcatcagctcatcagtaatgagctgcctattccatcagcactgctggctgttgccacttgcaggagtccattcaccctgatgtatatggtggagctgctcatgtatatgataactggtaacacgctgggaatcagatgaaatatactataaattccaacaagttctcaatgaaaactacgaactatt

SEQ ID NO: 1876 - DNA, 886 bp, Sorghum bicolor
gctgctgcaagaaaacacaggtacacagacagcagcatggccggagtccaggtgacgccggcggccgtcggcgtggcggggctgagagggtcaggggttggcagcaccaccggcttgttcgccggcgactggaggaggaaggctcgacgcccggcgtgctcggtctgggcgctcaggcggcagcagagacggagcagcagcaggagcaaggggggcggcctcgccatcgtctgcaacctcgcgggacagtacgaggattcctttgacgacgtccagcggcaactgatgaactacttcacctacaaagccgtgaggaccgtgctgacccagctatacgagttgaacccaccaagctaccgttggttctacaacttcgttgctgtcaacaaacctactgacggcaaacacttcctccgtgctctcagcaaggagaggcaggagcttgcagagcgagtgatgattactaggcttcacctatatggaaaatggatcaagaaatatgaccacgcaaacacgtacgagaagatttctgatgagaacctgacgctgatgcgagagcggctcatggagacggtcatctggccaactgatgacaccaacacagagaagatcggctgatcaagcttagctccttatattaggtagaatactctgggtttctctatcagtcagtcagtcagtcagtcagtcagttgtatataatcagagttttagtagagagtatatatttctctgggcagtgttcaggcaattaatatgtgaggtgttaacaatgctgttttgccctcccaagtctctacagttgctctagaggaagcaaaaaagactttaccttgtaatttgtatgaataatgaaagctttggttcacttcagagttcagagatc

SEQ ID NO: 1877 - DNA, 2276 bp, Sorghum bicolor
cccgacacgaaaaagaggaaacccctcagccctcactagattcctagtgggccagcctcgtcgtaggccgatagccagtccagccacacccacacaacacgcggacgccccacttcaccacggcaccaccggccggccaccgggcgccaaaaggaacggaacggcgcagccgcggcggcggcggcggctgtaagctcccgcaccagcgaccggcggacacgtacacggtatatcgatctcccctcgcacagtcccacgcaacccgtcctcggcctcgttccgtccgccagcaatgccgctggcgctcgcgcagctgcaggacctgcgggaccgcatctccgaccacctccgcccatggagccgctccgcgcagttctgggtccgcgccgcggacatctacaccagctataaggtgtgccagctgcgggcggggtttgtgaaggatgaggacgagcgggaggccatgtgggagcagcagcacgagctcggcgcccagaagatgtactccctctgctccgagctcggcggtcttttcctcaaggctgctcaaattctgggaaaacctgacctggcaccgatggcttgggtgaagagacttgtcacgctgtgtgatcaggccccagccacgccatttgttgtggttagagatgttgtggagaaacagtttggaaagaacttcgatgacatattcgaattcttcgatgtcgagcctgttgggtctgcttctattgcacaggtgcatcgagcaaggcttaaattatcaaaggcagacgttgctgtcaaggttcaacatccaggagccgagcatttgatgatggttgatattcggaatatgcaagcaatggccttgtttctgcagaagtatgacatcaactttgatctattctctgccaccaaagagatggaaaagcagatatgctatgaatttgactttgtgcgtgaagcaagagcaatggaaagaatacgagaattcctacgtgtcaccaataagaaacctccagttatggtgcctcgtgtgattcctgggatggttagcagagaggttttggtaatggaattcatcaaagggaccccaataatgaatcttggcaatgaaatggctaaaaggggcatcgatcctggtggtaagattgcagcaatggcaaagcagaagattttgtcagatcttactcttgcatatggtcaaatgatcttgaaggatggctttttccatgcagatccacacccaggaaacatccttatctgtaaggacacagaggtggctttacttgattatggacaagtgaaagaaatgccagaagatttgcggcttgcttatgcaaatcttgtagttgcaatggctgatgatgatttcttgagggctgaggaaagtttcagggagctcggtatccgaacatgggccataactgataacaagctagaagaattgtttcaattatccctgcgaatgtttgatacaagattaccaccaggtgtaactgttatgtcaccttttgccgatgattcttcgcttaataaaattggagtggagagcttcccggaagagttattttcagtgcttcgaacaattcagcttttgcgagggttgactgtaggcatgggccttacattctcgtgcgctcagcattggagaccaatcgctgaggaagtattgttaaaggctggaagacaaaatgcttcaaaatcaagaaatcaaaagagaagttttctcaggagacttttttggtgaagtagggatagggaccatcaaagaatatggtatacgaacaattctatgatgaaatggaagtagccataaatctcaagccttcgattcttatattcacagtacatctgttcactttttttttgagaggcatctgttcacattcatttacattggatttgcaggccaaaaatctcggcccattatcaaacgtgcaaacctacggaaccatcctccaggagatcaatgcaaggagacggagcttcacaagagcagatttcgtctttgaagtgtgaagatcgaatgttgacgctcatctagtcgctagaagctctataaatttattgataggtagacatgcttggtttttggagcctcctgatggagtttgtaatccttatcctgctgattgaataaagtcagagctcccctaaaaaaaggaaaaaaaaaacatgtacacattcatgctcaaaatactccaaatatcgtgtggggacaaacacaatactccatccgttcttttaatttgtcacattgaacattgatctttacttggtcaaacctgtccaac

SEQ ID NO: 1878 - DNA, 1970 bp, Zea mays
ccctaatcgagcgcgaaaggaacggaacggcgcagccgcggcggcggcggcggctcatgtaagctccccaccagcgaccagtggacacgtatatccatctcccctcgcacagtcgcaactcgcacgcatccgtcctcggcctcgttccgtccgccagcaatgccgctggcgctcgcgcaactgcaggacttgcgggaccgcatctccgaccgcctccgcccatggagccgctccgcgcagttctgggtccgcgccgcggacatctacaccagctacaaggtgtgccagctgcgcgcggggttcgtgaaggacgaggacgagctagagaccatgtgggagcggcagcacgagctcggcgcggagaagatgtactccctctgctccgagctcggcggtctcttcctcaaggctgctcaaattctgggaaaacctgacctggcaccgatggcttgggtgaagagacttgttacgctgtgtgatcaagccccatccacgccatttgatgtggttagagatgttgtggagaaacagttggggaagaacttcgatgacatgtttgaattcttcgatgtcgagcctgttgggtctgcttctattgcacaggtgcatcgagcaaggcttaaattatcaaagacagacgttgctgtcaaggttcaacatccaggagccgaacaactgatgatggttgatattcggaatatgcaagcaatggccttgtttttgcagaagcatgacctcaactttgatctattctctgccaccaaagagatggaaaaacagatatgttatgagtttgactttgtgcgtgaagcaagagcaatggaaagaatacgagaatttctacgtgtcactaataagaaacctccggttatggtgcctcgtgtgattcctgggatggttagcagagaagttttgataatggaatttatcaaggggaccccaataatgaatcttggcaatgaaatggctaaaaggggcatagatcctggtggtaagattgcagcaatggcaaagcagaagattttgtcagatcttactcttgcatatggtcaaatgatcttgaaggatggctttttccatgcagatccacacccaggaaacatccttatctgcaaggacacagaggtggctttacttgattatggacaagtgaaagaaatgccagaagatttacggctggcttatgcaaatcttgtagttgcaatggccgatgatgatttctcgagggctgaggaaagtttcagggagctgggtatccgaacatgggccataactgataacaaactagaagaattgtttcagttatccctgcgaatgttcgatacaagattaccaccaggtgtaactgttatgtcaccttttgccgatgattcttcgcttaacaaaattggagtggagagcttcccggaggagctattttcagtgcttcgaacaatccagcttttgcgagggttgactgtgggcatgggccttacattctcgtgcgcccagcattggagaccgatagctgaggaggcgttgttaaaagctggaagacaaagcgcttcaaaatcaagaaaacagaagaggagttttctgaggagattgttttggtgaagtaggcatttagccgcatagcgaacatcaaaggacatggtatacgaacattctgtgatgaaacggaagtagccaaaagctcgagccttcgatttttagacagtacatctgtccatattcgtttaccttgggtgcgtgttattttatatatttgctcattcctttatcactatgtgttttttgggattcagtatatagttgggattgtatcggaagctgacatgtacacaagtgacatggaccaattcaaaggaaatcatcgtggtatgtgggggtttgttctgtggactttttttgtttctgatgtgaggggttgcagcaccactggtttgaagccgccatgcaaagaattcttttcccccaaaaaactgagc

SEQ ID NO: 1879 - DNA, 1775 bp, Panicum virgatum
  misc_feature (504)..(504): n is a, c, g, or t
  misc_feature (1717)..(1717): n is a, c, g, or t
  misc_feature (1752)..(1752): n is a, c, g, or t
gcgctcgcggacgcagcagcctcgcccagtccgcccgcccggccgcggacgcaatgccgctggcgctcgcgcagctgcaggacctgcgggagcgcatctccgacagcctccgcccgtggagccgctccgcgcagttctggatccgcgccgcggacatctacaccagctacaaggtgtgtcagctgcgggcggggttcgtcaaggatgaggaggagcgggaggccatgtgggagcagcagcacgagctcggcgcccagaagatgtactccctctgctccgagctcggtggactcttcctcaaggctgctcaaattctgggaaaacccgatttggccccaatggcttgggtgaagagactcgtcacgctctgtgatagggccccagccacaccatatgatgtggttagagatgttgttgagaaacagtttggaaagaacttcgatgacatatttgaattcttcgatgtcgagcctgttgggtctgcttctattgcacaggtgcatngggcaaggcttaaattttcaaagacagatgtcgctgtcaaggttcaacatccaggagctgaacatctgatgatggttgatatccggaacatgcaagcaatggccttgtttttgcagaagtatgacatcaactttgatctattctctgccaccaaagagatggaaaagcagatatgctatgagttcgactttgtgcgcgaagcaagggcaatggaaaggatacgagaattcctacgtgccaccaataagaaacctccggttatggtgcctcgtgtgattcctggaatggttagcagggaggttctggtaatggaattcatcaaagggaccccaataatgaatcttggcagtgaaatggctaaaaggggcatagatcctggtggtaagattgcagcaatggcaaagcagaagattttgtcagatcttactcttgcatatggtcaaatgatcttgaaggatggctttttccatgcagatccacatccaggaaatatccttatctgtggctttacttgattatggacaagtgaaagaaatgccagaggatttacgacttgcttatgcaaatctgtagttgcaatggctgatgatgatcttttgagggccgaagaaggtttcagggagctcggtatcaaaacaaggaccatagctgataacaagctagaagaattgtttcaattatcattgcgaatgtttgatacaagattaccacctggtgtaactgttatgtcaccttttgccgatgattcttcacttactaaaattggagtggagagcttcccggaagagctattttcagtacttcgaacaatacagcttttgcgagggctgactgtagggatggggcttactttctcatgcgctcagcaatggcgaccaattgctgaggaagcattgttaaaagctgggaggctaagagcttcaaaaccaaagcaaaagagaagttttctcgggcgactattttggtgaagtagagatagcgaccatcaaagaaatcttatatgaactttgtaatgaactggcagtatccaaaagctcaagccttcaatttcacttcacagtacatctgtacacattttactttgggtgcgtgttatttgactcaatgatgttgctcattcctttatcaaatgtttatttttggcatttatagacgagaaaccttcttggttccggttcttcatgttttatttggattatataggtaggggttntattggaagctgacatgtacacaatcaccgctatntgctcagaatacatttttgtaaa

SEQ ID NO: 1880 - DNA, 1936 bp, Oryza sativa
ggctcggctagtagtagccacgcacgcgaggccgcccgcgagccacatatcgcgtcgcgccgcgccgtgcacatcccccccaaccccaccccaatcaggcacaatcacggcgcgccgtggccgaggcatcatccaatcaaggcgaggccacctcgacctcgtcctcgtgccgtccgcccccttcggcgagcgcgagcgcgcgcgcgagggtgagagggagggagggagcaatgccgctggcgctggcgcagctgcaggacatcggggaccgcatcaccgaccgcctccgcccgtggagccgctccgcggagttctgggtccgcgctgccgacatctacaccagctacaaggtgtgccagctgcgcgcggggttcgtcaaggatgaggaggagcgggaggccatgtgggagcagcagcacgagcttggtgcccagaagatgtactccctctgctccgagctcggcggcctcttcctcaaggctgcacaaattctgggaaagcccgatttggcgccaatggcttgggtgaaaaggcttgtaaccttgtgtgacaatgctccagccacgcccattgatgtagttagagatgttgtggagaaacagtttggcaagagctttgatgacatatttgaatgctttgatgttgagcctgttgggtctgcttccattgcacaggtgcaccgagcaaggcttaaactatcaaaaacagatgttgctgtcaaggttcaacatccaggagctgaaaaactgatgatggttgacatccggaacatgcaagcatttgcattgttcttgcagaagtatgatatcaattttgacctgtactctgcgacaaaggagatggaaaagcagatatgctatgagtttgactttgtgcgcgaagcaaaggcgatggaaagaatacgagaattcttacgcgtgaccaacaagaaaaagcctccagttatagtgcctcgtgtgattcctgaaatggttagcagggaggttttggtaatggagttcattgaagggacaccaataatgaatcttggcaatgaaatggctaaaaggggcattgatcctggtggtaagattgcaacaatggcaaagcagaaaattttaacagatcttacacttgcctatggtcaaatgattttgaaggatggttttttccatgcagatccacacccaggaaacatccttatctgcaagaacacagaggtagctttgcttgattatggacaagtgaaagcaatgccagaggatttacgacttgcttatgcaaatcttgtaattgcaatggctgatgatgattttttgaggactaaagaaagtttcagggagattggtattgaaacatggagtatagctgataatgagctagaagaattatttcaattatcccttagaatgtttgatactagattaccaccaggagtaactgctatgtcacccttcgccgaggattcttcactaaataaagttggagtgcagagcttccctgaagagctattttcagtgcttcgaactatacaacttttacgtgggttgactgttgggatgggcctcagattctcatgtgctcagcaatggaagcctattgccgaggaagctttgttgaagtctgggagactaaaagctgcaagatcaagaaggccgcggagaagttttgtcaggagactgttttcgagtgacaacgagaaccaaggaacatgatattacaattgtttcatataacaaatatcatgtattttgaagtgacattaataacaggctcaagcccaattttttatgatgcatatatgcatataagactacacatatttcctttgtgccatatggttttgacacgataatacttttatattttggaaggtagactcaactaaacttgtttcaatttgtattgtggaatcttcctgagaataatgtcttgttggaggtcttgcagctgcttc

SEQ ID NO: 1881 - DNA, 1873 bp, Triticum aestivum
ccgtcccgccggcccgagacgcgatcacagccgtccgtccgtccccgaccacgtgggagcgtcttctgtggcctgcaaaggcccacgccttttcccactttccgccttcgccccagctcgccgcttggagccacgagtcggatgttgcggcgcgcgtcattaaggcaggggggcatctagattctagactccatccattccctcctctccggcggccgcaatgccgctgccgctggccaggtgcaggagctgcgggaccgcctctccgaccggttccggccgtggagccgctccgcgcagttctgggtccgcgccgtcgacatctacggcagctacaaggtgtgccagctgcgcacggggttcgtcaaggatgaggaggagcgggaggccatgtgggagcaacagcacgagatcggcgcccagaagatgtactcgctctgctccgagctcggcggcctcttcctcaaggctgctcaaattctgggaaaacccgatttggcgccgacggcctgggtgaagaggctcgttacattgtgcgacaaggctccgtccacgccgatcgaagttgtcagggatgttgtggagaaacagttctgcaagagctttgatgagatattcgatttctttgaagttgagcctgttgggtctgcttctattgcacaggtgcatcgagcgaggcttaaatcatccaagacagatgttgctgtcaaggttcaacatccaggagctgaacaattgatgatggttgatatccggaacatgcaagcatttgccctgttcttacagaaatatgacatcaactttgatctgttctccgccacaaaagagatggaaaagcagatatgctatgagtttgatttggtgcgagaagcaagagcaatggaaagaatacgagaattcttacgtgtcagcaataagaaacctccagttatggtgcctcgtgtgattcctggaatgattagcagagaggtcttggtcatggaattcatacaaggaactccaataatgaatctcagcagtgaaatgtctaaaagaggaattgatcctgctggtaagcttgcagcaatggcaaagcagaagattctgacggatcttacacttgcttatggccaaatgatcttgaaggatggctttttccatgcagatccacacccaggaaacatccttatctgcaacaacacagaggtagctttgcttgactatggacaagtgaaagaaatgccagaggatttacgactggcttatgcaaatcttgtcattgccatggccgatgatgaccttttgagaactaaagaaagtctcagtgaatttggtttcaaaacatggagtatagcagacaatgagctagaagaactgtttcagttatctcttagaatgtttgatacaagattaccgcctggagtaaccgtgctctcgccctttgctgatgattcttcactgaataaagttggagtagagagcttcccagaggaattattttcggtgcttcgaacgatacaactgttgcgcgggctgactgtagggatgggcctccgtttttcttgtgctcagcaatggaaaccaattgctgaggaagctttgttaaaggctgggagaataaaagatgtaaaatcaagaagaccaagaagaagtttccttagaaggttgttttagggaagtagagatgacgacagccaaagaaccgatatgtaaatcattttgtaacgaactggcagtaaccaaaagggaattttttttcctttttgtgaggttgtagtgctggagtatttgatactgaatatttgttagtctttgatcacaaattatatatatatgatgagaaacatgtacttataaagaaggaaagaaataagagaaatgtataatttaattt

SEQ ID NO: 1882 - DNA, 1788 bp, Brachypodium distachyon
gactctcccacgccggcacaatgccgctgccgctcgcgcagatgcaggagctgcgggaccgcctgtccgaccggttccgcccgtggagccgctccgcgcagttctgggtccgcgccgtcgacatctacggcagctacaaggtgtgccagctgcgcgcggggttcgtcaaggatgaggacgagagggaggccatgtgggagcagcagcacgagatcggcgcccagaagctctactcgctctgctccgagctcggcggcttcttcctcaaggctgctcaaattgtgggcaagccagatttggcgccgacagcttgggtcaaaaggcttgtcacattgtgtgataaggctccatccacgccgattgaagttgttagagaagttgtggagaaacagttcaacaagagcttcgacgagatattcgatttctttgatgttgagcctgttggatctgcttctattgcccaggtgcatcgagcaaggcttaaatcatcaaagacagatgttgctgtcaaggttcaacacccaggagctgaaaaattgatgatggttgatatccagaacatgcaagcatttgccttgttcttacagaagcatgacatcaactttgatctgttctctgccaccaaggagatggaaaagcagatatgctatgagtttgattttgtgcgagaagcgagagcaatggaaagaatacgggaattcttgcgtgtcactaataagaaacctccggttatggtgcctcgtgtgattcctggaatgattagcagggaggtcttggttatggaattcgtacaagggacccctataatgaatcttggcaatgaaatgtccaaacggggcattgatcctggtggtaagcttggagcaatggcaaagcagaagattctaacagatcttacacttgcttatggccaaatgatcttgaaggatggcttttttcatgcagatccacacccaggaaacatccttatctgcaacaacacagaggcaactttacttgattatggacaagtgaaagaaatgccagaggacttacggctggcttacgcaaatcttgtaattgcaatggctgatgatgaccatataagggctcaagaaagtctcagggaatttggttttaaaacatggagtatagctgacaatgagctagaagaactgtttgagttatcccttagaatgtttgatacaagattaccacctggagtaactgtgctctcacccttcgctgatgattcttcactgaataaagttggagtagagagtttcccagaggagctattttcggtgcttcgaacaatacaactgttgcgtgggctgactgtagggatgggtctccgtttctcatgtgctcagcaatggagaccaattgccgaggaagctttgctaaaggctgggagaataaaagatgtaaaatcaagaaggtcgaggagaagttttcttagaaggctgttttaggtaactggagataacgatagccaaagaacggatgtatgaaacattttgcaacgaactggcgctggcggtagccagaggcaaaagacctcgattcaaccgcatctgtaggtcttactatttatttttggaggttgtggtgggagtatttgatattgattcttccttgtattcatttgatcacagattcgcagtcgtttatacactttgacaaagaaatgtacttttcaagaagaaagaaagaaaacaaacatgtatgatctgtttgacatttaccaaacacagttttaccacaagtctgaaacgtacagcagtcacgttgggtgattttggattt

SEQ ID NO: 1883 - DNA, 1875 bp, Triticum aestivum
  misc_feature (616)..(616): n is a, c, g, or t
  misc_feature (619)..(619): n is a, c, g, or t
  misc_feature (631)..(631): n is a, c, g, or t
  misc_feature (862)..(862): n is a, c, g, or t
  misc_feature (874)..(874): n is a, c, g, or t
  misc_feature (910)..(910): n is a, c, g, or t
  misc_feature (923)..(923): n is a, c, g, or t
  misc_feature (928)..(928): n is a, c, g, or t
  misc_feature (932)..(932): n is a, c, g, or t
  misc_feature (967)..(967): n is a, c, g, or t
  misc_feature (1761)..(1761): n is a, c, g, or t
  misc_feature (1839)..(1839): n is a, c, g, or t
  misc_feature (1857)..(1857): n is a, c, g, or t
  misc_feature (1862)..(1862): n is a, c, g, or t
ccgtcccgccggcccgagacgcgatcacagccgtccgtccgtccccgaccacgtgggagcgtcttctgtggcctgcaaaggcccacgccttttcccactttccgccttcgccccagctcgccgcttggagccacgagtcggatgttgcggcgcgcgtcattaaggcaggggggcatctagattctagactccatccattccctcctctccggcggccgcaatgccgctgccgctggcgcaggtgcaggagctgcgggaccgcctctccgaccgcttccgcccgtggagccgctccgcgcagttctgggtccgcgccgtcgacatctacggcagctacaaggtgtgccagctgcgcacggggttcgtcaaggatgaggaggagcgggaggccatgtgggagcagcagcacgagatcggcgcccagaagatgtattccctctgctccgagctcggcggcctcttcctcaaggctgctcaaattctgggaaagcccgatttggcgccgacggcctgggtgaagaggctcgttacattgtgcgacaaggctccgtccacgccgatcgaagttgtcagggatgttgtggagaaacagttctgcaagagctttgatgagatnttngatttctttgangttgagcctgttgggtctgcttctattgcacaggtgcatcgagcgaggcttaaatcatccaagacagatgttgctgtcaaggttcaacatccaggagctgaacaattgatgatggttgatatccggaacatgcaagcatttgccctgttcttacagaaatatgacatcaactttgatctgttctccgccacaaaagagatggaaaagcagatatgctatgagtttgatttngtgcgagaagcnagagcaatggaaagaatacgagaattcttacgtgtnagcaataagaaanctccngttntggtgcctcgtgtgattcctggaatgattagcagngaggtcttggtcatggaattcatacaaggaactccaataatgaatctcagcagtgaaatgtctaaaagaggaattgatcctgctggtaagcttgcagcaatggcaaagcagaagattctgacggatcttacacttgcttatggccaaatgatcttgaaggatggctttttccatgcagatccacacccaggaaacatccttatctgcaacaacacagaggtagctttgcttgactatggacaagtgaaagaaatgccagaggatttacgactggcttatgcaaatcttgtcattgccatggccgatgatgaccttttgagaactaaagaaagtctcagtgaatttggtttcaaaacatggagtatagcagacaatgagctagaagaactgtttcagttatctcttagaatgtttgatacaagattaccgcctggagtaaccgtgctctcgccctttgctgatgattcttcactgaataaagttggagtagagagcttcccagaggaattattttcggtgcttcgaacgatacaactgttgcgcgggctgactgtagggatgggcctccgtttttcttgtgctcagcaatggaaaccaattgctgaggaagctttgttaaaggctgggagaataaaagatgtaaaatcaagaagaccaagaagaagtttccttagaaggttgttttagggaagtagagatgacgacagcccaagaaccgatatgtaaatcattttgtaacgaactggcagtaaccaaaaggcatttttttttcctttttgcgaggttgtagtgcnggagtatttgatactgattatttgtttgtctttgatcacaaattatatataatatgatgagaaacatgtacttataangaaggaaagaaataaganaaatntataatttaattt

SEQ ID NO: 1884 - DNA, 1827 bp, Hordeum vulgare
cggcacgaggccacttggagccacgaggcaggggagcatctcgactatccattccacccctcccttctccccggcgaccgcaatgccgctgccgctgccgctggcgcaggcgcaggagctgcgggaccgcctctccgaccgcctccgcccgtggagccgctccgcgcagttctgggtccgcgccgtcgacatctacggcagctacaaggtgtgccagctccgcacggggttcgtcaaggatgaggaggagcgggaggccatgtgggagcagcagcacgagatcggcgcccagaagatgtactcgctctgctccgagctcggcggcctcttcctcaaggctgctcagattctgggcaagcccgatttggcgccgacggcctgggtgaagaggctcgttacattgtgcgacagggctccgtccacgccgatcgaggttgtcagaggtgttgtggagaaacagttctgcaagagctttgatgagatattcgatttctttgaagttgagcctgttgggtctgcttctattgcacaggtgcatcgtgcaaggcttaaatcatcaaagacagatgttgctgtcaaggttcaacatccaggagctgaacaattgatgatggttgatatccggaacatgcaagcatttgccttgttcttacagaaatatgacatcaattttgatctgttctccgccacaaaagagatggaaaagcagatatgctatgagtttgactttgtgcgagaagcgagagcaatggaaagaatacgagaattcttacgtgtcagcaataagaaacctccggttatggtgcctcgtgtgattcctggaatgattagcagggaggtcttggtcatggaattcatacaaggaaccccaataatgaatctcagcaatgaaatgtctaaaagaggaattgatcctgctggtaagcttgcagcaatggcaaagcagtaagccccttcatctcaaaagagaagattctaacggaccttacacttgcttatggccaaatgatcttgaaggatggctttttccatgcagatccacacccaggaaacatccttatctgcaacaacacagaggtagctttgcttgactatggacaagtgaaagaaatgccagaggatttacgactggcttatgcaaatcttgttattgccatggccgatgatgaccttttgaggactaaagaaagtctcagtgaatttggtttcaaaacatggagtatagcagacaatgagctagaagaactgtttcagttatctcttagaatgtttgatacaagattaccacctggtgtaaccgtgctctcaccctttgctgatgattcttcactgaataaagttggagtggagagcttcccagaggagttattttcagtgcttcgaacgatacaactgttgcgcgggctgactgtagggatgggcctccgtttctcttgtgctcagcagtggaaaccaattgccgaggaagctttgttaaaggctgggagaataaaagatgtaaaatcaagaaggccaagaagaagtttccttagaaggttgttttagagaagtagagatgacggcagccaaagagccgatatgtaaatcattttgtaacaaactggcagtagccaaaaggctaagacccttgattctgaaacatttataggtcttctacattgtggtgtcggaaaattttgtctccttttcacgaggttgtagtgcgggagtatctgatattggttatttatttgtctttgatcacaaactatatgtcatatgacgagaaacatgtagctttaaagaaggaaagaaataagagaaatatatatacaatttgatttggac

SEQ ID NO: 1885 - DNA, 1501 bp, Sorghum bicolor
ctctgttttgaagctcttggtgtcgatcggtattcgggggttcgccggattgtgaattcattcaggagatagtaacctcatgcagtcatcctcgtgctcctttcttctgtagattgatggaatgatcagattctaaacaaacttacagcccggaagcgtcgcagagacatggggaatgcagcagttgcaatcgcatcttcagtcgggggaactgcgacagtagtagtaatgatcgtcctcatcagaagatgccgcgccgtcaggaagaagataaagaagaaaatcgtaaagaaagtcttggaggagcttgagaaaaagaaccgcgagatgcaagtcagcaacaacgtggaagatgtggtgatcgaggtcgggccagttgagacgttcctcaaccagatcctcaacgagaagccgatgcgtttcagctcccaacagctagcggcctgcacccggaactactcgtcggagctgggatccggcggctacggcgttgtctacaagggtgagctgccgaacggcctgccggtggccgtgaaggtcctgaaggtgtccatgaacaagagggttcaagaggcgttcatggcggagatcggcactataggccggacgtaccacgtgcacctcgtccgcctctacggcttctgcttcgacgcgaacacgaaggcattagtctacgagtacttggagaatggctcgctcgagaagtatctttacggcgatgtggagggcagcacagccacgaggctggagtgggaggcgctgcacggcatcgccgtcggcacggcgaaggggatcaggtacctgcacgaggagtgccagcagcggatcgtccactacgacatcaagccggccaacatcctcctcaccgccgattacaccccgaaggtggccgacttcgggctggcgcggctgggcgagcgcgagaacacgcacatgtcgctgaccggcggcggccgcgggacgcccgggtacgcggcgccggagctgtggttggcgctgccggcgtcggagaagtgcgacgtgtacagctttggaatggttttgttcgagatcctggggcggcgccggaactttgacccctgccacggcgagagcaaagagtggttcccgagatgggtgtgggagaagtacgaacagggagagatcgactgcgtcgtgtcctgcgacggggtcgtcggagaggcggacaggcagaaggcggagatgatgtgcaaagtagcgttgtggtgcgtgcaattccagccggcagcgaggccgacgatgagcagcgtggtgcggatgctggagggcgagatggccatcgtcccgcctgcgaacccattccactacgtcatggacagcaacattggctcaactaactcggggttctggagtgacacataccaaagtagcagagagaccattggcagagacagcgagctatcggtaattagggctgttgtcaagtcgacttgatcgtcggtgtttatgaaatgaagcttaaagtcttgtactgtttttt

SEQ ID NO: 1886 - DNA, 1560 bp, Zea mays
atcaccattcaccactgaatcagctagactgctctctcatcagctcaacgatttaggcatttagccctgcgggcagcagttgcgagcaaaggccaaagaacacggagaggctaaggctatccacacccacacagagtctaatcaagcttacagcccagaagcgtcacagacatggggaacgcagcagttgcaatcatatcttcagtctcggcaactgcgacggtagtagtaatgatcgccctcatcagaaggtgccgcgtcgtgaggaagaagataaagaagaaaatcgtaaagaaagtcttggaggagatcgagcggaagaaccgcgtgggggcagcctgcgacgccttggaagacgtggtgatcgagatcggtcccgtggagaagttcctcaacgagatcctgaacgagaagccgatgcgtttcagctccgagcagctggcggcctgcaccaagaactactcgtcggagctggggtccggcggctacggcgtggtctacaagggtgagctgcccaacggcctgctggtggccgtgaaggtgctcaaggtgtccatgaacaagaaggtgcaggaggcgttcatggcggagatcggcaccatcgggcggacgtaccacgtgcacctcgtccgcctctacggcttctgcttcgacgcggacaccaaggcgctggtgtacgagttcctggagaaggggtcgctcgagaagtacctctactgtgacgagggcagcacggccacgcggctggagtgggcaacgctgcacggcatcgccgtcggcacggcgaaggggatcaggtacctgcacgaggagtgccagcagcggatcgtgcactacgacatcaagccggccaacatcctgctcacggccgactacaccccgaaggtggccgacttcgggctggcacggctgggcgagcgcgagaacacgcacatgtcactgaccggcggcggccgtgggacgcccgggtacgcggcgccggagctgtggatggcgctgccggcttcggagaagtgcgacgtgtacagctttggaatggtgttgttcgagatcctagggcggcgccggaactacgacccctgccagggcgagagcaaggagtggttcccgagatgggtctgggagaggtacgcgcagggtgagatcgaggacgtcgtggcctgcgacgggatcgttggagacgcggacagagagaaggcggagatgatgtgcaaggtggcgctgtggtgcgtgcagttccagccgtcggcgcgaccgacgatgagcagcgtggtgcggatgctggagggggagatggccatcgtcccgcccgtgaaccccttccactacgtcatggaaagcagcagtgcctcgactagctcggggttgtggagcggcacataccagagcagcagagacaccactgccagagaaagtgagctgtcggctagcccagctgccaagtcgactgacgccatgattgaagatgttgagcgggcttatgcgtcagtgttggcgaaacagagcttgtagtcttgtacacattaattattgagtaaaatgcatccgcgacggtgggat

SEQ ID NO: 1887 - DNA, 1715 bp, Panicum virgatum
agcacctctcggcgttggaaagaggatcagacacggcgggcgagggtgtcaacagttcaacacaggactgcaaacaaacttgcagcccggaagcaccgcaaacatggggaatgccgctgttgcaatcaaagatgcgagggtagtagtagtgagcgccctcatcagaagatgccgcgtcgtgaggaagaagatgaagaagaagatcgggaagaaaatcattaaggagattgagagattgaaccgcgagtctcaagcctgcaaggccctggaggacgtggtgatcgagatcgggccggtggagaagttcctgaacgacatcctaaacgagaagcccatgcgtttcagccccgagcagctggcggcctgcacccggaactactcgtcggagctggggtccggcggcttcggagtggtgtacaagggcgacctgccgaacggccttccggtggccgtgaaggtcctgaaggtgtccatgaacaagaaggtccaggaggcgttcatggcggagatcggcaccatcggccggacgtaccacgtgcatctcgtccggctctacggcttctgcttcgacagggacaccaaggcgctggtatacgaattcttggagatgggctccctcgagaagtacctctatggcggcgacgaggagggcacggcgccgaggctggagtggaggacgctgcacagcatcgccgtcggcacggcgaaggggatccggtacctgcatgaggagtgccagcagcggatcgtgcactacgatatcaagccggccaacatcctcctcaccggcgacttcaccccgaaggtggccgacttcgggctggcgcggctcggcgagcgggagaacacgcacatgtcgctgaccggcggagggcgcgggacgcccgggtacgcggcgccggagctgtggatggcgcttccggcgacggagaagtgcgacgtgtacagcttcgggatggtgctgttcgagatcctggggcggcggcggaacttcgacccctgcgtgggcgagagcaaggagtggtacccgaggtgggtgtgggagaagtacgagcagggcgagctggagtgcgtcgtgtccggtgacggcatcggggaggcggacagggacaaggcggagatgatgtgcaaggtggcgctgtggtgcgtgcagttccagccggcggcgcgcccgacgatgagcagcgtggtgcggatgctggagggggagatggccatcgttccgccggtgaaccccttccactacgtgatggacagtagcagcggctccacgagctcggggctgtggagcagcggcacgtaccagagcagcagggacaccaccggcagaaacagccagatgtcagggagccattctgccttacagcttgacgcgatgatcgaagatgttaagcggactgatgtgccggtgtcaatgaaatagagccagtagtcctgtccacatttgttagtgtattttacgtcttgtaaagtaagcagagcgcacttctctgttttagtcatacctgcatcttcatgctattttatttgaccttgaacccctgcaagttgaactatagatttcaagaaaaccgttatgggatctcaagccacttcttttgtgcagttacgggcccaattagccagccaatgttcaagttgtggccaacactgattgagccgttgcaaatagtttctttagataatggaaaaaattatccggcttcaccctcctc

SEQ ID NO: 1888 - DNA, 1632 bp, Zea mays
cagctccaccatccaggcggtctctcgtgacctcaacaatttaacccagcgggcagcgcagttgacgctcgccagcgagcacagaggacgttagaaagaggatcgaacacggtgagagtatctagttatccacagagattccaatcaagcttacggcccgggaagcgtcgtagacatggggaatgcactcgcaatcataaccacaatcatcgtgagcaagaggatgaagaagaaaatcataaaaaaggtcttggaggagatcgaaaaaaagaaccgcgagacgcaagccagcaacaacgccgtggaagatgcggtgatcgaggtcgggccagtcgagacgttcctgaatcagatcctgaacgagaagccgatgcgtttcagctccgagcaactggcggcctgcacccggaactactcgtcggagctgggatccggcggctacggcacggtctacaagggtgagctcccgaacggcctgctggtggccgtgaaggtgctcaaggtgtccatgaacaagaaggtgcaggaggcgttcatggcggagatcggcactataggccggacgtaccacgtgcacctcgtccgcctctacggcttctgcttcgacgcgaacaccaaggcactagtctacgagtatttggagaaggggtcgctggagaagtacctttactacggcgacgtggagtgcagcacgagcacgggcaaaaggcttgagtggggaacgctgcacggcatcgccgtcggcacggcgaaggggatcaggtacctgcacgaggagtgccagcagcggatcgtgcactacgacatcaagccggccaacatcctgctcacggccgatgacaccccgaaggtggccgacttcgggctggcacgactgggcgagcgcgaggacacgcacatgtcgctgaccggcggcggccgcgggacgcccgggtacgcggcgccggagctgtggatggcgctgccggcgtcggagaagtgcgacgtgtacagcttcgggatggtgctgttcgagatcctggggcagcgcaggaactacgacccctgccggggcgagagcagagagtggttcccgagatgggtgtgggagaggtacgagcagggtgagattgagtacgtcgtgtcgtgcgatgggatcggggaggcggacatggagaaggcagagatcatgtgcaaggtggcgctgtggtgcgtgcagttccagccggcggcgcggccgacgatgagcagcgtggtgcggatgctggagggggagatgccgattgtcccgcctgtgaacccattccactacgtcatggacagcagcagtggctcaactagctcggggctgtggagtgacacataccaaagtagcagagagaccattggcattgccatagacagtgagctatcggttagccctattgccaagtcgacttgattgtaagatgatgatcggactcatatgttgatgttgatgaaatcctgtactgtttgcttattataaacaaaaaaaggctgaggtttgtaaattagcatcatgcataagaatcaaagatatgcgagttgagtggattagtgtggtgtggcacatgtaggctatccctggctaataagctaagtaccgaaagatagagggcttgtttgacaata

SEQ ID NO: 1889 - DNA, 1979 bp, Sorghum bicolor
actcggaggaggtgacgggcgggcgagggcgaccaggactccaccgcaggaggaacccgaggaagacgctgacggaaccggacggatacgcacggcgccgcaaatagcatcattcaatgacatgtgggacccgaaacggaaagatttcggggcccacgtgtcggtgggtttgaggacggtatcgtcctcgtgccttctccgttataaggacgtctctggtaaggttttctctctctccgtctctcgcttcgccaacgccggcgagagctagggtttcgtgcgccaccgtaccgccaccgccacttccgcacgccatggccgagacccctacgtatcagatcctggtgcgtctcctcgacgggcgcaccagatgtctccgcttctccacgcccaccgtttccggcacggtgctcctcgacgccgtcgcgtcgatctctcgcgtacccgctgacgccctccgcctcgtcaccggccgcatcgacgtctcgccctcctccgtcctcacctcggcagctgatggccagttcccctacgcgtccgcgctcctccgccttcgaggaggcaagggcgggttcggctccctcctcagaggggccgcctccaaggcggggcagaagaagaccagcaactttgacgcctgccgcgacatcaacggccgccgcctccgccacgtcaacgctgagcgccgcctcgaggaatggaaggccgaggccgccgaccgccagctagaaaagctcgctgagaactttatcaagaagaaggccaaggaggcgggccgcagcggcggaccctcagctgccgaggtggacaagtacctggagaagtaccgcaaagatgctgagatctgcgtgaacgcggttgaggaatccgtgcgtgcatctcttggaaagaggaagaccgctcctaagctgccctctggcgcagacgctaagaagcttaagatttggttgggaaagaacaaagtagaagaagatgaaagtgatagtgacagtgacattgacagtgatgtagatgatgagaacagtgaagatcatgagaacacagatgcaaaatctgtactagttgatgacgggaattgctcaaatggatccagcaaaaatgaaaagcttgaactgggttctgtttctgggtcacattcagaaggagagtcctcaggggaaaagtcccaactgacaacaagatcaggagctgaaggtggtgacttcgaatctgatggtagtgcagagcctgaggtaggaatggtggatcatctcatttctgtgaacagtgctgctgctgctgcttcagaagaagtgctgaaatcagatgaagtgacagcagatgaggataacactgcttcagctacttcaaaccaaagcaatccaggggtaccacaagttgaagaagcgctgaaagcagatgaggataaagctgcttcagctacttcaaaccaaaacaatccagaggtgccacaattagaagaatatgctgacgccagcaaatcttattcagagccattggaccttgcaaagtacagttcagctgcagaattggaggtgcttggtctggagaagctaaaaatagagctgcagtcccgcggattaaaatgtggtggaactttacaggagcgagctgcccgactcttccttctgaagacaactccattggataagttaccaaagaagctgcttgcaaaggccactactggggggaagtgagaagctgtcgcaacatataaacaagtactagaggtggaatgcttaagtttttctttggcaatatatggaaatatgttgtgtaatcatgtgttataagcccttggcttggcattgacaattaatgagatgactgtatgtacgtatatgttaaccgttacttggaagagccccaagtttggactggatttgtgatgccttaaaacttttttacaaaaaaaaagggggtatataaaccgttacttggaaattgaatgaagtttggcatttcgttgcctggtatat

SEQ ID NO: 1890 - DNA, 1664 bp, Saccharum officinarum
ctcgcttcgccaacgccggcgagagctagggtttcgtgtgccaccgccacttctgcccgccatggccgagacccccacgtatcagatcctggtgcgtctcctcgacgggcgcaccagatgtctcagcttctccacgcccaccgtttccggcgccgtgctcctcgacgccgtcgcgtcgatctctcgcgtccccgccgccgccctccgcctagtcaccggccgcatcgacgtctcgccgtccaacgtcctcacctcagcagctgatggccagttcccctccgcgtccgcgctcctccgccttcgaggaggcaagggcgggttcggctccctcctcagaggggctgcctccaaggcggggcagaagaagaccagcaactttgacgcctgccgcgacatcaacggccgccgcctccgccacgtcaacgccgagcgccgcctcgaggaatggaaggccgaggccgccgaccgccagctagaaaagcttgccgagaacttcatcaagaagaaggcaaaggaggcgggccgcggcggcggaccctcagctgctgaggtggacaagtacctggagaagtaccgcaaggatgctgagatctgcgtcaacgcggttgaggagtccgtgcgtgcatctcttggaaagaggaagaccgcgcctaagccgccctctggcgcagacgctaagaagcttaagatttggttgggaaagaacaaagtagaagaagatgaaagtgatagtgacagtgatgtggatgatgaggacagtgaagatgatgagagcgcagatgcaaaatctgtagtagttgatgacgggaattgctcaaatggatccagcaaaaatgaggaggagaagcttgatatgggttctgtatctgggtcacattcagaaggagagtcctcaggggaaaagtcccagcacagcaattcagaggaaaatgtaaaatgtgttcagtcaactgtggaactgacaacaagatcaggagctgaaggtggtgactttgaatctgatggtagtgcggagcctgaggtaggaatggtggatcatcccttttctgtgaacagtgccgttgctgctgcttcagaagaagtgaaagcagatgaggataacactacttcagctacttcataccaaaacaatacagaggtgccacaagttgaagaagcactgaaagcagatgaggataacactgcttcagctacttcaaaccaaaacaatccagtggtgccacaagtagaagaatgtgctgatgccagcaaatcttattcagagccattggacctttcaaagtacagttcagctgcagaattggaggtgtttggtctggagaagctaaaaatagagctgcaatctcgtggattaaaatgtggtggaactttacaggagcgagctgcccgactcttccttctgaagacaactccattggataagttaccaaagaagctgctcgcaaaggccactgctggggggaagtgagaagctgcagcaacatataaacaagtactaaaggtgcaatgcttaagtttttctttggcaatgtatgggagtctgttgtggtgtaatcatgtgttataagcccttagtttggcattgacaatgagatgtctgtatgtacgtatatgttaaccgttacttggaagccctaagtttggactaggatttgtgatgcctc

SEQ ID NO: 1891 - DNA, 1669 bp, Zea mays
ccgggcccacgtgccggtatcgtcctcatgctttctccgcccaaggacgcctctggtaaagttctctcttcccctctcgcttcgcttcgccaacgcctgcgagagctagggtttcgtgcgccactgccacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctccgcatcgtcaccggccgcttcgacgtctcgccctccaacgtcctcacctcatcagctgatggccagttcccctccgcctccgcgctcctccgccttcgaggaggcaagggcgggttcggctccctcctcagaggggccgcctccaaggcggggcagaaaaagactagcaactttgacgcctgccgcgacatcaacggtcgccgcctccgccacgtcaacgctgagcgccgcctcgaggaatggaaggccgaggccggggaccgccatctagaaaagctcgccgagaacttcatcaagaagaaggccaaggaggcgggccgccgcggcggaccctcagctgctgaggtggacaagtacctggagaagtaccgcaaggatgctgagatctgcgtcaacgcggttgaggaatccgtacgtgcatctcttggaaagaggaagaccgcccctaagccgccctctggcgcagacgctaagaagcttaagatttggttgggaaagaacaaagtagaagaagatgaaagtgatagcgatagtgacagtgacatggatgatgaggacagtgaagatcaggagagcgcagatgcaaaatctctcgtagttgatgaaggcaattgctcaaatggatccataaaaaatgagaaacttgatctgggttctgtttctggatcacattcagaaggagagtcctcaggggaaaagtcccaaccgacaacaaaatcaggagctgaaggtggtgactttgaatctgatggcagtgcagagcctgaattaggaatggtggatcatcccattcctgtgaacaatgctgttgctgctgcttcagaagaagtgctgaaatcagatgaagtgacagcagatgaggataacactacttcagcaacttcaaaccaaaacaatccagtggtaccacaagttaaagaagcgctgaaagcagacgaggataacagtgcttcagctacttcgaaccaaaacaacccagaggtgcccaaagtagaagaatatgccgatgccagcaaatcttattcagagccattggaccttgcaaagtacagttcagctgtagaattggaggtgcttggtctggagaagctaaaaatagagctgcaatctcgtggattaaaatgtggtggaactttacaggagcgagctacccgactcttccttctgaagacaactccattggataagttaccaaagaagctgcttgctaaggccgctattggggggaagtgagaagctgtataaacaagtactgatggtgcaatgcttaagttttttctttgacgatgtatggaaatctgttgtggtgtaatcacgtgttacaagcccttggtgtggcattgacgattaatgatgtgtctgtatctacgtatatg

SEQ ID NO: 1892 - DNA, 364 bp, Triticum aestivum
aattgcagctagttgtttgcaccatggcgcagtactactcggaggtggaccactgcgcggaggagatgaactggccgccgcacgccggcggcgagcactacgccgtcaggagggagtcgtacgaggaggtggacgagatggcgcgcgcaggcagggggcaccaccacggcggcggcggcggcggccacctgggctacagcggcagccgccacggtgatgcccatctgggcggccaccgggaggagcacctcgtccacggtgacgagcaccgccacggccacggcggcgggcgccagtacgactcctgcaccggccagtactacggctgagcacgtacgaggctgcagtttctgtatgactacta

SEQ ID NO: 1893 - DNA, 423 bp, Triticum aestivum
aattgcagctagttgtttgcaccatggcgcagtactactcggaggtggaccactgcgcggaggagatgaactggccgccgcacgccggcggcgagcactacgccgtcaggagggagtcgtacgaggaggtggacgagatggcgcgcgcaggcagggggcaccaccacggcggcggcggcggcggccacctgggctacagcggcagccgccacggtgatgcccatctgggcggccaccgggaggagcacctcgtccacggtgacgagcaccgccacggccacggcggcgggcgccagtacgactcctgcaccggccagtactacggctgagcacgtacgaggctgcagtttctgtatgactactatgtgtgagtgtgcgtgtgcacggtcgtgtacatggtgtgtgtgtgcgcgctgacgcacg

SEQ ID NO: 1894 - DNA, 949 bp, Panicum virgatum
gtttatctacgcatcgcgcgctgcaacggccaacggggggcgctgccattgtatacgtgctcgaacggtcgaacctgctcgtgcactccagcatctcaagttctcatagcgagaggggagagagcggcagaggtgggagggaggaagatgagcggcagcgtggagacgcaggcgcgggcgttcgcggacgaggtgcgcggcggcgccctggaggcgaagaactggatgctggacctcggccacccgctcctcaaccgtgtcgccgagagcttcgtcaaggccgccgggatcggcgcggtccaggcggtcgcgagggagtcgtacttcatggccatcgaaggcgagggaggatcggtgtccggcgccaccggctcgaggaaacgctcgttcccggaactcaatgggacgaacagtggtagcaagtcggccgaggccatggtgaaaaacgtgagcaaagagtcgttgcagtggggactcgcggctggcgtgcactccggcctgacctacggcctgacggaggtgcgcgggacgcacgactggcgtaacagcgccgtggccggcgccatcacgggcgccgccgtcgcgctcacgtcggaccgcgcgtcgcacgagcaggtcgtgcagtgcgcaatcgccggcgcggcgctctccacggccgccaacgtgctctccggcatattctgaatccgtcctgagcccgccggccgaagctatgttgcgctggatgttgcgcaccctaatgttgccatcgctatgttcttagtagtagtagtagccccccttatacgataatttggggtgttgcatcaatgtgtcgcggatgctttcagctacagcatcttgtaagcggactagatgacattgatttgtcgttaccgtcgccgatatatctgttgctgcggctattgagcctcccgtggcagatcatgagttcatgaccgtcttcaaa

SEQ ID NO: 1895 - DNA, 822 bp, Setaria italica
agctagccatcactgcaagcgtgcactgccatctgcattcacctgtgcacttcagcagcgcagcaagccaagagggagagcggcagagaggaggaactcaggaagatgagcggcagcatggagacgcaggcgcgggcgttcgcggacgaggttcgcggcggcctggaggggaagagctggatgctggacctcggccacccgctcctcaaccgcatcgccgagagcttcgtcaaggccgccgggatcggcgcggtccaagcagtcgcgagggagtcgtacttcatggccatcgaaggcgagggaggatcggtgtctggcgccaccggctcgaggaaacgctcgttcccagaactcaatgggacgaacagtggtagcaagtcggctgaggccatggtgaaaaacgtgagcaaagagtcgttacagtggggactcgcggctggcgtgcactccggcctgacctacggcctcacggaggtgcgcgggacgcacgactggcggaacagcgccgtggccggcgccatcacgggcgcggcggtcgcgctcacgtcggaccgcgcgtcgcacgagcaggtcgtgcagtgcgccatcgccggcgccgcgctctccacggccgccaacgtgctctccggcatattctgattcgtctgagcccgccagtgatgggagggtgcactgcaccgtcatggggccatcgttatgttcctagtagcccacttcgacgataatttgggttgttgtatcatggatgctctaagctatcttgtaagcggaccggaagaaatggctatggattcgtcattacgtgcgccgctgtgtctgttc

SEQ ID NO: 1896 - DNA, 979 bp, Pennisetum glaucum
actgccatttgcattcacctgtgcactttcagcgctgcaagagcgagagagcggcggaggacaggaggagctcgatcgggaagatgagcggcagcatggagacccaggcgcgggcgttcgcggacgaggtgcgcggcggcctggaggggaagaactggatgctggacctcggccacccgctcctcaaccgcatcgccgagagcttcgtcaaggccgccgggatcggcgcggtccaggcggtcgcgagggagtcctacttcatggccatcgaaggcgagggaggatcggtgtccggcgccaccggctcgaggaaacgctcgttcccagaactcaatggaacgaacaatggtagcaagtcggctgaggccatggtgaaaaacgtgagcaaggagtcgttacagtggggacttgcggctggcgtgcactcgggcctgacctacggcctcacggaggtgcgcggggcgcacgactggcggaacagcgccgtggcaggcgccatcacgggcgcggccgttgcgctcacgtcggacggcgcgtcgcacgagcaggtcgtgcagtgcgccatcgccggagctgcgctctccacggccgcaaacgtgctctccggcatattctgattcgtctgagcctgcgggtgatggagggtgtactgcactgtcatggcgccatcgttatgttccaagtagagttgtagtagacttgtagaccacttctacgatagtttgaggtgttggatcatggatgcgtgaagctattatcttctaatgtaagcgagttggaggaaacgcgtgctgctgtacctgctcgagctacgactagtgttttgatggcaaatcatgagcagacttctcagtgtcgtgagccgaatctggtggtgttcatcatccttgagttttgttgcatgattatcaagaaaattaggtgattgtactataggaatggttataactagatgccgattactttgattgaaaattag

SEQ ID NO: 1897 - DNA, 862 bp, Pseudoroegneria spicata
catttctccgtagcttagctttgctagcagagcagaggaaaaggagcaaagatgagcagccaggaggcgcgcaagtttgtggaggaggtgcgcggcctggagaagaactggatgctcgacctcggccaccccctcctcaaccgcgtcgccgacagcttcatcaaggccgccgggatcggcgcgatacaggccgtcacacgggactcctactttatggccatcgaaggcgagtctgggggcaccggagcggtgtcggacgccaccggcagcaggaaacggacgttcccggacctcaatggagggacgagcaacagcaagtcagcggaggccatggtgaaaagcgtcagcaaggagtcgttccagtgggggctcgcggccgggatgcactccggcctcacctacggcctggcggaggtgcgcgggacccacgactggaagaacagcgcggtggcgggcgccgtcaccggcgcggctgtcgcgctgacctcggacaacgcttcgcacgagcagattgtgcagtgcgccatcacaggcgccgcgctgtccgccgccgccaacgtgctctcggacatagtttagggagttcattcataccacccgatggcccggcggaaggcgagcggtagtagtatgcggaatggacttgtttaggtgacgtgttgttgcgacttgcgagcgcacttgtcctgtgtttccttcttacgatctcggtgtagccagttcaaataatactcctttcgtacagaaaggttgggcgctattcgcagcgtcgttgatgttgttaggatttcatcaagataaaaattggtttgtcaaacgggaaagatgaagtcttcttttataaaatgcggtgttctagtaa

SEQ ID NO: 1898 - DNA, 931 bp, Triticum aestivum
  misc_feature (15)..(15): n is a, c, g, or t
gaattcggcacgagnacgcatagcttgcagtgcttgtgcatttctccgtagcttagcttggctagcagagcagaggaaaaggagcaaagatgagcagccacgagacgcgcaagttcgtggacgaggtgcggggcctggagaagaactggatgctcgacctcggccaccccctcctcaaccgcgtcgccgacagcttcgtcaaggccgccgggatcggcgcgatacaggccgtcacgcgggactcctacttcatggccatcgaaggcgagtctgggggcaccggagcggtgtcgggcgccaccggcagcagcaaacggacgttcccagacctcaatggagggacgagcaacagcaagtcagcggaggccatggtgaaaagcgtcagcaaggagtcgttccagtgggggctcgcggctgggatgcactccggcctcacctacggcctggcggaggtgcgcgggacccacgactggaagaacagcgcgctggcgggcgccgtcacaggcgcggcggtcgcgctgacctcggacaacgcttcgcacgagcaggttgtgcaatgcgccatcaccggcgccgcgctgtcggctgccgccaacgtgctctccgacatagtttagggagtgcattcgtatcataccacccgatgccccggcggaaggcgagcggtagtagtatgcggaatggacttgtttaggtgacgtgttgttgcgacttgcgagcgcacttgtcctgtgttcccttcttacgatcttttttttttctttcaaaacggtccttacttacgattctcggtgtagccagttcaaataataactgccatatctcctttcatacagaaaggttggacgctattcgcggcgtctttggtagtggttaggatttcaggaagataaaaattggtttgaccaatgggaaagagtgttctttttat

SEQ ID NO: 1899 - DNA, 723 bp, Triticum aestivum
  misc_feature (83)..(83): n is a, c, g, or t
  misc_feature (194)..(194): n is a, c, g, or t
  misc_feature (197)..(197): n is a, c, g, or t
  misc_feature (232)..(232): n is a, c, g, or t
  misc_feature (271)..(271): n is a, c, g, or t
  misc_feature (299)..(299): n is a, c, g, or t
  misc_feature (305)..(305): n is a, c, g, or t
  misc_feature (326)..(326): n is a, c, g, or t
  misc_feature (692)..(692): n is a, c, g, or t
  misc_feature (695)..(695): n is a, c, g, or t
agcagagcagaggaaaaggagcaaagatgagcagccatgaggcgcgcaagttcgtggaggaggtgcggggcctggagaagaantggatgctcgacctcggccacccgctcctcaaccgcgtcgccgacagcttcgtcaaggccgccgggatcggcgcgatacaggccgtcacgcgggactcctacttcatggcnatngaaggcgagtctgggggcaccggagcggtgtcggncgccaccggcagcaggaaacggacgttcccggacctcantggagggacgagcaacagcaagtcagcngaggcnatggtgaaaagcgtcagcaangagtcgttccagtgggggctcgcggccgggatgcactccggcctcacctacggtctcgcggaggtgcgcgggacccacgactggaagaacagcgcggtggcgggcgccgtcaccggcgctgcggtcgcgctgacctcggacaacgcttcgcacgagcgggttgtgcagtgcgccatcaccggcgccgcgctgtccgccgccgccaacgtgctctccgacatagtttagggagttcattcatatgataccacccgatggcccggcggaatggacttgtttaggtgacgtgttgttgcgacttgcgagcgcacttgtcctgtgtttccttcttacgatctcggtgtagccggttcaaataataactgncanatctcctttcatacagaaaggttggacg

SEQ ID NO: 1900 - DNA, 914 bp, Triticum aestivum
acgcatagcttgcagtgcttgtgcatttctccgtagcttagcttggctagcagagcagaggaaaaggagcaaagatgagcagccacgaggcgcgcaagttcgtggacgaggtgcggggcctggagaagaactggatgctcgacctcggccaccccctcctcaaccgcgtcgccgacagcttcgtcaaggccgccgggatcggcgcgatacaggccgtcacgcgggactcctacttcatggccatcgaaggcgagtctgggggcaccggagcggtgtcgggcgccaccggcagcagcaaacggacgttcccagacctcaatggagggacgagcaacagcaagtcagcggaggccatggtgaaaagcgtcagcaaggagtcgttccagtgggggctcgcggctgggatgcactccggcctcacctacggcctggcggaggtgcgcgggacccacgactggaagaacagcgcgctggcgggcgccgtcacaggcgcggcggtcgcgctgacctcggacaacgcttcgcacgagcaggttgtgcaatgcgccatcaccggcgccgcgctgtcggccgccgccaacgtgctctccgacatagtttagggagtgcattcatatgataccacccgatgccccggcggaaggcgagcggtagtagtatgcggaatggacttgtttaggtgacgtgttgttgcgacttgcgagcgcacttgtcctgtgttcccttcttacgatcttttttttttctttcaaaacggtccttcttacgatctcggtgtagccggttcaaataataactgccatatctcctttcatacagaaaggttggacgctattcgcggcgtctttggtagtggttaggatttcaggaagataaaaattggtttgaccaatgggaaagagtgttctttttat

SEQ ID NO: 1901 - DNA, 1755 bp, Saccharum officinarum
ccactgggaccatgcagagcaccgtgaagctcgcggtgctagctctactgctagcggcagcagctcaccatggtctgctgccgctgccgacggcgcgatgctactggctcaacccggagatctacgacgccggcgggctgagccgccgcgcgttcccggagggcttcgtcttcgggacggccgcgtcggcgtaccaggtcgaggggatggccaagcgcgggggccggggccccagcatctgggacgccttcatagaggtacctgggaccatccctaacaatgccaccgctgatgtaacggtcgacgagtatcatcggtacaaggaagatgtgaacataatgaagaacatgggctttgatgcgtaccggttttcgatttcttggtcgaggattttcccaaatggaactggcaaggtgaaccaggaaggagtggattactacaacaggctcatagattatatgcttcagcaaggtatcacgccatatgcaaatctctaccattatgacctcccattggcactccatgaacagtacttgggctggcttagcccaaagattgtggaggcgtttgcagactacgccgagttctgcttccagacttttggagacagggtgaagaactggtttaccttcaacgaaccgaggtgcgtcgctgctctgggctacgacaatggcttgcacgcaccgggaaggtgttccgagtgtgctgccggaggcaactccacgacggagccgtaccttgctgcacatcatctcatcctttctcatgcagctgcggtgaggcgataccgcgacaagtatcagctttaccaaaaggggaggattggaattctcttggatttcgtgtggtacgaacctttcagcgacagcaatgcggaccaggctgcagcacagcgagccagggacttccacctaggctggttccttgaccccattataaatggacggtacccgtactcgatgcaagagattgtcaaagacaggctgccattgttcagcgatgaagaatccaggatggtgaaaggctctatagactatgttggcatcaaccactacacttctttctacatgaaggaccctgggacatggaacctgacgccagtcagctaccaggatgattggcatgttggttttgtctacgaacgaaacggcgttcctattggagctcatgcaaactcctactggctgtacattgtgccgtggggaatcaacagggctgtcaactatgtcaaggaaacttatgaaaatcctacaatgatccttgctgaaaatggaatggaccaagctggtgatgtcagtattactcagggtgttcatgacacagtaagaattcgctattacagagactacataactgagctcaagaaggcaatagatggcggtgccagagtcattgggtactttgcgtggtcgctgcttgacaacttcgagtggaggcttgggtacacttcacggtttggcttggtctatgtggactacaagacgctgaagaggtaccccaaggactcagctttctggttcaagcatatgctctccaagaagaggagctagaatttcaaacaagaggaccaatggcttcaggtgtcacacaaaagttcactctgcatatcctcttagtatgtcagatttagcttaagaaaccatgcagatgattgagtctcaagactcgacatctctaacttagttaattgttgcaaggcaataaattggtatctttgaaaaccttgatcctccataatagaacaaatagaagcac

SEQ ID NO: 1902 - DNA, 1754 bp, Sorghum bicolor
ccactgggaccatgcagagtaccgtgaagctcgcggtgctcgctctactgctagcggcagcagctcaccacggtctgctgccgctgccgacggcgctatgctactggctcaacccagagatctacgacgccggcgggctgagccgccgcgcgttcccggagggcttcgtcttcgggacggccgcgtcggcgtaccaggtcgaggggatggccaagcacgggggccggggccccagcatctgggacgccttcatagaggtacccgggaccatccctaacaatgccaccgctgatgtgacggtcgacgagtatcatcggtacaaggaagatgtgaacataatgaagaacatgggctttgatgcgtaccggttttcaatttcttggtcgaggattttcccaaatggaactggcaaggtgaaccaggaaggagtggattactataacaggctcatagattacatgcttcagcaaggtatcacgccgtatgcaaatctctaccattatgacctcccattggcactccatgaacagtacttgggctggcttagcccaaagattgtggaggcgtttgcagactacgccgagttctgcttccagacgttcggagacagggtgaagaactggtttaccttcaacgagccgaggtgcgtcgctgctcttggctacgacaatggcttacacgcaccgggaaggtgttccgagtgcgctgccggaggcaactccacgacggagccgtaccttgctgcacaccatctcatcctttctcatgcagctgcggtgaggcgataccgcgacaagtatcagctttaccaaaaggggaggattggaattctcttggatttcgtgtggtatgaacctttcagcgacagcaatgctgaccaggctgcagcacagcgagccagggacttccacctaggctggttccttgatcccataataaatggacggtatccgtactcgatgcaagagattgttaaagataggctgccgttgttcagtgatgaagaatccaggatggtgaaaggctctatagactacgttggcatcaaccactacacttctttctacatgaaggaccctgggacatggaacctgacgccagtcagctaccaggatgattggcatgttggtttcgtctatgagcgaaacagcattcctattggcgctcatgcaaactcctattggctgtacattgtgccgtggggaatcaacaaggctgtcaactatgtcaaggaaacttatgaaaatcctacaatgatccttgctgaaaatggaatggaccaacctggtgatatcagtattactcagggtgtgcatgacacaataaggatccgttactacagagactacataactgagctgaagaaggcaatagacgatggtgccagagtcatcggttactttgcgtggtcgctgctcgacaacttcgagtggaggcttgggtacacttcgcggtttggcttggtctacgtggactacaagactttgaagaggtaccccaaggactctgctttctggttcaagcatatgctctcaaagaagaggagctagaattgcagataaggggaccaatggcttcaggtgtcatacaaagttcactctgcatatcctcttagtatgtcagatttagcttaagagaccatgcagatgattgagtctcaagactcgacaactctagctctgttaattgttgcaaggcaataaattggtatctttgaaaaccctgagcctccataatagaacaagtagaagcac

SEQ ID NO: 1903 - DNA, 1808 bp, Zea mays
tcgccggccaacagcggcataggagatgggggtagccggcaggtgctcgccgtccctcttttactagccttcggaaagcgcggcctggagtccggggccatgcagagctccgtaaagctcgcggtgcttgctcttctgctagcggcagcagctcaccacggtctgctgccgctgccgacggcgcgatgctactggctcaacccggagatctacgacgccggcgggctgagccgccgcgcgttcccggacggcttcgtcttcgggacggccgcgtcggcgtaccaggtcgaggggatggccaagcacggcgggcggggccccagcatctgggacgccttcatagaggttcccgggaccatccctaacaatgccaccgctgacgtgacggtcgacgagtatcatcggtacaaggaagatgtgaacataatgaagaacatgggctttgatgcgtaccgattttcgatctcttggtcgaggattttcccagatggaactggcaaggtaaaccaggaaggagtggattactacaacaggctcatagattacatgctccagcaaggtatcgcgccgtatgcaaatctctaccattatgacctcccattggcactccatgaacagtacctgggctggcttagcccaaagattgtggaggcgtttgcagactacgccgagttctgcttccacgcgttcggagacagggtgaagaactggtttaccttcaacgagccgaggtgcgtcgctgctctgggctacgacaatggcttgcacgcaccgggaaggtgttccgggtgccccgccggaggcaactccaccacggagccgtaccttgtcgcacaccatctcatcctttctcatgcagctgctgtcaggcgataccgcgacaagtatcagcttcaccagaaggggaagattggaattctcctggatttcgtgtggtacgaacctttcagcgacagcaatgcggaccaggctgcagcacagcgagccagggacttccacctaggctggttccttgaccccattgtacatggacggtacccgtactcgatgcaagagattgccaaagacaggctaccgttgttcagcgatgaagaagccaggatggtgaaaggctctatagactatgttggcatcaaccactacacttctttctacatgaaggaccctgggacatggaacctgacaccagtcagctaccaggatgattggcatgttggttttgtctacgaacgaaatggagttcctattggcgctcacgcaaactcctactggctgtacattgtgccgtggggcatcaacaaggctgtcagctatgtcaaggaaacttacaaaaatcctacaatgatccttgctgaaaacggaatggaccaacctggtgatgtcagtattactcagggtgtgcatgacacagtaagaatccgttattacagagactacataactgagctcaagaaggcaatagatgatggtgccagagtcattgggtactttgcgtggtcgctgcttgacaacttcgagtggaggcttgggtacacttcgcggtttggcttggtgtacgtggactacaagactctgaagaggtaccccaaggattcagctttctggttcaagcatatgctgtccaagaaaaggagctagagaattgcagacaagaggaccactggcttcacgtgtcatacaaaagttcactctgcaaatcctcttagtatgtcagatttagcttaaggaaccgtgcagacaattgagtctcaaggctcgacatctctagcttcgttaattgttgcaaggcaataaattggtatcttcga

SEQ ID NO: 1904 - DNA, 1796 bp, Brachypodium distachyon
actctcccttctcctacaaagctccgcagctcaccgcagagcaaggcttcttcttcttcttcttcttctgtgtcttcagtccatagttgcttcctagctctccgtgcaggcatgaagtccacagcactggtgctgctaacactggcagcccatgtgttgctggcgcagtgccaccggccggagatccacgacaccggcgggctgagccgcggcgccttcccggagggtttcgtgttcgggacggccgcgtcggcgtaccaggtggagggcatggcgaaaaggggtggccgagggcctagcatctgggacgccttcatagagattccagggatgatctccggcaatggcaccgccgacgtggcggtcgatgagtatcataggtacaaggaagatgtggacataatgaagagcatgggctttgatgcataccgattttcgatctcctggtcgaggatttttccgaatggagctggaaaggtgaaccaggaaggagtggattactacaacaggctcatagattacatgcttcagcaaggcatcactccatatgcaaacctctatcactatgacctcccactggcactccatcagcagtacctaggctggctaagcccaaagattgtggaggcgtttgcggactatgccgatttctgcttcaaggtgttcggggacagggtgaagaactggtttacattcaatgagccgaggtgtgttgctgctctgggctacgacaatggctaccatgcaccgggtaggtgttctcagtgcactgcaggaggcaactcgatgacggagccataccttgtcgcgcaccatctcatcctttctcatgctgctgcagtgaagcggtaccgcgagaagtaccagcatcaccaaaagggaaagatcggaattctcttagattttgtttggtacgaacctcttagcaagagcaaagcggaccaagctgcagcacagagggcaagggacttccaccttggatggttccttgaccccattgtccatggtcagtacccagagtcgatgctcaagattgtcgaaggcaggcttccgacattcagccacgaggagtcaaggatggtgaaaggctcaatggactatgtgggtatcaaccactacacttcttattacatgaaggaccctggggcatggaacctgacgccggtcagttaccaggacgattggcatgttggatttgtctatgaacgaaatggtgtgcctattggagctcgtgcaaactcctactggctttacattgtgccatggggaatcaacaaggctgtgacctatgttaaggaaagatacggaaatcctacaatgttcctttctgaaaacggaatggaccagcccggtaatgtgagcatcactgagggagtgcacgacacagtaagggtccggtactatagagagtacataactgagctgaagaaggtgatagacgatggagccagagttattgggtactttgcatggtctctgcttgacaacttcgagtggagactcggctacacttctcgatttggcatcgtctatgtggactacaagactctgaagaggtaccccaaggactcagccttctggttcaagaacatgctctccaagaagaggagctaggatagaaaacaagacccaagaggatcaagtgcttcagctttcagaacaaatccaaccgtagcgtatgttcatctaagcacatcagatttagccttaagaaacttggaataataagcgtcccggtagtttctttgccagttcatacaatgcaatgagaaataaagagatctgttttaaaagtc

SEQ ID NO: 1905 - DNA, 1641 bp, Setaria italica
atctacaacacaggcgggctcagccgccgcgcgttcccggcggggttcgtcttcgggacggccgcgtcggcgtaccaggtcgaggggatggccaagcagggaggccgggggcctagcatctgggacgccttcatcaaggtaccagggacgatccctgacaatgccacggctgatgtggcggtcgacgagtatcatcgatacaaggaagatgtgaacataatgaagaacatgggctttgatgcataccggttttcgatctcttggtctaggatcttcccgaatggaactggtgaggtgaaccaggaaggagtggattactacaacaggctaatagattacatgattcagcaaggaatcaccccatatgcaaacctctaccactatgacctcccgttggcactccatgagcagtaccttggctggcttagcccaaagatcgtggaggcgtttgcagactatgcagaattctgcttccagatgtttggagacagggtgaagaactggtttaccttcaacgagccgaggtgcgtcgcggccctgggctacgataatggcttacacgcaccaggaaggtgttctggatgtgctgctggagggaactccactacagagccgtaccttgtcgcgcatcatctcatactttctcatgcagctgcggttaagcgataccgtgataaatatcagctctaccaaaaggggaggattggaattctcttggattttgtgtggtacgaacctttcagtgacagcaacgcggatcgagctgcggcgcagcgagccagggacttccacctcggctggttcctcgaccccattgtaaacggacggtacccatactcaatgcaagagattgtagaggatagactgccattgttcagtgatgaagagtccaggatggtgaaaggctccatagactatgttggcatcaaccactacacttctttctacatgaaggaccctggtacatggaacctgatgccgatcagctaccaatatgattggcatgctagttttgtctatgaaagaaacggtgtccctatcggcgctcatgcaaactcctactggctgtacattgtaccatggggaatcaacaaggctgtcaactatgtcaaggaaacctatgaaaatcctataatgatccttgctgaaaatggaatggaccaaccaggtaacatcagtatttctcagggtgtgcacgacacgataagaattcgctattacagagactacataacagagctcaagaaggcgatagatgatggtgccagagtcattgggtactttgcgtggtcattgcttgacaacttcgagtggaggcttgggtacacttcccggttcggcctggtctatgtggactacaagacactgaaaaggtaccccaaggattcagctttctggttcaagcacatgctctccaagaagaggagctagaattgcggacaagagggccaatggtttcaggtgtcacacaaaagttcactctgtacatctaactcctagatgtcagattagctttaagaaaccgtgcaaataatagtgtttcgatctcgacatctctagatttgtcaattgttgcaatactaaaataataaagtggtgccttcaaacaccttgagcctcaatgacagaactagtagaagc

SEQ ID NO: 1906 - DNA, 812 bp, Triticum aestivum
gctagccactgatcagaagaacacctcgatctctgagagtgttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccgccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcaccggcaccggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgctgccggcgacggccgccacgtcaccttcctgaataataagatgagctagccgagcgcaataaaaggaaaaaaaaatgttactgtcgtgtgatgagtgtgaatgtgtgatggcgttctccagtgcggaccgtgtctgcgtgttgtttgtactgtgaaagtacgctgtgtatgtacgtcgtatgtgtacaattccgctttgttgaaatacgtatcgaatatatactgtgtgta

SEQ ID NO: 1907 - DNA, 835 bp, Triticum aestivum
  misc_feature (7)..(7): n is a, c, g, or t
  misc_feature (10)..(10): n is a, c, g, or t
gagggcnagngctaagtgagctagccactgatcagaagaacacctcgatctctgagagtgttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccgccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcaccggcaccggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgctgccggcgacggccgccacgtcaccttcctgaataatagatgagctagccgagcgcaataaaaggaaaaaaaaatgttactgtcgtgtgatgagtgtgaatgtgtgatggcgttctccagtgcggaccgtgtctgcgtgttgtttgtactgtgaaagtacgctgtgtatgtacgtcgtatgtgtacaattccgctttgttgaaatacgtatcgaatatatactgtgtgtacctta

SEQ ID NO: 1908 - DNA, 1951 bp, Zea mays
ctgtgttcaagcgcgatcatcatgattcgtgatgacgaggcagaggtacctctccagccagcctccaggacgacaaggcgacgacctgggatctgacaattccaaattccaacgcgctaagctgccaacgtcgccgcagcggcagcacctcaaacgtacgtcgccgcagcagctcagacgtgcgccgctaccacgtgtcctgccgcacgccccgcgtcagcggcatctgtaaagccgcttgtcgccgccccggcgcccaccccgcccccgcgcttttattccccacttcaccgcatctccccctcgtctacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaagggagggcccgggcttgagggactggtggtggggagctactgccacgatgtgctaatccggggcgggcgcatagtgggggagacgctcggcggggctgcggccttcgtgtccaacgtgctcgacgccgcttcgccccagggcgccgcgctcaacgagacatccccctttgtcgttgtggccaaggtgggtcacgacttcatctacgcccgcgcgccggcgtccgcgcggcatccgcctctgctctgctcgtccccaaccacctccttccacgcccagttctcggagaccgccgcctcggcgcacgcccccgaccgggagctccggcgcgtgcgcgcctgcgacccgatctaccccgccgaccttcccgaccgccgcttcgcctacggcctcgctgtcggcgtcgccggggaggtgctaccggagacgctcgagcagatgatcaggctctgccgcacggtgctcgtggacgcgcaggcgctgatccgggcgttcgacggtgacggcgccgtcggtcacgtggcgcttggcgataccccgtacgcgcggcttctgccccgagtggcgttcgttaaggcgtcgtcggaggaggcgccatacgttggggtggaaacgacgaggcggcagtgctgtgtgatcgtcacggaggggagggacggctgccggctgtactgggacggtggggaggcgcacgttgcgccgttccccgccgtacaggtggaccctactggcgccggagacagttttctcgcgggctttgcagccggattgctgtgggggttgtcggcgacggacgccgcgctgctggggaacttctttggcgccgctgctgtatcgcaggtcggcgtgcccaccttccatcccaagatgttgcaggcagttaaagaaatacttgaagagaagacaaggaaacgatctagtccatgtatgaacggcgctagttttaccttggagaagtcaaatatgcacaacgagttacacgcagctctccaagaagctgcggtgctgatgtctgaacagcagcaggctgatccggcgaacggcagtggcggtgatatttgctcggcataggtacctcacagtgaagctgaagcagtcgaacgccaaactgaagtttgtggcaaaataaccagcactgcagtcctgaactcctgatctcacattgagatctgtaaacatggtgccaacaagtggaggaagtttgtacatacgctctctccggcctttacactactattctgctggcaaggccgtcagggatcgtttctaccttgctatcgctgacgaggaaatgaagacaactgaacagttgagctgtggcgcttgcacgcaccatgttttctccgctgaacaagtgcgcatttttgagctttcgggcattcgtgctgttaactttttaccattctatatgtcgacttctaccaaaaggtctagcgtttttaccctgactgaacacagggaaatttgtctgactg

SEQ ID NO: 1909 - DNA, 1488 bp, Setaria italica
ccgccgccgcccccgccgcgatgccgctcgcggcggaacccgacgacgcgcgtgaggaaatggagaatcatcagcagctgccgacgacggcgaagggagcgcccgcgctcgagggactggtggtggggagctactgccacgacgtgctgatccggggcgggcgcgtggtgggggagactctcggcggggccgctgccttcgtgtccaacgtgctcgacgccgcgtcgccccgggaggaggaggagcagggggaggccccgttcgtcgtggtctccaaggtggggcacgacttcgcctacgcctccgcgccggggcccgctcggcgcccgccgctgctctgcgcgtcgccgaccacatccttccacgcgcagttctccgacgccgcctcctcggcgcacgcccccgaccgggagctccggcgcgtgcgcgcctgcgacccgatctacccggccgacctccccgatcgccgctttgcctacggcctcgccgtcggcgtcgccggggaggtgctgccggagacgctcgagcggatgatccggctctgccgcgcggtgcttgtggacgcgcaggcgctaatccgggcgttcgacggcgacggcgccgtcggccacgtggcgcttgaagatacgccgtacgcgcggctcctcccgcgggtggcgttcctcaaggcgtcgtcggaggaggcgccgtacgtggggttggagacggcgaggcggcggtgctgcgtgatcgtcacggatgggagggacgggtgccggctgtactgggacggaggggaagcgcgcgtcgtgccgttccccgccgttcaggtggaccccactggcgccggagacagctttctggctggttttgcggcggggttgttgtggggcctctctgcaacggacgccgcgctgctggggaacttctttggcgccgccgctgtctcgcaggtcggcgtgcccactttccatcccaagatgttgcaggctgtcaaggaaatacttgaagagaagacaacaaaacgatctagtccatgtataaacggcactacttttaccttggagaggtcaaatgtgcacgatgagttacacgcagctctccaagaagcagcgaggctgatgtctgaacagcagcaagctgatccagcaaacggcaatggtggtgatatttgctcgacgtaggaactgaaatcaccgtgaagcagtcagacgccaaactttgtggcaaaataatgcagcactgaaatccagatttcacattgaggtctgtgtaaacacgtagccaacaagtgaagaaagtctgtgcacacgctgcctccagcttataccattatcctgatgatgagggtcgtttctgcctgtaatagctgatgagaaaagtgaagccaacctgatcagctgggctgtgacctgctgtgtttctgtgtacgctgaacgagtgtgctcttttgagctttggagcaacctacgtcgactcctaccaaaatctagcattttaccatgcctg

SEQ ID NO: 1910 - DNA, 2631 bp, Zea mays
gggcgctactgcggggccgtccttggcgagaggaggggaggggcccccgagggatcggttttcggcgggggagccagcggccgcgggcgaatggctggcggcgaggtagcggtcgtggaggaaacggcggtgggggcgccgactgcgacggcgacgccgcctgacttggcggcgcatgccgcggccggtggcggggaggaggcgatgcggatggagggctggctgtacctgatccgatccaaccgatttgggatgcagtactcgcgcaagcgctacttcgtgctcgaggacgccgcgctccgctgcttcaagtccacgccatcctccaagcgcgaggatcctgtcagaagtgcaataattgactcttgtattcgtgtgacagacaatggcagagaaagtgtacataggagtgacttttacatattcacactatataattcttccaatcattatgatcaacttaagttgggtgcgagaagttcagaagaagcagctaggtggatcaggtgcttaatggagtctgccttaaagtcacctagaaaagatgagcacattgttgcttgttcacacagaagatggcaggctttcaggttgagccgccgcaatagccgtatgcactcaatagattggactttattttcatctgctcataacgatccaatggcatctgatgtcattgcaccttctccatggacaatatttggctgtacaaacgggttacgtttgtttaccgaggcaaacgatggtggctctcatgggaagtattgggatgatcatccggctataatggcagttggtgtggttgatgcgaattccgaggctgtctttcagactctaatgtcccttggccaatcaagatctgaatgggacttctgtttgcgggaaggaaaggtaatcgagcatcttgatgggcatacagacataatccaaaagaaattaagaagcgactggttaccatggggaatgagaaagagagatctattacttagacgatattggaggcgagaagatgatggaacttatgtaattctataccactctgttttccactacaaatgtcgtcccgagaaaggctacatccgtgcatgtcttaaaagtggaggttatgtaatatcaccagtcaatcaaggaagacaatcagttgtaaagcacatgcttgccatagattggaaattctggaagtcttatctgtttacatcatctgccaaatatatcactatacgaatgttaggcagagtagcagcactacgagaattcttccgagcgaaaaatggtaattgttcttgcatggagttctcatctggagagttgaccagggacacgggattacctcaaggtgaaaatcagcgaataaatttggaaatgcagcaagaaaatgagaacggaagacttgaaggtcctactgaaggatcactgggtggttctaacaggcacttaagcagtactggttcctttgttcaactcaatgatgcagcagatgagttctttgacgtgccagacgaatcagaatatgatcagagagaagttatgtttccttctgatgagagcttgcatgctgcggaccagcgtcacgctaaactgtccactgctgctgtttttgtaaaaaggttgcatgatcttgcagttcagaaaagaggatacattgacttacagggagctgcagatgctgataatgggccatgttgctatggatatactcttcccaaagattcgagctatacagtgccttctacttgggcaatgacagatcctacaacattcttaatccggggagagacttatttgcacgatcgtataaagatcaaggcaaatagtaccctgatgcaaatggtaggtgctgactggataaaatctgataagcgtgaggatgatctagctggtcgccctggggggctagtccagaaatgtgcagcacaagggggcacccgattcttcttcattgtaaacattcaggttcctggttcaaccacatacagcttagctttgtattatatgatggatacaccattagaaaaggtccctctgcttgaaagatttgtaaatggagatgatgcattcagaaattcaaggttcaagctcattccttacatctcaaagggatcttggattgttaaacagagtgtgggcaagaaagcttgcttggttggacaagcattagaaatcaattattttcgtggaagaaactatttggagcttggagttgatattggttcatcaacggtggcacgaggtgtggtgagcctagtgcttggctacttgaacaatcttgtgatcgaaatggccttcttggtacagggaaacacaaatgaagaactcccggaattcctcctaggtacctgccgactgaattacctggatgcctccaaggcagtgtccatagacgagtgctaggaccccaactgacctcattttttaaagccaagtacaccaaaagacaaaaaaaaaaggctgaatccccattccttgctgccgacacaatcggcaaccctagcccagatgcccattttattgcctcaccgcaaaagtgggggatccattgcaaccgttgtacattctcttcttgccgactgctcaggtattgtgttgtaatgatgatagcaatccatgataaaagccccctcattctttggc

SEQ ID NO: 1911 - DNA, 2568 bp, Pennisetum glaucum
gcgccgccgccgcggcgaacggggaggaggggatgcggatggagggctggctctacctgatccgatccaaccgcttcgggctgcagtactcccgcaagcgctacttcgtgctcgaggacgccgcgctccgctgcttcaagtccgcgccatcctccaagcgcgaggatcctgttagaagtgcaataattgactcttgtatacgtgtgacagacaatggcagagaaagtgtacataggagtgatttttacatattcacactttataatgcttccaatcattatgatcaacttaagttgggtgcgagaagttctgaagaagcagctaggtggatcaggtgcttaatggagtctgccttaaagtccccaagaaaagatgagcacattgttgcttgttcacacagaagatggcaggctttcaggttaagccgccgcaatagccgcatgcactcaatagattggactctattttcatctgctcataatgatccaatggcatctgatgttatcgcaccttctccatggacaatatttggctgtaaaaatggtttacgtttgtttaccgaggcgaacgatggtggatctcatggaaagtattgggatgatcatccggctataatggcagttggtgttgttgatgcaaattctgaggatgtcttccagactctaatgtcccttagccaatcaagatctgaatgggacttttgtctgcgggaaggaaaggttgttgagcatcttgatggacacacagacataatccacaagaaattaagaggcgactggttaccatggggaatgagaaagagggacctattacttagaagatattggaggcgagaagatgatggaacttacgtaattctataccactctgttttccactacaaatgccgtcctgagagaggctacatccgtgcatgtcttaaaagtggaggttatgtaatatcgccaatcaatcaaggaagacaatcagttgtgaagcacatgcttgccatagactggaaattctggaagtcttatctgtttacatcatctgctaaatatatcacagtacgtatgctaggcagaatagcagcactgcgggaattcttccgatcaaaaaatggaaattgtgcttgcatggagttctcatctggtgagttaaccagggatatgagactgccacaaggtgaaaatggaagaataaatttagaaatgcatcaagaaaatgagagcagaagacttgagggccctactgaaggatcactgggtggttctgacagacatttaagcagtactggttcctttgttcaacttaacgatgcagcggatgagttctttgacgtgccagatgaatcagaatatgatcagagagaaattgtgtttccttctgatgagagcacacatgctgtggaccaacggcatgctaaattgtccactgctgctgtttttgtaaaaaggttgcatgatcttgcagtccaaaaaagaggatacattgacctacagggagctgcagatgctgataatgggccatgttgctatggatatactcttcccaaagattcaagctatacagtgccttctacttgggcaatgacagatcctacaacattcttaattcggggagagacatatttgcacgatcgtctaaagatcaaggcaaatagtaccctgatgcaaatggtaggtgctgattggataaagtctgataagcgtgaggatgatctagctggtcgccctggaggactagtccagaaatgtgcagcacaaggaggcaccaaattcttcttcattgtaaacatacaggttcctggttcaaccacatacagcttagctttgtattatatgatggatacaccattagaaaaggtccctctacttgaaagatttgtaaatggagatgatgcattcagaaattcaaggttcaagctcattccttatatctcaaagggatcttggatcgttaagcagagcgtgggcaagaaagcttgcttggttgggcaggcattagaaatcaattatttccgtggacgcaactatttggagcttggagttgatataggttcttcgacagtggcacgaggtgtagtgagccttgtgcttggctacttgaacaatctggtgatcgaaatggccttcttagtacagggcaacacatctgaagagctcccggagttcctcctaggtacctgccgactgaattacctggacgcctccaaggcagtgtcgatagacgaatgctagaaggcgtcgaactgacctcattctttttgaagccagtacagcacagaccaaaagggttgaagccattccttgctgcccgacacaccgtcggcaaccctcgcttgtattgccccctgcaaaagtggggatccactgcagccgttgtacattctcctcctctcgactgctcaggtgcattgcgttgtaatcatcatagcaaatccatgataaaagagaatcctctccattctttggccacctcttctccctggagaaaacgcagacaaaaagagaaatttagacaaaaagtgtaatctaatcctggtaccacgccgtcgcttctgccctgggtcagatcagattatcagat

SEQ ID NO: 1912 - DNA, 2817 bp, Panicum virgatum
caaaacaaaagcgcagcgcagggaggaggtgtcccgcggccacaagccaagcagccaccccaagcgaccgcgaggcggaggggcgtcgcccgctgccggaaggggaggcgagggggatcggattcggcgggggagccggcgggggcgaatgggcggcggcgcggaggtggcggtcgtggaggacgcggcggcgacggccgccgccgcggccgagggggcggcgcctgccgcggaggcggcgagcggggaggaggggatgcggatggaggggtggctctacctgatccgatccaaccgcttcgggctgcagtactcgcggaagcgctacttcgtgctcgaggacgccgcgctccgctgcttcaagtccgcgccatcctccaagcgcgaggatcctgttagaagtgcaataattgactcctgtatacgtgtgacagacaatggcagagaaagtgtacataggagtgatttttacatattcacactttataatgcttccaaccattatgatcagcttaagttgggtgcgagaagctcagaagaagcagctaggtgggtcaggtgcttaatggagtctgctttaaagtccccgagaaaagatgagcacattgttgcttgttcacatagaagatggcaggctttcaggttaagccgccgcaaaagccgcatgcactcaatagattgggactctattttcatctgttcataatgatccaatggcatctgatgtgatcgcaccttctccatggtcaatatttggctgtaaaaatggtttacgtttgtttaccgaggcaaatgatggtggctctcgcgagaagtattgggatgatcatccggctataatggcagttggtgttgttgatgtgaattctgagggtgtcttccagactctaatgtcccttgggcaatcaagatctgagtgggacttctgtttgcatgaaggaaaagttgttgagcatctagatggacacacagacataatccacaagaaattaagagccgactggttaccatggtctggtgctggattgattttctgtgtcttttacatgcattatttgttttgttctaatagcagtatatttagttttcaggggaatgagaaagagggatctattacttagaagatattggaggcgagaagatgatggaacttacgtaattctataccactctgttttccactacaaatgtcatcctgagagaggctatatccgtgcatgtctcaaaagtggaggttatgtaatatcaccaatcaatcaaggaagacaatcagttgttaagcacatgcttgccatcgactggaaattctggaagtcttatctgtttacatcatctgctaaatatatcactatccgtatgttaggcagaatagcagcactgcgagaattcttccgagcaagaaatggaaattgtgcttgcttggagttctcatctggtgagttgaccagagatatgggactgccacaaggtgaaaatgaaaggataaatttggaaatgcatcaagaaaatgaaaacagaagacttgaggggcctactgaaggatcactgggtggttccaacaggcacttaagcagtgccggttcctttgttcaacttaacgatgcagcggatgagttctttgacgtgccagatgaatcagaatatgatcagagagaaattatgtttccttctgatgagagcacacatgctgtggatcaacggcatgctaaattgtccacagctgctgtttttgtaaaaaggttgcatgatcttgcagtccaaaaaagaggatatgttgaccttcagggagctgcagatgctgataatgggccatgttgctatggatatactcttcccaaagattcgagctgtacagtgccttcaacttgggcaatgacagaccctacaactttcttaatccggggagagacatatttgcacgatcgtctaaagatcaaggcaaatagtaccctgatgcagatggtaggtgctgattggataaagtctgataagcgtgaggatgatctagctggtcgccatggaggactagtccagaaatgtgcagcacaagggggcaccaaattcttcttcattgtaaacatacaggttcctggttcaaccacatacagtttggctttgtattatatgatggatacaccattagaaaaggtcccactacttgaaagatttgtaaatggagatgatgcattcagaaattcgaggttcaagctcatcccttacatctcaaagggatcttggatcgttaagcagagtgtgggcaagaaagcttgcttagttggacaggcattagaaatcaattatttccgtggaagcaactatttggagctaggagtggacataggttcatcgacagtggcacgaggtgtggtgagccttgtgcttggctacttgaataatctggtgatcgaaatggccttcttggtacagggcaacacatatgaagagctcccagagttcctccttggtacctgccgactgaattacctggacgcctccaaagctgtgtcgatagacgaatgctagaaggcgtcaaactgacctcattctttttgaagccagtacagcacaaccaaaaggttgaagccattccttgctgccgacacgatcggcagacccagatgctcctccttgtattgtccccgcaaaagtcggggatccactgcagccgttgtacattctcctcttaccgacagccgactcctcaggtattgcgatgtaattatgatagcaatcgatgataaaaaaaaatgccctccattctttggcttctcatcacttaataagaaagaaaaaaccatagaaaaaagggtgtgacct

SEQ ID NO: 1913 - DNA, 3509 bp, Oryza sativa
actctctctctctctctctcgcgtcgcctgcgtccaattcaattcaactgcggcggcgacggcgagcgccccacgcaagcaaaatttccacagaaaaaaagcagagcgcggcggcgacgacgaagacgactacgcgaggcgaagcgagagcggaggagacctgagcgcgcgggagcgggatgatgggaggggtggcggcagaggtggtggtggaggacgctgccgcggcggcggcagctgtgcccgcggcggcggtggcggggacgggagcgggagggggggaggaggggaggatgcggatggaggggtggctgtacctgatccgatccaaccgcctcggcctgcagtactcgcggaagaggtacttcgtgctcgaggacgccgcgctccgctgcttcaaggccccgccgccgccctcctcctcctcctcctcctccaagcgcgaggatcctgttagaagtgcaataattgattcttgtatacgtgtcacagacaatgggagagaaagtgttcatagaagtgttttttacatattcacactctacaatgcctctaatcattatgatcaacttaagttgggtgctcgaagttcagaggaagccgctaggtggatcaggtgtttgatggagtctgccttaaagtccccaagaaaagatgagcatattgttgcttgttcacatagaagatggcaagcttttaggctaagccgccgcagtaaccgcatgcactcaatagattggactgtattttcttctgtccataacgatcctatggcatctgatgttattgcgccttctccatggacaatatttggctgcaaaaatggattgcgtttgtttactgaggcaaaggatggtggttcagaggggaagtattgggatgatcatccagctataatggctgttggtgttgttgatgcgaattctgaggctgtattccagactgtaatgtcccttggtcaatcaagatcagagtgggacttctgtttgcaggaagggagggtggtggagcatatagatggtcatacagatataatccacaagaaattaagagacggctggttaccatggggaatgagaaagagggatctattacttaggcgatattggaggagagaagacgatgggacttatgttattctataccactctgttttccactacagatgccgttctgagagaggctatgtccgtgcatgtcttaaaagtggaggatatgtaatatcgccagtcaatcaaggaaaacaatcggttgtgaagcatatgcttgctatagattggaaattctggaagtcttatctgtttaccgcatctgcaaaacacatcactatacgcatgctaggaagagtagcagccctgcgggaattcttccgagcaaaaaatggaaattgtgcttgcatagagttctcgtcaggtgagttgacaagggatatgcgtctgcaacaaggtgaaaatgagcggataaaaatcgaaatgctgtcagcaagtgaaaataacaggctagaagatcctacagaaggatcactgggtggttctaatagacacttaagtagcgctggttccttcattcaactgaacgatgcagcggatgagttttttgatgtcccggatgattcagaatatgatcaaagagaagccatgtggccttccgatgagagcacacattctgtggaccaacgacatgctaaattgtccaccgctgctgtcttcgtaaaaaagttgcatgatcttgcagtgcaaaagagaggatatgttgacttacaaggagctgctgatttcgataatggtccattttgctatggatatactcttccaaaagattcgaactgtacaatgccttctacttgggcaatgacagatcctacaacattcttaatccgaggggagtcatatttgcaggatcgtctaaagatcaaggcaaacaatacattgatgcaaatggtaggtgctgactggataaaatctgataagcgtgaagatgacctttctggccgccctggaggactagtacagaaatgtgcagcacaagggggcaacaaattcttttttatcgttaacatacaggttcctggttcatccacatacagcttagccttgtattatatgatggataccccattggaaaaggttcctctacttgaaagatttgtaaatggagatgacgcattcagaaattcaaggttcaaactcatcccgtacatctcaaaggggtcttggatagtaaagcaaagtgtgggaaagaaagcctgtttggttggtcaagcactagagatcaattatttccgtggaagcaattatttggagcttggagttgatataggctcgtcaacagttgcacggggtgtggtgagccttgtgcttggctacttgaacaacctggtgattgaaatggccttcctggtacagggcaacacgcaagaagagctcccggagttcctcctgggcacctgccgactgaactacctcgacgcgtccaaggcagtgtccatagacgagtgctgaaggcgtcatcagccaccattgaccccgccaacattctttctgaggccaattacagtagtacagcgaaccaaggaaaaaaagaggctcaagtcattcgtttcccctgccggccccggtccaaagatactccttgtattgctccacacaaaagccgaagaattctggctcattctgcctgcctgccagcactgtacattctcctcttgccgacaggtattgcgatgtaatgatgatagcaatctacgcccattctttggcatgccatcatcgagaaaaagagaaagggaagtgtatcctaacggtgacccccgtggcgttcattctgacctgggactcgtctcagcttactgtgagtagtgagattgcatcattagatccaactccaaagcaacccattaccggacacttgactactcctgttccataatatttctcctgagttcgagtgagtggtggcagccatgattataccagagggactcgtcaacaactgaaagcgaccaaagtcacagggattgatatactatgctcctaccattggtaaggaaggaacacccaggcagacgcactcacaacccaaaccctttctttttgcctagtcacttgagctagaagggagggatggaacatgagcaagtggagccggcatttccctttgttcttgagaaaagacaggacatgcaaactatgcttaaggcagggacggatagagatgatggtgtgtgtcgccgtcgcaaagcggcgagacatcgtgtggtcgagatcgctgtgcgtcgtccgtcgtctgcgtgcttggctagctaacctaaaactaaaaggcttccgtctgcccgtgcaccccgtcgccgctgtagcagccgacgtgacaggtgaaccgatctctcctgcattttttgctcacacaaattctgtaccactagtagtagtttgccgcgtcatcgcttcgaaatggagagagattagtgtggggagaagtatatttaagtggacacttgcagggttagacag

SEQ ID NO: 1914 - DNA, 2312 bp, Saccharum officinarum
gatcctgttagaagtgcaataattgactcttgtattcgtgtgacagacaatggcagagaaagtttacataggagtgacttttacatattcacactttataatgcttccaatcattacgatcaacttaagttgggtgcgagaagttcagaagaagcagctaggtggatcaggtgcttaatggagtctgccttaaagttccctagaaaagatgagcacattgttgcttgttcacacagaagatggcaggctttcaggttgagccgccgcaatagccacatgcactcaatagattggactttattttcatctgctcataacgatccaatggcatctgatgttattgcaccttctccatggacaatatttggctgtaaaaacgggttacgtttgtttactgaggcaaacgatggtggctttcgtgggaagtattgggatgatcatccggctattatggcagttggtgtggttgatgcgaattctgaggctgtcttccagactctaatgtcccttggccaatcaagatctgaatgggacttctgtttgcgggaaggaaaggtggtcgagcatcttgatgggcatacagacataatccacaagaaattaagaggcgactggttaccatgttttcaggggaatgagaaagagagatctattacttagacgatattggaggcgagaagatgatggaacttatgtaattctataccactctgttttccactacaaatgtcgtcctgagagaggctacatccgtgcatgtcttaaaagtggaggttatgtaatatcaccagtcaatcaaggaagacaatcagttgtaaagcacatgcttgccatagattggaaattctggaagtcttatctgtttacatcatctgccaaatatatcactatacgtatgctaggcagagtagcagcactacgagaattcttccgagcaaaaaatggtaattgtgcttgcatggagttctcatctggtgagttgaccagggacatgggactaccacaaggtgaaaatcagcgaataaatttggaaattcagcaagaaaatgagaacagaagacttgagggtcctactgaaggatcagtgggtggttctaacaggcagttaagcagtaccggttcctttattcaacttaatgatgcggcagacgagttctttgatgtgccagatgaatcagaatatgatcagagagaagttatgtttccttctgatgagagcacgcatgcttcggatcagcgtcatgctaaattgtccactgctgctgtttttgtaaaaaggttgcatgatcttgcagttcagaaaagaggatacgttgacttacagggagctgcagatgctgataatgggccatgttgctatggatatactcttcccaaagattcgagctatacagtaccttctacttgggcaatgacagatcctacaacattcttaatccggggagagacttatttgcacgatcgtctaaagatcaaggcaaatagtaccctgatgcaaatggtaggtgctgattggataaagtctgataagcgtgaggatgatctagctggtcgccctgggggactagtccagaaatgcgcagcacaaggaggcaccaaattcttcttcgttgtaaacatacaggttcctggttcaaccacatacagcttagctttgtattatatgatggatacaccattagaaaaagtccctctgcttgaaagatttgtaaatggagacaatgcattcagaaattcaaggttcaagctcatcccttacatctcaaagggatcttggattgttaaacagagtgtgggcaagaaagcttgcttggttggacaagcattagaaatcaattatttccgtggaaacaactatttggagcttggagttgatataggttcatctacagtggcacgaggtgtcgtgagcctagtgcttggctacttgaacaatctggtgatcgaaatggccttcttggtacagggcaacacatatgaagaactcccagaattcctcctaggtacctgccgactgaattacctggatgcctcgaaggcagtatccatagacgaatgctagaaggaccccaactgacctcattcttttttaagacagtacatcaatcaaaagaccaaaaggctgaatccattccttgctgccgacacaatcggcagccccagatgctccttgtattgcgcccccgccaaaagtgggggaccactgcagacgttgtacattctcctcttgccgactgctcaggtattgtgttgtaatgatgatagcaatccatgataaaaggcccccattctttggcatcttatcaccacgg

SEQ ID NO: 1915 - DNA, 2833 bp, Triticum aestivum
cccctagcctacaagccaccggccaccaccaccagatgtgagacgaacagagccaagccgacgagggtagttttaaaactctgcgccgagaggagatttgcggactgcggaggaagaccaactgggtgaaattctgcgtcggcgcgggggcggccaatgggaggggcggaggcggccgtcgtggaggccgcgtcgaccgctgcggcagcggaggccgctgagggcggagaggacgggcggatggaggggtggctctacctgatccgatccaaccggctagggctgcagacctcgcgcaagaggtacttcgtgctcgaggactccgcgctccgctgcttcaaggccgccccggcgccttcctcctccagctccaagcgcgaggatcctgttagaagtgcagtaattgactcttgtatacgtgttacggacaacgggagagaaagtgttcatagaagtgttttttacatattcacactctacaatgcctctaaccactatgatcagctgaagttgggtgctagaagctcagaagaagcagcaagatggatcaggtgcttaatggagtctgccttaaagtcccccagaaaagatgagcatgttgttgcttgttcacatagaaggtggcaggctttcagactaagccgccgcagtaaccgcatgcactcaatagattggacaatattgtcatcttctcataatgatccaatggcatctgatgttattgcaccttctgcatggacaatatttggctgtacaaacggattacgtttgtttactgaggcaaaggatggtggctcacgtgggaagtattgggatgatcatccagctataatggcagttggtgtcgttgatgcaaattctgaggatatcttccagactttaatgtctcttggtcaatcaagatccgagtgggacttctgtctgcgggaaggaagggtggttgagcatctagatggacattcagacataatccacaagaaattaagaggggactggctaccatggggaatgagaaagagagatctattacttagacgatattggaggagagaagacgatggaacttatgttatcctgtaccactctgttttccacaacagatgcagtcctgagaaaggctacatccgtgcatgtcttaaaagtggaggatatgtaatatcaccagttagccaaggaagacaatcagttgtgaagcatatgcttgctatagactggaaattctggaagtcatatctccttacctcatccgcaaaatacatcaccatacgtatgctaggaagagtagcagccctacgagaattattccgagcaaaaaatggaaactgcgcttgtatggaattctcatcgggtgagctgatgagggatatgggactgccgcagggtggaaacgagcggacaaaaatagaaatgcagtcagcaaatgagtgtgaaagacttgagggtcctgtagaaggaccacagggtggttctaaccggcacttaagcagtactggttcccttgttcaacttaatgatgcaacggatgagttctttgatgtcccagatgaatcagaatatgatcagagagaagccatgtggtcttctgatgagagcacacatgctgcggaccaacgacatgctaaattatccagtgctgctgtctttgtacggaagttgcatgatcttgcagttcaaaagagagggtacgttgatttacagggagctgcagatgctgataatggaccatgttactatggacatactctcccaaaagattctagctgtacaatgccttctagttggtcaatgacagacccgacaacattcttaatacggggagaatcctatttgcttgatcgtcaaaagatcaaagcagagaatacactgatgcaaatggttggtgctgactggataaaatctgataagcgtgaggatgatcttgctggtcgtcctggcggactagtccagaaatatgcagcacaaggaggcagcaaatttttcttcattgtaaatatacaggttcctggttctaccacgtacagcttagctttgtattatatgatggataccccattggaaaaggttcctctacttgaaagatttgtaaatggagatgatacattcagaaactcaaggttcaaactcatcccttatatctcaaagggatcttggattgtgaagcagagtgtgggcaagaaagcttgtttggttggtcaagcactagaaatcaattatttccgtggaagcaactatttggagcttggagttgatataggctcgtcaacagtggcacgaggtgtggtgagccttgtgctcgggtacttgaacaacctggtgattgagatggccttcttggtacagggcaacacgcaagaagagctcccggagttcctcctaggcacctgccgactgaattatctcgacgcctccaaagctgtatcgctagacgaatgctgacctgacctctcaaggtcaaggaggcgtcaggttgaccccaattctctttcgaagcctgagtacagcacatcaaagccgaaaaggctcaagctactccccgtgtccacccgccatacactcatttgtctgccttgccgcccacaaaagtgtgggggatttgccgcagcagtgtacattcatttctcctcctgcaaataggaggtgttgcggtgtattgattgattgatgatggcagtgtactactcgtatgatgcaaagccttgctcccattctttggccgacaactcgtcatttcattcatcatgtaaaaattgagacaaaaggaaagtgtattctaaccctgacctcgtgtcgttcatttggaatctaatggggatcggatcagagatcgtcagat

SEQ ID NO: 1916 - DNA, 2952 bp, Brachypodium distachyon
atggctcgtgacaaaaggaaaagggcaccaggcctcacgcagagcagcagcgggattaaattaaacagctcgtccacggagtccaaatttccaataagtaaaaataagacaccctgggccaacctcagagggggacccacacggccagagacctccctcctacccctgcgtacaattcaattccactgcaacgaacgaacaaaacaggacaaaagcggaaaagagagccccgagcctgcaagccacccccggacgaacagagacaagccgaggagccagagagtcctggcagttcaaacacttgcgccgagaagagatttggggccaattgggcgagattccgcgggagagcggacggagccggggatgggcggcgcggcggaggcggtcgtcgtcgtggaggaggaggacgcgcacacgccagcggcgggcggggccgaggggcggatggaggggtggctgtacctgatccgatccaaccgcctcgggctgcagacctcgcgcaagaggtacttcgtgctcgaggacgccgcgctccaatgcttcaaagccgccccggcgccttcctccgactccgacagctccaagcgcgaggatcctgttagaagtgcaatgattgactcttgtacacgcgtcacagacaatgggagagaaagtgtacatagaagtgttttttatatattcacactttacaatgcttctaaccattatgatcaacttaagttgggtgctagaagctcagaagaagcagcaaggtggatcaggtgcttaatggagtctgccttaaagtctccaagaaaagatgagcatattgttgcttgttcacatagaagatggcaggctttcaggtggtatccacgcccatttaacgggctaattagttactacatcattgcagattggacaagattgtcgtctgctcacaacgatccaatgacatctgatgttattgcaccttctccatggacaatatttggctgtacaaatggattacgtttgtttactgaggcaaaggatggtgactcacatgagaagtattggcatgatcatccggctataatggcagttggtgttgttgatgcaaattctgaggatatattccagactttaatgtcgcttggtcaatcaagatccgagtgggacttctgtttgcgggaaggtagggttattgagcatctagatggccattcagatataatccacaagaaattaagaggcgactggctaccatggggaatgagaaagagagatctattacttcgacggtattggaggagagaagatgatggaacttatgttattttgtaccactctgttttccacaacaaatgccgtccggagcaaggttacatccgtgcatgtcttaaaagtggaggatatgtaatatcgccagtcagtcaaggaagacaatcagttgtgaagcatatgcttgctatagactggaaattctggaagtcatatctctttacctcatccgcaaaatacatcaccatacgtatgctaggaagagtagcagccctaagagaattcttccgagcaaaaaatggaaactgtgcttgtctggagttctcttcaggtgagctgatgagagatatgggactgccgcagggtgaaaatgagcagataaaaatagaaatgcattcagcaaatgagagcagaaggcttgagggttccacagaaggatcacagggtggttctaacaggcacttaagcagtgctggttccttcgttcaactgaacgatgcaacagatgagttctttgatgtcccagatgaatcagaatatgatcagagagaagccatgtggtcttctgatgagagcacacatgctgtggaccaacggcatgctaaattgtccagcgctgcagtcttcgtaagaaggttacatgatcttgcagtccaaaagagaggctacattgatttacagggagctacagatgctgataatgggccgtgttgctatggacatactctcccgaaagattctagctgcacaatgccttctagttgggcaatgacagatcctacgacattcttaatacggggagaatcctatttgcttgatcgccaaaagatcaaagcaaacaatacactgatgcaaatggtaggtgctgactggataaaatctgataagcgtgaggatgatcttgctggtcgtcctgggggattagtccagaaatatgcagcggaagggggcaacaaatttttctttattgtaaatatacaggttccaggctctaccacgtacagcctagctttgtactatgcgatggataccccattggaaaaggttcctctacttgaaagatttgtaaatggagatgatacattcagaaattctaggttcaaactcatcccttatatctctaagggatcttggatcgtgaagcagagtgtgggcaagaaagcttgtttggttggccaagcactagaaatcaattatttccgcggaaccaactatttggagcttggagttgatataggctcatcaacagtggcaagaggtgtagtgagcctcgtgctcgggtacttgagcaacctggtgattgagatggccttcttggtacagggcaatacgcaagaagagcttccggaattcctcctaggcacctgccgactgaattatctcgacgcctccaaagctgtatcgctagacgaatgctgatcctctaaagagacgtcagctagactccaattctttacgccagcacaacaaaggctcaattcattccttctgccggccacacactgcttggcctgccttgccgcccacaaaagttgtgggggatttgtcccagcgatgcacattcattgattcttctctagtcgaggggaggtaacattgggctgtaaagatgattgcggtcgactaagataaaaggcctctccattctttaaccgacaactcatcatcttgtaaggattgaggaaaaagaaaagtgtattctaaccc

SEQ ID NO: 1917 - DNA, 2406 bp, Saccharum officinarum
gtcgacccacgcgtccgggccgcccgccggaaaccctacccatccccctgcgccgccgccggccgcccgctccgtcacctcctacctcttctagcgccgtcgttcgatcccctacgttcgagcttagctgaggcattatgggtaagtcaagcaagaagtccagtgttgtggccgcacctgctgctgtctcagttccagatgggaaatctgtaaagaaggggaagagaaatgcagaagatgagattgagaaggccgtgagtgccaagaagcaaaagactgcatctgaaaaggctgtgccggttaagaagcagccccctccaaagaaagttgagagcagcagctctgactctgaggaggattcttcagattctgaagtggaggtgccagttaagaagcagccccctccaaagaaagttgagagcagcagctctgactctgaggaggattcttcagattctgaagtggaggttaaggtccagccaaaaaaggtcattcagccaaagaaaggtacacaacctgctaaacaggagtccagtgatgacagcagctctgagagctcctcagatgatgaaccttccaaaaaaccagttgccagttcaaataagccagctgccagtagtagcgacagtgatgacagcagtgacagtgatgatagcagttctgatgaggaacctgcaaaaaagcccactgtcctttcaaagaagcctgtcacagctgttagtaatggttcaaaacaggttaagcatgatagcagcagctccgacagtagctcagatgaggatgaaaaatctgctgctaacctaaagaagcctccggttgcttctgtgcaaaagaagacccaagaatctgatagctctgacagtgattctgatgatgatgaatcagaagatgatattcctgctaaagctgcagtagtggccaagaaaaaggaagtatccagtgacagttctgattctgatagtgattctgagtccgaggatgaggataataatgctaaaatagtacagcctgccaaggctgctgctcctaaaaaggaggaatctagtgggagctcagattctgactcagagtcagattctgattctgatgaacctgaaaaacctactgtccctgcgaaaaggcctctagcaacaaataagaagaatgaagaatccagtgacgaatctgatggcagctctgatgagagttctgatgaaagtgacgaggagcctccacaaaagaagtctaagaattctgcaccttctggtgctgccaaggctgccactaaggtttcaaagaaagaaagcagcagcgatgaagatgatggaagttcggatgaaagctctgacgatgaggaggaaagtgaaccaactaaaactcctaagaaaaaggaaacttctgtagacactacgcaaaagttggcacgtaatgagcccaaaactcctgccaaaagccaaagtcaggctactggttcaaagactatttttgttgggaatttagcctatagtatagagcgtgaacaagttaaggaattttttgaggaggctggcgaagttgtagatgttcgtttgtctacttttgatgatgggagtttcaagggttatggacatgttgaattcgctactgttgaagctgctcaaaaggcacttgaatttattggtcatgacctgatggggcgtcctctaaggattgacatagctgtcgagaggggtgcatacactcctagcagcgggaaggacaacggttcattcaggaagtctgctcaaaggtcaggcaacactgtatttattaagggctttgacacgtctggtggagaggaccagatccggagtgctctccaacaacattttggctcatgtggagagattacccgtatttcaattccaaaggattatgacactggtgcaagcaaaggaatggcatacatggatttcaaggacccagattccttgaataaagcatatgagctgaatggaaccgaccttggtggctacagcttgtatgtcgatgaagcgaagccgagacctgataacaacagggacggtggcttcagtggtgggcgtggtggcagaggaggaaggagtgacagggggcgtagtgggggccgtgggcgtggatttggaggccgtggtggaaggggtgacagaggccgtggtggccggggtacgcctttcagaccgaccgctggtacccctagtacaggaaagaagacaacatttggtgatgacgattgaagatccaaggctggcgattatagtgaaacgcaaactatattgtaccttccagacttctgttatctgtttcacctattggaggctgtactgctttgtttgcttgataattttgacaattcttttaccatttttaacatttggagctatgaagttatatcgaagacgtgatttatttataatatatgagcagcgg

SEQ ID NO: 1918 - DNA, 2110 bp, Saccharum officinarum
gacctcgcagctgacgcgcacacggcaaatccccaatcggagccgcggaccggatcggagctaggtctcgaggccatggcaagcggaggcgagggcgcagggagcggcgagtcccctcccgctgcctcagtggaggcggcagcgggggaggcgacgctgcacatccggtgcgcgaacggctccaagttcacggtgcagacggacctgggcgccacggtgggcgcgttcaaggaggtcgtagccgggagctgcgacgtgccggcgccgcagcagcgcctgatctacaagggccgcatcctcaaggacgagcaaaccctagaaagctacggcgttgagacagatcacacaattcacttggtgcgtggtgtcgccccaccagctgcatctagtgcacctgctgctgccagcccccttgcttcatctactcctagtagtggccctgcaggtggcctgggaggcctatttccaggtcttggtgatccaggaagtggtaggccatcaggaatatttgggtcaggatttccagaattagagcaagttgagcagcatttaagccagaatcccaacttgatgagggagataatgaatatgccagcgatgcaaaatctcatgaataaccctgatttaatacgcaatatgatcatgagcaacccacaaatgcgtgagatcatggatcggaatcctgatcttgcccatgtgctcaatgacccaagtgtcctccgtcaaaccctcgaagctgctaggaaccctgaaatcatgagagagatgatgcggaacacagacagagctatgagcaacattgagtcttctcctgaaggttttaatatgctccggcgcatgtatgaaactgtccaggagccacttctaaatgcaacaacaatggacggagaaggaaacacagcctcaaacccattttcagctcttctcggcaatcaggggtctaaccaacctggtcaagctcaacctgcaacaaatgctcccactactggttcagagtcgacaactggaaccccagctccaaatactaatccactaccaaatccctggagcaccaatgctgggagtgcacaaggagcaacacggtccagtgctagtggcaacgcaagaactggtgcttctggtggcgttggaggcactggtgccactggtggactgggagggttgggttcaccagatttgagtagtttgcttggtggtcttgctggcaatccaagaactggtgctgctggcggtttaggaggtttgggttcaccagatttggggagtatgcttggtggttcacctgatgtttctcttttcaatcagatgttgcaaaaccctgcaatgatgcagatgatgcagagcattatgtctgacccacagaccatgaaccagttgcttaacttcaacccaaacacacgcaacctgatggaatcaaacactcagatgagggaaatgcttcaaaatccagaatttcttcgccagctgacatcgcctgagactttgcagcaattactctcatttcagcagtctttattaggacagcttggtcaacttcaacctagccagggtggcaacaatgcaggcagtgccacaggtacgcggggaaaccctagtcttgacaccttgatgagcatgctcagcgggcttggttcgggaggtggcctaggtgttccaaatacttccaatgtgccaccggaggagctctatgccacacagcttactcagctccaagaaatgggtttcattgacaccgcagagaacattcaagcactggtcgctacagctgggaatgtacatgctgcggtggagcgtcttctcgggaaccttggccagtagctaaagcgagggagccagacactgcccgcaaatcttaaaatgtcgcgcatctgcaggagtgttcggcttaacgttcttcaagccccagaatttgaaggcggcggcgtccgtagtcccgaaagcaaaataatcaaaaagtcaggcagccattaacttttctcatacatggcggtcatgtctttgtttttacagtgttgtatttgcgatttggattggtgtacatacatatcggtcggatgttacctcatagaatgtctgtagtcttgtcttttcaactgttgattcttgattc

SEQ ID NO: 1919 - DNA, 2216 bp, Zea mays
gtttccttcagttcttcttccctcaatccattgcaagcaacaggaggagaaaaaacaaggagcgagacctcgcagctgacgcgcacaaggcaaaacccaatcggagccgtggaccgggccggagatagggctcgaggccatggcaagcggaggcgagggcgcagggagcggcgagtcccctcccgctgcctcagtggaggcggcagcgggggaggcgacgctgcacatccggtgcgcgaacggctctaagttcacggtgcagacggacctgggcgccacggtgggcgggttcaaggaggtcgtagccgggagctgcgacgtgccggcgccgcagcagcgtctgatctacaagggccgcatcctcaaggacgagcaaaccctagaaagctacggcgttgagacagatcacacaattcacttggtgcgtggtgttgccccaccagctgcatccagtgcacctgctgctgccagctcccttgcttcatctactcttagtagcgtcccggcaggtggcctgggagatctatttccaggtgttggtgctccaggaagtggcaggtcatcaggtatatttgggccaggatttccagagttagagcaagttgagcagcatttaagccagaatcccaacttgatgagggagataatgaatatgccagcgatgcaaaatctcatgaataaccctgatttaatacgcaatatgattatgagcaacccacaaatgcgcgagatcatggatcggaatcctgatcttgcccatgtgctcaatgacccaagtgtcctccgccaaaccctcgaagctgctaggaaccctgaaatcatgagagagatgatgcggaacacagacagagctatgagcaacattgagtcctctcctgaaggttttaatatgctccgtcgcatgtatgaaactgtccaggagccatttctaaatgcaacaacaatgagcggggaagggaacacagcctcaaacccatttgcagctcttctcggcaaccaggggtctaaccaacctggtcaaggtcaacctgcaacatatactccaactataggttcggagtcgacaactggaaccccagctccaaatactaatccacttccaaatccctggagcaccaatgctgggagtgcacaaggagcaacacggtccagtggcaacacaagaactggtgcttctggtcatgttggaggtactggtgccactggtggattgggagggcttggttcaccagatttgagtagtttgcttggtggtcttgctggcagtccaagaactggtgcttctggtggtttaggaggtttgggttcaccagatttggggaatatgcttggtggttctcctgatgtttctcttttcagtcagatgttgcaaaaccctgcaatgatgcagatgatgcagagcattatgtctgacccacagaccatgaaccagttgcttagcttcaacccaaatgcacgcaacctgatggaatcaaaccctcagatgagggaaatatttcaaaatccagaatttcttcgccagctgacatcgcctgagactttgcagcaattactcttatttcagcagtctttattaggacagcttggtcaacatcaacctaaccagggtagaaacaattcaggcagtgccacaggtacgcctggaaaccctagccttgacaccttgatgagcatgctcagtgggcttggttcgggaggtggcataggtgttccaaatacttccaatgtgccaccggaggagctctatgccacacagcttactcagctccaagaaatgggtttcattgacactgcggagaacattcaagcactgctcgctaccgctgggaatgtacatgctgcggtggagcgtcttctcgggaaccttgggcagtagctaaaacgagcgagccacacaccgccagtaaatcttaaaatgtcgcgcatctgcaggagtgttcggcttaacgttcttcaagcccttgaatttgaagggggtggcgtccataatcccgaaaacaaaataatcaaaaagtcaggcagccattaacttttctcatacatggtggtcatgtctttgttttacagtgttgtatttgcaatttggattggtgtacatacatatcggtcggatattacctcatagaatgtatgtagttttgtgttttgaactgttgattcttgattcccaatcaatcaaatcaaactatctaatccaactgttggctttctcattc

SEQ ID NO: 1920 - DNA, 2043 bp, Zea mays
ctcgtcagactttcagttcttccaatctcttgcaagcacaactgcacaagggaacaggaggaaaaaagagcgagaactcgcagctgacgcgcacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgggcgccacggtgggcgcgttcaaggaggtcttatccggtagctgcggcgtgccagcaccgcagcagcgcctgatctacaagggccgcatcctcaaggacgagcaaaccctagacagctatggcgttgagacggatcacacaattcacttggtgcgaggtgtcgccacaccagctgcatccagtgcacctgctgctgccaacccccttgcttcatttactcctagtagtggccctgcaggtggcctgggaggcctatttccaggtgttgatgctccaggaaatgacaggccatcaggtatatttaggccaggatttccagaattagagcaagttgagcaacatttaagccagaatcccaacttgatgagggagataatgaatatgccggcaatgcaaaatctcatgaataaccctgatttaatacgtaatatgatcatgaacaacccacaaatgcgcgagatcatggatcggaatcctgatcttgcccatgtgctcaatgacccaagcgtcctccgccaaacactcgaagctgctaggaaccctgaaatcatgagagagatgatgcggaacacagacagagctatgagcaacattgagtcttctcctgaaggttttaatatgctccgccgcatgtacgaaactgtccaggagccatttctaaatgcaacaacaatgggtggggaaggaagcacagcctcaaatccattttcagctcttctcgggaatcaggggtctagccaacctggtcaaggtcaacctgcaacaaatgctccaactactggttcagaatcgacaactggaaccccagctccaaatactaatccacttccaaatccctggagcaccaatgctgggagtgcacaaggtgcaacacggactcctagtggcaatgcaagaactggtggtgttgggggcactggtgccaccggtggactgggaggattgggttcaccagaattgagtagtttgcttggtggtcttgctggcagtccaagaactggttctgctggtggtttaggaggttcgggttcaccagatttggggagtatgcttggtggttcacctgatgtttctccgttcagtcagatgttgcaaaaccctgcaatgatacagatgatgcagaacattatgtctgacccacagaccatgaaccagttgcttaacctcaacccaaatgcacgcaacctgatggaatcaaacactcatatgagggaaatgtttcaaaatccagaatttcttcgccagctgacatcgcctgagactttgcagcaattactctcatttcagcagactttattaggacagcttggtcaacatcaacctagccagggcgggaacaatgcaggcagtgccacaggtacacggggaaaccctagccttgacaccttgatgagcatgctcagcgggcttggttcgggaggtggtctaggtgttccaaatacctccagcgtgccaccggaggagctctatgccacacagcttactcaactccaagaaatggggtttattgacaccgcggagaacattcaagcactggtcgctactgctgggaatgtacatgctgcggtggaacgccttcttgggaaccttggacagtagctaacccgagcgagccagacactattcgtaaatcttaaaattgtcgcgcatatgcaggagtgttcggcttaatgttcctcaagccccagaatttgaaggcggcggcgtccatagtcccgaaaacaaaataatgaaagagtcaggcagccgtttacttttgtcata

SEQ ID NO: 1921 - DNA, 2331 bp, Panicum virgatum
ggggaaaaaaaaagagaggagagacctcgcagctccacgcgcacacgccaaaccccaatcggagccgcgtccgccgacgccgaccggatcggagcaaggtctcgagtccatggcgagcggaggcgaaggcgccgggagcggcgagtccccgcctgccgccgcgggggaggcgccggcagcggcgggggcgacgctgcacatccggtgcgcgaacggctccaagttcacggtgcaggcggacctggccgccacggtgggcgcgttcaaggaggtcgtggccgggagctgcgacgtgccggcgccgcagcagcgcctgatctacaagggccgcatcctcaaggacgagcaaaccctagaaagctacggtgttgagacagatcacacaattcacttggtgcgtggtgttgcctcaccggctgcatcaggtgcacctgctgctgccagtccccttgcttcatctactcctagcagtggcccagcaggtggcctgggaggtctatttccaggtgttggtgctccaagaagtggcaggccatcaggtttatttggggcaggatttccagaattagaacaagttgagcagcatttaagccagaatccaaacttgatgagggagataatgaatatgccagcaatgcaaaatctcatgaacaacccagatttaatacgcaatatgatcatgagcaacccacagctgcgcgagatcatggatcggaatccagatcttgcccatgtgctcaatgacccaagtgtcctccgccaaactctcgaagctgctagaaaccctgaaatcatgagagagatgatgcggaacacggacagagctatgagcaacattgaatcttctcctgaagggtttaatatgctccgacgcatgtatgaaactgtccaggagcctttcctaaatgcaacaacaatgggtggggaaggcaacacagcgtcaaacccatttgcagctcttcttggcaatcaggggtctaaccaacctggtcaacctgcaacaaatgctccaattcctggttccgagtcaacaacaggaacccctgctccaaatactaatccacttccaaatccctggagcaccaatgctgggggtgcacaaggagcagcacggtctggtcctactagcaatgcaagaactggtgccactggtggcctgggagggttgggttcaccagatttgagcagtttgctcggtggtcttgctggcagtcaaagatctggtgctgctggtggtctaggagggttgggatcagcagatcttgggagtatgcttggtggttcacctgatgcttcttttcttaatcagatgttgcaaaaccccgcaatgatgcagatgatgcagagcattatgtctgatccacagaccatgaaccagttgcttaacttcaacccgaatgcacgcaacctgatggaatcaaacactcagctgagggaaatgtttcagaatccagaatttcttcgccagttgacatcgccagagactttgcagcaattactctcatttcagcagagcttattaggacagcttggtcaacaaccacctagccaggatggcaacaatttgggcagcgccacaggtatgcaaggaaaccctagccttgacaccttgatgagtatgctcagcgggcttggatcaggaggtggccttggtgttccaaataattccaacgtgccgccggaggagctctatgcaacacagcttactcagctccgagaaatgggtttcattgacaatgcggagaacatccaagcactggttgctactgctgggaatgtacatgccgcggtggagcgcctccttgggaatcttggccagtagctaaagcgagtcagacgctgctcaaaatttcgcgcatctgcaggagtgtctgggttactgttttttgagcccagaatttgaaggcggtgtccacagtccggaaaacaaaataaaaaagaagtcagccagccattaactttgccatacatggtcgtcgtcgtgtctttacagtgttgtatttgcaatttggattggtgtacatacatactatgtttttaaagcggtaaggcgaggcgaggcgatccaccaccgccttatcgcctaggcgatgcctaggcgggctaaggcgagaccttaagcaaggcgagccgccactgcctaggcgacgccttgaaaacagagcatacatatcgatcggatgttgccccatagaatatgcctgtagtctttccaactgttgattcctcatctatccatctatctgattcaaccggtggttttcaatggaaaatgagatgatgcattgcagtgttgatcactgtggcatacggatttcccgtatgttttat

SEQ ID NO: 1922 - DNA, 2155 bp, Panicum virgatum
gcagaggggaacaggggaggagggggaaaaaaaatagagaggagagacctcgcagctcacgcgcacacgccaaaccccaatcggagccgctgccgccgacgccgatccggagcaaggtatcaaatccatggcgagcggaggcgatggcgcagggagcggcgagtccccgcctgctgccgcgggggaggcgccggccgcggcgggggcgacgctgcacatccggtgcgcgaacggctccaagttcacggtgcaggccgacctggctgccacggtgggcgcgttcaaggaggtcgtggccgggagctgtgacgtgccggcgccgcagcagcgcctgatctacaagggccgtatcctcaaggacgagcaaaccctagaaagctacggcgttgaaacagatcacacaattcacttggtgcgtggtgttgccgcaccggctgcatcaggtgcacctgctgctgccagtccccttgcttcatctactcctagcagtggcccagcaggtggcctgggaggcctatttccaggtgttggtgctccaagaagtggcaggccatcaggtttatttggagcaggatttccagaattagagcaagttgagcagcatttaagccagaatcccaacttgatgagggagatgatgaatatgccagcaatgcaaaatctcatgaacaacccagatttaatacgcaatatgatcatgagcaacccacagttgcgcgagatcatggatcggaatccagatcttgcccatgtgctcaatgacccgagtgtcctccgccaaactcttgaagctgctagaaaccctgaaatcatgagagagatcatgcggaacacggacagagctatgagcaacattgaatcttctcccgaagggtttaatatgctccgacgaatgtatgaaactgtccaggagccattcctaaatgcaacaacaatgggtggggaaggcaacacagcctcaaacccatttgcagctcttcttggcaatcagggttctaaccaacctggtcaaccggcaacaaatgctccaattcctggttctgagtcaacaacaggaacccctgctccaaatactaatccacttccaaatccctggagcaccaatgctgggggtgcacaaggagcagcacggtccggtcctactagcaatgcaagaactggtgccactgggagcctgggagggttgggttcaccagatttgagtagtttgctcggtggtcttgctggcagtcaaagatctggtgctgctggtggtctaggagggttgggatcagcagatcttgggagcatgcttggtggttcagctgatgcttctttccttaatcagatgctgcaaaaccccgcaatgatgcagatgatgcagagcattatgtctgatccacagaccatgaaccagttgcttaacttcaacccgaatgcacgcaacctgatggaatcaaacactcagctgagggaaatgttccaaaatccagaatttcttcgccagttgacatcgccagggactttgcagcaattactctcatttcagcagaccttattaggacagcttggtcaacaacaacctagccaggatggcaacaatttgggcagcgccacaggtacccaaggaaaccctagccttgacaccttgatgagcatgctcagcgggcttggatcaggaggtggccttggtgttccaaataattccaatgtgccgccggaggagctgtatgcaacacagcttactcagctccgagaaatgggtttcattgacaatgcggagaacatccaagcactggttgctactgctgggaatgtacatgccgcggtggagcgcctccttggtaatcttggccagtagccaaagcgagtcagaggctgctcaaaattccgcgcacctgcaggagtgtccccggcttgctgttttttgagcccagaatttgaaggcggtgcccatagtccggaaaacaaaataaaaaaaagaagtcagccagccattaactttgccatacatggtcgtcgtcgtgtctctacagactacagtgttgtatttgcaatttggattagtgtacatacatatcggtcggatgttgccccatagaatatgctgtagtctttccaactgttgattcctcatctatcaatctatctgattcaaccggatttcagttatgtt

SEQ ID NO: 1923 - DNA, 2053 bp, Pennisetum glaucum
agcgtcgcccccaccgacgccgcctcctccgcgccatggcgagcggaggcgaaggcgccgggagcggcgagtccccgcctgctggcgcggaggaggcggcgtcggtgggggcgacgctcaacatacggtgcgccaacggctccaagttcacggtgcgggccgaccttgccgccacggtgggcgcgttcaaggaggtcgtggccgggagctgcgacgtgccggcgccgcagcagcgcctgatctacaagggccgcatcctcaaggacgagcaaaccctagaaagctacggtgttgagacagatcacacaattcacttggtgcgtggtgttgccccatccgctgcatcaggtgcacctgctgctgctgctgctgccagtccccttgcttcatctactcctagcagtggtccagcaggtggcctgggaggcctatttccgggtgttggtgctccaagaggtggcaggccatcaggtgtatttgggcctggatttccggaattagagcaagttgagcagcatttaagccagaatcccaacttgatgagggagataatgaacatgccagcaatgcaaaatctcatgaacaacccagatttaatacgcaatatgatcatgagcaacccacaattgcgtgagataatggatcggaatccagatcttgcccatgtgcttaatgacccaagtgtcctccggcaaactcttgaagctgctagaaaccctgaaatcatgagagagatgatgcggaacacagacagagctatgagcaacattgaagcttctcctgaagggtttaatatgctccgacgcatgtatgaaactgtgcaggagcctttcctgaatgcaaccacaatgggtggagaaggcaacacagcctcaaacccatttgcagctcttcttggcaatcaggggtctaatcaacccggtcaacctgcaacaaatgctccaactccaggttctgagtcgacaactggaacccctgctccaaataccaatccacttccaaatccctggagcagcaatgctgggactacacaaggagcagcacggtctgttcctgcagggaatgcaagaactggtgccactggtggtctgggagggttgggttcgccagatttgactagcttgctcagtggtcttgctgcccatccaagatctggtgctgctggtggcctaggagggttgggatcaccagacctggggagtatgcttggcggtgcacctgatgcttcttttcttaatcagatgttgcaaaaccccgcaatgatgcaaatgatgcagagccttatgtctgacccacagaccttgaaccagttgcttaatttcaacccgaatgcacgaaacctgatggaatcaaacactcagctgagggaaatgtttcagaatccggaatttcttcgccaattgacatctccagagactttgcagcaattagtctcatttcagcagactttattaggacagcttggtccaaatcaatctagccaggatggcaacaattcaggcggtgccacaggtacgcgagcaaaccctagcattgacaccttgatgagcatgctcagcgggcttggatcaggtggcagcctaggtgttccaaataattccaatgttccaccggaggagctctatgcgacacagcttacccagctccgagaaatgggtttcattgacaatgcggagaacatccaagcactagttgctactgcagggaatgtacatgctgcggtggagcgcctccttgggaatcttggccagtagttaaagcgagtcagatgctgcccataatatcaaaaatttgcgtatctgcaggaatgttcggcttactgtttttgaagcccaagaacttgaaggcggtgtccatagtccggaaaacaaaataaaaaggaagtcagccagccattaacttttgtcatacatggtcgccagtgtctttgctttacagtgttgtatttgcaatttggattggtgtacatacatatcggttggacgttaccccatagagtatgcctgtagtctttccaactgttgatccccctatccatctatctgatccaacc

SEQ ID NO: 1924 - DNA, 2536 bp, Oryza sativa
ttctccttcctcctcttcttcccctctcccgaagaaagaaaaaaaaggaaaaaagaaaagaaaaagaaaaaaaaaactcgagctcacgcgcacacgcacgcgacgcgacgcgaccccgaatcggaggcgaggccgccgactccgagcggatcgggccgaggtcgacggcatgggcggcggaggaggcgaggccgggggcggcgacggaggggagtcctctcctgctgcggctgcggcggcggcggtggcgggggccgcggcgctgcacatccggtgcgcgaacgggtccaagttcaccgtgcgggccgacctcgacgccacggtgggggcgttcaaggaggtggtggcggggagctgcgacgtgccggcggcgcagcagcgcctgatctacaagggccggatcctcaaggacgagcaaaccctagaaagctatggtgttgaaacagatcataccattcatatggtgcgtggcgctggtcccccagccggatcagctgcacctgctgcagccagcccccaagcttcagctgctcctagcagcggcccaacagatggtcttggaagtttgtttcctggccttggtggtacaggaactgctggtaccaggccatctggtctttttgggtctggatttccagaattggatcaaatgcagcagcagttaagccaaaaccccaacttaatgagggaaataatgaatatgccaatgatgcagaatctcatgaataaccctgatttaattcgtaacatgatcatgaacaatcctcaaatgcgtgatatcatcgaccggaatccagatcttgctcatgttctcaatgatccaagtgttctccgccagacccttgaagcagccagaaaccctgaaatcatgagggagatgatgcggaacacagacagagcaatgagcaacattgagtcttctcctgaagggtttaatatgctccgacgcatgtatgaaactgtccaggagcctttcctaaatgcgacaacaatgggtggagaaggcaacacagctccaaacccattctcagctcttcttggaaatcagggttctaaccaaccaagggatcctgctacaaatgctccaaatactggctcagagtctacaacaggaacccctgctccaaacactaatccacttccaaatccttggagctccaatgctggaggtgcgcaaggagcaacacgggcaggttctactggcaatgcaagaaccggtgccactgggggccttggagggttggggtcagctgatctgagcagtttatttggtggtcttgccggtaatacaggaactggtgctactggtggtctaggagggttgggttcagcagatttgggaagtttgcttggtggttctcctgattcttcttccttgagccagattttgcaaaaccctgttatgatgcagatgatgcagaatatcatgtctgatccacagtccatgaaccagttgcttaacttcaacccaaatacacgcaacctcatggaatcaaacactcagttgagggaaatgttccaaaatccagaatttattcgccagcttacatccccagaaactatgcagcaattactctcgttccagcagacattattatcacagcttggtcaaaatcaacctaggcaggatggtagccaaggaggcaatgcgacaggcatgcggggaaatgttagcctcgacaccttgatgggcatgcttagtgggcttggtgctggaggtggcataggtgtacccaatacatccaatgttccaccggaagaactgtatgcaacacagctcactcagctccgagagatgggtttcatcgacactgcagagaacatccaggcgctagtcgcaactgctgggaatgtgaatgctgcggtggagcgtcttcttggcaatcttggccagtagctaaagcgtaccagacgctgcccataacgtcaccaactccgctcttttgcaagaggttttttagcccctccaagttcaaacgcagcgtctgtctacagtctcaggagaaaataaaacaaagaaatcccacccccaccattaacttttccatacatggtcgtcatgcctttgtttttaccgtgttgtatttgactatttgggttgatgtacatacatatgaaattatcggatcttaccgcatagaatatgggtctacctttgcaattgtcggctcccaatcctcaagatgtatgttgatgccttcttgtgttttggggtatcttcataaatcataacgcagccttgttcttctaggcataaggtaattaaggtagctggccttgttctagacaaggcagctgccatgctagtgctgtgtcttctctgttggttgctctatccatttgacatttgcactgctctcgggattctattggcaaatacatgataggttactgcaccattttttttcttttctggttaaagttcagaggctgtgctcgataatggagcagtcagatttgacgtggaaatgttcatgaattactctgaacgtttgtgtatgatatttgcagaattgcagttcagttcatttcatct

SEQ ID NO: 1925 - DNA, 2039 bp, Leymus cinereus x Leymus triticoides
  misc_feature (643)..(643): n is a, c, g, or t
  misc_feature (645)..(645): n is a, c, g, or t
  misc_feature (1924)..(1924): n is a, c, g, or t
gagaagggaagagaaaaaaaaaataactcgcagctcacgcgcacacggcagaacccaatcgcagcccacgccccctgacccgaccggatcgagccttggtcgagggcatgggcggagcaggccacggcgagggggtcgggagcggggacggcggcgagtccccgccctcgggcgcgcgggcgacgctcaacatccggtgcgcgaacggcgccaagttcaccctgcaggcggacctgggcgagacggtcggggcgttcaaggaggtcgtggccggcagctgcgacgtgccggcgccgcagcagcgcctgatctacaagggccggatcctcaaggacgagcaaaccctagaaagctacggtgttgagacagatcacaccattcacttggtgcgaggcgttgcccaaccggcagcatcaggagcacctgctgcagcaagcccccaagcttcaactactcctaccagtggccctgcaggtggtcttggaggcttatttccaggccttggtgctactggagctgctagtggcaggccagcaggtttatttggggctggacttccagaattagatcaaatgcagcagcagttgagccagaatcccaatctaatgagggagataatgaacatgccaatgatgcagaatcncntgaataaccctgatctaatacgcaatatgattatgaataatccacaaatgcgtgatattatcgatcggaatccagatcttgcccatgtcctcaatgaccctagtgttctccgccagacccttgaagcagcaagaaaccctgaaattatgagggagatgatgcggaacacagacagagcgatgagcaacatcgaagcttcccctgaagggtttaatatgctccggcgtatgtatgaaactgtccaggagccttttcttaatgcaacaacaattggagggggtggggagggcaccccggcctctaacccgtttgcagctcttcttggaaatcaggggcctaaccaacccggcaatcctgctacaaatgcgccaactaccggcccagaatccacaacaggaacccctgttccaaatactaatccacttccgaatccctggagcaccaatgctgggggtgcgcaaggaacaacacggccaggtcctgccgctagtaccaggactggtgcaaccggtggccttggagggctgggttcagcagatttgagcagtctgctcggtggtcttggtgggaatgcaagaaccggtgctgcagggggtctaggagggttgggttcagcagatttggggagtatgcttggtggtccacctgacgctgctcttttgagtcagatgctgcaaaaccctgctatgatgcagatgatgcagaacattatgtctgacccacagtcaatgaaccagttgcttaacatgaacccaaatacacgtaacctgatggagtcaaacactcagctgagggatatgttccaaaacccagaatttcttcgccagatggcatccccagaggctttgcagcaattactctcattccagcagacactatcatcacagcttggtcaaaatcaacctagccaggatggtaacctaggaggcaatggcgcaggcacacggggaaatgttggcctggacaccttgatgggcatgcttagtgggcttggtgctggaggtggcttaggtgtaccaaatacctccaatgtgccaccggaggaactctatgcaacgcaactcggccagctccaagaaatggggttcttcgacaccgcagagaatatccgggcactgatggccacttctgggaatgtacatgctgctgtggagcgccttctcgggaattttggccagtagataaaacgagccagatgctgcccgtaatctccctgttttagcccacaggcagtgtccgtctacagtaagaaagacggaataatacaattaactttttncccgtacatggtcgtcatgcctttgttttttcagtgttgtattgacaatttggattgatgtacatacatatcagatcatcgggtgctaccgcaaagaatatggctctagttttca

SEQ ID NO: 1926 - DNA, 1552 bp, Zea mays
agcaggctgccaggcaggcaacacgcggacacccaattattcacccaagacccaacacccgcccaggcagcaagacaaggacaagggtctccaccgcttcccctcccctcccctgctctgctcctcgcctcctccctcccgaatcccgatcccagcttccctccttcctcccgcccacgccgccaaatcgagccccagccgcgatgagttggtggtggacgggcgcgatcggcgcggtcaagaagcgccaggacgagcaggcggccgccgccgagccctcctaccagagcgtcgccctcgtcgtcggatccaccggcatcgtcggcacctccctcctcgacatcctcccgctcgccgacacccccgccgggccgtggaaggtctacgccgtctcgcgccgcccgctcccgccctggtccccggcgccctccccggccgtcacccacctccacctcgacctcgccgactccgccgccgtcgcggaggctctccagcccctcaccgacatcacccacgtcttcttcgtcgcctggaccaaccgccccaccgaggcggagaaccgggaggccaactccgccatgctccgtaacgtcctctccgtcgtcgtcccgaactgccccgcgctcgtccacgtctgcctccagaccggccgcaagcactacgtcggccccttcgaggccatcggcaaggtcgccgccccggacccgcccttcaccgaggacatgccgcgcctcgactgccccaacttctactacgacatggaggacatcctcttccacgaggtctcccgccgagacggcgccgtcagctggtccgtgcaccgccccaccaccgtcttcggatactcccctcgcagcgccatgaacctcgtcggcagcctctgcgtctacgccgccatctgccggaaggagggcacgacgctccggtggcccggctctcgggtcacttgggagggcttcagcgacgcctccgacgccgaccttatcgccgagcacgagatctgggccgccgtggatccgttcgccaagaacgaggccttcaattgcagcaacggggatctcttcaagtggaagcagctgtggccgatactcgccgaccatttcggcctggaatgggctggctacgaaggtgaggagaacaggttcaagctcgaggaggccatggccgggaaggaagctgtctgggcagagattgtcagggaaaacgaccttatagccacggagcttgacgagatcacgaattggtggttcgtcgatgccatgtttgctgtggagacccagcttctggacagcatgaacaaaagcaaggagcatggcttcctcggcttcaggaacactgtcagctctttcaacacatggatcgagaagctgaaggtcttcaagattgttccctaataataattcatccttgctattcacttctatactgttgttctgcatccttattatcctgctcatttatcagcaccagttctcctgtaattcaaacatcttgctatctgtgccaggtttgcatgttatatactagggaccaataaggatcaacacattgc

SEQ ID NO: 1927 - DNA, 1528 bp, Setaria italica
cgccgccttccgaatccatccggctcccgcgatgagctggtggtggacgggcgcgatcggcgccgtcaagaagcggcaggacgagcaggcggcggcggccgagcccacctaccagagcgtggccctcgtcgtcggatccaccggcatcgtcggcacctccctcctcgacatcctcccgctcgccgacaccccgggggggccctggaaggtctacgcgctctcgcgccgcccgctcccgccctggtcccctccgccctcccccgccgtcacgcacctccacctcgacctcgccgacgccgccgccgtcgccgacgccctgaagcccctcaccgacatcacccacgtcttctacgtcgcgtggaccgcccgccccaccgaggcggagaaccgggaggccaacgccgccatgctccgcaacgtcctctccgtcgtcgtccccaactgccccgccctcgtccacgtctgcctccagaccgggcggaagcactacgtcgggcccttcgaggccctcggcggggtctccttcccggacccgcccttcaccgaggacatgccgcgcctcgactgcccgaacttctactacgacatggaggacatcctcttcgacgaggtcaaccggcgcgagggggccgtcagctggtccgtgcaccgacccaccaccgtcttcgggtactccccacggagcgccatgaacgtcgtcggaagcctctgcgtctacgccgccatctgcaggaaggagggcgccacgtttcgatggcccgggtcgcggatcgcctgggagggcttcagcgacgcctccgacgcggaccttatcgccgagcacgagatctgggccgccgtggatcccttcgccaagaatgaggccttcaattgcagcaacggggatctctacaagtggaagtacctctggccgatactggcggaccatttcggggtggagtgggctggctatgaaggggaggagaacaggttcaagctcgaggaggccatggctgggaaggaggcgctctgggcggagattgtcagggagaatgagcttatatctacggagctcgacgagatcaccaattggtggttcgtcgatgctgtgtttggtgtcgagttcgagcatttggacagcatgaacaagagcaaggagcatggcttcctcggcttcaggaacacggtgaactcattcaacacatggatcgagaagctcaaggtcttcaagattgttccgtgattcttcactgcaatttaggtctctactgttgttttgcatcattcagcaatcagcatcttattatcttgctcgtttatcaagttctggttcatttgtaatttatagttccatttcatacattctgctatctgtgccaggttgcatgttgtatactgttgtatactaggaccaaataaagatcaacacattgcaaataagtttattcatgctctgcctcaagctttcattatgagcagtgctttatctgtgaatcggttgatagagacatcagtttttttccctgctgtgcattcttgtagccctgaa

SEQ ID NO: 1928 - DNA, 1443 bp, Pennisetum glaucum
atgagctggtggtggacgggcgcgatcggcgccgtcaagaagcggcaggacgagcaggcggcggcggccgagcccacctaccagagcgtggccctcgtcgtcggatccacgggcatcgtcggcacctccctcctcgacatcctccctctcgccgacacaccggggggcccctggaaggtctacgcgctctcgcgccgcccgctcccgccctggtcccctcccccttcccccgccgtcacccacatccacctcgacctcgccgacgcccccgccgtcgaggaggccctcaagcccctcaccgacatcacccacgtcttctacgtcgcatggaccgcccgccccaccgaggcggagaaccgcgaggccaacgccgccatgctccgcaacgtcctctccgtcgtcgtccccaactgccccgcgctcgtccacgtctgcctccagaccggccgcaagcactacgtcgggcccttcgaggccctcggccgggtctccttcccggacccgcccttcaccgaggacatgccccgcctcgactgccccaacttctactacgacatggaggacctcctcttcgacgagatcagtcgccgtgagggggccgtcagctggtccgtgcaccgacccaccaccgtcttcggctactccccgcggagcgccatgaacgtcgtcggcagcctctgcgtctacgccgccatctgcaggaaggagggcgccacgtttcggtggcccgggtcgcggatcgcctgggagggcttcagcgacgcctccgacgctgaccttatcgccgagcacgagatctgggccgccgtggatcccttcgccaagaacgaggcattcaattgcagcaacggggatctgtacaagtggaagaacctgtggccgatactggcggaccatttcggggtggattgggctggctatgaaggggaggagcacaggttcaagctcgtggaggccatggccgggaaggaggcgctctgggcggagattgttagtgagaatgagcttatatctacggagcttgacgagatcaccaattggtggttcgttgatgctatgcttggtgtcgaattcgagcatttggacagcatgaacaagagcaaggagcatggcttcctcggcttcaggaacacggtcaactccttcaatacatggatcgagaagctcaaggtcttcaagattgttccgtgatgcttcactgcaatttaggtctctatactgttgtttcataccattcagcaatcagcatcttattatcttccttgtttatcaagttccgattcatttgtaatttatagttccatttcatacattctgctatctataccaggttgcatgttgtatactgttgtatactaggaccaaataaagatgaacatattgcaaataagtttattctagttcagccttaagatgaacatattgcaaataagtttattctag

SEQ ID NO: 1929 - DNA, 1551 bp, Brachypodium distachyon
cttccacgatgagctggtggtgggcgggcgcgatcggcgccgtgaagaagcgccaggacgagagcgcggccgcggcggagccctccttccagagcgtcgcgctcgtcgtcggatccaccggcatcgtcggcacctccctcctcgacatcctcccgctccaggacaccccgggcggcccctggaaggtctacgcgctctcccgccgcccgctcccgccctggtccccgccgccctcgcccgccgtcacccatctgcacctcgacctcgccgactccgccgccgtcgccgacgccctcacgcccctcaccgacatcacacacgtcttctacgtcgcctggtccaaccaccccacggaggcccagaaccgcgaggccaactccgccatgctccggaacgtcctctccgtcgtcgtccccaactgcccggcgctcgtccacgtctgcctccagaccggccggaagcactacatcggccccttcgaggccatcggcaagatccccgccccggacccgccttacaccgaggatatgccccgcctcgattaccccaacttctactacgaccaggaggatgtcctcttcgacgaggtctcccgacgcggcggtgccgtcagctggtccgtgcaccgtcccaccacaatctttggcttctctccacggagcgccatgaatgtcgtcggtagtctatgcgtctacgccgccatctgccgcaaggagggtgccactatgcggtggcctggatccaaggtcgcttgggagggtttcagtgattcctcggacgctgacctcatcgccgagcacgagatctgggcggcagttgatccattcgccaagaacgaggctttcaattgcagcaatggggatttgtacaagtggaaacagctttggccgatgctggcagatcatttcgaggtggaatgggctgggtatgatggagaggagaaccggttcatgcttacacaggccatggcagggaaggaagcagtgtgggccgaaattctgcaggagaacgagctcattaggaccgagctggaggagatcaccaattggtggttcgtcgatgccttgttcaatgttgagacccagcatttggatagcatgaacaagagcaaagaacatggattccttggtttccggaacacgacaaactccttcaacacatggatcgagaagatgaaggttttcaagattgttccctgatacctttattttctatatctattgtttcttttatatcctgttctttctcatacccagtgactcttgaatttagtttcattgcaactgtttgcttatttgggaatggtcacatgttctgaaatgttgtaatctagaataaactagaatggagtacccttgcttagtagttgttcattgccattgttgaagctttgagtaattggttggatgctttccatattgtgagggattcatctatgaattacctgcgaaacttggccattcttgtaaatggtatgctgatctgttgcttttgttggtaatgatatgcttgagattcgcttcactgagaagatataaaagctgccgcatt

SEQ ID NO: 1930 - DNA, 1304 bp, Saccharum officinarum
cgtcggatccaccggcatcgtcggcacctcgctcctcgacatcctcccgctcgccgacacccccggcgggccgtggaaggtctacgccgtctcgcgccgcccgctcccgccgtggtccccggcgccctcccccgccgtcacccacctccacctcgacctcgccgacgccgccgccgtcgccgaggccctccaacccctcaccgacatcacccacgtcttcttcgtcgcctggaccagccgccccaccgaggcggagaaccgggaggccaacgccgccatgctccgcaacgtgctctccgtcgtcgtccccaactgccccgcgctcgtccacgtctgcctccagaccggccgcaagcactacgtcgggcccttcgagccatcggcaaggtccagaccccggacccgcccttcaccgaggacatgccgcgcctcgactgccccaacttctactacgacatggaggacatcctcttccacgaggtctcccgccgcgacggcgccgtcagctggtccgtgcaccgccccaccaccgtcttcggctactccccccgcagcgccatgaacctcgtcggcagcctctgcgtgtacgccgccatctgccggaaggagggcgccacgctccggtggcccggctccagggtcacctgggaggggttcagcgacgcctccgacgccgacctgatcgccgagcacgagatctgggccgccgtcgatcccttcgccaagaacgaggccttcaattgcagcaacggggatctcttcaagtggaagcagctgtggccgatactcgccgatcacttcggggtggaatgggctggctacgaaggggaggagaacaggttcaggctcgaggaggctatggccggaaaggaagccgtctgggcggagattgtcagggagaatgacctcatagcgacggagcttgacgagatcaccaattggtggttcgtcgatgccatgtttggtgtcgagacccagcttctggacagcatgaacaaaagcaaggagcatggcttcctgggcttcaggaacactgtcacctctttcaacacatggatcgagaagatgaaggtcttcaagattgttccctgattcgtccctgcaattcagttctctactgctgtttcgcatccttctgtgccatattatctttgctcatttatcaacttccaggtctcttgtaatttagttccatttcatacatttcgctacctttgccaggtttgcatgttgtatactaggaacaaataaagatgatcaacacattgcaaataagttattcttgttcagcttcggtttgattg

SEQ ID NO: 1931 - DNA, 1574 bp, Avena sativa
ggcttgacggagcggagattctcttaatcaccatctcaccgcccccacctcctgatatcctaccgatccccgagagtcgtcacctgccatctctcctccctccttcgtccctcccgccggccgatccatccaagcgtctctccgcgatgagctggtggtgggcgggcgcgatcggcgccgtgaagaagcgccaggacgagcacgccgccgcagccgagccctccttccagagcatcgccctcgtcgtcggatccaccggcatcgtcggcacctccctcctcgacatcctcccactgcaggacacccccggcggtccctggaaggtctacgcgctctcccgccgcccccttccgccctggtcgccgcccccctcccccgccgtcacgcatctgcacctcgacctcgccgactccgccgccgtcgccgaggccctcgagcccctcaaagacatcacccatgtcttctacgccgcctggtccagccacctgactgaggacgagaaccgggaggcaaattccgccatgctccggaacgtcctctccgtcgtcgtccccaactgtccggcgctcgtccatgtctgtcttcagaccggccgcaagcactacgtcggcccgttcgaggtcctcggcaagatcccttccccagacccgccgtacactgaggatatgccccggctggattaccccaacttctactacgaccaggaggatgtcctcttcgacgaggtctcccgccgcgagggcgccgtcagctggtccgtacaccgtcccaccctagtcttcgggttctctccccggagcgccatgaatgtcgttggcagcctatgcgtctacgccgccatctgccgcaaggagggcgccctgctgaggtggccagggtccaaggtcgtttgggagggtttcagcgatgcctcagacgcggacctcatcgccgagcacgagatctgggcggccgtcgatccattcgccaagaatgaggctttcaattgcagcaatggggatttgtacaagtggaagctgctttggcctatgctggctgatcattttggggtggaatgggctgggtatgagggggaagagacccggttcaagcttgccgaggatatggcagagaaagaagcggtctgggcggaaattatccaggagaatgagctcatcgcaaccaaactggaggagatcaccaattggtggttcgttgatacggcgttaaatttggagatcgagcatttggatagcatgaacaagagcaaggagcatgggttccttggcttcaggaacacggtgaactccttcaacacatggatcgagaagatgaaggttttcaagattgttccctaagacattattttcagtatcaattgttgtttacttaatgccgcatatcagtttcttttctcatttatcaagtttactcttgaagttagtgtctttgtgtgtttgggatggccatatgttgtaaaatgttgtaatctagaataaactagaaccaaataaagctcgtcaaatcgtgatttaattacccttgctcttcgtatgttcaatgccgattttgagcatctaatattttttttggat

SEQ ID NO: 1932 - DNA, 1562 bp, Oryza sativa
gttgctttactacacgacacgacgcgcattaccagctcagctcggctcaggtcctccaacaacaaaacaaactactctgggctgggcttctcccgatcgatatcccccgttcgtccgtccgctctcctccttcccaaccggcaatccgccgatccgtccgacctctagcttgtacgctgccgctgccgccatgagctggtggtgggcgggcgccataggcgcagtgaagaagcggcaggaagagaacgcggcggccaccgagccgtccttccagagcgtcgccctcgtcgtcggctccacgggcatcgtcggcacctccctcctcgacatcctcccgctccaggacaccccgggcgggccctggaaggtctacgccgtctcccgccgcccgctccctccctggtccccgccggcctcccccgccgtcacccacctccacctcgacctcgccgactccgccgccgttgccgaggtcctcacgcccctcaccgacatcacccacgtcttctacgtcgcctggtccgcccaccccacggaggcccagaaccgcgaggtgaactccgccatgctccgcaacatcctctccgtcgtcgtccccaactgccccgctctcgtccacgtctgcctccagaccggccgcaagcactacatcggaccattcgaggtcatcggcaagatcgccgccccggacccgcccttcaccgaggacatgctccgcctcgattgccccaacttctactacgacctggaggacgtcctcttcaacgaggtctcccgccgcgacggcgccgtcagctggtccgtgcaccgccccaccgtcgtcttcggattctctccccgaagcgccatgaatgtcgtcggcagcctgtgcgtttatgccgccatctgccgcaaggagggcgctgtgctgcgatggcctggatccagggtcgcctgggagggattcagtgacgcgtccgatgcggatctcatcgctgaacacgagatctgggccgccgttgagccattcgccaagaatgaggcatttaattgcagcaacggggatctctacaagtggaaacttctctggccgatgctggcagaccaattcggcgtcgaatggtctggctacgagggagaagagagcagcttcaagcttgcagatgccatgtcggggaaggaggcagtgtgggcagagattgtcaaagagaatgatctcatggacaccgagcttgaagagatcaccaattggtggtttgttgatgccgtgttcggcgtccgcagcgagcatttggatagcatgaacaagagcaaggaacatggattccttggcttccggaacacggtgaattccttcaacacatggatagaaaagatgaaggttttcaagattgtcccatgatgcgttcaattgttttttatattattgcacatcttgttttctatgccattcatccaaattgctcccgaatttagttccattataaacattgctttcaaggttacatgttgtaaaatgctgtattctacaaaaaactagaaccgaataaaattaatcaagtggagaatgaattttatggatc

SEQ ID NO: 1933 - DNA, 1399 bp, Triticum aestivum
  misc_feature (1387)..(1387): n is a, c, g, or t
  misc_feature (1393)..(1393): n is a, c, g, or t
ccgcgatgagctggtggtgggcgggcgcggtgggcgcggtcaaaagcggcaggacgagcgggcggcggcggcggagcccaccttccagagcgtggcgctcatcctcggctccacggggatcgtcggcacgtccctcctcgacatcctgccccgcgacgacaccccgggcgggccctggaaggtgtacgccgtctcgcgccgcgcgccgccgggctggtccaccccgccgccgtcccccgccgtcacgcacctccagctcgacctcgccgacgccgccgccgtcagggacgccctgacgccgctcaccgacgtcacccacgtcttctacgccgcgtggtccagccacgagacggaggaccggaaccgggaggtcaacgccggcatgctccgcaacgtgctctccgtcgttgtgcccaactgccccgcgctcgcccacgtctgcctccagaccggccgcaagcactatgtcggacccttcgaggccatcggcaagatcccggcccccgacccgccctacaccgaggacatgccccggctcgaccaccccaacttctactacgacctggaggacgtcctcttcgaccacgtctccggccgcgacggcgccgtcacctggtccgtgcaccgccccaccgtcatcttcggcttctccccccgcagcgccatgaacgtggtcggcagcctgtgtgtgtacgccgccatctgccgcaaggagggcgccacgctgcggtggccaggctgcaaggtcgcctgggagggcttcaccgacgcctctgacgcggaccttgtcgccgagcacgagatctgggcggccgttgacccgttcgccaagaacgaggctttcaattgcagcaatggggatgtgttcaagtggaagcagctctggccgatgctggccgagcgcttcggggtggagtgggcagggtatgagggagaggacagccggttcgctctcgccgacgccatgaccgggaaggaggcggtctggaccgagatcctccaggagaacgagcttgtcacgaccgagctcgaggagatcaccagttgggggttcgtcgatgccatgttcaatatcgacattgagcatttggacaacatgaacaagagcaaggagcatgggttcctcggcttccgtaacaccgtcaactccttcaacgcttggatcgataagatgaaggcttccaaggttgttccgtgatgctcttattgtctagtatctattgttgtctacagcatatgctactgcatcccattttatcactcatttataaatttacttctgaaattagttacatcccatcatttgtgccaaatgttgtaatctagaataagccagaaccaaataaagctcccaagttgttaatcgattatctgtgctcacctcggncgcgancacggc

SEQ ID NO: 1934 - DNA, 1509 bp, Triticum aestivum
ggcacgcaacgcgcgcacacacacacggaagccactctgccgccatcattcccagatacagacggagctcccctcccctccattcacctgtggtctccgaccaagctgtccgtggccaatccctaatccgcgatgagctggtggtgggcgggcgcagtgggcgcggtcaagaaacggcaggacgagcgggcggcggcggcggagcccaccttccagagcgtggcgctcatcctcggctccacggggatcgtcggcacgtccctcctcgacatcctgccgcgcgacgacaccccgggcgggccctggaaggtgtacgccgtctcgcgccgcgcgccgccgggctggtccaccccgccgccgtcccccgccgtcacgcacctccagctcgacctcgccgacgccgccgccgtcagggacgccctgacgccgctcaccgacgtcacccacgtcttctacgccgcgtggtccagccacgagacggaggaccggaaccgggaggtcaacgccggcatgctccgcaacgtgctctccgtcgttgtgcccaactgccccgcgctcgcccacgtctgcctccagaccggccgcaagcactacgtcggaccgttcgaggtcatcggcaagatcccggcccccgacccgccctacaccgaggacatgccccggctcgaccaccccaacttctactacgacctggaggacgtcctcttcgaccacgtctccggccgcgacggcgccgtcacctggtccgtgcaccgccccaccgtcatcttcggcttctccccccgcagcgccatgaacgtggtcggcagcctgtgtgtgtacgccgccatctgccgcaaggagggcgccacgctgcggtggccaggctgcaaggtcgcctgggagggcttcaccgacgcctctgacgcggaccttgtcgccgagcacgagatctgggcggccgttgacccgttcgccaagaacgaggctttcaattgcagcaatggggatgtgttcaagtggaagcagctctggccgatgctggccgagcgcttcggggtggagtgggcagggtatgagggagaggacagccggttcgctctcgccgacgccatgaccgggaaggaggcggtctggaccgagatcctccaggagaacgagcttgtcacgaccgagctcgaggagatcaccagttgggggttcgtcgatgccatgttcaatatcgacattgagcatttggacaacatgaacaagagcaaggagcatgggttcctcggcttccgtaacaccgtcaactccttcaacgcttggatcgataagatgaaggcttccaaggttgttccgtgatgctcttattgtctagtatctattgttgtctacagcatatgctactgcatcccattttatcactcatttataaatttacttctgaaattagttacatcccatcatttgtgccaaatgttgtaatctagaataagccagaaccaaataaagctcccaagttgttaatcgattatctgtgctcgt

SEQ ID NO: 1935 - DNA, 1478 bp, Triticum aestivum
gcacgagcacacacggaagccactctccccccattatccccagatccagccggcgctcccctcccctccctccacctccggcctccgaccaagctgcccgcggccaatccctaagccgcgatgagctggtggtgggcgggcgcggtgggcgcggtcaagaagcggcaggacgagcgggcggcggcggccgagcccaccttccagagcgtggcgctcatcctcggctccacggggatcgtcggcacctccctcctcgacatcctcccgcgggacgacaccccgggcgggccctggaaggtgtacgccgtctcccgccgcgcgccgccgggctggtccaccccgccgccgtccccggccgtcacgcacctccagctcgacctcgccgacccggccgccgtcagggacgccctgacgccgctcaccgacgtcacccacgtcttctacgccgcgtggtccagccacgagaccgaggaccgcaaccgggaggtcaacgccggcatgctccgcaacgtgctctccgtggttgtgcccggctgccccgcgctcgcccacgtctgcctccagaccggccgcaagcactacgtcggcccgtttgatgtcatcggcaagatcccggcccccgacccgccgtacaccgaggacatgccccggttggatcaccccaacttctactacgacctggaggacgtcctcttcgaccacgtctccggccgcgacggcgccgtcacctggtccgtgcaccgccccaccgtcatcttcggcttctccccccgcagcgccatgaacgtggtcggcagcctgtgcgtatacgccgccatctgccgcaaggagggcgccacgctgcggtggcccggctgcaaggtcgcctgggagggcttcaccgacgcctccgacgccgaccttgtcgctgagcatgagatctgggcggccgtcgacccgtttgccaagaacgaggctttcaattgcagcaatggggatgtgttcaagtggaagcaactctggccgctgctggccgaccgcttcggggtggagtgggcagggtatgagggagaggacagccggtttgcgctcgcggatgccatggctgggaaggaggcggtgtggacggagatcatccaggagaacgagcttgtcaccacggagctcgaggagatcaccagttggtggtttgtcgatgccatgctcagtatcgacattgagcatttggacaacatgaacaagagcaaggagcatgggttcctcggcttccgtaacaccatcaactccttcaatgcttggatcgataagatgaaggcttccaaggttgttccttgatgcttttattgtcttgtatctattgttggttacagcatgctatcgcatcccatgttatttctcatttatcaatttatttctgaaattagttacatcccatcatttgtgccaaatgttgtaatctagaataagccagaaccaaataaagctctcaagttgtgaat

SEQ ID NO: 1936 - DNA, 1880 bp, Zea mays
ggaatttttttgaacttttttttttgccaacctaggctcaacgcctcatcgccggacgaaagagcggcttgcacgtcggggcggtggcccacagcccactcaacagcaacacgtgtcggcgcggtccggccagacacgtggtcgcccccctccttgcccgcccaccaaacacccgacccagccagctaggggagccacagcaagaaatgcaggccttcccttttgctgcccaaccccaatcatagagcggaacggacggagtgggtgcaaatcggattagacggccacgtcccccccgagcctcaccaatcgccggccctccgcaggcagggaagggcggttgggcggccggccggccggagatctgattgctcttatcttctcccctcccgttcatccaatctgctgtcaccatatctgatctccctctccccctgattgcccgcggtggccattgcctcgctcgcgtctccttcgccgcgcttctaggaagattcggcggcgtgcccatttgtcggtcgtagccttaaccagttcttccccaactccgagctccttccttgcttgggagcagctgcacacacatccgcccaggatattagttagcgtggaggatggcgtccagggacttcctccgcgtcttcggcgccggtgagggggcgggcccgccgggggacgccggcgccggccagcccgacgacgacgagctcagcctcggcctctccctgggcggccgcttcggcaccgacgccaagcgcccgcgcctggcgcgctcctcctccatcgcctccgtctgctccgtctcctctctccacgccgacccgtcccccgccgcgccgctgccgctgctgcgcaccacctcgctgcccaccgagaccgaggaggagcgctggcgccgacgcgagatgcagagccgccgccgcctcgaggcgcgccggaagcgcgtcgagcgacgcaactccatgggctccgtctccgtggcacccgccgacgccgtcagcgggaggaggtccaacgcctcgcaggggagcaactctgcaagcaccacggagcaaggtattggtggaagcatgtttaaccaatccgcagacgcgaagagtccatctacctctgataatagaaatcaaaacgacatgcttcctccgaccaaagcggccgagaagccactaaacggtactgcgacagagcagcagcctcgcctacggacgcttgggtccctcacgacacggacgggcagcaccagtgacatcagaaagctcatgatggaggacatgccaatggtctcatccaaggtagaagggcccaacgccaggaggatcgacggcttcctgtacaggtacaagaaaggcgaggatgtgaggatagtgtgcgtctgccatggtagcttcctcactcccgcggagtttgttaagcacgcggggggcggtgatgtgccgaatccgcttcggcatattgtcgtcaaccctgcgcccttctcgtgaagagagagggttacgctggtgctgctatctgctgtgctgtaacatgtaggctcctttgtttctgggagttcaacggaaggtctctgtatttttacataaatcgagtgtgacagcaaattcaagagaaaaaaaatcatctgcaaatgttataggcttgtctacaaattgacaaggattcagtagcaatgctttgctagctggttttaacagttccctttccagtgacaagtctctgtatgcttcaagagggttcacatccaagataggaacagggttctagatggcattcaagtttgccatgctcaagctattcgatttcgaaggcattgaggaaacagagatatcattatgcttctctaggaggttgagctcccaaaggaatgaagcgaatgctccact

SEQ ID NO: 1937 - DNA, 1466 bp, Zea mays
aattcggattagacggccacgtcccccgccgagcctcaccaatcgccctctgcaggcagggaaggacggggcggggcggagatctgctgattgctctctttcttatcttctcgcctcccctcccctcccgttctcccaattccaacctgctgctcgcggtcgcggtggccattgcctcgctcgcgtctccttggccgcgggcggatccggccgcatcctgctgctgttccccattcgtcggtcgttgccagtccatggattcttaaccaattcttccccaagcttcttccttgcctgggagcagctagctgcatcctgttaaataatagctctagcgtgcggggggaggccgcgatggcgtccagggacttcctgcgcgtcttcggggcaggggcgggccaccaggacgacgccgccgccgccgccggccggacagacgacgtcgagctcagcctcggtctctccctgggcggccgcttcggcaccaccgacgccaagcgcccgcgcctggcgcgctcctcctccatcgcctccgtctgctccgtctcctccctccacgccgacgccgacgccgcgccgctgccgctgctgcgcaccacctcgctgcccaccgagaccgaggaggagcgctggcgccgccgcgagacgcagagccgccgccgcctcgaggcccggcagaagcgcgtcgagcgccgcaactccatggcctccctggcgcccgccgtcgtcggcgggaccgggaggaggtccaacgcctcgcaggggagcaactctgccagcaccacggagcaaggtattggtgggagcgcgagtaaccaatccacagacgcgaggagtccatcgtcaacctctgataataatacaaatcaaaacaacatgcttcctccgacgactaaagcagccgagaagccactaaacggcactgcgacagagcagccgcagcctcgcctgcggacgcttgggtccctgacgacgcggacgagcagtaccggcgacatcaggaagctcatgatggaggacatgccgatggtctcgtccaaggtagaggggcctaacgccaggaggatcgacggcttcctgtacaggtacaagaagggcgaggacgtgaggatagtgtgcgtctgccatggcagcttcctcacccccgcggagttcgttaagcacgctggcggcggtgacgtatcgaacccgcttcgacatatcgtcgtcaaccctgcgccgttctcgtgaagagagagggttacgctgttgctgctggtatcgatcgtgctgtaacatgttgtagtaggctccttgtttccgggagttcaatggaaggtctctctctatatttgacatggattgagtgtgacagcaaatccaagagaaacatcatctacaaatgttagacttgtctacaaattgacaaggattcaggttgctggcttacagcatttgcctgttctttgacattaaaaaaactccaa

SEQ ID NO: 1938 - DNA, 1202 bp, Zea mays
aaggaggacgagtgatcgaacgatctatgaaaaaagattagactcattttcaactcatatatttcttgattttttggttaagataaagtgtaacatttatttttattagtttaatatttggtaagtgaaccatatgctcaatttaatattaattagtttgcagctcaagagaggatttcacgagagggttgtactagtagaagatattggagaattgatacattatccaatgcaaaagtctatatattcaaacaccggagcaaacagtcgcgcagcctccacggctccacgtgacctcccaaacctagacctagttgtccttcctgttcaacctgcatagcggcggcgcgtcctgccttcagagagagagggagagagagcgcttgatctccgtaggcatggcatgggaggaggaggcggtagaagaggaggattacggggaggagatgtcggcttcggagtcggaggaggacgtcgtggtggggcagatgccgacggttatggtgccaaagcatatcaataagcggtccctgaagaacaaggcgctgtctgttaccctcgacaagaaagcgctcagggatttcgtgactgggttccacaagcggaagaaaaagagaagaaaggaggcgcagaagattttgcaggagaaggagaggaagaagaaaatacaagaccgcaagaggaggaaagaagagaaggagattgctctgtatggtagagtactgacatcggataaaaatgatggtgctggattagaaaacgaagatatcggcgatgatggtgaggatatggaaaatgacaaacctttgtctgaaatcaaaacctacgaagatgatgggaccagaactgtagtcaccaccagtgaaattactcctgaagaagatgacattgtcccgaaaactgtcggccccgtggcgacgagcctcaccagcaagaatcctagctcttttgccaagaagaacagcagtttaggtgtgaagaggaagccaccgaagagaacgttcaagagcaaggctagagcgaaaaggggtgacaagaagcggggtgctgcaaagggtaaaaggaagggcaagggaatgaagtagtgttttgtgaaccctctgtaggaagaattatgctgtcactggctgtggacctgtggttaatctcgcatcacctgatctgcagtttgtttggtaatatattgatgatcatttgttccg

SEQ ID NO: 1939 - DNA, 1157 bp, Setaria italica
gttccaacctaggtggcttcccctccgctagctaggcggcttcccaaggcggcggcgctgccttctctccccgagagagagagagagagagagagagagagagagagagagaggcgagctgtgtagccatggcatgggaggaggaggccgtggaagaggaggaatacggggaggagatggcggcgtcggagtcggaggcggaggacgttgtggtggggcagatgccgacggtgatggtgccgaagcacatcaagaagcgttccctcaagaacaaggcgctctccgtcaccctcgacaagaaagctctcagggatttcgttactgggttccacaagaggaagaagaagagaagaaaggaagcacagaaggttttgcaggagaaggagaggaagaagagaatcgaggcgcgcaagaggagaaaacaagagaaagagattgctctatatggtagagtgctgtcatcggatgatgttgaattagaaaatgaagatattggtgatgatggtgaggagatggaaaacgatgaacctttgtctgaaatcaaaacttatgaagatgacgggactagaatcacagtgaccaccagcgaaattacttgtgaagacgatgatattggaccgagaaatgttggccctgtgtcgagctacaccaacaagaattctagttcaatggccaagaagaactccagcttaggcgtgaagaagaagccacagaagagaacgttcaagaacaagagcaaggcgaaaaagggcgacaagaagcggggcgcggtaaagggtaaaaggaagggcagaggacggaagtagcgttttctgtctgtagagaaaaatcgtatggctgactgggttgtgggtgacctcatataatttgatgtgcacttgtctgttggtcatccatacggggctggtatgctaaactgtgagttgtgctgcatatcggttatcaatgtcagggtccatccatgatagaactgttttgatcctagttgagataattttcgtgacagtttttggccctttatttgtactaacctttcttgcatggacacatggttgtctgagccaaatgctgatctgctcgtagcttgccagcagtagcaccagctatgtactgcaaaaacaagggtgactatattttaggcagatggatttaattct

SEQ ID NO: 1940 - DNA, 1000 bp, Setaria italica
ggaagagttgtgtagccatggcgtgggaggaggaggccgtggaagaggaggaatacggggaggagatggcagcgtcggagtcggaggcggaggacgtcgtggtgggacagatgccgacggtgatggtgccgaagcacatcaagaagcgttccctcaagaacaaggcactctccgtcacccttgacaagaaagccctcagggatttcgtgactgggttccacaagaggaagaagaagaggagaaaggaagcgcagaaggtcttgcaggaaaaggagaggaagaagagaatcgaaggacgcaagaggagaaaacaagagaaagagattgctctatatggtagagtactgtcatcggctgatgctgaattagaaaatgaagatattggcgatggtggtgaggagatggaaaatgatgaatctttgtctgaaataaaaacatatgaagatgatgcgactagaattatagtgaccactagtgaaattacttgtgaagatgatgacattggacccagaactgttggccctgtgtcagcaggctacaccaacaagaatcccagctcggtggccaagaagaactccagcttaggcgtgaagaagaagccacagaagagaacgttcaggaacaagagcaaggcaaaaaagggtgacaagaagcggggcgcagtaaagggtaaaaggaagggcaaagggcggaagtagtgttttcagtctgtagagaagaatcctatggctaactgggctgtgggtaacctcatgtaagacatgacttgatctgcacttgtttgttggtcatccatactgggctcagtgggctgatatcctgatatgctaagcttcgagttgtgctgctgaggggttgagttgtgctgcatttcggctgtcaatctcagggttcatgaaagaactgatttaatcctagttgagataattttagtgacagtttttggccctttgggctactctttcctgacatgttcacatggtcatcgagccaaatgctg

SEQ ID NO: 1941 - DNA, 1026 bp, Panicum virgatum
cttccccttctcttccgcaaggcagcggcggcggcggctcctctcgacctctccccgtgtttttgagggagggagggagggatccttttctcgaagcggtgtagccaatagccatggcgtgggaggacgaggccgtggaggaggaggaatacggggaggagatggcggcgtcggagtcggaggcggaggacgttgtggtggggcagatgccgacggtgatggtgccgaagcacatcaataagcgttccctcaagaacaaggcgctctctgtcaccctcgacaagaaagccctcaaggatttcgtgactgggttccacaagaggaagaagaagagaagaaaggaagcacagaaggttttgcaggagaaggagaggaagaagagaatcgaggagcgcaagaggaggaaacaagagaaagagattgctctatatggtagagtactgtcatcagatgatgctggattagaaaacgaggatattggcgatgatggtgaggagataaatgatgaatctttgtctgaaatcaaaacttacgaagatgatgcgactagaatcactgtgaccactagcgaaattactcctgaagatgatgacattggaccgagaactatgggccccgtgtcgacgagctacaccagcaagaatccaagctccgtggccaagaagaactccagcttaggcgtgaagaagaagccacagaagagaatgttcaagaacaagagcaaggcgaaaaagggcgacaagaagcggggcacggtaaagggtaaaaggaagggcaaaggacggaaatagtgttttcagtctgtagaggagaatcgtatggctgattgggctgcgtgtaacctcatataacttggatctgcacttgtttgttggtcatccatactgtgggatgatatgctaagcggcgagttgtgctgctaaaggggttggactgcgctgctgaggggttgagttgttctgcatatcggctgtcaatctcagggtacattaaagacttattttgatcctagttgggatatttttc

SEQ ID NO: 1942 - DNA, 944 bp, Saccharum officinarum
cacgcagcctgcacgtgacctcccaaacctaagttgtccttccggtttaccctgcatagcggcggcgcctcctgccgagagagagagagcgaactccgtagccatggtgtgggaggaggaggcggtggaagaggaggaatacgggaatgagatggcggcttcggagtcggaggaggacgtcgtggtggggcagatgccgacggtgatggtgccaaagcatatcaataaaagggccctgaagaacaaggcgctctctgttacgctcgacaagaaagcgctcagggatttcgtgactgggttccacaagcggaagaagaagagaagaaaagaggcgcagaagattttgcaggagaaggagaggaagaagaaaatacaggaccgcaagaggaggaaagaagagaaggagattgctctatacggtagagtactgtcatcggataacaatgatggtgctggattagaaaatgaagatatcggcgatgatggtgaggacatggaaaatgacgaacctttgtctgaaatcaaaacgtacgaagatgatgggaccagaattatagtcaccaccagtgaaattactcctgaagacgatgacattggcccgaaaactgttggccccgtggcaacgagctacatcaacaagaatcctagctcgtttgccaagaagaacaacagtttaggtgtgaagaagaagccacaaaagagaacgttcaagaacaagaagtaagccaaaaaggtgacagaaacggggtgctggaaagggtaaaagggagggcaagggaaggaagtagtgttttgtgaaccctctgtagaaagaatcgtatgctgtgactggctgtggacctgtggttaatctcgcatcatctgatctgcacttctgttggtgacatatcgatgatcatttgttccgcacacaaatgtgatggaccaattggtatatcgatgct

SEQ ID NO: 1943 - DNA, 1118 bp, Panicum virgatum
cgtgacctccctaacctcgctgcccagcctgccctcgccttctcttccgcggcggcggcggcggcggcttcttctctccccgtgtgtttgagagggagggaggagggagagagcgagggagccaatagccatggcgtgggaggaggaggccgtggaggaggaggaatatggtgaggagatggcagcttcgcgagtcggaggcggaggacgttgtggtggggcagatgccgacggtgatggtaccgaagcacatcaataagcgttccctcaagaacaaggcgctctccgtcaccctcgacaagaaagccctcaaggatttcgtgactgggttccacaagaggaagaagaagagaagaaaggaagcacagaaggttttgcaggagaaggagaggaagaagagaatcgaggagcgcaagaggagaaaacaagagaaagagattgctctatatggtagagtactgtcatcggatgaggctggattagaaaatgaggatattggcgatgatggtgaggagataaatgatgaatctttgtctgaaatcaaaacttatgaagatgatgcgactagaaccactatgaccactagcgaaattactcctgaagacgatgacattggaccgagaattatcggccctgtgtcgacgagctacaccagcaagaatcctagctcggtggccaagaagaactccagcttaggcgtgaagaagaagccacagaagagaatgttcaagaataagagcaaggtgaaaaagagcgacaagaagcggggcacggtaaagggtaaaaggaaaggcaaaggacggaaatagtgtcttcagtctttagaggagaaatcgtatggctgattgggctgcgcgtaacctcataaacttggatctgcacttgtttgttaggtcatccatatgctaagttgcgagttgtgcagctaaggggttggccggttgggttgtgctgccgagggcttgagttgtgctgcatttcggctgacaatctcagggtacatgaaagatttattttgatcctagttgagataattttcgtgatagtttttggtccttggggacaatctttcgcgacacggacacatggttatatgagccaaatgctgatttgctcct

SEQ ID NO: 1944 - DNA, 1415 bp, Zea mays
gagctctccgctggcgttgtgcaacgaacaaagctcatgtcataatcaccaatcgataatcggctgatgataccaaacaaggagtcactaattatcccaaggcgcccatcggctttaaaatatccgagttgcgtgcgttgccatcctctcttgctcggtcgcctttcccggtctttggtgtggataaaccggctttcttgctgttctcgatccttcttcaattcgctgtagtttttccttttgtcgcttgctcttgttctctttccaagaccgaggaagacgagtcagatttggtgattgtgtagagcgtacaagtgattgttcttggagaagcataggcctctcttggctgctcttgtcttcttgagcaaggaggcggaggaaaggaaagacatggaagaggaatccgtcgcagcttcaaggtactactgccacatgtgctcgctgatcataaggcccgaactgggcatcgaggaggtgaagtgcccccactgccacaccggcttcgtggaggagatggcgggcgaccggcgaggcagcgacgacgcagccatcagaggccgtcctcccggcggcgaggcgagctctaacgcctcggacgcggcgctggagcgcgaggtttcgctctgggcgcctgtgctcatggacttcatcgccgcctcgtccggccgccacggcctcgacggccacggaggggacctcgccgctttggcgcgaaggcagtaccgcaacatcgccctcctgcagctgctcaacgcgctccaggaaggcgacaccgatgccgggcgcgagcgggtcgtgctcatgagccccgcggacgcgcgcgccatgcttatgggacaagagcgaggggacggcgccgccgccctgggccccggcggtctgacgctcggggacctgttcctcggcccggggctggacttgctgctggagtacctggccgagaccgacccaaaccggcagggcacgccgccggccaggaaggaggccgtggccgcgttgccgacggtccgggtgcgcgaggacttcacctgccccgtgtgcctggacgaggtcgcgggcggcggcgacgcgcgcgagatgccgtgcaagcaccggttccacgaccagtgcatcctgccctggctggagatgcacagctcctgccccgtgtgcaggcaccagctgcccacggaggagccggcggaggcaattggcagcgacagaggcgccggtgttgagtccagtggcaacgcgcgcggcggcgggaggaggcattggttctcgtggcccttcggagggttgttctcgcaaagatccagcgggaactcctcgtcgtcctgatgatgcatgaacacgataataatatgcaagggaacacctcatcgtccctgatgatgctaatgaacaggataataatatgcgtcgatgtagcc

SEQ ID NO: 1945 - DNA, 954 bp, Setaria italica
acatggacgaggaatccggcgccgcttccaggtacttctgccacatgtgctcgctgatcatacggcccgagctgggcatcgaggaggtgaagtgcccccactgccacaccggcttcgtggaggagatggccggcgaccgtcgagccggcggcgacgcggacacccgaggccgtgctgtgagtgtgaacgcctcggacgccgcgttggagcgcgaggtctcgctctgggcgcccgtgctcatggactatctcgccgcctcctccggccgccacggcctcgacgccggtggcggcggaggggacctcgcggctttcgcgcggaggcagtaccgcaacatcgccctcctgcagctgctcaacgcgctccaggagggcgacgccgccgacgcggggcgcgagcgggtcgttctcgtcagcccctcggacgcgcgcgccatgctcatggggcaagagcgaggcgcaggcgccggcggcgcggccctgggccccggcgggctgacgctcggggacctgttcctgggccctgggctggacctgctgctggagtacctggccgagaccgacccgagccggcagggcacgccgccagccagaaggaggccgtggcggcgctgccgatggtccgggcgcgcgaggccttcacctgccccgtgtgcctggacgaggtcgcggccggcggcgaggcgcgggagatgccgtgcaagcaccggttccatgacccgtgcatcgtgccatggctggagatgcacagctcctgccccgtgtgcaggcaccagctgcccgcggaggagcctgctgagccggccggcggcggcaggcgcgctgctgacgaggccagcggcaacgcgcacagcggcgacgacgggagaagcagcggcaggaggcattggttctcgtggccctttggcgggctgttctcgcaacgatcgaacgggagctcctcctcctcgtcgtg

SEQ ID NO: 1946 - DNA, 1408 bp, Panicum virgatum
  misc_feature (718)..(718): n is a, c, g, or t
  misc_feature (1274)..(1274): n is a, c, g, or t
  misc_feature (1284)..(1284): n is a, c, g, or t
  misc_feature (1334)..(1334): n is a, c, g, or t
  misc_feature (1347)..(1347): n is a, c, g, or t
  misc_feature (1374)..(1374): n is a, c, g, or t
  misc_feature (1386)..(1386): n is a, c, g, or t
ggtcgtcgccgctccgggtccggaactccggataaacccgctttccttgctgttctggatccttcttctcgcttgtttttacgcgggttgcttgctctggtcgtctggttccctgccctgaccgaggaagcagattcaggccagcttggtgatcgcgtagaagaagaggaagcagaggctccacgatctcttggctgttcttgatcaagaaggcggaggaacagagcgcaggcaagggaaggcatggacgaggcatacggcgcggcggcttccaggtacttctgccacatgtgctcgctgatcatacggcccgtgctgggcatcgaggaggtcaagtgcccccactgccactccggcttcgtggaggagatggccgtggactcgctaggaggcgccggcggcgcggcgatcccagggcgtgctgccggcgagccgagcgtggacgccccggaagccgcgttggagcgcgaggtctcgctctgggcgcccgtgctcatggacttcctcgccgcctcgtccggccgccagggccaggaccacggccgcggccacggcctcgacgccgccgccggcggcggcggaggggacctcgcggctttcgcgcggcggcagtaccgcaacatcgccctcctgcagctgctcaacgcgctccacgaagcagacgccgccgacgcggggcgcgagcgggtcgtgctcgtcagccccgcggacgcgcgcnccatgctcctgggacaagagcgaggggacggcgccgccgccctgggccgcggcgggctgacgctcggggacctgttcctcggccccgggctggacctgctgctggagtacctggccgagaccgacccgagccggcagggcacgccgccggccaggaaggaggccgttgccgcgctgccgacggtccgggtgcgcgaggccttcacctgccccgtgtgcctcgacgaggtcgcggccggcggcgaggcgcgggagatgccgtgcaagcaccggttccacgacccctgcatcgtgccgtggctggagatgcacagctcctgccccgtgtgcaggcaccagctgccagcggaggagccggctgacccggccggcagcggccggcgcgctggcgacgaggccggtggcaacgcgcgcggcggcgacgggggaagcggcggcaggaggcactggttctcgtggccttttggcgggctgttctcgcaaagatcaaacgggagctcatcgtcgtcgtcttgatgcaacgaacagaataaagaaaatcttgtagaagctcgttnttgatttctnctacgtgatgattgggttaatattggccattgtaaagctgcatttgtccntaggtttatttgnactagttttgcttcgttcaggtggatngagattattggngaatgcatctatcaacgcaaaa

SEQ ID NO: 1947 - DNA, 1604 bp, Zea mays
gcatacagagttgcttgaatcctcggccatgccggccaggacatggctcgccgacctgcggtcgaggctccgcgtcggccccaggaagaacgacgggcttggcatcctggccttcgaggcagcagccaacatgtcgcggctggtatccctccaccggacggtgtccgacgtcgaggtcaggaggctccgcgccgacgtcttgcgcgccgagggcgtcgcgcggctaacgtctacggaccagtctctcctgctccgcttcgcgtgcggcgagctcctcgcggacctcgaccgcgccgccggcagcgtggcgtgcctcggcgcgcggtgctgcgccggcgacgcgccgctactgagggacttcgatcgggtctacgccgaggcgaagcgtggccggctcgcgcagctggacgccacggtcgggttctccaggggcgccacgaggcggttcaaggagatggagcgccatgtggtcgtggcggcgaagctgtacgcggagatggacgcgctcagcgagctggaggcgtcagagcggcggatggagcggtggaagcagcacagcgggccaatcccggcgcagacgacggggacgggcaaggggtcagcggccgatcccggagagaagctgatgagtaagctcagggagcagcggcagaaggtgcgacgggtcatggagggatcgctgtggaacgtcgccgccagcaaggcggcgaggctcatggccaagtcggtcctcgccgtgctcgcgcgcatctccctcgcctttgccgcgttcgttccaggccttcccccttggacggtaggacgcgcgtgggcgctcggtcactcatccggatccggcccgttacaccggtcggcgacgcccgcggcgctccagcattcggctcccatcttcggccagagagactccgcctccctactgtcggcgtcgtcgatcaagccgtcagtgagcacggtcggcggctcgagcatggagctgcgatacgcgaacgtgatcttagccgccaagacgttgctcgcggcgctgaggccgccggcaggtgacaacgaggaggcgcacgaagggatgatcgacctgtcgaagagagacgcgctgtacaagatgctacccgtcggcatccgcaaggccatgaacgctaagctgagagagatctggaagaaagcgcaaccggtggacgaggtgtctgccgcggcatcgaaggatgcggtggagtgtctgctgcggtggttgagcccgatggcgcacgacactgtgcggtggaacgacgagcagagtatggagcgggcgcagcggttcagcatgcagcctcgcgcgctgatggtgcagacgttgcacttcgccgaccgcaagaagacggatgctgctattgttgatgtgctcatcggcctcacctgcgtatgctggtacgacgatgagcagcgaaggctggagtctctagacagggacgacgacgacgagtatcagctatagatttttgagctgtgattttatcgtgtgtgtgaatatcatgtaactgcaaatcgcgtgtacatagaacaacttaacagcctttatataatcaaatctagccgttttagataaataaaaggaacttgccatatttcag

SEQ ID NO: 1948 - DNA, 1358 bp, Saccharum officinarum
cgctctcaagcctcaaaatcccactagcgaaagaaaaacgagagaagcagcagcagccgcggctccatttcttcttccttgagcactcgcctttgcctgctcaaagagcttgctttggtggcatcggttcttcgtttcatggccgagatctgctgcgaggtggcggcggccgggtcggaccggaaggggaagtgcgtcggcgcggacgccggcagccgcgcggcgcggcggcggaggatggagatccggcggctcagggtggtggccgaggaggcgtccgccaagaggccgaggctggaggcggatgtggaagacgcggttaggggaccggcgccgaggtacggcgtgacgtcggtgtgcgggcggcggagggacatggaggacgcggtgaccgcccgccttgggttcatcaacggccaccacttcttcggggtgttcgacggccacggctgctcacatgtggcgacgtcgtgcgggcagcggatgcaccagatcgtggccgaggaggcgaccgctgccgccggctcgtcggtttcggacgacgcggcgcggtggagggatgtcatggagaagagctattcgaggatggacgccgaggccgtcggctccagggagaccgccggcccggcgcccacctgccgttgcgagatgcagcttcccaagtgcgaccacgtgggctccacggccgtcgtcgccgtggtggggccacgccacctcgtcgtcgctaactgcggcgactcccgcgcggtcctctgcagcggaggcgccgcgatccctctctcagatgaccacaagcctgaccgccccgacgagctggaacggatccacgcagcgggagggcgcgtcatctactgggacggcgcccgcgtcttcggcatgctcgccatgtcccgcgccatcggtgacagctacctgaagccgttcgtgatatcggacccggaggtgcgggtggtggagaggaaggacggcgaggacgagttcctgatcctggccagcgacgggctgtgggacgtggtgagcaacgaggtggcgtgcaaggtcgtgcgcacctgcctccgcaacagagcgccgcacccgcacggcggggagcggtcgagcgcgacctccaacctgagccccaggcacagcaacggcagcagcagcagggaggaggaggaggctgggccaagcgacggcgcggggtccgagagcgacgacggcgagagcagcgaggacagggcgtgcgccgaggcggccatcctgctgaccaagctggcgctggcgcgacagagcgcagacaacgtcagcgtcgtcgtcgtaaacctaggcggggcccgagatcgtgatcggcggatccaaggaactaccgttcctgatgt

SEQ ID NO: 1949 - DNA, 1810 bp, Zea mays
gtggcgcgtggcatccctgctcctgccttttatacccccgcggcaccacttggaacgcaaacgcaacccctctcgctctcaagcttcaaaatcccactagcgaaaggaaaacgggagaagctaggaagcagcagccgcggcatttcttccttgagcgttcgccttcggctgctcaacgcgtgcttcgtttcaggagagccttggtggcatctctgtttcatggccgagatctgctgtgaggcggcggcggcggcggcggggtcggaccagaagggggagtgcgccggcagccgcgcggcgcggcggcggaggatggagattcggcggctcagggtggtggccgaggaggcgtccgccaagaggcggaggctggaggcggatgaggaagacgcggttggggggcgagcgccgaggtacggcgtgacgtcggtctgcgggcggcggagagacatggaggacgcggtgaccgcccgtccggagttcatcaacggccaccacttcttcggggtgttcgacggccacggctgctcacatgtggcgacgtcgtgcggggagcggatgcaccagattgtggccgaggaggcgacagctgccgcaggctcgtcggtttcggacgagaccgcgcggtggaggggtgtcatggagaagagctacgcgaggatggacgccgaggccgtcgtctccagggagaccgccggcccggcgcccacctgccgttgcgagatgcagcttcccaagtgcgaccacgtgggctccactgccgtcgtggccgtggtggggcctcgccacctcgtcgtcgccaactgcggcgactcccgcgcggtcctctccagcggaggcgccacgatccctctctcagctgaccacaagcctgaccgccccgacgagctcgaacggatccacgcagcgggagggcgcgtcatcttctgggacggcgcccgcgtcttcggcatgctcgccatgtcccgagccatcggtgacagctacctgaagccgttcgtgatctccgacccggaggtgctggtggtggagaggaaggacggcgaggacgagttcctgatcctggccagcgacgggctgtgggacgtggtgagcaacgaggtggcgtgcaaggtcgtgcgcacctgcctccggaacagggcgccgcgcggtggccgggagcggtcgagcccgacctccaacctgagccctaggcagagcagcgccagcggcggcagcagcagcagcggggacgaggaggctggtgggcccagcggcgacggcgcggggtccgagagcgacggcgagagcgccgaggacagggcgtgcgccgaggcggccatcctgctgaccaagctagcgctggcgcggcagagcgccgacaacgtcagcgtcgtcgtcatcaacctcaggcggcgcccgcgatcgtgatcggtggtggtggctctgtgatggactagccgttcttggttggtttggttttctggccccctccgtaagttcaaatgggagcccggttcaccttcgcttcggcagagcaatcatcagacaagatgtcaaagcgaagatcgaacaaaatgtgagatccttagcaaaattgcatgctacttccttttacagtagtacagcaggactattgtttcgttagcgtttttttatgggtgggttgaggggtgcgtttctgatctggtcggacagatcatcccgcctttcttcccccggtaaattctccaaatagaaaagcgcatgcgtctccgatgtttgaagaaactttaccgtgcgtccgagagatttaattgtaatatatagtccagtgcccctttcactagcc

SEQ ID NO: 1950 - DNA, 1382 bp, Setaria italica
cgtgttcaaccaagtggctttggcgaacccctctcgctctcaatcaacaagcactagcgcaaggaaaacgagagaaggcaggagcagcagcagcagcatttcccccttccgcttgcttgtttgctcaacgcgtgcttgatttgaggagattatcgtgggatttggatcgttgtttcatggaggagatctgctgcgaggtggcggcggggtcgtcgtcgtcggacaggaagggggagggcgtgggcgacgccggcagccgcgcggcgcggcggcggaggatggagatacggcggctcagggtggtggcggaggagcaggccgcgaagaggcggaggctggagggtgacgacggggaggaggaggaggacgcggtgagggacccggcgccgaggtacggcgtgacgtcggtgtgcgggcggcggagggacatggaggacgcggtcaccgcccgcccggggttcatccacggccaccacttcttcggggtgttcgacggccacggctgctcgcatgtggcgacgtcgtgcggggtgcggatgcacgagatcgtggccgaggaggcggccgccgctgcggcgggctcgtcggcgtcggacgaggcggcgcggtggagggacgtcatggagaagagctacgcgcggatggacgccgaggccgtcggctcaagggacactaccggcccggcgcccacctgccggtgcgagatgcagatgcccaagtgcgaccacgtgggctccacggccgtcgtcgccgtggtagggccgcgccacctcgtcgtcgccaactgcggcgactcccgcgccgtcctctgcagcggaggcgccgccatcccgctctcagccgaccacaagcccgaccgtcccgacgagctcgaacggatccacgcggcgggagggcgcgtcatcttctgggacggcgcccgcgtcttcggcatgctggccatgtcgcgagccattggcgacagctacctgaagccgttcgtgatctccgacccggaggtgagggtggtggagaggaaggacggcgaggacgagttcctgatcctggccagcgacggcctgtgggacgtggtgagcaacgaggtggcgtgcaaggtcgtgcgcgcctgcctccggaacggcgcggtgcgccgcggggagcggtcgagcccgacctccaacctgagccccaggcagagcagcggcagcagcagcggcgacgaggaggccgggcccagcgacggcgcggcgtccgacagcgacggtgagggcggcgaggacaaggcgtgcgccgaggcggccatcctgctgaccaagctggcgctggcgcggcagaccgcggacaacgtcagcgtcgtcgtcgtcaatctcaggcgccgccggaggtcgtgaccgggcggatcc

SEQ ID NO: 1951 - DNA, 1258 bp, Sorghum bicolor
ctgcaggcttggagcaagcctctcaacatgtcgtgggccgcaatagagaatgatcctggtgtttttacagaactgttgcagcagatgcaactgaagggtcttcaagtcgatgaactctactcacttgacctggatgctctcagtgatcttcagccaatctatgggctaatagtgctatacaaatggcgacctccggaaaaggatgagcgtcctgtcatcaaggatgcaatcccaaaccttttctttgccaaccagataattaacaacgcttgtgcaacccaagctatcctttcagttctcttgaactctcctggcatcacccttagtgatgagcttaaaaagctgaaggaatttgcaaaggatttgccacctgagctcaaaggattggctatagtcaattgtgcaagcattcgcatgctaaacaactcgtttgcaaggtcagaggtctctgaggagcagaaaccacatagcaaggacgacgatgtataccatttcataagctatgttccagtggatggcgtcttgtatgagcttgatgggctaaaggaaggaccaataagcctgggaaaatgcccaggtggtattggtgatgcagggtggcttaggctagtgcaacctgtgattaaagagcacattgacatgttctctcagaatgagataagattcagtgtgatggcaatcttaaagaaccggaaggagatgttcacagtggagctcaaagaccttcagaggaagagggagagcctcttgcaacagatgggtgacccttctgcgatcaggcacgtgccatctgttgagcagtcgctagcggaggtggcagctcagatcgagtctgtgacagagaagatcataatggaggaagagaagtcgaagaagtggaagacggagaacttgaggaggaagcataactacgtgccgttcctgttcaatttcctcaagattcttgaggagaagcagcagttgaagcccctgatagagaaggcaaaggcgaagcagaagtctcacggcccaagtgctaggtgaaaaaagctgcgatgcacctacagtctcttttagttgggggtttcttgtagagattgggcctgtgtcccttgttttcttggccagtgtttgaaccttatgcttacccctagttttaggtagcgcacaaatgtctgccgttacatattcaggtgaatgaatcttggcatggcgagtgccccgtggactgtatgcagtcatactgtatgaaaccatgcatgatttacccagttttttt

SEQ ID NO: 1952 - DNA, 1377 bp, Zea mays
atgccccataaactgagtctgcactgagctactcctggctaccgcaccacgcttcacccggcgtgcactccatctctctgggacgactacggccgccgccgccgccgcccccacctacgccaggtgccgaggccttcgttggcctcttcgccggtgacgagaacctaccagacttggagcaagcctctcaacatgtcgtgggccgcaatcgagaatgatcctggtgtttttacggaactgttgcagcagatgcaactgaagggtcttcaagttgatgaactctactcacttgacctggatgctctcaatgatcttcagccaatatatgggctaatattgctatacaaatggcgacctccagaaaaggatgagggtcctgtcatcaaggatgcaatcccaaaccttttctttgccaaccagataattaacaaagcctgcgcaacccaagctatcgtttcggttctcttgaactctcctggcattacccttagtgatgagcttaaaaagctcaaggaatttgcaaaggatttgccacctgagctcaaaggactggctatagtaaactgcgcaagcattcgtatgttaaacaattcgtttgcaaggtcagaggcctctgaggagcagaaaccacctagcggggatgatgatgtataccatttcataaactacgttccagtggatggtgtcctgtacgagcttgatgggctaaaggaaggaccaataagtctagggaaatgcccaggtggtgttggtgatgcagggtggtggcttaggctagcgcagcctgtgatcaaagagcacatcgacctgttctctcagaacgagataagattcagcgtgatggcgatcttgaagaaccggaaggagatgttcacggtggagatcaaagaactccagaggaagagggagggcctcttgcagcagatgggcgatcccaacgcaagcaggcatgttgagcagtcactcgcggaggtggcagctcagatcgagtctgtgacggagaagatcataatggaggaggagaaggtgaagaagtggaaagcggagaacctgaggaggaagcataactacgtgcccttcctattcaatttcctcaagattctcgaggagaagcagcagctgaagcccctgatagagaaggcgaaggcgaagcagaagtcccacggccccagctaggtgaaaagccgcaatgcacctacgtactgtctcttttagttggggttccttgtaagattggagttcgcgtatatgctttctgtttttagtttaggacaattgcaccaatagggtgcaactgcagatttatccctgttttttagactttgcgtgtgtgcctttagattttttgaaatgaaactgctgtatgtctctattccg

SEQ ID NO: 1953 - DNA, 1701 bp, Zea mays
atgccaaaggaaacacgacgactactacaaacacaggcacatgagaaggtagactgcggcacaccatcgttgccaagccacgagacatcccactcgagaccgctccgattcttcactagcgagacttccaaaatcttgatccttcgtcccgtctccgccaaatgcctcaccaacgaagcaaaccagcccatgaaaaagggagtctccccatatcatcgttaccgagctacacccccagacgtagtagcttcgacttcacgaattatacgttgccagaggttcaaaactgactgcagatattccttagtattttatttctttcatattgttgccgtgtcaacccgtcaattttcagttttgaaccctacgagcagcggtgcgactaggagcaaacctctcaccatgtcgtgggctgcaatagagaatgatcctggtgtttttacagaactgttgcagcagatgcaactgaagggtcttcaagttgatgaaatctattcacttgacctggatgctctcaatgatcttcagccaatatatgggctaatagtgctatacaaatggcgacctccagaaaaggatgagcgtcctgtcatcaaggatgcaattccaaaccttttctttgccaaccagataattaacaacgcgtgtgcaacccaagctatcctttcggttctgttgaactctcctggcatcaccctcagtgatgaacttaaaaagctgaaggaatttgcaaaggatttgccacccgagctcaaaggattggctatcgttaattgtgaaagcattcgcatgataaacaactcgttggcaaggtcagaggtctctgaggagcagaaacgacctagcaacggcgacgatgtttaccatttcataagctatgttccagtggatggtgtcctgtatgagcttgatgggctaaaggaaggaccaatatgcctggaaaaatgcccaggtggtgttggtgatgcagggtggcttaggctagcgcagcctgtcattaaagggcacattgatctgttctctcagaatgatgtaagatgcagtgtgatggcaatcttaaagaaccggaaggagatgtgcacggtggaactcaaagaactaaagaggaagagggagagcctcttgcaacagacgggctatccttctgcaattaggcacgtgccatctgttgagcagtcactagcggaggtgtcagctcagatagaggctgtgacggagaagatgataatggaggaagagaaggtgaagacgtggaagacggagaacttgagaaggaagcataattacgttcccttcctgttcaatttcctcaagattcttgaggagaagcagcaattgaatcccctgatagagaaggcaaaggcgaagcagaagtcgcactgccccagtcctaggtgaaagatgcaatgatgccatttcattcacatattagtaacgtaatgggtaatcaacaacattaaattatgtttgtttaagtaacgtaatgggtaatgcaatgattcgtagttgggtccttgttttcttgaccagtatttgaaccttatgtttatctctactagttttattaggtagtgcacaaatggctgccattacatgtttgaggtgaacgagtcttgacgagacgagtgcctcgtggactgtatgcagtcatactgatgtgtttgaacaccatccatgaaatggcttacacagtttctttgt

SEQ ID NO: 1954 - DNA, 1235 bp, Setaria italica
tttacagaattgttgcagcagatgcaactgaagggtcttcaagttgatgaactctactcacttgacctggatgctctcaatgatcttcagccaatatatgggctcatagtgctgtacaaatggcgacctccagaaaaggatgagcgccctgtcatcaaggatacagtcccaaaccttttctttgccaaccagataattaataacgcgtgtgcaacccaagctatcctttctgttctcttgaactctcctggcatcacccttagtgatgagcttaaaaggctaaaggaatttgcaaaggacctgccacctgagctcaagggattggcaatagtgaattgctcaagcatccgtatcttgaacaactcatttgcaaggtcagaggtccccgaggagcagaaaccatctagcaaggatgacgatgtctaccacttcataagctatgttccagtggatggagtcctgtatgaactcgatggacttaaggaagggccgataagcctggggaaatgcccaggtggtgtcggtgaggcggggtggcttagggtagcgcagcctgtgattcaagagcacattgatcggttcactcagaatgagataaggttcagtgtgatggcaatcttgaagaaccggaaggagatgtacacagcagagctgaaagacctgcagaggaagagggagaacctcttgcagcagatgggcgatccttctgccaggcatgtgccatctgtcgagcagtctctagcagaggtggctgctcagatcgaggctgtgacggagaaaatcataatggaggaagagaaggtgaagaagtggaagacagagaacatgaggaggaagcacaactatgtgccgttcttgttcaatttcctcaagattctcgaggagaagcagcagttgaagcccctgatagagaaggcaaaggcgaaacacaagtctcacagtcacagcaccaaccctaggtgaaaaagctgcaacgcgcccagtgtttgttttagttgaggtttcttgtagagattgtgtctgtggcccatgttttcttggccagtgtttgaatctatgcttacccctaatcttagctagtgcacaaatgtctgccaaaatatgttcaggtgaatggatcttgaaggggcgagtgccctgtggagtttacccagtcatactgtatgagaactatacactttttttttcctcgcagactgattgtttcgtactttcgtttgctgacacatctgtgg

SEQ ID NO: 1955 - DNA, 1406 bp, Pennisetum glaucum
ctctcatctctgtctgttttttctttcccccgttcccttctctcggactcttggtctctcacggcgacgactgggcgcaccgcgtcttcgccgggcctttttccggcgacgagcgtccaccagaattctttggagctagcgtttcgacatgtcttgggctgcaatcgagaatgatcctggtgttcttacagaactgctgcagcagatgcaactgaaaggtcttcaagttgatgaactctactcacttgacctggatgccctcaatgatcttcagccaatttatgggctcatagtgctgtacaaatggcgacctccagaaaaggatgagcgtcctgtcatgaaggatacagtcccaaaccttttctttgccaaccagataattaataacgcgtgtgcaacccaagccatcctttctgttctcttgaactctagtggcattacccttagtgatgagcttaaaaggctaaaggaatttgcaaaggacttgccgcctgagctcaagggattggccatagtcaattgctcaagcatccgtatgttaaacaactcatttgcaaggtcagaggtctccgaggagcagaaaccatctagcaaggatgacaatgtctaccacttcataagctatgttccagtggatggcatcctgtatgagcttgatggacttaaggaagggccgataaacctggggaaatgcccaggtggtgttggtgaggcagggtggcttaagttggcgcagcctgtgattcaagagcacattgatcggttctcagataatgagataagattcagtgtgatggcaatcttaaagaaccggaaggaggcgtacacagcagagctcaaagaactccagaggaagagagagagcctcttgcagcagatgggcaatggttctgccaggcacatggcatctgttgggcaatctcttgcagaggtggcttctcagattgaggctgtgacggagaagatcataatggaggaagagaagttgaagaagtggaagacggataacattaggaggaagcacaactacgtgccattcttgttcaatttcctcaagattctcgaggaaaagaaacagttgacgcccctgatagagaaggcaaatgcgaatcagaagtctcatagtcgcagctccaatcctaggtgaaaaggctgcaatgcatccatattgtttgttttagttgatgtttcttgtagagattggcagtgacaggggtggatccaggacccccaccttatacattaatccaaaaaatgggtcatacaagaggttcttggcacaatacaaaggatatataatgtgtcttgagtgttactcttcttcctcagttcactaacttatacatggaggaaactcaacttgtaggcttcttttgtgacagtcaaattcaacttaaatgtaagac

SEQ ID NO: 1956 - DNA, 1413 bp, Avena sativa
gatcgcccctatcccgttgttcctgttggaacagagcagctcggcccgcccctagcagaacacggcggccggagagacggcggtcggcggcgggattccacggaaaaaggcgagctgtccgtagcgacgctagatccgcccctgctcgttgggattcttcgcggatttacagagggcttcctcagcatgtcttgggcggcaatcgagaatgatcctggtgtttttaccgagctgttgcaacaaatgcagttgaagggtctccaagtcgatgaactctactcacttgatcttgatgccctcaatgatcttcagccaatttatgggcttataattctgtacaaatggcgacctccagagaaagatgaacgccctgttatcaaggattcagttccaaatctattctttgccaatcagataattaacagcgcatgtgcaacccaagctattgtttctgttctattaaactcttctggcatcacccttagtgatgacctcagaaagctgaaggagttcgcaaaggacttgcccccagagctcaaaggattggctatagtgaattgcgaaagcattcgtatgaccagtaactcatttgcaaggtcagaagagcccgaggaactgaaatcatctagcaaggatgatgatgtctaccatttcattagctatgttcctgttgacggtgtcctgtatgagcttgatggactaaaggaaggacctataagcttgggaaaatgcccaggtggtattggtgagatggggtggctgaagatggtgcagcctgtcattcaggaacacattgataagttttctcagaacgagataaggttcagtgtcatggctatcacaaagaaccggagggatatgtacatcgtagagctcaaggaacttcagagaaagagggagaacctcttgtcacaaatgggtgatccttctgccaatcgccaaaggccatctgttgagcggtcactcgcggaggttgctgctcagattgaggctgtgaccgagaagatcataatggaggaagagaagtcgaagaagtggaagacagagaacatcaggaggaagcacaactacgtgcctttcttgttcaatttccttaagatcctcgaggagaagcagcagctgaagcccctgatagagaaggcaaagcggggttctcacagccgtaactccaagtgaatctgcattgtaaaattctattgttctgatttgttttgttttcatgtagagatgaccctgactggctttgtgttcttatggctgactggctttgttttcttgccgaatgtgcctgtagcttagtcctggatagggcgtgcattttacagtcctagtattttcagggaaatcttaagatttatgtagggggacatcctgaattttatcagaatttatatgcgcagttgagggttgttc

SEQ ID NO: 1957 - DNA, 1566 bp, Oryza sativa
gtctctctctctctctctctctctctcttctctctccagtccaatctcacccatcgccgacgacccacgcacgcagtccaccaacgcgccgccgccgccgaatccgcttcgctccctccgccgcgccgcgcgccacctccgtcgacgctggcccgacgcgcgcggttcgtgaaggaggaggaggaggaggagcttctgccgggtcggaccgtcggtttctctcgttgacctgcaggagggtgcgcagggtttcttcttcgacatgtcttgggctgcaatcgagaatgatcctggcatttttactgaactgttgcaacagatgcaactgaagggtcttcaagttgatgaactctattcactcgatctggatgccctcaatgatcttcagccagtttatgggctcattgtgctgtacaaatggcaacctccagaaaaagatgagcgtcctatcaaggacccaatcccaaaccttttctttgctaagcagataattaacaatgcatgtgccacccaagctatcgtttctgttctattaaactctccgggtatcacccttagtgaggagctcaaaaagctaaaggagtttgcaaaggacttgccaccagatctcaaaggattggctatagtcaattctgagagcatccgtttggccagtaattcatttgcaaggccggaagtccccgaggagcagaaatcatctgtcaaggatgatgatgtctaccatttcattagctatgttcctgtggacggtgtcctgtatgagcttgatgggctaaaggaagggccaataagcctggggaaatgcccaggtggcgttggcgacataggttggctgaggatggtgcagcctgtcattcaggaacgcatcgatcggttctctcagaatgagataaggttcagcgtcatggctatcctaaagaaccggagggagaagttcactttagaactcaaggagcttcagaggaagagggagaacctcctggcacagatgggtgatccttccgccaataggcacgcgccatctgttgagcactctcttgcggaggttgctgctcatattgaggctgtaacagagaagatcataatggaggaagagaagtggaagaagtggaagacagagaacatcaggaggaagcacaactatgtgccattcttgttcaatttcctcaagattcttgaggagaggcagcagttgaagcccctgatagagaaggcgaaacagaagtctcacagctctgctaatcctaggtgaaatcaactgttatttgtctcgattgccgtggtttttgtcaatgtagagatggctgactagccttttgttttcgcggtagtgtttgaaccatgtgatgattattatctttagttatagatattcggtcgaatttagatgaaattcaggcgaatgtcccttgaaatagactgtcttatcagactacatgtgtacactggagggtcattccctattgcatccgtgtagatcttgtccttcctttgtcacattataaataatctaattgacggcctaaagcctcacatcatgccataatctattttttttgtcagata

SEQ ID NO: 1958 - DNA, 1480 bp, Brachypodium distachyon
ctcctcgccccctgcggagcgccccagccccctcgctccgtcgctcgtcttcctcctcgggcaagcgccgccaccgggtcgatctctccttcgattctctcgctcccggctgtttctcctcccatcacctcacgaatagattccgccctttagccccccgtttcatctccttaataacccaattcgtaactgaggcaaaaaactaaggtagggcggccgtcctaccttgccctactgggtcctccgcccgtgtttgcagagggctcctcgttcctcaacatgtcttgggcggcagtcgagaacgaccctggtgtttttacagaactgttgcagcagatgcaattgaagggtcttcaagtcgatgaactctactcacttgaccttgatgccctcaaagatattcagccagtatatgggctcataattctgtacaaatggcgacccccagagaaagatgagcgccctgttatcaaagatgcggtcccaaatcttttcttcgccaaccagataattaacagtgcatgtgcaacgcaagctctcgtttctgttctgttgaactcttcaggcatcacccttagtgacgacctcagaaagctaaaggagttcgcaaaggacttgccaccagagctcaaaggattggctatagtgaattgtgaaagcattcgtgtgaccagtaactcctttgcaaggtcagaagactctgaggagcagaaagcatctagcaaggatgacgatgtctaccatttcattagctatgttcctgttgatggcgtcctgtatgagcttgatggactaaaggatggaccaattagcctgggcaaaaccccaggtggtgctggtgatatcgggtggctgaggatggtgcagcctgtcattcaggaacgcattgatcagttctctcagaatgagataaggttcagtgtcatggcaatcacgaagaaccggaaggagatgtacattgtagagctcaaggaacttcagaggaaaagggagaacctcttgtcacaaatgggcgatccttctgtcaatcggcaaaggcaatctgttgagcggtcactcgcagaggttgctgctcagatcgaggctgtgaccgagaagatcataatggaggaagagaagtcgaagaagtggaagacagagaacatcaggaggaagcacaactatgtgcctttcttgttcaatttcctcaagattcttgaggagaagaagcagctcaagccgctgatagagaaggcaaaacagaagtctcctaaccctaagtgaaatctacaatgtcaaattgtatcgtgtcaattatttcagttttgtgtagagatggctgactggatttgttttcttgctgagggtgcttatcggtcaagtcctagatagggcgcgtgcttctctcctggtatatccgtgcaaatcttcaagatttcatgtagaacttaacttcccaaaatttccaacatttatgagtaatgctaagggctttttcatt

SEQ ID NO: 1959 - DNA, 1216 bp, Setaria italica
aaacaactcatgagctttttatgctgttattacaggtgttcttacggaactgctgcagcagatgcaactgaaaggtcttcaagttgatgaactctactcacttgacctggatgctctcaatgatcttcagccaatttatgggctcatagtgctgtacaaatggcgacctccagaaaaggatgagcgtcctgtcatgaaggatacaatcccaaaccttttctttgccaaccagataattaataacgcgtgtgcaacccaagctatcctttctgttctcttgaactctcctggcatcacccttagtgatgagcttaaaaggctaaaggaatttgcaaaggacctgccacctgagctcaagggattggccatagtcaattgcacaagcatccgtatgttaaacaactcatttgcaaggtcagaggtctccgaggagcagaaaccatctagcaaggatgacgatgtctaccacttcataagttatgttccagtggatggcgtcctgtatgagcttgatggacttaaggaagggccgataagcctggggaaatgctcaggtggtgttggtgaggccggatggcttagggtggcacagcccgtgattcaagagcacattgatcggttctcacagaatgaggtaagattcagtctgatggcaatcttaaagaaccggaaggaggtgtacacagcagagctcaaagacctccagaggcagagagagagcctcttgcagcagatgagcgatacttccaccaggcacatgtcatctgtcgggcagtctctagcagaggtggctgctcagattgaggctgtgacggagaagatcataatggaggaagagaagttgaagaagtggaagatggagaacatgaggaggaagcacaactacgtgccgttcttgttcaatttcctcaagattctcgaggagaagcagcagttgatgcccctgatagagaaggcaaaggcgaaacagaagtctcacagtcacagctccaatcctaggtgaaaaagctgcaatgcatccatattgtttgctttagttgcgatttcttgtagagattggctgtgactaggagcagatccaggatcccccaccttatccattaataaaaaaatggtcatacaagaggttcgtggcacaatacaaaggatgtataatgagtgaccattgctcttcttcctcagtttcactaacttatacatggaaaatcaacttgca

SEQ ID NO: 1960 - DNA, 1448 bp, Hordeum vulgare
gtatctctcatctcccttctgacctacccaagctccagtccaccgccgctgtgccctagaactgcgccgcgcccgccctctgtccctcacgcgcctcgtcgccggcgccctccctgtcccgtagcgtccccgctctctcctccccacccgcaatcttggacttcggttttgagatctgcccctgctatcgattgcaggtttgcagagggctcgtcgacatgtcttgggcgccaatcgagaatgaccctggtgtttttacggagctgttgcaacagttgcagttgaagggtctccaagttgatgaactctactcacttgatcttgatgccctaaatgatcttcagccaatttatgggcttatattattgtacaaatggcgacctccagaaaaagatgagcgccctgttatcaaggatgcggtcccaaatgtattctttgctaatcagataattaacagcgcatgtgcaacccaagctattgtttctgttctgttgaactcttctggcatcacccttagcgaggacctcaaaaagctcaaggagtttgcaaaggacatgccgccggagctcaaaggattggctatagtgaattgtgaaagcattcgtataaccagtaactcgtttgcaaggtcagatgactactctgaggaacagaaatccaaggatgatgatgtctaccatttcattagctatgttcctgttgacggcgtcctgtatgagcttgatggactaaaggaaggaccgattagcctgggaaaatgcccaggtggcattggggagatggggtggctgaagatggtgcagcctgtcatccaggaacgcatcgataagttctctcagaatgagataaggttcagtgtcatggctatcacaaagaaccggaaggaaattttcatcatggagctcaaggaacttcagaggaagagggagaacctcttgtcacaaatgggtgatccttctgccaatcggcaaaggccatccgttgagcgatcactcgcagaggttgctgctcagattgaggctgtgactgagaagatcataatggaggaagagaaggcaaagaagtggaagacggagaacatcaggaggaagcacaactacgtgcctttcttgttcaatttcctcaagatcctcgaggagaagcagcaactgaagcccctgatagagaaggcgaaacagaattctcacggccgtaaccctaagtgaaacctgcgttgtaaaattttatcgtcttggttgttttggttttgtgtagagatggctgactggctttgtttcctagccgaatgtgccttgtagttctagtcctagacaggccatatatcgataccgtcctggtttattcaggcagatcttaaaacattcatatagggggaacaccctgactccttatcagaattatgtgcatcagagggctgtttccctgtctaattcttcccaaactttaac

SEQ ID NO: 1961 - DNA, 1355 bp, Triticum aestivum
cagtccaccgccgctgtgccctagaactgccgccgcgcccgccctctgcccctcacgcgcctcgtcgccggcgccctccctgtctcgtagcgtccctgctctcttccccccacgcgcaatcttgaacttcggttttgagatccgcccctgctgtcgattgcaggtttgcagagggctcgtcgacatgtcttgggcgccaatcgagaatgaccctggtgtttttacggagctgttgcaacagttgcaattgaagggtctccaagttgatgaactctactcacttgatcttgatgccctcaatgatcttcagccaatttatgggcttatagttctgtacaaatggcgacctccagaaaaagatgagcgccctgttatcaaggatgcagtcccaaatctgttctttgctaatcagataattaacagtgcatgtgcaacccaagctattatttctgttctgttgaactcttctggcatcacccttagcgaggacctcaaaaagctcaaggagtttgcaaaggacatgccgccagagctcaaaggattggctatagtgaattgtgaaagcattcgtatgaccagtaattcatttgcaaagtcagatgactactccgaggaacagaaatccaaggatgatgatgtctaccatttcattagctatgttcctgttgacggcgtcctgtatgagcttgatggactaaaggaaggaccgattagcctgggaaaatgcccaggtggtattggggagatggggtggctgaagatggtgcagcctgtcatccaggaacgcgttgataagttctctcagaatgagataaggttcagtgtcatggctatcacaaagaaccggaaggaaattttcatcatggagctcaaggaacttcagaggaagagggagaacctcttatcacaaatgggcgatccttctgccaatcggcaaaggccatccattgagcggtcactcgcagaggttgctgctcagattgaggctgtgaccgagaagatcataatggaggaagagaaggcaaagaagtggaagacagagaacatcaggaggaagcacaactacgtgcctttcttgttcaatttcctcaagatcctcgaggagaagcagcaactgaagcccctggtagagaaggcgaaacagaattctcacagccgtaaccctaagtgaaacctgcgttgtaaaattttatcgtcttggttgttttggttttgtgtagagatggctgactggctttgtttcctagctgaatgggccttgtagttctagtcctagacaggccatatatcgataccgtcctggtttactcaggcagatcttaaaacattcatgtaggggggacactctgactcct

SEQ ID NO: 1962 - DNA, 1412 bp, Triticum aestivum
  misc_feature (497)..(497): n is a, c, g, or t
  misc_feature (1314)..(1314): n is a, c, g, or t
  misc_feature (1384)..(1384): n is a, c, g, or t
gcgggggacctacccaagctccagtccaccgccgctgtgccctagaactgccgccgcgcccgccctcgtcgctggcgccctccctgtctcgtagcgtccctgctctcttccccccacgcgcaatcttgaacttcggttttgagatccgcccctgctgtcggttgcaggtttgcagagggctcgtcgacatgtcttgggcgccaatcgagaatgaccctggtgtttttacggagctgttgcaacagttgcaattgaagggtctccaagttgatgaactctactcacttgatcttgatgccctcaatgatcttcagccaatttatgggcttatagttctgtacaaatggcgacctccagaaaaagatgagcgccctgttatcaaggatgcagtcccaaatctgttctttgctaatcagataattaacagtgcatgtgcaacccaagctattgtttctgttctgttgaactcttctggcatcacccttagcgaggacctnaaaaagctcaaggagtttgcaaaggacatgccgccagagctcaaaggattggctatagtgaattgtgaaagcattcgtatgaccagtaattcatttgcaaagtcagatgactactccgaggaacagaaatccaaggatgatgatgtctaccatttcattagctatgttcctgttgacggcgtcctgtatgagcttgatggactaaaggaaggaccgattagcctgggaaaatgcccaggtggtattggggagatggggtggctgaagatggtgcagcctgtcatccaggaacgcgttgataagttctctcagaatgagataaggttcagtgtcatggctatcacaaagaaccggaaggaaattttcatcatggagctcaaggaacttcagaggaagagggagaacctcttatcacaaatgggcgatccttctgccaatcggcaaaggccatccattgagcggtcactcgcagaggttgctgctcagattgaggctgtgaccgagaagatcataatggaggaagagaaggcaaagaagtggaagacagagaacatcaggaggaagcacaactacgtgcctttcttgttcaatttcctcaagatcctcgaggagaagcagcaactgaagcccctggtagagaaggcgaaacagaattctcacagccgtaaccctaagtgaaacctgcgttgtaaaattttatcgtcttggttgttttggttttgtgtagagatggctgactggctttgtttcctagctgaatgggccttgtagttctagttcctagacaggccatatatccgataccgtcctggtttantcaggcagatcttaaaacattcatgtagggggaacaccctgactccttatcagaattatatgtgcatcanagggttttttccctgtctaaaaaaaaaa

SEQ ID NO: 1963 - DNA, 489 bp, Triticum aestivum
ggcacgaggcacaaataaacaccatatatctcagctcgatcgatcgacgataaacaacaacacatgcgcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatgggcgtatctgcgaggaataaaggatgggttattcgtccatgcactttgccgtctgcctggctgctcccatccctgcttatattatatatgctctcgtatatgcacgtttgtgtaatgtgtgcccatcg

SEQ ID NO: 1964 - DNA, 536 bp, Triticum aestivum
  misc_feature (67)..(67): n is a, c, g, or t
ggcacgaggcacaaataaacaccatatatctcagctcgatcgatcgacgataaacaacaacacatgngcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatgggcgtatctgcgaggaataaaggatgggttattcgtccatgcactttgccgtctgcctggctgctcccatccctgcttatattatatatgctctcgtatatgcacgtttgtgtaatgtgtgcccatcgatataaatatatttatatatatatatatatataccggtccagtttgt

SEQ ID NO: 1965 - DNA, 675 bp, Saccharum officinarum
gttgtttctagctagcgtgtgactgattcagccaaacctcgatcgtctagtcgacctatcgatcgcttgtgtgtgtgtgttttgatggcaagatcggcgtttgttccgatggaggagaaagagcaaggtgctgctggaagaggagcgggagcgggcgtcaataaggagcagcagaaggtgctgctggtgcacagccaggtgcggcggatcaagaaggaggacgaggaggccagggagcgcctcctgaagctgcgcctgctggagaccaggcccgctgccgccggcggcggggtggcgtggcgagcaccgcgctctctgtcgccgctccgccgtgccgggagcgccatcccggtcccggtgggggagtagacaggctctgcttgtgttgtatccgagcatccgtcgcggttctcggccggttgtagatacctcctaggcgtagcgagcgtggttcagtggtggtgcctgtgagcctgcccatgctctgcgtctgcgtgcagacatgggatcagagctttagtagacgacggtagggtgagggtgggtgatggcaggcagcatcgccatgtgtggttggtggtggttgtagcataacatgccctgttctgtatcctgtcttcttcttgggggtgtatatatgacgagacatgagagggagtttacctgcttactacc

SEQ ID NO: 1966 - DNA, 640 bp, Saccharum officinarum
gtttctagctagcgtgtgactgattcagcgaaacctcgatcgtctagtcgacctatcgatcgcttgtgtgtgtgtgtgttttgatggcaagatcggcgtttgctccgatggaggagaaagagcaaggtcccggaagaggagcgggagcgggcgtcaacaagaagcaggtggagcagcaggaggtgctgctggtgcacagccaggtgcggcggatcaagaaggaggacgaggaggccagggagcgcctcctgaagctgcgcctgctggagaccaggcccgctgccgccgccggctgggtggcgtggcgagccccgcgctctctgtcgccgctccgccgtgccgggagcgccatcccggtcccggtgggggagtagcagcgcctcgcagccctctgcttggattgtatccgagcatccgtgatccgtcgcggttggttctcggtcgcagttgtagatacctaggcgtaccgagcgtggttgagtcgtggtgcctgtgaacctgcccgtggtctgcgtctgcgtgcagacatgggatcagagcttagtagacgacggtagggtgagggttatagcaggcagcatcgccttgtgtgggtggtggtgggagcatagcatgctctgttctgtatcctatcttcttc

SEQ ID NO: 1967 - DNA, 1781 bp, Oryza sativa
aaggctcacctcctcctcttccctctccggcatctccatctctcagctcctctgctagctcgagctgctcttcccggatcctagccacatttcttggttctgatctctctcgggttgttttgaaattttctttggttcaattgccatggccgcgcaatcttggaggtccttcatgtgctgcggcggcggcgctgccgtccacgacgacgacgactcggcgccgaggcggcggaggatcgcgcgcaggggggacagcccgaggtcgtcgtcgaggatgtcgttcacgagcctcagctcgtcggggacgctgtcgccggaggacctgtcgctgacgctgtccggctcgaacctgtacgccttcacctacgccgagctccgcgccgcgacgggcagcttctcccgcgccaactacctcggctgcggcgggttcggccccgtctacaagggcgccgtcgacgacggcctccgcccgggcctcgccgcgcaggacgtcgccgtcaagtacctcgacctggactgcggcacgcagggccacaaggagtggctggccgaggtgttcttccttgggcagctgaggcacaagaacctggtgaaattgattggttactgctatgaagccgagcatcggatgctggtgtacgagtacatgagcggcgagagcttggagaagcatctcttcaaaactgtcaatggttctcttccatggatgacaaggatgaagattgccctcggcgcggcgaaaggcctcgcattcctccatgatgccgatccgccggtgatctaccgcgatttcaaggcatccaacatcttacttgacctggattacaataccaagctgtccgactttggcctagctaaggatgggccccagggtgacgctacgcacgtaacgacacgtgtcatgggaacacatggatatgcagctcctgagtacatcatgacggggcatttaacagctaagagcgatgtgtatagttttggagtggtattgttggaacttctctcggggcgaaagtcagtggaccgctctcgacgcccgagagaacaaagcctggtggattgggctagaccatacctcaagtgggccgataaattgtacaaggttatggaccctgctctcgagtgccagtactcgtgccagggtgctgaggtggcggcattggtggcgtacaagtgtctgagtgagaaccctaagtccaggcccacaatgagggaggttgtcaaagccctggagcctgtgcttggcatggatgacttcttcccagttggcccatttgtcttcactgtcattgtggaggacgagaaggtggttaacatgaaggtggacatgaaggttgaggttgaggagaagaaaaacactcaccaaaaccatcaggacaggcatcgacagaagtacccagactcggcgattcacgctggcattgtgctgcatgaccgtgatggtgtcatcggaggagggtacaccggtgcgctgcgacgacaccggaggacggcgagctacaacaaggagaggggagcataggaatagaggtggggaacagagtaggagaaaaaggtcatgcatgtacatatgctggtgagggtgtggcagaatgccacatttgattgggtttagtttttggtgttgtcattttttagctttcttcttgatggtgacagtgggtgggtgtaagataatacaggaatgcaaaatagtgtgatgaaaagttaggcttggatttgcaaggattgttggatgttgtacgcaatcaaatggtctagttaaaaggatgccccatgct

SEQ ID NO: 1968 - DNA, 3077 bp, Zea mays
ctcgcacccaacccgcatccgcattcctcgccgcgccgccgctctaaacctcagagcctcaaaccgtcagaactcagaagtaaacccctcctagtctgtcgtctctcttcgcacgccgccaccgagaggacgaaggagcgcgcacgcgcgtgacagagtggtaagatgggaggcgggcggaagcgcgggcgcacgcagcgccgccacttcaagcagggccgcgagaacgtctggaagcacaaccctcagcgtcctcccgccggcgaaggaggagaggcgcgagaggacaatccctcgtggcagcccttcgctaccgagaacccagccttcgaggagtactacaaggagcagcaaattgtttctgaggaagagtgggatagcttcatgagcatgctccggaagccattacctgccacttttaggattaatgcgagctgtcaattttttcaagatatctgctcgcaattggaaaacgacttcaggaaatcattagagactgaggtgaccgatgatcatgaagaagatgctattcggcctttgccttggtacccgggtaatcttgcatggcatttgaacttttctcgaatgcagctgaggagaaatcaggcacttgagagttttcatgaattcttgaagcgagagaacgaagttggcaacataactaggcaagaggctgttagtatggtcccaccactgtttctgaacgtgcaacctgatcatcatattcttgatatgtgtgccgctccaggatctaaaactttccagttacttgagatgattcaccagtcaacgaagcctggactgcttccaaatgccctggtggtagctaatgatgttgatgtgcaaagatgcaatcttcttattcaccaaaccaagagaatgtgcacagctaacctgattgtgacaaatcacgaagcacaaaactttcctggttgtaatcttgcaaagttctgttcaaaaatgtgtatggatgaggcaaaggtgcagaggttggagtttgatcgcgttctttgtgacgtgccttgtagtggcgatgggactgtccgtaaggctcctgatatgtggaggaagtggaatgctggtatggggaacggacttcatcacctgcaagtggaaattgctatgcgtggtatgagcttgctcaaagtgggtgggaggatggtttattcgacatgttcaatgaaccctgttgaaaacgaaggcgttgttgctgagattttgcggagatgtggggactctgttgaacttcttgatgtttctaatgaactacctgaattagcccgtcgtcctggacttagcacctggaaggtacgggatagagggtcttggtttggtgttcatgaagatgtacctcgctacaggaagcatgtgatatcagcaagtatgtttccttctgggaaaggcagcaaagatagtggtacggggagcagcagcgttgaggtcaacacagatgtagctgatgcagacatgaaggattcaacagacatgggagagggagaacaagaaacaactgtaacaattgatgacagcaataatggtgacaatctgaaaaccgaagagggaactaaagttgattgcgagtctggtgaagtcacaactagtagtagttataaaaagttaaattctacttccatccgtacggaacattcagattacccactgcatcgctgtatgagaattgttcctcatgaccagaacagtggggcatttttcattgcagtccttcataaactctctcccctgaatgagaaccaggtggtagatggtgtcagaattgaccagaatatctcaaaagacaagactgagaaacttgagaaggatttagtatcacataaggcatcatctgaagaaaatactgtgcatcagcaagtgattgataatgcaaatgttctggatggagaacagaatagagacagggataacaaaagttcagaagataagagctcagaggattctaaggtcaatgttaatgaggcagcaaagggtcaagcaggaacaagggataggaggaggcagcaaaaccaaggcaggtggagaggggttgaccctgtgatattttttaaagatgaagtgacagtcaaaagcattgtatctttctatggtatcacagattcatttccacttgaaggtcatctggtgactagaaaccctgatactagtcatgttaagagaatatactatgtgtcaaaatctgttcaagatgttttggagctcaacataaaaattggcgaaaggctaaagatcacctcactgggcctaaagatttttgaaaggcagtcttcaaaggaaggctccccatgcacatttcggttgtcatcagagggattgccgctcctgcttccatacatcacaaaacagattctatatgcatctgcaattgacttccaacatcttttacagtacaggactattaagtttcctgatttcgtggatgcaaaatttggtgaggaagcttcagctttgcttccaggttgctgtgttgtagttttacgtgaagggcatcaggatataggatccatagctacagatccctcggccattgccattgtttgctggaaaggaaagaccaatttgtgcgtcatggtttctccgctagatggtaaagaattgcttgagaggatttctttgcgccatgggctcaaaatccccaaaggggataaagagaaacccagccaggagattgctggatcagacgagctgcttgattgtgccactgaggtggacgatcaagagtctcttcctgaaagcaaagcatctgacatcgaaatttcagatgctaaggaggctgagtagcttttgttttatgtcactacgcatattacacaggaggtagctgtatcctcgagatggctattagcttttttaagtcacttcggttgccaagggagagagatgatagcccaccacatgggaatgacagactcaaaacaccatctggtaatcgttcacggtgacacagaatctatagacttgtaacttcttggttttatttcttcgagaggatgtattgcatcgattttaatttgttgcactcaacacagaatctagtaaagattgagaaaaacattttttttgag

SEQ ID NO: 1969 - DNA, 1540 bp, Zea mays
ccacgtgcagccgaccagccgtcgaattccgttccaaggcaaactaggcaaagggtcctcgtggcctcctcctctccagactccagagtccagaccgtgacaagttcatcatccagccccgcttgcgcttgaccccttcaagtccaagcattccattccatccagtaccttccttgtcaccttgaccttccccctcccttcctagtcccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgccgccggcctcgctgcagcccgagtccccgggggtcttcttctccgccgccgccgccgccgcgcccctgggcaccgcccaccgccgcatcgccatcgccgtcgacctctccgacgagtccgcctacgccgtgcgctgggccgtcgccaactacctccgccccggggacgccgtcatcctgctccacgtgcgccccacctccgtgctctacggcgccgactggggcgccgtcgacgtctccctccccaaccctagcgccaccgccgcctccgaggacggcgacggcgactgcgagaccgccgctgccgcgcgcaggatggaggacgactacgacgccttcacggccaccaaggccgacgacttcgccagcccgctcaaggacgccggcatcccctacaagatccacatcgtcagggaccacgacatgaaggagcgcctctgcctcgaggtcgagcgcctctcgctcagcgccgtcatcatggggagcaagggcttcggcgccgcgcggaggaccagcaagggcaggctcggcagcgtcagcgactactgcgtgcaccactgtgtctgccccgttgtggtggtgcgcttccctgatgacggctctgccgagggtggggaggccgctggtttgtccgccgcggttggtgctgaggatgtgctgcaccccgtgccggaggaagaaggcgagtaccatgacgctgcggaggagcacaaggatgcttgacctcgttgatgcattgtgaagtcctcttggattcagcatgtagaggttctagcattcgactgttggctgggtgctaagctgggatttgtacttgagtgcatgtgatgtttatgaactcccattaccggtgtctatccgtgctttcgctttgtttgtatcctccgttacctttgttcatgtagcttgtctgacttccactgcgtggtggatatatgtctgaacatttgtagctactttgcgttgcactgtgtttctgatgaaagttacaggttactggtcacttctatagaacccaaaaaaaacaaggatgcaaattcgtcctgatttttattttctttattttagtataaagtagaagggcaggcatgatgtcggtgtgtcgagtaagccaaaagatcccgagttcgacgcagtattgtaatgcttgcctcggttatttcttctctaga

SEQ ID NO: 1970 - DNA, 1401 bp, Pennisetum glaucum
ccaccgacggttccaagtctttcattccttccagtaccttctccccctccctctacctccccaagcaactcccagagcgagcttctcctccccacttccctctccccgcccctctccctcgcgatagccgcaggagatcccgcgatgcaggccccagcgaccccctccaccgacgacctcccgctgtcggcgccgccgccaccggtgaaggcgccgaccccgcgcccgccgccgccggcctcgctccagcccgactccccgggcgtcttcttctccgccgcggcggccgccctgccctcgggctcctcccaccgccgcatcgccatcgccgtcgacctctccgacgagtccgcctacgccgtgcgctgggccgtcgccaactacctccgccccggcgacgccgtcgtcctgctccacgtgcgccccacctccgtgctctacggcgccgactggggcgccgtcgacgtctccctccccaaccctagcgccggggacgacgacgacgacgactcggaggccgccgcgcgcaggatggaggacgactacgacgccttcactgcttccaaggccgacgacctcgccaggccgctcaaggaggccggcatcccctacaagatccacatcgtcagggaccacgacatgaaggagcgcctctgcctcgaggttgagaggctcggcctcagcgcggtcatcatggggagcaagggcttcggcgccgcgcggaggaacatcaagggcaggctcgggagcgtcagcgactactgcgtccaccactgtgtctgccccgtcgtggtggtgcgcttccctgatgacggcccggccgaggatggggaggccggtggcctgtcgtcagcggtgggtgctgaggatgtgctgcaccctgtgcctgaggaggacgccgagtaccatgatgctactgaagagcagcacaaggatacttgaccgtatcgttgagttgtgaactgaaaagtactcttggagatccagcttgtaaaggttgtagcagtggactgttggctgggtgctagctgggaagtgcatgtgatgtttgttgaactctcagtgcccatgtctatccgtgctttcgcatcgtttgtatcttcagtcgtcttcattcacctagattatctaactattcaactgcctggtgaatatttgtggttcaaaacatttgtactttctttgcattgcaatacctgttctgatgaaagttacagtttaaccatttctatagaaacaactagtcatcagtgcattttttccccatctgctctgctttatttagtcgaaagtagctctggtagatttcattaatcttgtgatgcgcatgtggtccatgccgacatcataccctgaggaagtttctcttatttaccaaatgtaccgagatatatctatata

SEQ ID NO: 1971 - DNA, 1279 bp, Zea mays
agcacctaccttgcacgacttcttctttccggtaccttctccccttcctctccctccctagtccctagtcggcagtcccccgaccccgacctcgctaagcaaactcccagagcgatcgccgcagaagatcccgcatgcatgccccggcgccgccctcctccgtcgatctgccgttgtcggcgccgccgccgccggtgaaggcgccgtccccgcggcctccgccgccggcctcgctgcagcccgagtccccgggcgtctttttctccgccaccgcacccctgggcacctcccaccgccgcatcgccatcgccgtcgacctatccgacgagtccgccttcgccgtgcgctgggccgtcgccaactacctacgctccggggacgccgtcatcctgctccacgtgcgccccacctccgtgctctacggcgccgactggggcgccgtcgacgtctctctccccatccctagcgcctactccgaggatggctttggcggcggcgacgccgattccgaggccgccgctgcgcgcaggatggaggacgactacgacgccttcacggcctccaaggccgacgacatcgccaggccgctcaaggaggcgggcatcccctacaagatccacatcgtcagggaccacgacatgaaagagcgcctctgcctcgaggtcgagcgcctctcgctcagcgccgtcatcatggggagcaagggcttcggctccacgcggaggaccagcaaggggaggctcggcagcgtcagcgactactgcgtgcatcactgtatctgccccgttgtggtagtgcgcttccctgatgagtgatgacggctctgccgagtgtggggaggcaggtggtttgcccgccgcggttggtgctgaggatgtgctgcaccccgtgccggaggaggaggaggccgagtatcatgattcatgacgccgctgaggagcacaaggatacctgacctcgttgatgtattgtgaagtcctcttggattcagaatgtaaaggttgtagcattcgacagttggctgggtgctaggtgggatttctacccgagtgcatgtgaagtttgctgaacttccattacccgtgcccatgtatctgtgatttcgctttgtttgtagcttctgttacctttgttcatgtagcttgtctgacttccactgcctggtgaatatctttgtctgaacatttgtacttactttgcgttgcactgtgtttctgatgaaagttataggttaaccacttctatagaaccaactaatcaagggtgcaaattcctccta

SEQ ID NO: 1972 - DNA, 1674 bp, Oryza sativa
gacgccgtccgtttcccttcttcttccgccgcgtctccccaacttccaagtcttccattcccccttcttccagtagcttcctcctccttctccgccgcaaccccacccaaccaaaccaaaaaaccaaaggaaaccaaagcaaagcgagctccgagctctccacccacgagcgcgtgcggaatctgtagtaaactagtaatccatccccgatcggcggcgatgcagaacccgccgagccaccccgttgacctgccgctggcggcggcgccgccgccggtgaaggcgccgaccccgcgcccccccacgccggcgtcgctgcagccggagtccccgggggtgttcttcacggccgccgcggcggccgccccggtcgggtcctcgcaccgccgcatcgccatcgccgttgacctctccgacgagtccgcgtacgccgtccgctgggccgtcgccaactacctccgccccggggacgccgttatactgctgcacgtccgccccacctccgtgctctacggcgccgactggggctccgtcgacctctccctccccgccgccaaccctaaccctagcggcgacccgccgtcggccgaggacgacgctgaggccgcggcccgcaagatggaggacgacttcgacgccttcaccgcgtccaaggccgacgacctggccaagccgctcaaggacgccgggatcccctacaagatccacatcgtcaaggatcacgacatgaaggagaggctctgcctcgaggtggagaggcttgggctcagcgcggtcatcatggggagcaagggcttcggcgcctccaggcggaccagcaaggggaggcttggaagcgtcagcgattactgcgtgcaccactgtgtgtgccccgtggtggtggtgcgtttccccgacgatggtgtggcggagggcggagaggccggtggcgcatcggagttggcggtgggcgaggaagtgctgcaccctgtgccagaggaggatgccgagtaccatgacgccactgaagagcacaaggatacttgatcatgctgtatgatgatgtcctctttgatccagcatgtaaaggttctagcagtcaactgtttgctgggtgctaggtggggtttcttctgagggcatttgctgttccgttcaactttcactgcctatgtttattcgtgctttcactttgttgtattttattgtcttgtttcatgtagttttatctgacctactgcttgcacggttaatttttatgatttagaatttttgtgctttctcaacatcacaagatctgtttctgatgaaagttacagtttgactacttaacgaaccaagtaaccgtctcccttttatttttctcccttgttgtactttcccttaaagtaagattatggtagatatcatgaatctcttgatgtgcgcagtcaatatctgccaaaggaaactttttttttttaatctactgttaggaaaagttggcgtttctacataagagcatggttacttaaattgtgttctgctctctggtccctgtcttggtttgtttgttctgctgttagaattatagttaactcgtaactaggacttggaagctgagctctggaatcttctttgtacatgtataatctattggcacatggaaagtagtatgaccggtactcatctaatatgccttgctataaaattaag

SEQ ID NO: 1973 - DNA, 1219 bp, Zea mays
gatcttctcgcgtcgattgcttgcccagctcgcttcctcttcgtcttccttctcccccttctcctcgcctccggttaaccgccacagcctggattcgccttctcccgcggcggcgcggccggccgctgctgctgcgtcggcgcgtgagatggatgattgcggcggcggcggcggcaagaggccgttccagctggcgcggtcgctgacgtaccaccaccacccggggcaccggccggcggctgcgtccaggtggcggcggcagcaccagcagcatcagctcgcggacgagccgcgcgctccccggccgcaggcggtggtgctgtacacgacgtcgctgcgcggggtgcggcgcacgttcgcggactgcgccgcggtgcgcgccatcctgcgcggcttccgcgtggccgttgacgagcgggacgtgtccatggacgcggcgctccggcgggaggtccaggcgctgctggccgcgcgcggccgcgccttcgcgctcccgcagctgctcatcggcggccgcctcgtcggcggcgcggacgaggtgcggcagctgaacgagaccggccagctccggcgcctcctcgacggcgcggccgggcaggacccggccttcgtctgcgacgcctgtggcggcgtccggttcgtcccgtgcgccggatgcggcggcggccgcaaggtgttcgtcgaggaggagggccgcgtcgtccgctgcgtcgagtgcaacgagaacgggctggtacgctgccttaactgctgctcttgatcgccgacggcggcggcgaacatcgccgttccattcgtgctgctaatccaagcggtagaggttgtggtagatatcaacaaaaggaagaagaagaagaagaagagggggctttcggtttcccggcgtggggttcgtgtgtgtccgatccgatcattttgaggatcggatttgctgctagtcggtggacaagaacagattgttcttggctcattgctgcaaaattgccatatggtgatggcgattggagaataagaactgggcttgtttgtatatgcatctgatgtatcaaagattgatactgctgctagttcaactaatgtaaatacttaagtttggtgtgatgaattgcttcatgccttgtccagttcatggacttgcttcatgcctttcttggtaaaattgctagagatctgaagctgtaggcagatcatttttcataaaaaaaggataattgtggcc

SEQ ID NO: 1974 - DNA, 1055 bp, Cenchrus ciliaris
  misc_feature (315)..(315): n is a, c, g, or t
  misc_feature (317)..(318): n is a, c, g, or t
cccctttcctcgcgtccctttaaccgccaaagaacctgacctcaccttcccctacggcggcgcgggcagctggtgctgcgccgtcgtcgcgtgagatggaagactgcagcggcgtcgctgccggagtcggcggcggcaagaagccgttccaattggcgcggtcgctgacgttccaccaccaccaggggcaccggccggcggcggcgtcggcggcaaagtggcggcggacccagctcgcggacgagccgcgcgcgcatcggccgcaggcgctggtgctctacacgacgtcgctgcgcggggtgcggcgcacgttcncnnactgctccgcggtgcgcgccatcctgcgggggttccgcgtcgccgtcgacgagcgggacgtgtccatggacgccgccttccgcagggagctccaggcgctgctctccgtgcgcggccgcgccttctcgctcccgcagctgctcatcggcggccgcctcgtcggcggcgcggacgaggtgcggcagctgcacgagacggggcagctccggcggctcctcgagggcgcagcgggccaggatccggcctacgtctgcgacgcatgtggcggcgtccggttcgtcccctgcaccggctgcggcggcagccgcaaggtcttcgtcgaggaggaggaccgcgtcgtccgctgcggcgagtgcaacgagaacggattggtacgctgcgctaactgctgttcttgatcaccaaacagagacgcgatctttccagttccattcatgctactaatttaatgggttagaggttgtagaatcaacaaaaagaaaagaggggcctttcggtttcatggcgtgggatttgtgtgtatccgatcattttgaagatcggatttgattctcatgaaggagaagaacgtattgttctcgactccttgctgcaaaattgccatacggtgatggtgattggagaataagaactgggcttctatgtatatgtatctgattctgatctgatgtatgaaagattgacactgctgttagtgcaattaatgtaaatactaaagtttgccttgggggtgctca

SEQ ID NO: 1975 - DNA, 809 bp, Setaria italica
cggcgaattccatttctcgcttcgcttgcttccacaactcgctttcttcgtcttcctcttccccctttcctcgcgtccgggtaaccgccatagccaaagaacctgacctcaccttctcctacggcggcgcgggcagctggtgctgcgccgtcgtcgcgtgagatggaagactgcagcggcgtcgcggccggagtcggcggcgggagctgcggcaagaagccgttccagttggcgcggtcgctgacgtaccaccaccaccaggggcaccggccggcgggggcgtcggcggccaagtggcggcggagccagctcgcggacgagccgcgcgcgcagcggccgcaggcggtggtcctctacacgacgtcgctgcgcggggtgcggcgcacgttcacggactgctccgcggtgcgcgccatcctgcgggggttccgcgtcgccgtcgacgagcgggacgtgtccatggacgccgccttccgcagggatctacaggcgttgctcgccgtgcgcggccgcgccttctcgctcccgcagctgctcatcggcggccgcctcgtcggcggcgcggacgaggtgcggcaactgcacgagacggggcagctccggcggctcctcgagggcgcagcgggccaggatccggcctacgtctgcgacgcctgcggcggcgtccgtttcgtcccctgcatcggctgcggcggcagccgcaaggtcttcgtcgaggaggaggaccgcgtcgtccgctgcggcgagtgcaacgagaacggattggtacgctgcgctaatgatcaccaacagagacgcgatctttccca

SEQ ID NO: 1976 - DNA, 502 bp, Triticum aestivum
agggagattccaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaagcttcccgttgcagtcctgcatgagtttcgtttcgagcggcaacattgcatcttgtgctttggacgtctgactgatggcgttcttgggtgtttgcttgctcaggatttttctttcgtgcatcagtgtatccacatgcatgtattatgtatatatatgtattatgagtataaagatctgtgagctttgtgtcagattgcacaggagaaaaaaaaaaaa

SEQ ID NO: 1977 - DNA, 652 bp, Saccharum officinarum
taaactgccaaccatatcaagttactgtgaagagatatcagctaggacaagacctcttcagactcgagggagatccgcagatggaggggaagagcaagctgccggaggtgaccatcgtcccggcggcaaggccgcttgctggcgatggcaccgtcgacgccgcgaaggcggctgcggcgggcaaggagcccatcagccctggcactccgtcctcggtggacgccggacgccgcggcaaagagaggcgcgcggtggacgccgtgcccctgcctgggtggaagctcgacgccctctgccaggagtcctgcccgtcgccgaccatgagggcgcgcttcccctacttctgaatcttcccgagtgcagtcctgcatgagtttcgttttgagcggacgtctgactgatggcgttcttgggtgtttgcttgctcaggattttctttcgtgcatctctacatgtatatatatgtattatgagtataaagatctttgagctttgtgtgtacggtcagattgcacatcacaaatgatgaaccatcagttaattgcttgtatgattttttttacagcaatttgctggtatgtatctgacataatttgagcacactgtatccatcaggaaatatttcctatatacaagtaccgggatagcacgc

SEQ ID NO: 1978 - DNA, 631 bp, Saccharum officinarum
acagctagcacaagacctcttcagactccaagggagatccgcagatggaggggaagagcaggctgccggaggtgagcatcgagccggcggcaaggccgttggctgtcgatggcaccgtcgacgcggcgaaggcgagcaaggagcccatcagccctggcactccgtcctcggtggacgccggccgccgcagcaaagagaggcgcgcggtggacgccgtgcccctgcctgggtggaagctcgatgctctctgccaggagtcctgcccgtcgccgaccatgagggcacgcttcccctacttctgaagcttcccgttgtagtcctgcatgagtttcgtttcgagcggcaacatcttgtgctttggacgtctgactgatgatgttcttgggtgtttgcttgcttaggaattttctttcgtgcgtgttctgatgtacatgtatatatacgtattatgagtatacagatctgtgagctatgtgtgtatggtcagattgcataacacaaatgtatacagatctgtgagcttttgtgtgtatggtcagattgcacgacacaaaagatgaccatcagttaatggcttgtatgctttttttacaacaatttgcttgatgattggatctgacataaattgacc

SEQ ID NO: 1979 - DNA, 535 bp, Triticum aestivum
  misc_feature (319)..(319): n is a, c, g, or t
cacgagggctaggactgacctcttcagacttcaagggagattccaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaancttcccgttgcagtcctgcatgagtttcgtttcgagcggcaacattgcatcttgtgctttggacgtctgactgatggcgttcttgggtgtttgcttgctcaggatttttctttcgtgcatcagtgtatccacatgcatgtattatgtatatatatgtattatgagtataaagatctgtgagctttgtgtcagattgcacaggagaaaaaaaaaaaa

SEQ ID NO: 1980 - DNA, 705 bp, Setaria italica
tccgatctgcaaactgcagacagagtgtagcacacgcacagcaaaggacccagctttcaggccccaagcacagcgtgattccaagggagatccggaggagatggaagggaagagccgggtgccggaggtgaccatcgtcccggcgcctaggccggcggctggcgctggctccgtcgacgcggctaaggcggcgggtaaggagccgatcagcccgggcacgccgtcctcggcggacgccggccgcggccgcagcggcaaggagaggcgcgcggaggagggcgtctccctgcccgggtggaagctcgacgccctctgccaggagtcctgcccgtcgccggccatgagggcgcgcttcctctacttctgaggccaagccgcccacgcgcgcgcgcgccggtgatggcgctcgctctgcaggcctaacgatgttcatgttcctgggcgtcgtgccgtcgtctcgtcttcttgctcaggattttcttttgtgctgtgcatgtacatacgactccatcgatctcggagcttttgtgtgttttgtcagagtttcagtccatcagtcagttgcctgtatccaattatctggtaatctgaagcaattgcaatcataccgtatccaattatccatcaggaagtatttcccatgcatgcaacccatgtcccatggcatagaacttctgtacaagtactaccctgcagcaagccttt

SEQ ID NO: 1981 - DNA, 3418 bp, Zea mays
gtggcatctcgcgcacccgtcttcggtcttctccccagcagcaggcctcagcctcccacgccacgactccgctcgcgacgccggctagccggccaccgacccccacacccacaagtgcttggcgataaattggggagaagagaagaaaaaggaaccacccccattccttcgcttcctccccgaaataaagctctgctcgcctcagctcggggggcggctcagacaccaatccgaagccctgctgctgcaccacaaatgcgtgagagagacgcctgctgggagtactgcgacaagctggatgggaacaaggtccggtgcaggttctgccacaaggtcctcaacggcggcatcagcaggctcaagttccacctgtcccagatccccagcaaaggggtgaacccctgcaccaaggtgaaggaagacgtcgtcgacagggtgaaggccgtcatctcggccaaggaagagtacaaggagttccagctcctcaagaggcagcgcgtcgccgacctgtcgtcggctgctgccccggcgaagtgggcgccggaggctcctccgtccctgtctacctctccggggcgagtggcctctcctgctgctgttattactcgtgccgctgaacagagtcggcttctcgccccggaagcgtccgctccggtgcccagaccatctgctgctgcggcaaacaacaagccacgcgccgccgccgcttcggaatgggagacagaacgatgtatagctgagttctttttcgagaacaagttggactacagcatagccgactcggtctcataccagcagatgctcgaggcgctcggcggtccgggattccgagggccgccagcagatgttctgcgggacaagtggctgcagaggctcaagtccgagatcctgcagaagacgaaggagatcgagaaggactgggcgacgaccggctgcacgatactggccgattcgtggaccgacaacaagctgaaagccctgatcaacttctccgtggcgtctcccatgggcacgttcttcctcaagacggtggacgcctcctcgcacttcaagacgcacaggggcctgtacgacctcttcgacgaggtgatccaggaggtgggcccggagaacgtggtccagatcatcgccgacaggaacatcaactacggcagcacggacaagctggtcgcgcagaactacggcggcgccatcttctggtccccctgcgcgtcgttctgcgtcaacgccatgctggacgacttctccaagatcgactgggtgaaccagtgcatctgccaggcgcagaccgtgacgcggttcatctacaacagcaggtgggtcctcgatctcgcgaggaagtgcgtggcggggcaggagctcgtctgctcggggatcaccaagtccgtgtcggacttcctcacgctgaagtccctgctgaggcacaggccgaagctgaagcagatgttccacagcgccgagttttcgtcctcgtcgtacgcgagcaggtcgataccgtgcgtcgagatcctggacgacgacgagctctggagggcggtcgaagagatagccgccgtctccgaacctctgctcagggtcatgagggacgtctcaggaggcaggcaggccatcggctacatatacgagtcgatgacgaaggtcacggactctatcagaacgtactacataatggacgaagggaagtgcaagtcgtttctggacatagtggagcagagatggcagacggagctgcactcgcctcttcactcggctgccgcctttctgagcccgggcatccagtacaacccggaagttaagttcttccgcactatcaaggaggagttctaccaggtcctggataaggttcttacgacccctgaccagaggcatgatatcaccgcacagttgcacgctttccgcaaggcacaagggctgtttggttcgaacattgctaaagaggcccgcaacaatacccctccaggcatgtggtgggagcagtacggcgactcagcaccgtcgctgcaacgcgccgccgtcagaataaccagccaggtgtgcagcacgctgacgttccagagggactggggcgtgatcctgcagaaccactacgagaagcgcaacaagctggacaaggaggccctggccgaccaggcctacgtgcactacaacctcacgctgcactccgagccgaaggcgaggaggaggccggacgcggacccgatcgcgctggacgcggtcgacatgacgtcggcgtgggtggaggactccgacggccccatcctcacccagtggctcgacaggttcccgtcggcgctggatggcggggacctgaacacgagacagttcggtggatccatcttcggcaccaacgacaacctgttcggcctctgatggcttccggctccagggggtggggggacatctgcctgttctcatttgttttgattaacacgagagccatgaagctgctgaaaatgtgctaagcatccatttcttctgcagtcatcattgctatcttcttcagtgtatttacctggtgccttggtgggtgcacatacatagctgacacatgggggccactctacaagaatgactcgggaagaggataaccatagaaggagacaaacgccatcgccttttccatttgttgcggaagtaaatataaactgcgagctatcatatcaagttactgtgaagagtgaagagatatcacagggacctcttcaggcttcaaggcagatccgcagcagatggaggcgaagagcaggctgccggaggtgaccatcgtcccgacggcacggccgttggctggcgatggcacaggcgacgcggcgaaggcggcggcaggcaaggagcccgtgagcccgggcactccgtcctcggtggccgccggccgcagcagctgtgaggagaggcgcgcggtggacggcgtcgccctgcctgggtggaagctcgacgccctctgccaggagtcctgcccgtcgccagccatgagggcgcgcttcccctactacttctgaagcttcccgttgcagtcctgcgtgatgagttcttgagcggcgacatctggtgcatgctcttgacgactgatggcgttcttgggtgttttccttgctcagggttttcctttcgtgcacgtccatgtatgtatgtatgtatgtattgtgggtttaaagatctgtgatctttgtgtataacgcaaatgatgaaccttcgggtaactgcgtgtatggttgtatctgtctatctgacataatttgagcacactgtatgtatcggtctcatcgaaatagttgccaatatggcatagcacgcgtaatacagcgtaggaatttcagaacctggagcaaagcttgttggttctgtttaatataattaatacaaacattacacagctacaacacctcctcgacaggcagcgccgctcgccagctcatct

SEQ ID NO: 1982 - DNA, 780 bp, Panicum virgatum
agcagcattgccattgcccctcagctcgccggaatccccaggccgccgggactcgctcgcctgatctcgctcgctcggccgccggccgccggctccgaccgatccgtcagcaccaagccatggggtcgcaggccatcgaggcgcaccgcgcgggcgcggaggtgtacagcggcgcggcgctctgcgcggagaagtcgacggagctgctggcggaggtgcacctcccgctgggcctgctcccgctcgccgacatggaggaggtcggctacaaccgctccaccggcttcgtctggctccgccagaagaaggccctcacccacaccttcaagcagatcgggcgccaggtctcgtacgccgccgaggtcaccgccttcgtcgaggaccgccggatgaagcgcatgaccggcgtcaagaccaaggagctcctcatctgggtcaccctctccgacatgttcgtcgagaaggacgacccgtccaagatcaccttcaagacgcccaccgggctcggcaggaccttccccgtcgccgccttcgccaaggaaggagacgacggcaagaccaagcccaaggaggcccccaccgcagccaacggcaaggagcccgccgccgccgtcaccagtaagtaaaggctcagtggcggcgtggagtggagtgctttttatgatggataaactacctgcttaatactactcttctgaataaataatgaagtctgtactgctgctactgtttgcttaagtttattatgttctatactcgtatttacttatgaatgaacga

SEQ ID NO: 1983 - DNA, 969 bp, Panicum virgatum
gccgccgcgccgagcacggcaccaacacggcacccagcgcattaactaaaccccgccttaaatcccccgcaccccaaccggcaaccgtcccccgccgactcggaccccggcgacccgatccccccgctataaatccccggcgcctccccgatccagagccccagcgatccagcagcattgccattgcccctcagctcgccggaatccccaggccgccgggactcgctcgcctgatctcgctcgctcggccgccggccgccggccgccggctccgacccatccgtcagcaccaagccatggggtcgcaggccatcgaggcgcaccgcgcgggcgcggaggtgtacagcggcgcggcgctgtgcgcggagaagtcgacggagctgctggcggaggtgcacctcccgctgggcctgctcccgctcgccgacatggaggaggtcggctacaaccgctccaccggcttcgtctggctccgccagaagaaggccctcacccacaccttcaagcagatcgggcgccaggtctcgtacgccgccgaggtcaccgccttcgtcgaggaccgccggatgaagcgcatgaccggcgtcaagaccaaggagctcctcatctgggtcaccctctccgacatgttcgtcgagaaggacgacccgtccaagatcaccttcaagacgcccaccgggctcggcaggaccttccccgtcgccgccttcgccaaggagggagacgacggcaagaccaagcccaaggaggcccccaccgcagccaacggcaaggagcccgccgccgccgtcaccagtaagtaaaggctcaggtggcggcgtggagtggagtgctttttatgatggataaactacctgcttaatactactcttctgaataaataatgaagtctgtactgctgctactgtttgcttaagtttatttatgttctatactcgtatttacttatgaatgaaacgagaatcaatc

SEQ ID NO: 1984 - DNA, 909 bp, Panicum virgatum
gccccatcgatccagcattgccattgcccctcagctcgccggaatccccaacaacccgccgggactcgcctgatctcgctcgctcggccggccgccggttccgctccgtcaaggcgtcaacaccaagccatggggtcgcaggccatcgaggcgcaccgcgcgggcgcggaggtgtacagcggcgcggcgctgtgcgcggacaagtcgacggagctgctggcggaggtgcacctcccgctgggcctgctcccgctcgccgacatggaggaggtcggctacaaccgctccaccggcttcgtctggctccgccagaagaaggccctcacccacaccttcaagcagatcggccgccaggtctcgtacgccgccgaggtcaccgccttcgtcgagaaccgcaggatgaagcgcatgaccggggtcaagaccaaggagctcctcatctgggtcaccctctccgacatgttcgtcgagaaggacgacccctccaagatcaccttcaagacgcccaccgggctcggcaggaccttccccgtcgccgccttcgccaaggagggagacgacggcaaggccaagcccaaggaggcggccccagcagccaacggcaaggagcccgccgccgccgtcagcggtaagtaataaggctcaggtggcggcgtggagtggagtggagtggagtgccttttatgatggttaaactacctgcttatacgactgttctgaataatgaagtctgtactgctgctactgtttgcttaatttaatgttctatttattatgaatgaaacgagaatcaatcgtgcgagctttccaattgtgtgtgcccccgggagtaagtgattgcccatgattccattgtaatcttaagtgaatactgtacaccacaattcgccttcaattcagtcaattcgc

SEQ ID NO: 1985 - DNA, 1884 bp, Zea mays
ccgtagcgccccaaccgcaaccggcaaccgcccctcgccgactgcacggacggggaagcctcctggagagtggactccctttccttctataaatccggctcctcccaatccaggatcttcccagcctcgccgccccaccaccccagcattgccttaccttgccttgccttgccctgccctccattccacctccacctcgccgcccgaatccccccacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaggaccggcggatgaggcgcatgaccggggtcaagaccaaggagctcctcatctgggtcaccctctccgacatgttcgtcgacagggacgacccctccaagatcaccttcaagacgcccaccgggctcggcaggacctaccccgtctccgccttcgctaaggaaggcgccggtgacgacggcgcggcggccaagcacaaggatgatgcccccgccccgaccgccgccggtaaggctgctgccagcaagtgagctaacctcacgccggcggactctagcaagagcacgaacgagggccaagcgctcgaaacccagcgacgtggaagcgcctgcgccgcgagcatccttccagagcgcggggccaaggccaagcagaggtatttatcatcgcagccgatccccagccgcacgaacggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggcttcgtggcggacgccgacgtcggggagcaggcggcgcggctcgaggccagcctccagggcacccggtgggccgccgccgtcaacgacgcgcgcagggccgacccggcctcgccctacaccgtcgcgcagtacaactcgcccttcgagttcaccggcagggtcaacgagatctggatgctcttcgacgcggacgacgacgccagtatgtgatgcgattccaagcgtgctctcggggcactgaggcgtttagggaaggacgcgcatgcacctgtgcagtgcagctgtgctaccatgaagtatttcgtgctcttgtgcgctagcttcgtttactttcgacttttcgagtaaggaataaggtgcctcttgttgcaataatgataaagctaatcctgcttgtaattacatttcgtggcatggccattccggcaacatgtccagtaaaaaaaaactttttagtttca

SEQ ID NO: 1986 - DNA, 688 bp, Saccharum officinarum
aaacagctggctggaagacatattttcaacagattcagagaggcaaagagcgagagagctacggaggattatcaacccagctagcttccatggagagagttgcatcaagctgcgtcagcctcctagcacaaaggagggcgtactctgtggccgcggccatggcgaagggagccgcatcacggagggccgacgataagaaggcggcggcggggctgcgatgaccaagcgcgtgatgggcaagaaggaggtgaacaccgcagccgctgctgcggcagaggagaagagggcgtgggtgccggaccctgtgaccggctactatcgcccagcaggtagcgctgccaaggaggtggacgcggcggagctgcgcgccaagctgctgccggaggctgcggccaactgatgattaatcaaacagtcaccttgtcgagctcgagcatgagttggctgtccacgcctagcttatcttgctttaagatacgcgctcgttgatcgccgggctccttgcctagagcatgagggtgctgtgtatcgtctgttctttgcaggcagcatagtatagtattgtccgcaaagtgctccatcttctttttaataagaagacggaatagaaccggcttctacacccatacacgtccaagccttaccatatactaaatctatttcaaattataattcgtttgactttttt

SEQ ID NO: 1987 - DNA, 776 bp, Zea mays
ctctcacatcacatctgaaacagaaacagctagaagacatattcaacagattcagagaaagcacatatatatagaatatagagagagagaggcaaaaaaagagcgagagagagctgcggattaattaccaacccggccagcttccatggagagagttgcatcaagctactgcgtcagcctcctagcacaaagcaggagggcctacactgtggccgcggccatggctaagaagggagccgccgcacggagggtcgacgagaagaaggcggcggccgcgctgaccaagcgcgtgatgggcaagaaggaagtgaacacggctgccgctgcggcagctgaggagaaggcgtgggtgccggaccctgtcaccggctactatcgcccagcaggtagcgccaaggaggttgacgcggcggagctacgcgccaagctgctgacggaggctgcggccaactgattaatcaagcagtcactttgtcgagctacagcatgagttggctcacttggctgtccacctagcttctcctgctttaagatccgcgctcgttgatccccgagctccttggcctagagccttttatatactcaatgatacatatataatatataacaggaacatatccaatacacatgagtttttgatacacatatggtgcatataaattaacaaagtccacacaaaattcatacttattctttctatcttactctaattatatacaaaagtttaaatttaaattcattatactttagttgtagctgtaataaaaaagataaaa

SEQ ID NO: 1988 - DNA, 769 bp, Setaria italica
gagaggagacgactttctcatcgagagattacagagagagagctggtattcagctagtcctgcttccatggagagagttgcatcaggctgcgtgagccttctagcacaaaggagggcctactctgtggccgcggccatggcgaagggagccgggcggagggccgacgagaaggcggcggcggccaagcgcgtgatgggcaagaaggaagtgaacaccgcggccgcagtggcggaggagaagacggcgtgggtgccggacccggcgaccgggtactatcgcccggccggtggcgccaaggaggtggatgcggcggagctccgcgccaagctgctgacgcaggccgcaaactgatgaatcaaggtcacttatttgtccagcatgggttaccagtcgtcgagctagcatatcttgctttgctttaagagccgcgctcgttgatcgctgggatttgtggcctagagcatgagggtgctgtatctccgcagcatggtcgaatcgtcggtgactactccatctacgcaccacatttacatatatgatacgtatatagcttccctgtaacatccggtttagctttggagatgtgtaatattttctgcaatcttcttgtctggctcgtcacattcttgaattgactataatacggagtccagaagggcagaaccaaacgtggcaagttgtgtttcctttttatggttcatggctaatttcagtttggtctgttaagttcattctacaatataattgaaaactttcactattccttcg

SEQ ID NO: 1989 - DNA, 775 bp, Panicum virgatum
aacagatcctcagagagaagagagaagctcctcgagagagatacagagaaagagctagcgcagagttgaacggagagctgaagttcaattagtcccctgcttgcttcttccatggagagagttgcatcaagctgcgtcggccacctggctcaaaggagggcctactccgtggccgcggccatggcgaagggagccgggcggagggccgacgacgagaagaaagcggcggccaagcgcgtgatgggcaagaaggaagtgaacaccgcagctgcggagaagacggcgtgggtgccggacccggtgaccgggtactaccgcccggcgggtggcgccaaggaggtggacgcggcggagctgcgcgccaagctgctcacgcaggcggccaactgatgatgaacccaagtcactttgacttttcgaaccatgagttatcagccgaggtagcttgtcttgctttgagatcggcgctcgttgatcgccgggctccgtggcctagagctagcgtgagggtgctgtatctttgcagcatagtagtttcttcggcgactgcttcatctgatttaggttttgagacatgcaagtctgcgatcttcttgcctgctgcctcgtgacctacttgactgctattcagtccagaaagaaagaacgaactaagcgtgcaaggttcagtgttaattattgtatttcagcttgtgttttccctttacgtttcatggttaatttcagtttagtccgttacagttaacttctgccaactgaaaactttctctattcg

SEQ ID NO: 1990 - DNA, 1173 bp, Zea mays
atactccgtataaagcagagaggagaggagaggagaggagacggggacggcaccggcagcgctccacaggcccaacctgccgtccacggcgcgaaagaagagccgcgaacccgggagtcctgcctgtcctcgtcctcctcccccttgccatccgccgcccatggcgtccgcgtccgcccccgaagtggtggtggtcttcgacttcgaccggaccatcatcgactgggacagcgacgactgggtcatcaccaagctcggcgccgccgacgccttccagcgcctgcgcccaaccatgcgctggaacccgctcatggacaggatgatggcggagctccacgccagggggaagacgcccgaggacatccgcgactgcctcaggagcgcgccgctcgacacgcacgtcgtttccgcagtcaagacggcggcggcgctggggtgtgacttgaaggtggtgagcgacgccaacaccttcttcatcgagaccgtcctggcgcaccacggcgtgctcggctgcttctccgagatcgtcaccaatccggcgagcgtcgacgcggacggcaggctcaggatctcgccgttccacgaccccgcgtccgcgccgcacggttgcagcctctgccctgacaacatgtgcaagtgcagggcaagatactggggaggatccaggcaacaggcagtgacaagaagcggcgccggcgcttcatctacatcggtgacgggaagggagattactgcccgtccctcaagctgggggaaggggaccacgtcatggcaagggagaactaccccctgtggcatctcatctgcgacaacaagcagcttctcaaggctgaggttcatccgtggaacagcggcgaggaactggaaaagacgctgcttaagttggccggcgaagtgatcagtccacctgcacaggcttcacaatttgactacagcaaatgcgagatgagcaatccagcatcctgccctccgtcgtgtgccgcactgattaccgaccaactcttagttcgcaagtactgataaaagtctccatcctgcattcaacatgatatatgtcgtcaatctgcacagcaatttagagatggattatctatgctatacactatgttatcaaataaactgtagcgtggcatggaaggacatgagttgagaattaattgatgccagtgtggg

SEQ ID NO: 1991 - DNA, 2190 bp, Saccharum officinarum
agcagttgcccctgggtctgggtgatcgtgacgcacatgaccggagcctcacttcgctttggtgtggcgtgagcacgatggacggtgaacatgatgcgttgcgccgatcggattcgcggttcttgtgagagctgtatagtcaaaaggctggagtggttggaattatccgatcagattgggtgaggcggagggagccctttgcgccgtcacaaatcccaaccaatcgctgagctgctcgtcgattgttaaatagctcgtcgcgtacgacacggcaagcgggctgcgacggcgactctctctaatctgctctgcgtctccactccgctccgccggcagcgcgggccatggcgacgccggcgccggcaccctccctccgcttcctcctcctcctgctaccgctgctagccatcgccggcgccttgtctcacccagcgcacgagttctgcgcggtcgggggtgacgccgccagctgcggcggcggaggggacggcacgaggatcctgatcaagggcgggacggtggtgaacgcgcaccgcgcggaggaggccgacgtctacatcgaggacggcgtcgtcgtcgccgtccgcccaaacatcccggttggtgctgataatgtccgagtaatcgacgcaacaggaaaatatgtcatgccaggtggaatcgaccctcatacgcacctggagatggagttcatgggcactgtgaccatagatgacttcttcagcggccatgctgcggcgctggctggtgggacgacgatgcatattgactttgtcattcctgtgaacggcaacttgactgcaggcttggagtcctacaagcacaaggcagcaaaagcttccatggattatggctttcacatggccattacaaagtggaatgatgaggttgcaagggaaatggaagtgatggttaaggaacatggaataaattctttcaagtttttcatggcatataaaggctccttgatggtcaccgatgacctcctcctgcaaggcctacagaaatgcaagtcgcttggtgctcttgctatggttcatgcagagaatggggatgctgttgccgagggacaacagcggatgattgaccttgggataactggtccagaagggcatgctctctcaagacctccaattttagaaggagaagcaactgcacgggcaatccgtttagcaaagttcatcaatacgccactgtatgttgttcatgtgatgagcatcgacgcgatggatgagattgccaaggctaaaagagaagggcagagagtcataggtgaacctgtggtttctggactagtgcttgatgattcttggctttgggatcctgacttcacaattgcttcaaagtatgtgatgagtcctccaatccgggaagcagggcatggtaaagcactccaagctgctctttcatcgggaattttacagcttgtaggtactgatcactgcacattcaactcgacacagaaagcttttggttctgatgattttcggaagattcccaatggtgtaaatggtcttgaggaacggatgcatataatttgggacagcatggtggtgactggcaagatttctgtaaccgactatgtcagagtgacaagcacagaatgtgccaagatcttcaacatatttcctcggaaaggagcaatcctggaaggatctgatgcagatatcataatcctgaatcctgaaaggagctttgtgatgggtgctcacacacaccattcgaggtccaacactaatgtgtacgagggcaggaaaggaaagggaatggtggaaatcacaatctcaaggggccaagtggtatgggaggatggcgttctgaatattgcacctggttcaggaagatacgtcatgatgccacctttcggctacgtctttgatgggattgagaagtccgatgccgcctacagagcttccctccgagcccctgtacagcgtggtaaagctggtgcatagctatgacagctgttgatgccattgacctggcagtagctccccatctgattcaagaacgagttgctccaaggtgaacaccgttcgttccatgtgtattgtctatacagaacactctatttaagatcagattcaggataggtaaaggccttagcttgcttatgtacatcaaacacatttgtgactcagaaaatttactagttctggtcagtttgtacaaatagtaacttgttattcc

SEQ ID NO: 1992 - DNA, 2521 bp, Zea mays
ttttttatttttcatctaataaactcaactaaattttttgtttggttgtttttttaaacacgtgcctgtggcacgtgcctctcaagtctcaactagtatgtagaaattggctagtcgatcggatactccctttccctgcgaagtgttctacgactggtggactctcttggctgtggctgctgatccgccaatgtcaaaggcacgtgcagcagcagttgcccttgcccctgggtctggttgatcgcgatgcacatgaccggagcctgactttggtgcggcgtgagcacgatgatgcgttgcgcggttcggattcgtgagagctgtagtcaaaaggctggaacggatggaattatccgagcagattgggtgggacggcggagggagccctttgcgccgtcacaaatcgcaaccaatcgccgagttgcttgtgttaaatagctcttcgcgtacgacacggcaagcgggctgcgacggcgactttctcatctgctcactgctctgcttctccactccgctccgctggcagcgcaggccatggcgacacaggcgctggcgccctccctccgcctcctcctgctgctaccgctgctcgccgccgccgccgccgccgccgcgttgtctcacccagcgcacgagttctgcgcggtcgggggtgacgcctccggctgcggcggcggaggagacggcacgaggatcctgatcaagggcgggacggtggtcaacgcgcacctcgcggaggaggccgacgtctacatcgaggacggcgtcgtcgtcgccgtccgcccagacatcccggttgatgttgataatgtcagggtaatcgacgcaacaggaaaatatgtcatgccaggtggaattgaccctcacacgcacctggagatggagttcatgggcaccgtgaccatagatgacttcttcagcggccatgctgcggcactggcgggtgggacgacgatgcatattgactttgtcattcccgtggacggcaacttgactgcagggttggagtcctacaagcacaaagccgcaaaagctgccatggattatggctttcacatggccattacaaagtggaatgatgaggttgcaagggaaatggaagtgatggttaaagaacatgggataaattctttcaagtttttcatggcatataaaggctccttgatggttactgatgacctcctcctgcaaggcctacggaaatgcaagtcgcttggtgcccttgctatggttcatgcagagaatggtgatgctgttgccgagggacaacagcggatgattgaccttgggataactggtccagaagggcatgctctctcaaggcctccaattttagaaggagaagcaactgcacgggcaatccgtttagctaagttcatcaatacgccactgtatgttgttcatgtgatgagcatcgacgcaatggatgagattgccaaggctaaaagagaagggcagagagtcatcggtgaacctgtggtttctggactagtgcttgatgattcttggctttgggatcctgacttcacgattgcttcaaagtacgtgatgagtcctccaatccgggaagcagggcatggtaaagcactccaagctgctctttcatcgggaattctacagcttgtaggtactgatcactgcacattcaactccacacagaaagcttttggttctgatgattttcggaagattcccaatggtgtaaatggtcttgaggaacggatgcatatactttgggacagcatggtggagactggcaagatttctgtaaccgactatgtcagagtgacaagcacagaatgcgccaagaccttcaacatattccctcggaaaggagcaatcctggaaggatctgacgcagatatcataatcctgaaccctgaaaggagctttgtgatgggtgctctcacacaccattcgaggtccaacaccaatgtgtacgagggcaggaaaggaaagggaatggtggaaataacaatctcaaggggccgagtggtatgggaggatggcgttctgaacattgcacctggttcaggacgatacgtcatgatgccacctttcggctacgtctttgatgggatcgagaagtccgatgcgacctacagagcttccctccgagcccctgtacagcgtggtaaagctgctgcatagctatgacagctgctgatgccattgacagggcagtagccccccatctgattcaagaacgagttgctccaaggtgaacaccgcatcgttccatgcgtattgtctatacagaacagtttatttaagatcagattcaggataggtaaaggcctcagcttgcctatgtacatcaaacacatttgttactagttctggtcaatttgtgcaactagcaattcgctgttccaataaatcatattatcacattcattactcgcattgtaatgttaaacccttcttcctattcatcatgagctatccccaaacatgctaaaagaacatggttactgattgttcatgaaaaggatggcctatgcagtactgtgattctttg

SEQ ID NO: 1993 - DNA, 1924 bp, Panicum virgatum
ggcgactctctcatgatctcatctgctctgcttctccactcgaccactccgccggcagcgcgggccatggcgacgccctcgcgccgactcctcctcctgctgctgccgctgctcgccgtcgccgtcgccgtcgcggcgtctcatccggcgcacgagttctgcacggcggggggtgacgccggctgcggcggaggggacggggcgaggatcctgatcaagggcggcacggtggtgaacgcgcaccgggcggaggaggccgacgtctacatcgaggacggcgtcgtcgtcgccgtccggcccaacatcccggtcggtgatgataatgtaagggtgatcgacgcaactggaaaatatgtcatgccaggtggaattgaccctcacacgcacttggcaatggagttcatgggcaccgtgaccatagatgacttcttcagtgggcatgctgctgcactggctggtgggacgacgatgcacattgacttcgtcattcctgtgaacggcaacttgactgcaggcttggagtcctacaagcagaaagcagcaaatgctgccatggattatggctttcacatggccattaccaagtggaatgacgaggttgcaagggaaatggaagtcatggttaaggaacatgggatcaattctttcaagttcttcatggcatataaagggttccctgatggtcactgatgacctcctcctgcaaggcctacagaaatgcaagtcgcttggtgccctggctatggttcatgcagagaatgggatgctgttgccgaaggacaacagcggatgatcgaccttgggataactggtccagaagggcatgctctctcaaggcctccaattttggaaggagaagcaactgcacgggctatccgcttagcaaagttcatcaatacgccactgtacgttgttcatgttatgagcattgatgcaatggaggagattgccaaggctaaaagagaagggcagagagttattggtgaaccagtggtttctggactagtccttgatgattcttggctttggaatcctgacttcacaattgtttcaaagtatgtgatgagtcctccaatccgggaagcagggcacggtaaagcactccaagctgctctttcatcgggaattttacagcttgtaggtactgatcactgcacattcaattccacacagaaagcatttggctctgatgattttcggaagattcccaatggtgtaaatggtctggaggaacggatgcatataatttgggatagcatggtggagaccggcaagatttctgtcaccgattatgtcagagtgacaagcacggaatgtgccaagatcttcaacatataccctcggaaaggagcaatcctggaaggttctgacgcagatatcatcatcctaaaccctgaacggagctttgtgatgggtgcccacacacaccattcaaggtccaacacaaatgtatatgaaggcaggaaaggaaagggaatggtggaagtcacgatatcaaggggccgagtggtatgggaggatggtgtgctgaatatagctcctggttcaggaagatacgtcaggatgctgccttttggctacgtctttgatggcattgagaagtcagatgccgcctacagagcttccctccgagctcctgtacagcgtggtaaagcttctgcttaacgatgccctgctccatctagttcgagactgctgcttaacgatgcctcgctccatctagttcgaggagctgctccaatgtgaacgccgttcgttccatgtgtatatacaaaaaagaacaatttactgaagttcagattcagcataggtaaaggccttaacttgcctatgtacatcgaacacatttaccagttctggtcagtttgtacaactagaaacttgctattctaataaatgaaaggaaaaactggtttctaccacc

SEQ ID NO: 1994 - DNA, 1861 bp, Pennisetum glaucum
tgctacggcgactctagtctcatctgctctgcttctccgctccactccgccggcagcacgggccatggcgacgccgacgccctcgcagttgctactcctgctgctaccgctactcgccgtcgcggcgtctcatccggcgcacgagttctgcgcggcggggggtgacgccggctgcggcggcggaggggacggggcgaggatcctgatcaagggcgggacggtggtgaacgcgcaccgggcggaggaggccgacgtctacatcgaggacggcgtcgtcgtcgccgtcaggcccaacatcccggtcggtaatgatcatgtcagagtgatcgacgcaactggaaaatatgtcatgccaggtggaattgaccctcacacgcacttggcgatggagttcatgggcacggtgaccatagatgacttcttcagcggccatgctgctgcactggctggtggaacgacgatgcacattgacttcgtcatcccggtgaatggcaacttgactgcaggcttggagtcctacaagcagaaagctgcaaatgccgccatggattatggctttcacatggccattaccaagtggaatgacgaggttgcaagggaaatggaggtgatggttaaggaacatgggatcaattctttcaagttcttcatggcatataagggttccctgatggtcacggatgaccttctcctccaaggcctacggaaatgcaagtcccttggtgccctggctatggtacatgcagagaatggggatgctgttgccgagggacagcagaggatgatcgaccttggaataacgggcccagaagggcatgctctctcaaggcccccgattttggaaggggaagcaactgcacgggcaatccgcttagccaaattcatcaatacaccactgtacgttgttcatgtgatgagcgttgatgcaatggaggagattgccaaggctaaaagagaagggcagagagtcattggtgaaccagtggtttctggactggtgcttgatgattcttggctttgggatcctgacttcacagttgcttcaaagtatgtgatgagtcctccgatccgggaagctgggcatggtaaagcactccaagctgctctttcatcaggaattttacagcttgtaggtactgatcactgcacattcaattcaacacaaaaagcctttggctctgatgattttcggaagattcccaatggcgtaaatggtcttgaggaacggatgcatattatttgggatagcatggtggagactggcaagatttctgtcaccgactatgtcggagtgacaagcacagaatgtgccaagatcttcaacatataccctcagaaaggagcaatcctagaaggatctgacgcagacatcatcatcctaaaccctgaaaggagctttgtgatgggtgcccacactcaccattcaaggtccaacacaaatgtatacgagggcaggaaaggaaagggaatggtggaagtaacgatctcaagggggcgagtggtatgggaggatggtgtgctgaacatcactcctggttcaggaagatacatcaggatggcaccttttggctatgtatttgatggcattgagaagtcagatgctgcctacagagcttccctccgagctcctgtacagcgtggtaaagctgctgcttaacaattctttgctccatctggttcagctccatctagttcgagaacaagctgctccaaggtgaataccactccttccgtgcgtataccaaagggggggagcttcattttagttcagatgatccaggattggtaaagaccttaacttgcctatgtacatcgaacacattaacccagaaattctgttggttccagacgatttgtacaa

SEQ ID NO: 1995 - DNA, 1865 bp, Brachypodium distachyon
ccatggcgacgccctgccgcctcctgctgatcctgctcggcatcgtcgccgtcgccgtcgcggcgcctcacccggcgcacgagttctgcgcggccgcggcaggaggaggaggcgccggcagctgtggaggggacggcacgaggatcctgatcaagggcgggacggtggtgaacgcgcaccgggcggaggtggccgacgtgtacgtcgaggacggcgtggtcgtcgccgtccgcccaaacatcccggttggtgaagataatgtcaaagtgattgatgcaaccggaaaatatgtcatgccaggtggaattgaccctcacacgcacctggagatggagttcatgggaactgtaaccatagatgacttctttagcggtcatgctgcagcactggctggtgggacaacgatgcacattgactttgtcattccagtaaatggaaacttaactgcaggcttggaatcctacaaacacaaagcagaaaagtctgctatggattatggatttcacatggccattacgaagtggaatgatgaggtttcaaaggaaatggaagtgatggttaaggaacatgggatcaattctttcaagttcttcatggcgtacaaaggttccttgatggtcaccgatgacctcctcttgcaaggtctacagaaatgcaagtctcttggtgcgctggctatggttcatgcagagaacggggatgctgttgctgagggacaacagcggatgattgatcttgggataactggtcctgaagggcatgctctctcaagacctccagttttggaaggtgaagctacttcccgggcaattcgattggcaaaattcatcaatacaccgctgtatgttgttcatgtgatgagcattgatgcaatggaagagattgccaaggctaaaagagaagggcagagagtcatcggcgaacctgtggtatctgggcttgtccttgatgattcttggctttgggatcctgacttcgcaactgcttcaaagtatgtgatgagtcctccaatccgggaagcagggcacaataaagcacttcaagctgccctttcatcaggaatattacagcttgtgggaactgatcattgcaccttcaattccactcagaaagctttcggttctgatgatttcaggaagatccccaatggtgtaaatggtattgaggaaaggatgcatataatttgggatagtatggtggagactggcaagataactgtcactgattatgtgagagtgactagcacagaatgcgccaagatcttcaacatataccctcagaaaggagcaatcatggagggatctgatgcggacatcatcatcctaaaccccaaagggagctttgtgatgggtgcccacacacaccattcaaggtccaacacaaacgtgtacgagggcagaaaaggaaagggaatggttgaggtcaccatatcaagggggagagtggtatgggaagatggcactctgaatgttgcggccggttcaggaagatacatcaggacgccgcctttcggctacctcttcgatggcattgagaaatcagatgctgcctacagagcttccctccgtgctcctgtacaacgtagtaaagctgctgcttaagggtctccatgtctggtctcattggcccatgatggttgcaccaccatcctatctggttcaggaacaaattgctcccaaggtgaacaccttctgttccttgtgtaacttgtatatagtctgcctttattgatatgcagatccgggataggtaacattctaaaactacgtatgtatacaaggcaacttattgttttcaggaacatgcaaagtacctttctgattggaaatactacaaatttgattcagttcatcatgttttaacta

SEQ ID NO: 1996 - DNA, 1905 bp, Triticum aestivum
ctgctgcgatttgcgacaagcgaatcgcggctagcaggagttggaaagtggggggccaagccatggcgacgccctgccgcatccgccgcctgctcgtcctgctcgccgccgtcgccgtcgcggcgtctcacccggcacacgagttctgcgcggccgcgggaggaggaggaggaggcgccggcggctgcggaggaggaggggacggcacgaggatcctgatcaagggcgggacggtggtgaacgcgcaccgggcggaggaggcagacgtctacatcgaggacggcgtcgtcgtcgccgtccggccgaacatcccggttggtgacgataatgtcagagtgatcgatgcaaccggaaaatatgtcatgccaggtggaattgacccgcacacccacctggagatggagttcatgggaactgtaaccatagatgacttctatagtggtcatgccgcagcactggctggtgggacgacaatgcacatcgactttgtcattccagtgaacgggaacttgactgcgggcttggaatcctacaaacacaaagcagaaaaggctgctatggactatggatttcacatggccattaccaagtggaatgatgaggtttcaagggaaatggaagtgatggtcaaggaacatgggatcaattctttcaagttcttcatggcatataaaggttcattgatggtgacggacgacctcctccttcaaggcttacagaaatgcaagtctcttggtgcactggctatggttcatgcagagaacggggatgctgttgctgagggacagcagcggatgattgaccttgggataactggtccagaagggcatgctctctcaagacctccagttttggaaggcgaggcaacttcacgggcaattcgattagcaaaattcgtcaatacaccgttgtatgttgttcatgtgatgagtactgatgcaatggaagagattgccaaggctaaaagagaaggtcagagagtcatcggggaacctgtggtatctgggctagtccttgatgattcttggctttgggatcctgactttgcaactgcttcaaagtatgtgatgagtcctccaatccgggaagcagggcataataaagcacttcaagctgctctttcatcagggatattacagcttgtgggaactgatcattgcaccttcaattccactcagaaagctttcggttctgatgatttcaggaagattcccaatggcgtaaatggtattgaagaaaggatgcatataatttgggatagcatggtggagaccggcaagatcacagtcaccgattatgtgagagtgacaagcacagaatgtgccaagatcttcaacatatacccgcgaaaaggagcaatcctcgagggatctgatgcagacatcatcatcctgaaccccaagaggagcttcgcaatgggcacgcgcacacaccattcgaggtccgacacgaacgtgtacgagggcagaaaaggaaagggaatggtagaggtgaccatctcaagagggcgagtggtgtgggaggatggcaatctgaacgccgtgcccggtgcaggaagatacgtcaggacaccgcctttcggctacctcttcgacggccttgacaagtcggatgccgtctacagggcttccctccgagcacctgtacggcgtggtgaggctgctgctgcttaactgcgtgttccacggctggtctcatggcaccactgacggtaccactatcccatctggttcaagaacaaattgcacctaaaggtgaacgccgtctgctccatgtgtagcttccttgtacatacaatctgcctcgtttatatccagattcggacataggtgaaattgtaaagttaattatgcatacaaggcacttcatttattttcttgcgaatataaaaatcacatttctgat

SEQ ID NO: 1997 - DNA, 2390 bp, Hordeum vulgare
gggaagaaggaactttgtctaaccactcgatggatgctccctgatgaatagtattattctcactagtgaggaatttagtctaaagcacatgcaggactttgttctggccagagtgtccgagagaatcaatccacagaaatcctcggctctcttttacgccacgccgtgaaaatggccatgatggatgaattcgccgttggtgcttgggctctgcaagtcaacaggcccgtggaggtggaggagatcatccggttatagattggggccgcaccagccaatccggagcctttctgttggacaagatacgctcgctcctctgtcaaagagggagaaggcgtgaaacaaaccaacaggctagcaccactgctactcctactctgctgcggtttgcgagcgggtcgcggctagcaggagttgggaagccatggcgacgccctgccgcatccgcgtcctgttcgtcctgctcgccgccgccgttgccggcgcggcgtctcacccggcacacgagttctgcgcggccgcgggaggaggggacggcacgaggatcctgatcaagggcgggacggtggtgaacgcgcaccgggcggaggaggccgacgtctacatcgaggacggcctcgtcgtcgccgtccggcccaacatcccggttggtgacgataatgtcaaagtgattgatgcaaccggaagatatgtcatgccaggtggaattgacccgcacacccacctggagatggagttcatgggaactgtaaccatagatgacttctatagtggtcatgccgcagcactggctggtgggactacaatgcacatcgactttgtcattccagtaaacgggaacttaactgccggcttggaatcctacaaacacaaagcagaaaaatctgctatggattatggatttcacatggccattaccaagtggaatgatgaggtttcgagggaaatggaagtcatggtcaaggaacatgggatcaactctttcaagttcttcatggcatacaagggttcattgatggtgaccgacgacctcctcctgcaaggcttacaaaaatgcaaatctcttggtgccctggctatggttcatgcagagaatggggatgctgttgctgagggacagcagcggatgattggtcttgggataactggtccggaaggacatgctctctcaagacctccagttttggaaggcgaagcaacttcccgggcaattcgattagcaaaatttgtcaatacaccgttgtatgttgttcatgtgatgagcatcgatgcgatggaggagattgccaaggctaaaagagaagggcagagagtcatcggcgaacctgtggtatctgggctagtccttgatgattcttggctttgggatcctgacttcgcaactgcttcaaaatatgtgatgagtcctccaatccgggaagcagggcacaataaagcacttcaagctgctctttcatcaggaatattacagcttgtgggaactgatcattgcaccttcaattccactcagaaagcttttggttctgatgatttcagaaagattcccaatggtgtaaatggtattgaggaaaggatgcatataatttgggatagcatggtggagaccggcaagatcactgtcaccgattatgtgagagtgacaagcacagaatgcgccaagatcttcaacatataccctcgaaaaggagcaatcctcgagggatctgatgcagacatcatcatcctgaaccccaagaggagcttcgcaatgggcgcgcgcacgcaccattctaggtccgacacaagcgtgtacgagggcagaaaaggaaagggaatggtagaggtcaccatttcaagagggcgagtggtgtgggaggatggcaatctgaacgccgtgcccggtgcaggaagatacgtcaggacgccgcctttcggctacctcttcgacggcatcgacaagtcagatgccgtctacagggcttccctccgagcccctgtaagacgtggtgaggctgctgctgcttaacggcgtgttcgacggctggtctcattgccccctgacggtaccaccatcctatctggttcaagaacaaattgcgcctaaggtgaacagcgtctgctccatatgtagcttccttgtacatacaatctgccttgtttatatccagattcagagatgggtggaaattgtaaagttaattattcatacaaggcactttttttcgtgcaaacatacaaatcacatttctgattggggagattgcaaataggctcaagttcgacatatcctgatgtcaaataaacttgggagtctggtacaacttccatgatcatagttatataccaggagcacacgctgatagcaggcacagttgtaactcaaatgatcaaattttgtagtatcctactcc

SEQ ID NO: 1998 - DNA, 2385 bp, Hordeum vulgare
gggaagaaggaactttgtctaaccactcgatggatgctccctgatgaatagtattattctcactagtgaggaatttagtctaaagcacatgcaggactttgttctggccagagtgtccgagagaatcaatccacagaaatcctcggctctcttttacgccacgccgtgaaaatggccatgatggatgaattcgccgttggtgcttgggctctgcaagtcaacaggcccgtggaggtggaggagatcatccggttatagattggggccgcaccagccaatccggagcctttctgttggacaagatacgctcgctcctctgtcaaagagggagaaggcgtgaaacaaaccaacaggctagcaccactgctactcctactctgctgcggtttgcgagcgggtcgcggctagcaggagttgggaagccatggcgacgccctgccgcatccgcgtcctgttcgtcctgctcgccgccgccgttgccggcgcggcgtctcacccggcacacgagttctgcgcggccgcgggaggaggggacggcacgaggatcctgatcaagggcgggacggtggtgaacgcgcaccgggcggaggaggccgacgtctacatcgaggacggcctcgtcgtcgccgtccggcccaacatcccggttggtgacgataatgtcaaagtgattgatgcaaccggaagatatgtcatgccaggtggaattgacccgcacacccacctggagatggagttcatgggaactgtaaccatagatgacttctatagtggtcatgccgcagcactggctggtgggactacaatgcacatcgactttgtcattccagtaaacgggaacttaactgccggcttggaatcctacaaacacaaagcagaaaaatctgctatggattatggatttcacatggccattaccaagtggaatgatgaggtttcgagggaaatggaagtcatggtcaaggaacatgggatcaactctttcaagttcttcatggcatacaagggttcattgatggtgaccgacgacctcctcctgcaaggcttacaaaaatgcaaatctcttggtgccctggctatggttcatgcagagaatggggatgctgttgctgagggacagcagcggatgattggtcttgggataactggtccggaaggacatgctctctcaagacctccagttttggaaggcgaagcaacttcccgggcaattcgattagcaaaatttgtcaatacaccgttgtatgttgttcatgtgatgagcatcgatgcgatggaggagattgccaaggctaaaagagaagggcagagagtcatcggcgaacctgtggtatctgggctagtccttgatgattcttggctttgggatcctgacttcgcaactgcttcaaaatatgtgatgagtcctccaatccgggaagcagggcacaataaagcacttcaagctgctctttcatcaggaatattacagcttgtgggaactgatcattgcaccttcaattccactcagaaagcttttggttctgatgatttcagaaagattcccaatggtgtaaatggtattgaggaaaggatgcatataatttgggatagcatggtggagaccggcaagatcactgtcaccgattatgtgagagtgacaagcacagaatgcgccaagatcttcaacatataccctcgaaaaggagcaatcctcgagggatctgatgcagacatcatcatcctgaaccccaagaggagcttcgcaatgggcgcgcgcacgcaccattctaggtccgacacaagcgtgtacgagggcagaaaaggaaagggaatggtagaggtcaccatttcaagagggcgagtggtgtgggaggatggcaatctgaacgccgtgcccggtgcaggaagatacgtcaggacgccgcctttcggctacctcttcgacggcatcgacaagtcagatgccgtctacagggcttccctccgagcccctgtaagacgtggtgaggctgctgctgcttaacggcgtgttcgacggctggtctcattgccccctgacggtaccaccatcctatctggttcaagaacaaattgcgcctaaggtgaacagcgtctgctccatatgtagcttccttgtacatacaatctgccttgtttatatccagattcagagatgggtggaaattgtaaagttaattattcatacaaggcactttttttcgtgcaaacatacaaatcacatttctgattggggagattgcaaataggctcaagttcgacatatcctgatgtcaaataaacttgggagtctggtacaacttccatgatcatagttatataccaggagcacacgctgatagcaggcacagttgtaactcaaatgatcaaattttgtagtatcct

SEQ ID NO: 1999 - DNA, 1942 bp, Triticum aestivum
  misc_feature (26)..(26): n is a, c, g, or t
  misc_feature (29)..(29): n is a, c, g, or t
  misc_feature (48)..(48): n is a, c, g, or t
  misc_feature (57)..(57): n is a, c, g, or t
  misc_feature (67)..(67): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (111)..(111): n is a, c, g, or t
  misc_feature (118)..(118): n is a, c, g, or t
  misc_feature (264)..(264): n is a, c, g, or t
  misc_feature (293)..(293): n is a, c, g, or t
  misc_feature (364)..(364): n is a, c, g, or t
  misc_feature (371)..(371): n is a, c, g, or t
  misc_feature (380)..(380): n is a, c, g, or t
  misc_feature (533)..(533): n is a, c, g, or t
  misc_feature (581)..(581): n is a, c, g, or t
  misc_feature (593)..(593): n is a, c, g, or t
  misc_feature (638)..(638): n is a, c, g, or t
  misc_feature (833)..(833): n is a, c, g, or t
  misc_feature (1160)..(1160): n is a, c, g, or t
acaaaccaacaaactagtacttctantantctgctgcgatttgcgacnagcgaatcncggctagcangagttggaaagtggnggnccnagccatggcgacgccctgccgcntccgccncctgctcgtcctgctcgccgccgtcgccgtcgcggcgtctcacccggcacacgagttctgcgcggccgcgggaggaggaggaggaggcgccggcggctgcggaggaggaggggacggcacgaggatcctgatcaagggcgggacgntggtgaacgcgcaccgggcggaggaggcngacgtctacatcgaggacggcgtcgtcgtcgccgtccggccgaacatcccggttggtgacgataatgtcanagtgatngatgcaacnggaaaatatgtcatgccaggtggaattgacccgcacacccacctggagatggagttcatgggaactgtaaccatagatgacttctatagtggtcatgccgcagcactggctggtgggacgacaatgcacatcgactttgtcattccagtgaangggaacttgactgcgggcttggaatcctacaaacacaaagcagaaaangctgctatggantatggatttcacatggccattaccaagtggaatgatgaggtttcnagggaaatggaagtgatggtcaaggaacatgggatcaattctttcaagttcttcatggcatataaaggttcattgatggtgacggacgacctcctccttcaaggcttacagaaatgcaagtctcttggtgcactggctatggttcatgcagagaacggggatgctgttgctgagggacagcagcggatgattgancttgggataactggtccagaagggcatgctctctcaagacctccagttttggaaggcgaggcaacttcacgggcaattcgattagcaaaattcgtcaatacaccgttgtatgttgttcatgtgatgagtactgatgcaatggaagagattgccaaggctaaaagagaaggtcagagagtcatcggggaacctgtggtatctgggctagtccttgatgattcttggctttgggatcctgactttgcaactgcttcaaagtatgtgatgagtcctccaatccgggaagcagggcataataaagcacttcaagctgctctttcatcaggnatattacagcttgtgggaactgatcattgcaccttcaattccactcagaaagctttcggttctgatgatttcaggaagattcccaatggcgtaaatggtattgaagaaaggatgcatataatttgggatagcatggtggagaccggcaagatcacagtcaccgattatgtgagagtgacaagcacagaatgtgccaagatcttcaacatatacccgcgaaaaggagcaatcctcgagggatctgatgcagacatcatcgtcctgaaccccaagaggagcttcgcaatgggcacgcgcacacaccatacgaggtccgacacgaacgtgtacgagggcaggaaaggaaagggaatggtagaggtgaccatctcaagagggcgagtggtgtgggaggatggcaatctgaacgccgtgcccggtgcaggaagatacgtcaggacaccgcctttcggatacctcttcgacggccttgacaagtcggacgccgtctacagggcttccctccgagcacctgtacagcgtggtgaggctgctgctgctgctgcttaactgcgtgttccacggctggtctcattgccccactgacggtaccactatcccatctggttcaaggacaaattgcacctaaaggtgaacgccgtctgctccatgtgtagcttccttgtacatacaaatctgcctcgtttatatccagattcggacataggtgaaattgtaaagttaattatgcatacaaggcacttcatttattttcttgcgaatataaaaatcacatttctgat

SEQ ID NO: 2000 - DNA, 2561 bp, Oryza sativa
cagtctcagagtcagaggcaagagaaccgcaaaacacaggacgcgctccgctcctctgccgccgccgccggagctctcacctccaggggctctcgccacgagccgccggagctcaacccgtgccgccgcacgggcgccggcggacggctggaggccgctgctgcatccttctaccgcccgcattgcttttgctccctcctcctcggctcctccctgtccaaacaccggcagtgtttcctcagttttactgggatctcccctgacgtgacaacattagggaatatcattgccatgttctggatcttctcaacactaggatacgaagaaggtcgtcaaggcaacttcgacgaacatagcagttcaatgtgcaggagcaccatgatctgtttgaaccacgatctttgcagcaagtgcagccattgtcaaagacaggcagcacgtagttgaagcttgcaggagttttgctctatccaagatgtcacaaacacagcctgagttcttacggcgctggatgacagtgacgttctgaagatggtttgcagatcggatttatagcaagaagattatcggatggatttggtgacgagggcctgcgcgagattccaactaacccaggattttctctgttttttttttctttcgtttttgtttaataataatccgtttaattgatgtgttagtcctccccgcatacgtcgcacgcgctgctgattggataagagaatcgaacgaacgtgacaactggtttagtggttttttttttctctgcttcttctcttctctccgctcttctgcgtctctgaggatccgaggaagtggcggtcggaggaggaggagccatggcgatgccctgccgcctccacggcgacatcctgctgctcctgctcggcgccgtcgccgtcgcggtggctcacccggcggcgaacgagttctgcgcggccgtcggtggaggaagcggtggctgcggcgtcggcggcggcggcggaggggacgggaggaggatcctgatcaggggcgggacggtggtgaacgcgcaccgggtggaggaggccgacgtgtacgtggaggacggcgtgatcgtcgccgtgcggcccaacatcccggttggtgatgatcatgtaaaagtgattgatgcaactggaaaatatgtcatgccagcattggctggtgggacaacaatgcacattgacttcgtcattccagtgaatggcaatttaactgcaggtttggaatcctacaaacagaaggcagaaaaatctgccatggattatggatttcatatggccattacaaagtggaatgatgatgtttcgagggaaatggaaacgatggttaaggaacatgggatcaattctttcaagttcttcatggcgtataaaggttcattgatggtcacggatgacctactcctgcaaggcttacagaaatgcaaatctcttggtgccttggctatggttcatgcagagaatggggatgctgttgctgagggacagcaacgaatgatcgatcttgggataactggcccagaaggacatgctctctcaagacctccagttttggaaggggaagcaactgctcgggcaattcgattagccaagtttgtcaatacaccattgtatgttgttcatgtgatgagcattgatgcaatggatgagattgccaaggctaaaagagaagggcagagagtcattggtgaacctgtggtttctgggctagtacttgatgattcttggctttgggatccggacttcatgatagcttcaaagtatgtaatgagtcctcctatccgagaagcaggacataataaagcacttcaagttgctctttcatcaggaattttacagcttgtaggaactgatcattgcaccttcaactccacacagaaagctttcggctctgatgatttcagaaagattcctaatggtgttaatggtatcgaggaaaggatgcatattatttgggacagtatggtggagactggccgaatttctgtcagtgattatgtgagagtgacaagcacagaatgtgccaagattttcaacatataccctcggaaaggagcaattctggaaggatctgatgcagatattatcatcctgaatcccgagaggagctttgtcatgggtgcccacacacaccattcaaggtccaacacaaatgtgtacgagggcaggaaaggaaagggaatggtagaagtcacgatctcaagagggcgagttgtgtgggaggatggcattctgaacgttgttcccggttcaggaagatacgtcagaacaccgccttacagctacctgtttgatggcattgaaaagtcagacgctgcctacagagcctcccttcgtgcccctgtgaaacgtggcaaggctgctgcttaacgatgcccgctgctgatgaactacagaactagtttctccaaggtgaacgacgtctgctccatgcgtaacttccttgtgtttgtgtatacagatctcattattcatatcattttctgataggtaagaatgtaaaattacctgatactacctccgttttttaatagatgacgccgttgactttttctc

SEQ ID NO: 2001 - DNA, 1646 bp, Zea mays
tctatctgtattgccccgaaaccttcgtgcccgtttcgcctcgcgcctgcgttgctctgctatttccatttccattgcacccatttccggggtcgcctgcgttgcttcgcgtgggagcgtgattcgtttaggcctctcgccaatttcggagggcgacggcgacgtgctttcggcgggcgggcagagaaaatctagagtcttgggtttgccagacgcgcctttgtgggagacagacacttgctctcgcctccaatggccgagatctgctgcgaggaagccaagtcgacgccggcaaccgccgtggctgcggcttcagtctccgccacggccgcagcggccgcagccgtggcagtggcctcctcggcgttagagaggaggcgacgcaggctggagatgaggaggttccgcgtcgcgagcgatcccgaggagctggtcgcggaggacgtccgcgctgccaagcggcagaggctggcgcgcacgctgtccggctcctgccccgacgcgggctcggactccgacaggccggccctgcccaggtacggggtcacctccgtctgcggccgacggcgcgagatggaggacacggtctccatcaggccggacttcctgcccggcaccagcaagcacaacttcttcggcgtcttcgacggccacggctgctcccacgtagcgacgatgtgccaggacaacatgcacgaggttgtcgcggacgagcacacgaaggctgcctctggcgaggagacggcgtggaagggcgtgatggagaggagcttctcgcgattggatgagcaggccgccagctgggcgaccagccgcagccgcgacgagcctgcctgcaggtgcgagcagcagatgcccttgcgctgcgatcacgtggggtccaccgccgtggtcgccgtcgttagccccagccacgtagtcgtcgccaacgccggcgactcgcgcgccgtcctctcccgcggcggcgtccccgttccgctctccgtcgaccacaagcctgaccgacctgacgagctggctcgcatcgaggcggcgggtggccgcgtcatttactgggatggtgcccgtgttctcggcgtcctcgccatgtctcgagccataggggataggtacctaaagccgtttgtgtcgtcggagccggaggtaacggtgacggagcgcaccgacgacgacgagtgtctgatcctggccagcgacggcctgtgggacgtcgtgaccaacgagatggcgtgcgaggtcgtccgggcgtgcttccgtagcaacggtccgccggcgccggccgctcgcccgaacggcgtggccctcccggcagccggcgcgggcgccgaggacggatcggcggttgtcaagggtgtgggcaaggaggactccgacaaggcgtgctccgacgcggccatgctgctggcaaagctggcgctggcccggcggagcgccgacaatgttagcgtggtcgtcgtggatctccgccggggcatatgattctcggagcgaagcagagcagggcaaaatcatatgctccatgcttgaaactagctcttctgaaatccacgctaatttctcccccattttgaccatccttctattttgatgtagtattagtagtagatcctgatcagatgaatataatagacgcttttcttctctca

SEQ ID NO: 2002 - DNA, 1724 bp, Zea mays
gtactgcccccacgaagcattcgtgctcgtttcgcctcgcgcccgcgctgctgtcctgctgctgctattttgccattgcatccatttccgggggacggagtggaggaggagggcgtcgcctgcgttgcttcgcgtgggaagcgtagcgtgcttcgtttaggcctctcgccaatatccgagggttaatctagagaggcctttggctttgccagacgcgcctgtacgcgcctttctgggaggcagccgcttgctctcgcctccaatggccgagatctgctgcgaagaagccaagtccacgccggcgaccgccgtggctgcggcttcagtctccgccacggccgctgcggccgccgccgtggcagtggcctcctcggcgttagagaggaggcgacgcaggttggagatgaggaggttccgcgtcgcgggcgatcccgaggcgccggtcgcggaggacgtccgcgccgccaagcggcagaggctggcgcgcacgctgtccagcacctgccccgacgcgggctcaggctcgggctcggactccgacaggcctgccctaccggagcggttgcccaggtacggggtcacctccgtctgcggccgacgccgcgagatggaggacacggtctccgttaggccggactttgtgcccggcaccagcaaacagcacttcttcggcgtcttcgacggccacggctgctcccacgtagcaaccatgtgccagaacatgatgcacgaggtggtcgcggacgagcacaggaaggcagattgttctggcgaagagacggcgtggaaggccgtgatggagaggagcttcgcgcgactggacgagcaggccgccagctgggcgaccagccgcagccgcgacgagccctcctgcaggtgcgagcagcagaagcccttgcgttgcgatcacgtggggtccaccgccgtggtcgccgtcgtcagccccacccacgttgtcgtcgccaacgccggcgactcccgcgccgtcctatcccgcgccggcgtccccgttccgctgtccgtcgaccacaagcctgaccggcctgacgagctggcgcgcatcaaggcggcgggcggccgcgtcatttactgggacggtgctcgtgttctcggcgtcctcgccatgtctcgagccataggcgacggatacctgaagccgttcgtgtcgtcggagccggaggtaacggtgacggagcgcaccgacgacgacgagtgcctgatcctggccagcgacggcctgtgggacgtcgtgaccaacgagatggcgtgcgaggtcgtccgcgcgtgcttccacagcaacggtccgccggcgccggccgctcgggcgaacggcgcggccctccgggcagccgagaacggatccgcggccgccaagggcgtgagcgtggaggattccgacaaggcgtgctccgacgcggccatgctgctggcgaagctggcgctggcccggcggagcgccgataatgttagcgtggtcgtcgtggatctccgccgggggatatgatttgccttccttcctttttagccctcttggaatccaagctaatttctcccccgttttcttccatacttttaggttctgttttggtttagtattaatactgtagtagttaccaaccagacgcttttcttctctcaaacgaggaattaaaagccagtcggaccaaggaaatagaacatcgaattgcacacagatgcacaaggtagtggtaatcgttaatcat

SEQ ID NO: 2003 - DNA, 1681 bp, Setaria italica
gacggcgacgtgctcggcggcggggcggagaaaatctagggaggcttgggctcgcgagacgcgcgcctgtacgtggcgtacgtgcctttgttggatacagctgcttgctctagctaccaatggccgagatctgctgcgaggaagccaagtccacgccggccaccgccgtggccgcggctgccgcagcggcagccgcggcagtcgcctcctcggcgttagagaggaggcgacgcaggttggagatgaggcggttccaggcgccggtggccgacgacgtccgggccggcaagcggcagaggttggctcgcacggcgtccggttcgtgccccgaagtggtctcggagttcgagaggccggaactgccggagcggttgccgaggcacggggtcacctccgtctgcggccggcgacgcgagatggaagacgccgtctccattaggccggacttcctgcccggcgccaccaagcaccacttcttcggcgtcttcgacggccacggctgctcccacgtggcgacgttgtgccaggatcggatgcatgaggtggtcgccgacgagcacaacaacgccggctccggcgaagagacggcgtggaagggtgtgatggagaggagcttcgcgcgattggacgagcaggccgcgagctgggcgagcagccgcagcggcgacgagcccgcctgcagatgcgagcagcagatgccctcgcggtgcgatcacgtggggtccaccgccgtggtcgctgtagtcaaccccacccacgtcgtcgtcgccaacgccggggactcccgtgccgtcctctcccgcgctggcgcccccgtcccgctttccgtcgaccacaagcctgaccggcctgacgagctggcgcgcatcgaggcggcgggcggtcgcgtcatctactgggatggcgcccgtgttctcggcgtcctcgccatgtctcgagccataggcgatggttaccttaagccgttcgtgtcgtcggagccggaggtgacggtgacggagcgcaccgacgacgacgagttcctgatcctggccagcgacggcctgtgggacgtcgtggacaacgtgatggcttgcggggtcgtccgggcgtgcttccgtagcaacggtccgccggcggcgccggccgctcgggccaacggcgtggctccgcccgctggcgacgcggacgccgagaacggatccgcggtggtgaagggcgtgagcaaggtggattccgacaaggcgtgctccgacgcggctatgctgctggcgaagctggcgctggcccggcggagcgccgacaatgtcagcgtggtcgtcgtggatctccgccgggggatatgattcttggagcagagcaaaatcatacgctccatgattgcttgctttagccccttttttcttctttttttcaaatccaagctaattcttcccctcatttttaccatccgtccattttgatttagtattaagagtagttcctgaccagatgaatataatagacagcttttcttctctcaaatgaggaactaaagctagctggaacacggaaaatgctgatcttggcctagcaccatgtaccaccgaccgataagcacaactttttggtcgtagattacatgccaaacgtgttgattccatcctccgattaaactagatttaactgggcgattggtgcggaaattggcatcacacagcag

SEQ ID NO: 2004 - DNA, 1892 bp, Panicum virgatum
cacttgcgctgcctcctgctgccgccgcttctattgccattccattccgttcctggggaggaggaggaggaggagagggcgctctgcttcgcgtggaaagcttgcttcgtttaggccttacgaattgccgagggcgacagtgacgtgctcgtccaccgagcagagaaaatctagggaggcttggggcttgcgagacgcgcctgtacttagcgtacgtgcaatctgtcggagacagccacttgctctcgctgccaatggctgagatctgctgcgaggaagccaagtccacgccggctaccgccgtggccgtcgcctcctcggcgctagagaggaggcgacgcaggttggagatgaggcggttccgcatcgcgaccgatctcgacgcgccggccgaggaggacgtccgcgctggcaagcggctgcggctggcgcgcacggcgtccggctcgtccgccgacgccgtcccggattgcaagaggccggccctgccggagcggttgccgaggtacggggtcagctccgtctgcggccggcgccgcgagatggaagacgccgtctccattaggccggacttcctgccgggcgccagcaagcaccacttcttcggcgtcttcgacggccacggctgctcccacgtggccgcgttgtgccaggacaggatgcatgaggttgtcgccgacgagcaccacaacgccgggtccggtgaagtggcggcgtggaagggggtgatggagaggagcttcgcgcgattggacgagcaggccacgagctgggctagcagccgcagcggcgacgagcccgcctgcagatgcgagcagcagatgccctcgcggtgcgatcacgttgggtccaccgccgtggtcgccgtagttagccccacccacgtcgtcgtcggtaacgccggcgactcccgtgccgtcctctcacgcgctggcgcgcccgtcgagctttccgtcgaccacaagcctgaccggcctgacgagctggcgcgcatcgaggcggcgggcggtcgcgtcatctactgggatggcgcccgtgttctcggcgtcctcgccatgtctcgagccataggcgatgggtacctaaagccattcgtgtcgtcggagccggaggtgacggtgacggagcgcaccggcgaggacgagtgcctgatcctggccagcgacggcctgtgggacgtcgtgaccaacgagatggcgtgcgaggtcgtccgcgcgtgcttccgtagcaacggtccgccggcgccggccgctcggccggacggcgcggcgccgcccgcggccgacgcggacgccgagaacggatccgcggtggtcaagggcgtgagcaaggcggattccgacaaggcgtgctccgacgcggccatgctgctggcgaagctggcgctggcccggcggagcgccgacaatgtcagcgtggtcgtcgtggatctccgacgggggatatgattcttggagcagagcagaaatcatatgctccatgatttgcttgctttagaccccccccttttttttcaaaatccacaagctaatacttccccattttaaccatccttccaatttgatttagtcttaatagtagtagttcctgaccagatgaagatgaatataatagacgcttttcttctctcaaacgaggaattgaagctttagctggaacaaggaacaggaacggcgaaatgctgatctaggcctagcagcattgcagcaaccatgtactaccaatcgataagcacaaccttttggtcgtagattaacatgccagaaagtgttgattcgatcctccgataaaactagggccatgtttagttctttacatgtaaacgcatgtttagtttagttctttacatgtaaacgcaacaacgtcatgtttagttttttaaatgtaaacgc

SEQ ID NO: 2005 - DNA, 2013 bp, Saccharum officinarum
ctaccttttccccccacgccctctcgtcttccggccgccgcaggcgaaacccgctcgtcgcctcgcgctgtccaccgacgaatctcccccaggttagggggggtgggtacctgttgtttcagctgagttaatcgggggggactggttgtgggcggagatgttggtgctcttcgagacccccgcggggtttgccctgttcaaggtgctcgacgaggggaagctcgacaaggtcgaggatctatggaaggagttcacgacgtcggactcagcgagaaaggtggttgagctgaaggctttcaacaagtttgagaacacatctgatgccctatccgcggcaaccctgattattgatagcaagcctagcaagggtctgcgcaagttcttgcagaaacattgtgagggtgaaacattggcagttgctgattctaagcttggaaatgctataaaagaaaagctgaaaattgattgccttcacaatagtgctgtgatggagctgatgagagggctgagaaatcagctcactgagcttataactgggttgggtgcacaagaccttggtccaatgagcttgggattgtcccacagcttgtctaggtataagctgaagttcagtcccgagaaggttgataccatgatcattcaagccattggattattggatgatcttgacaaggagcttaacacttacgccatgagagttcgtgaatggtatggctggcactttccagaactcaccaaaatagttacagataatatacagtatgccaaagttgtgaagatgatgggcaacagagctaatgcagtcaaccttgacttttctgagatattgtcagatgaagagatagaaacacagctaaaggaggcagcagtaatatccatgggaacagaagttagtgaccttgacttgtcaaatatcagagagctatgcgatcaagtgttggccctttctgagtacagaacccagctgtatgactatttaaaaagcaggatgaacaccattgcaccaaatctgacagcactggtgggcgaattagttggtgctcgccttattgcgcatggtggaagtttgctaaatttggctaagcagcctggtagcacaattcagatacttggtgcagagaaggctttattcagagctctaaagacgaagcattctacacctaagtatggcctcatctaccatgcatccttaattgggaaggcttctcaaaagcacaagggaaaaatctctcgttctcttgctgcaaaaactgctcttgccatccgatatgatgcccttggtgatggtgaggacaactccattggcacagagagtcgactcaagcttgagacacggcttcaagttcttgagaatagagaacttgggaagtctgctggttccacaaaggggaagcccaagatagaagtgtatgagaaggaccggaagaagggtgctggggctttaacaactcctgctaagacatacaaccctgcagctgatctggtacttaccgaagaaacaccaaagaaatcagaattggcttcaaagaagaggaaacatcatgaggtggaaactgaaccatcagcagagcctgcagaggaagcaatccaggaggatgggaagaaaaagaagaaaaagaagtccaaggaaagtgaggaggctcctgctgttgaaggtgatggggagaagaaaaagaaaaagaagtccaaggaggccgaggaagagcctgctgtggccgctgcctcagaaggtgagaagaagaagaagaagaagaagtctgatgctgatggtgaggatgttgcaatgcaaaccgaagagtccggtaagaaagataagaagaaaaagaagaaaaagcatgctgatgatgagtgaggcattcaccggtagagaatgtacgggtaccataggctgggactaggctgttctgtaaaattggtatcacggggttagaaaccatattgagatcagccttttttttgggacccggcttgtattcaagtacttgctcgatcttgatgatgatggaatttaag

SEQ ID NO: 2006 - DNA, 2514 bp, Zea mays
ctttgtgctctccgatatattagtccagccccaagccctagaagagctaaaacccttgcggcggctaccttttccccagctccctctcgtctcgcggccgccgcaggcgaaaccccctcatcgcttcgcgctgtccaccgacgaatcttccccagagcgtgtgtatctgttgtttcagctgagttaatcggggactggtcgtgtgcggagatgttggtgctcttcgagacccccgcggggttcgccctattcaaggtgctcgacgaggggaagctcgacaaggtcgaggatctatggaaggagttcacgacgtcggactcagcgagaaaggtggtcgagctgaaggctttcaacaagtttgagaacacatctgatgccctatccgcggcaaccctgattattgatagcaagcctagcaagggtctgcgcaagttcttgcagaaacattgtgagggtgaaacattagcagtagctgattctaagcttggaaatgctataaaagaaaagctgaaaattgactgccttcacaatagtgctgtgatggagctgatgagaggactgagaaatcagcttaccgagcttataactgggttgggtgcacaagaccttggtccaatgagcttgggattgtcccacagcttgtctaggtataagctgaagttcagccctgagaaggttgatacaatgatcattcaagccattggattattggatgatcttgacaaggagcttaacacttatgccatgagagttcgtgaatggtatggctggcactttccagagctcaccaaaatagttacagataatatacagtatgccaaagttgtgaagatgatgggcaacagagttaatgcagtcaaccttgacttctctgagatattgtcagatgaagagctagaaacacagctaaaggaggcagcagtaatatccatgggaacagaagttagtgaccttgacttatcgaatatcagagagctatgtgatcaagtgctggccctttctgagtacagagcccagctgtatgactatttaagaagcaggatgaacactattgcaccaaatttgacagcactggtgggtgaattagttggtgctcgccttattgcacatggtggaagtttgttaaatttggccaagcagcctggtagcacaattcagatacttggtgcagagaaggctttattcagagctctaaagacaaagcattctacacctaagtatggcctcatctaccatgcatccttaattggcaaggcttctcaaaagcacaagggaaaaatctctcgttctcttgctgcaaaaacagctcttgctatccggtatgatgcccttggtgatggtgaggacaactccattggcactgagagtcgacttaagcttgagacacggcttcaagttcttgagggtagagaacttgggaaatctgctggttccacaaaggggaagcccaagatagaagtgtatgaaaaggaccggaagaagggtactggggctttaacaactcctgctaagacatataaccctgcagctgatctggtactcacggaagaaacaccaaagaagtcagaattggcttcaaagaagaggaaacataatgaggtggaaactgaaccattagcagagcctgcagaggaagcaatccaggaggatggtgaccaggaggatcggaagaagaagaagaaaaagaacaaggaaagcaaggaggctcctgctggtgaaggtgatggtgagaagaaaaagaaaaagaagtctaaggaggtcgaggaagagcctgttgtggctgctgcttcagaagttaagaagaagaaaaagaagtctgacgctgatggtgaggatgtcgcaatgcaaaccgaagaatcaggtaagaaagagaagaaaaagaagaaaaaggcgtgctgatgatgagtgagacattcacactggaagagaatttgcgggtaccaaactaccaaaggctgggactcagctgttctgtaaaatggatttgcgggtagaaacgatatcgacatcagtttttttggacccggcttgtattcaagtacttgctcgatcctggtgatgatggaatttaagttttgctgttgcaacctgatatattagtacgatgattgtcatggtaacgcggcagctgagagatcttccatgctcaatgttgacccgaacgtgctctggtaattggtagttttaatgctggaggtcatggttaaaattggcagagaaacaagtagtggctgatattttagcaaaaaatagacacgttttgattcttagtttttgttctcttgtgagtcttgagcacattcctgaaattgtactattcaggtggctctcaaaagctttcaatggagtgttttttagcctatctaaataatttgcatttaaggtttaaatgaaagttacccttaaaaacttgcaagttttctatgtacatgtaacggataaaagtggatatccgaactgtttgaataaatttaatattttaatattaatatagatgtgtatgaaatttgatga

SEQ ID NO: 2007 - DNA, 2179 bp, Zea mays
gcactagcagagctaaaacccttgcggcggctacctttccctcaccccctttctcgcctcgcggcggctacctttccccccttctcgcctctcgcctcgcggcggctacctttccccccttctcgcctctcgcctcgcggccgccgcaggcgaccccttgtcgcctcgtgctgtccaccgccgaatcttccccaggttagggagggtatctgttgtttcagctcagttttaccgggggactggttgtgggcggagatgttggtgctctttgagacccccgcgggcttcgccctattcaaggtgctcgacgagggtaagctcgacaaggtcgaggatctatggaaggagttcacgacgtcggactcagcaagaaaggtggttgagctgaaggctttcaataagtttgagaacacatctgatgctctatctgcggcaacccttattattgatagcaagcctagcaagggtctgcgcaagttcttacagaaacattgtgagggtgaaacattagcggttgctgattctaagctaggaaatgctataaaagaaaagctgaaaattgactgccttcacaatagtgctgtgatggagctgatgagagggctgagaaatcagctcactgagcttataactgggttgggtgctcaagaccttggcccaatgagcttgggattgtcccacagcctgtctaggtataagctgaagttcagtcccgagaaggttgataccatgatcattcaagccattggattattggatgatcttgacaaggagcttaacacttatgccatgagagttcgtgaatggtatggctggcactttccagagctcaccaaaatagttacagataatatacagtatgccaaagttgtgaagatgatgggaaacagaaccaatgcagtcaatcttgacttctctgagatattatcagatgaagagctagaaacacagctaaaggaggcagcagtgatatctatgggaacagaagttagtgacctcgacttgtcaaatataagagagctatgcgatcaagtgctggcactttctgagtacagagcccagctgtatgactatttaaaaagcaggatgaacactattgcaccaaatctgacagccctagtgggtgaattagttggtgctcgccttattgcacatggtggaagtttgctaaatttagccaagcagcctggtagcacaattcagatacttggtgcagagaaggctttattcagagctctaaagacaaagcattctactcctaagtatggcctcatctaccatgcatccttaattggtaaggcttctcaaaagcacaagggaaaaatctctcgttctcttgctgcaaaaactgctcttgccatccgatatgatgcgcttggcgatggtgaggacaactccattggtactgagagccgacttaagcttgagacacggcttcaagttcttgagggtagagaacttgggaaatctgctggttccacaaaggggaagcccaagatagaagtgtatgaaaaggaccggaagcagggtgctggggctttaacaactcctgctaagacatacaaccctgcagctgatctggtacttactgaagaaacaccaaagaagtcagaattggcttcaaagaagaggaaacatcatgaggttcaaactgaaccatcggcagagcttgcagagggagcagtccaggaggataggaagaagaagaaaaagaacaaggaaagcgaggaggctcctgctgctgaaggtgatggtgagaagaaaaagaaaaagaagtccaaggatgtcggggaagagcctgctgtggctgctgctgctgccacagaaggtgagaaaaagaagaagaaaaagaagtctgacgcggacggtgagggtgttacaacgcaaaccgaagagtctggtaagaaagataagaagaaaaagaagaaaaggcatgccgatgatgagtgagacattcttcggaagagaatgtgcgggtaccaaatgctgggactcagctgttctgtaaaatgggtatcacggggttagaaaacatattgagatcagtttttggggttacctggtttttttgggggacctggcttgtattcaacaattacttgctcggtctagatgatgatggaatttttaacttttgctgttgtaaccccataaatttagtatgatgattgtcatggta

SEQ ID NO: 2008 - DNA, 2048 bp, Setaria italica
cttttccccaccccgccccctctcgtctcgccggccgccgccgcaggcgaaacccctcttgtccccgccctctccaccaccgaatctccacaggttacgggaggggtatttggtttgtatcagctgagatagtcgcaggttactgattctaggaggatatgttggtgctattcgagacccccgcggggttcgccctcttcaaggtgctcgacgaggggaagctcgacaaggtcgaggatctatggaaggagttcacgacatccgactcggcgagaagggtggttgagcttaaggctttcaacaagtttgagaacacatctgacgctctgtctgctgcgaccctgattattgatggcaagcctagcaagggtctgcgcaagttcttgcagaagcactgtgagggtgaaacattagctgttgctgattccaagcttggaaatgctataaaggaaaagctgaaaattgactgccttcacaatagtgctgtgatggagctgatgagagggctgagaaatcagctcactgagcttataactgggctgggtgcacaagaacttggtccgatgagcctgggactgtcccacagcctgtctaggtataagctgaagttcagtcccgagaaggttgataccatgatcattcaggccattggcttattggatgatcttgacaaagagcttaacacttatgctatgagggttcgtgaatggtatggttggcactttcctgagctcactaaaatagtcacagataacatacagtatgcaaaagttgtgaagatgatgggcgacagagctaatgcagtcaaccttgatttctctgagatactgtcagatgaagaggtggaagcacagataaaggaggcggcagtaatatccatgggaacagaagttagcgaccttgacttgttaaatatcagagagctatgtgatcaagtgttggctctttctgagtacagagcccagctgtttgactatttaaaaagcaggatgaacactattgctcccaatctgaccgcactggtgggtgaattagttggtgctcgccttattgcgcacggtggcagtttggtaaatttagccaagcagcctggtagcacaatccagatactcggtgcagagaaggctttattcagagctctaaagacgaagcatgctacacctaagtacggcctcatctaccatgcatccttaattggcaaggcatctcaaaagcacaagggaaagatctctcgttctcttgctgcgaaaactgctcttgccatacggtgtgatgcccttggtgatggtgaggacaactccattggcactgagagtcgactcaagcttgagacacggcttcaagttctggagaacaaagaatttgggaaatctgctggttccacaaagggaaagcctaagatagaagtgtatgaaaaggaccggaagaagggagctggggctttaattactcctgctaagacatacaaccctgccactgatgtcgtactaggacaatccactgaagaaacaccaaagaagtcagaattggcttcaaagaagaggaaacatcatgaggcggaggctgcacagacaacagagcctgcagcggaagcaatccaggaggatggtgatcaggagaggaagaaaaagaagaagaaggacaaggaaaccgaggcgactccagtggctgctgctgatggtgagaagaaaaagaaaaagaagtccaaggagagcgaggagcctgctgtggctgccgccgaaggcgagaagaagaagaaaaagaagaaatctgatgtggatggtgaggatgttgtactgcaaactgcagagtctggtaagaaagacaagaagaaaaagaagaagaagcacgctgatgatgagtgaggcattcaccggagaagggagagccaaggtgcccaaggttgggacttgctgttctgtaaaatggatattacaggctagtaaccatgttgagatttagttttttttttggaaccccggttttcaagtactagctcgatctggacgatcgatgaaacttaaattttggtgccgctgtctcaaatt

SEQ ID NO: 2009 - DNA, 2021 bp, Zea mays
cgaagccgcgcgacgagaatgttacaaagccaattaactctgctggtgctcttggaaacccccgcgggtttcgcgctattcaaggtgcttgatgaggggaagctcgacaaggtcgaggatctgtggaaggagttcacgacgtcggactcagcgagaaaggtggttgagctgaaggcttttaacaagtttgagaacacatctgacgccctatctgcagcaaccctgattattgacagcaagcctagcaagggtctgcacaagttcttgcagaaacattgtcagggtgaaacattagctgtggctgattctaagcttgggaatgctataaaagaaaagctgaaaattgactgccttcataatagtgttgtgatggagctaatgagagggctgagaaatcagctcacagagcttataactgggtttggtgcacaagaccttggtccaatgagcttgggattgtcgcacagcttgtctagatataagctgaagttcagtcctgagaaggcgtgtcttatatcggttgataccatgattattcaggccattggcttattggatgatcttgataaggatcttaacacttttgccatgagagttcgtgaatggtatggctggcactttccagagctcacaaaaatagtttcagataatattcagtatgccaaagttgtgaagatgatgggtaacagagctaatgcagtcaaccttgacttctctgagatattgtctgatgaagagctagaaacacagctcaaggaggctgcagtaatatccatgggaactgaagttagtgaacttgacttgttaaatatcagagagctatgtgatcaagtgttggccctttctgagtacagagcccagttgtatgactatttaagaagcaggatgaacactatcgccccaaatctgcagcactggtgggtgaattagttggtgcccgccttattgcgcatggtggaagtttgctaaacttggccaagcaacctggtagcacaatttagatacttggtgccgagaagctttctccactaagaactaaaggttgtgtttctctatatgctttattcaaagctctaaagacaaagcattctacacccaactatgggctcatctaccatgcatccttaattggtaaggcttctcaaaaacataagggaaaaatctctcgttctcttgctgcaaaaactactcttgccatcagatatgatgcccttggtgatggtgaggacaactccattggcactgagagtctactcaagcttgagacacggcttcaagttctcgaaggtagagaacttgggaaatctgctggttccacaaaaggaaagccaaagatagaagtgtatgaaaaggacaggaagaatggtgctagggctttgacgactcctgctaagacatacaatcccgcagctgatctggtgctcggacaatccacggaagaaacaccaaagaagtccgaattggcttcaaagaagaggaaacatcatgaggccgaagctgcacccacagcagagcctgaagaggatggtggccaggaggatcggaagaagaaaaagaagtccaaggaaagcgatgagagtcctgctgctgaagctgatggtgagaagaaaaggaaaaggaagtccaaggagggcgaggagcctgctgtggctgcctcagaaggtgagaagaagaagaaaaagaacaaatctgacgcggacggtgaggatgttgcagtgcaaaccgaagcgtctggtaagaaagataagaagaaaaagaagaaaaggcattgccgatgacgagtgaggcattctctcgttatgagaaaagaacgaatcagaggatcggattggctgttctgaagaatgggtaccacaggttagaaaccatgtttagggctagtttttttttttggacccagcttgtattcaagtacttacactttctggatggttgatggattcaaattttcctgctgcgatctcaaacaaattaatatgatgaatgctcatagtaacttgtgcagatgagagacctcccat

SEQ ID NO: 2010 - DNA, 2045 bp, Brachypodium distachyon
cctcgcggcggcgcctctcttttctccctcttcccacccgccgcagccaaaacccctcctgcttcttactctccatagctcaatcggcgcaaggtgaggaggggtcgtttgttctgagtttagttgcggattggtgagagatgttggtgttgttcgagacgcccgcggggttcgccctcttcaaggtgctcgaccagggcaagcttgacaaggtcgaggatctatggaaggagttcacgacgtcggactccgcaagaaaggtggttgagttgaaggctttcaacaagtttgagaacacatctgatgccctttctgctgcaaccctcattattgatagcaagccaaccaagggtttgcgaaagttcttgcagaagcactgtgagggtgaaacattggctgttgctgattctaaacttggaaatgctataaaagagaagctgaaaattgactgcgttcacaacagtgctgtgatggagctgatgagagggctgagaaatcagcttactgagcttatatctgggttgggcacacaagaccttggtccaatgagcctgggattgtctcacagcctgtccaggtataagctgaagttcagtcctgaaaaggttgataccatgatcattcaggccattggcttattagatgatcttgacaaggagcttaacacttacgcaatgagggttcgtgaatggtatggttggcacttcccagagctcactaaaatagtgacagataatatagagtatgcaaaagttgtgaagttgatgggcaataggactaatgcggtcaacctcgatttctcagagatactgacagatgatgaggtagaagcacagttaaaggaagctgcagtaatatccatgggaacagaagttaatgatcttgacttgtcaaatattagggaactttgtgatcaagtcttgtctctttctgagtacagagcccagctttatgattatctgaggagtaggatgaacacaattgcacctaatttgaccgcactcgtgggtgaattagttggtgctcgccttatttctcatggtggcagtctgctaaatttggccaagcagcctggcagcacaattcagatactcggtgccgagaaggctttattcagagctttgaagacaaagcatgctacacctaagtatggtctcatctaccatgcatccttaattggtcaggccgctccaaagcacaaggggaagatttctcgttcgcttgcttcaaaagctgctcttgcaatccggtatgatgctcttggtgatggtgaagataactccattggtcttgagagtcgactgaagcttgaaacacggcttcgtgttctcgagggtaaagaacttgggagatctgcaggttccacaaaggggaagcccaagatagaagtgtatgaaaaagacaggaagggtgctggtgctttaattactcctgccaagacgtacaatccttcagccgatcttgttcttgcaaaatctgccgaagaaccagcaaagaagcctgagacggcttcaaagaagaggaaacatgatgaggcggagactgcaccatcaacagagcctgcaggggaagcaattcaggaggatggtgaccaggaggttcggaagaagaagaaaaagaagtccaaggacagtgaggaatctgctgcaacgaataccaatggtgagaagaaaaagaagtccaaggggggcaaagaggagcctgctggcagcgagaagaagaaaaagaagaactctgatgtacaagacagcaagattgttgcgatggaaaccgagtctggtaagaaagacaaaaagaagaagaaaaaacatactgatgagtgatgaatgagctatttgctagagaagggaagaaagccaagtaatttttggtgggcttgggttgaatcgctgttctgtaaaatggcaatttactggctattcaatgtcagttagccgtagtataggaaccttgctgcgtttaattttctcatgcagctgtattgaacaacttacactatttggacaactggtaaaattcaaacttttgttccatccatacaaaaa

SEQ ID NO: 2011 - DNA, 2044 bp, Hordeum vulgare
gatctctctaacatcatgtataaatctctccaagacatgtagctctaaaaccctcgcggcggcgcctctcttttccccatcccactcgccgcagccaagctccctcctgggctcctcctagctcgcggtctccatcgcccaatcagctcaagtccaggtgagttgagttgcggctaggttggagatgttggtgctgttcgagacgcccgctgggttcgcccttttcaaggttctgaacgagagcaagcttgacaaggtcgaggatctatggaaggagttcacgacgtcgaactcggcgagaaaggtggttgagttgaaagctttcaacaagtttgagaacacatctgatgccctttctgctgcaaccctcattattgatagcaaacctaccaagggtttgcgcaagttcttgcagaagcattgcgacggtgaaacgttagctgttgctgactctaaacttggaaatgctataaaagagaaactgaaaattgactgcgttcacaacagtgctgtgatggagctgatgagagggctgagaaatcagcttagtgagcttatatctgggttgggcacacaggaccttggtccaatgagcctgggattgtcccacagcttgtctagatataagctgaagttcagtcctgaaaaggttgataccatgatcattcaggccattggcttattggatgatcttgacaaggagcttaacacatatgcaatgagagttcgtgaatggtatggttggcacttcccagagctcactaagatagtgacagataatatacagtatgcaaaagttgtgaagttgatgggcaataggactaacgcggttaaccttgatttctcggagatactgacagatgacgaggtagaagcacagttaaaggaggctgcagtaatatccatgggaacagaagttaatgatcttgacttatcaaacattagggaactttgtgatcaagtcttggctctttctgagtatagatctcagctgtatgattatctgaaaagtaggatgaacacaattgcaccaaatttgactgcacttgtgggcgaacttgttggtgctagacttatttcacatggtggcagtcttgtaaatttggccaagcagcctggtagcaccattcagatactcggtgcagagaaggctttattcagagctctgaagacaaaacatgctacacctaagtatggtctcatctaccatgcatccttaattggtcaagcagctccaaagcacaagggaaagatttctcgttctctagcttcaaaagctgctcttgccatccggtatgatgcccttggtgatggtgaacataattcccttggtgttgagagtcgactgaagcttgaaacatggcttcgggttctcgagggtaaagaactagggagatctgctggttccacgaagggaaagcccaagatagaagtctatgaaaaagacaggaagaacggtcctgggttaattgctcctgctaagacgtataatccttcggctgatctggttcttgcgcaatccatggaagaaactccaaagaagcctgatgcagcttcaaagaagaggaaacatgatgatgctgtgactgcaccatcaaccgagcttgctgaggaagcaattcaagaggatggtgaccaggagggcaagaagaaaaagaaaaagaagtccaaggacgttgaggagtctcctgcagttgataccaagagcgacaagaaaaagaaaagaaagtccaaggggacagaggaggaggttgctcccgtggaaactgagtctggtaaaaatgataagaagaaaaagaaaaggcaggctgattgatgcttctattccccagagaagaagggaagaaaggcaagtcattttgcgtaggcttaggttcagaatttgtgttgtgtaaactggaatttcaccggcaattcgatgcttgttagctatagtatataaactttgcagggttcacgcagctgtgttgaacaactactatttggacagactatgggaatttgaattttttgcactatctatatatatacaaaaaacttgaag

SEQ ID NO: 2012 - DNA, 1727 bp, Saccharum officinarum
ccgttccaaatccgcgatattcccaagaatcttctcttcccctgcccctctcgctatatctctctcctcccattgcgctgcactgctcccacacgctcggatttctgctcgctttctccgcctccgcctcggattccatcgccgcccctttttcttccttcttccctgtcccgcccgcccgcccaggactctccttcgcgcttcttagccagccagccgtcggcgagagagagggaagggatcgttcgtgcctttcgctcgctcgggagtcgggatcgcgcagcgccaccgtaccccgcccggacatgtgcgtggaggggctggacgacgcagcagggaggctcggcttcggagaccaggagatcgacaggcgcgccggtgccgcgatggagagagtttgtgagaacacggtgtctgttgagttcaagcagactaagttgaacacctttgtcccgttcatccggtcaggggagtggtctgatattggaagtcgcgattacatggaagatgcccacgtgtgcatctctgatctggcaaagaattttggctataactcggtggatgatgaagtaatttccttctatggggtgtttgatggccataatggcaaagatgctgcccattatgtccgtgataacttgccacgggtcatcgtggaagatgctgattgtgctcttgagcttgaaaaggtaatcaagaggtcatttgtgcaaactgatagtaagtttgcagagaaatctctcatcacaagggactttcttctgaacaacagcacttacagcaatgatttttggaaggtcccttctggtggccaatgccggtgactgcagagcagtgctctcacgccgtggcattgccattgaaatgtccaaggaccacaggccttgctgcatcaatgaaaggaagcgtgtggagtcacttggtggctatgttgatgatggttatctaaacggtcaactggcagtcaccagagcacttggcgactggcatctcgagggcatgaaagagatgggcgagccaggagggcccttgagcgctgaaccagagctcaagatggtcacactgacaaaggacgacgagttcttgatcatcggcagcgacggcatctgggacttcttctcaagccagaacgctgtggactttgcgcggcggaagctccaagaccacaacgacctgaggctgtgctgcagagagattgtcgacgaggcgatacggcggggcgccagggacaacctgacggcggtgatggtctcgtttcacccggacgcccctccccagagcagagcgaacaggactagggacggcagggtcccgcggagcatatctgccgaagggcttcacagcctcagagtgctcctggaaggtcagtgaccgccggcgccattgctgccgttcattcctgatgttgtgctacgttgctgagtgtcaactgtatgtagcgatttccggtatcttggagctgttcttcttcccactgtcagtcgacatgccagggtgggtgggtgactattcttgtccttccgagaataaaccaacgagcctgagatctcactagctgattgtgagacgctggaaataatatgaatgttggagctagtttattaaggacgagttagcagtgtgcatccagggggcttttgtggctcagtatgtgatgttttcccctgattttctgtaaataaaacgatgacgggagttatcgatgtaatcgaactagtgttctatta

SEQ ID NO: 2013 - DNA, 1763 bp, Zea mays
gagagagagggaagaggggcataaaaaaaatcctttgcacgcgcgatattcccaagaatcttctcttcctctcgctatatcccccatccgcccacccccattgcgctgcactgctcccacacgctcggattcctgctcgctttctcctcccacgattccatcgccagccgccccttttcccttcctttttcccttgctcgcccgcccaggactcgtccttcgcgcttcttcgccagctcgtccttcgcgcttcgtagccagccgtcggcgagagagggtgagaggatcctacgtgccttgtacgctcgctcgggagccggccgggatcgcgccgcgccatcgtaccccgcccggacatgtgcgtggaggggctggacgacgcagcagggaggctcggcttcggagaccaggacaccgacaggcgcgccggtgatgcgatggagagagtttgtgagaacacagtggctgttgacttcaagcagactaagctgaacaactttgtgccattcatccggtcaggggaatggtctgatattggaggtcgcgattacatggaagatgcccatgtgtgcatctctgatctggcaaagaattttggctatgactcagtcgaagatgaagtaatttctttctatggggtgtttgatggccataatggcaaagatgctgctcattatgtccgtgataacttgccacgggtcatcgtggaagacgctgattttcctcttgagcttgaaaaggtggtaaagaggtcatttgtgcaaactgatagtaagtttgcagagaaattttctcatcacaggggactttcttctggaacgacagcacttacagcaatgatttttggaaggtcccttctggttgcgaatgccggtgactgcagagcggtgctctcgcggcgtggcactgccattgagatgtccaaggaccacaggccttgctgcatgaacgaaaggaagcgcgtagagtcacttggcggctacgttgacgacggttacctgaacggtcagctggcagtgaccagagcgctcggtgattggcatctggatggcatgaaagaggtgggcgagccaggagggcccctgagcgccgaaccagagctgaagatggtcacgctgaccaaggacgacgagttcctgataatcggcagcgacggcatctgggacttcttctcgagccagaacgccgtggacttcgcgcggcggaggctccaggaccacaacgacctgaggctgtgctgcagggagatggtcgacgaggcggtgcggcggggcgccagcgacaacctgacggctgtgatggtctcgttccacccggacgcccctcccccgagccgagccaacaagaggaccggcagggtcaccaggagcatttcggctgaggggcttcacagcctcagagtgctcctggaaggccagtgacgtcgccgggcggcgcggcgccattgctgcccgttcgtccctgatgctgtgctacgttgctgatgagtgttaactgtaagtagcggtttccggtatcttggtgcttgctcttcttcttccgctgagggcgggcgactattcttgtccttcctccgacaataaaccaacgggcctgagatctcactgtgagacgctgtaaataaggaaatatggaagttggagctcgtcattaaggacgagttagcggtgtgcatccagggggcttttgtggctcagtatgtgatgccttttcgcccctcctgattttctgtaaataaaacgatgctgggagccatcggtgtg

SEQ ID NO: 2014 - DNA, 1714 bp, Pennisetum glaucum
ccttccctgccccgcctcggtcggattccatcgccgggctcactcactcacctcttatccctgctcctgcctcgcctcgccctcgcctgcctgccgccgcctcttttttttcatcccgccttcgccttcccctgtccgcccgggactctctctctctctctctgttttttcttccccccgcggttcttgctcgctgcgctgcgtcgaggagagcgggcctttcgttccccgggtcgtgcggcgcgcgcccccccgacatgtgcgtggaggagggactggaggacgacgcagggaggcttggtttcggagaccgggacgtcgacaacaggcacgccgattccgcgatggacagagtttgtgagaacacagtgtctgttgatttcaagcagactaagctgaacaactttgttccatacatccgatcaggggaatggtctgatatcggaggtcgtgattacatggaagatgcccatgtgtgcatctctgatctggcaaagaattttggctataaagcagtggatgatgaagtgatttccttctatggggtctttgatggacatggtggcaaagatgctgcccattacgtccgtgataacttgccacgggtcatcgtggaagatgctgactttcctcttgagcttgaaaaggtagtcaagaggtcatttgtggaaactgatagtaagtttgcagagacattttctcagcacaagggactttcttctggaactacagcactgacagcaatgatttttggaaggtcccttctggtggctaatgctggtgactgccgagcagtcctttcccggcgtggtactgccattgaaatgtccaaggaccataggccatgctgcatcaatgaaagaaagcgtgtagaatcacttggtggctatgtggatgatggttatttgaatggtcagctggcagtcactagagcactaggtgactggcatctcgatggcatgaaagagatgggtgagcctggagggcccttgagcgctgagccagagttgaagatgatcacattgacaaaggacgacgagttcttgataataggcagtgatggcatctgggatttcttctcaaaccaaaatgctgtggattttgcacgacgaaagctccaagaccacaatgacttgaggctgtgctgcagggagatcgtcgatgaggcaataaggcggggggccagagacaacctaactgctgtgatggtttcgttccaccaggaggcccctccccagaccagagtgaacaggacaggcagggttgcacgcagcatatcagctgaagggcttcacaacctcagagtgctcctgtcaggccagtgacaaggcgcgcccattgcccgccagtcctgatgttgtgctacattgttgagtgttaactgtaagtagcgattttcggtatcttggcgctgttcagcaactgcctgtcgacatgccagagtaactattcttgtctgagaataaaccaaccaacccgagatctcactagctgattgtgagtcgctgtaaataataaaagttggagctaggtaaggacgagttagcagtgtgcatccaggggtcttttgtggctcattatgcgatgtttccccctgatcttcttctgtaaataaaaccttgctgggagtattaatgtaatcgaactaatgttctctcatgtaatgtgtgcgccccaacattgaaattttacttatcatgttcagatagaaaaa

SEQ ID NO: 2015 - DNA, 1710 bp, Panicum virgatum
acgccagcagtaatcgctcgttaatcccttccaaatccgcgatattcccaagaatcttctctccccctctcaacccgactctctttcgctcctccccattgcgctccctccctcgcactcggattcctgctcgctttctccgtctccgtctccctctcggccgtccccctctcctccgcctcggattcgaccgccgcgcccccctccttatcctgctcctgccgccgtctttttcttccttcttctcctgtccgcccgggactccctccgcagttcttgctctttgcgtcgcgtcgcgtcgcgtcgaggagagcgtgcctttcgttccggatcgcgcggcgcccccgacatgtgcgtggagggactggaggacgcagggaggctagaccaggacatcgacaagcacgccggtttcgcgatggagagagtttgtgagaacacagtgtctgttgatttcaagcagaactttgtcccattcatcctgtcaggggagtggtctgatatcggaggtcgtgattacatggaagatgcccatgtgtgcatctctgacctggcaaagaattttggctataaagcagctgatgatgaagtaatttccttctatggggtctttgacggacatggtggcaaagacgcagcccattatgtccgtgataacttaccacgaatcattgtggaagatgctgattttcctcttgagcttgaaaaggtagtcaagaggtcatttgtgcaaactgatagtaagtttgcagagacattttctcatcacaagggactttcttctggaactacagcacttacagcaatgatttttggaaggtcgcttctggtggctaatgctggtgactgccgagcggtcctttctcggcgtggcactgccattgaaatgtccaaggaccacaggccatgctgcataaatgaaagaaagcgtgtagaatcacttggtggctatgttgatgatggttatttgaacggtcagctggcagtcactagagcactaggtgactggcatcttgacggcatgaaagagatgggtgaacctggagggcccttgagtgctgagccagagctgaaaatgatcacattgacaaaggacgatgagtttttgataataggcagtgatggcatctgggacttcttctcaaaccaaaatgctgtggatttcgcacgacggaagctccaagaccacaatgacttgaggctgtgctgcagggagatcgtcgatgaagcaataaggcggggagccagcgacaacctaacagcagtgatggtttcgttccaccaggaggcccctccccagaccagagtgagcaggaccggcagggttgcacggagcatatcagctgaagggcttcacaacctcagagtgctcctggaaggccagtgacggcgccattgcggccagtcctgatgctgtgctacattgctgagtgttaattgtaagtagcgattttcggtatcttgatgctgttcagcgactgtgtgtcgacatgccagagtgactattcttgtctgagaataaaccaacgaatctgagatctcactagctgattgtgaggcgctgtaaataataaaagttggagctaggtaaggacgagttagcagtgtgcatccagggggctttcgtggctcattatgcgatgttttcccctgatcttttgtaaataaaaccttgctgggagtatcaatgcagtcgaagtaatgttctct

SEQ ID NO: 2016 - DNA, 1743 bp, Panicum virgatum
gtccgtcgttcctctctccaacctccctcccccacatacgattcttcacgccagcagtaatcgcccgttaatccccttccaaatccgcgatattcccaagaatcttctcttccgctcctcccattgcgctccctccctcacactcggattcctgctcgctttctccgtctccgtctccgtctccctctcggccgtcctcctctcctccgcctcggattcgaccgccgcgccacccctcttatcctgctcctgccgccgcctttttcttcctgcttctcctgtccgcccgggactctctctctccgcagttcttgctctttgcgtcgcgtcgaggagagcgtgcctttcgttccggatcgcgcggcgcccccgacatgtgcgtggagggactggaggacgcagggaggctagaccaggacatcgacaagcacgccggtttcgcgatggagagagtttgtgagaacacagtgtctgttgatttcaagcagaactttgtcccgttcatccggtcaggggagtggtctgatatcggaggtcgtgattacatggaagatgcccatgtctgcatctctgacatggcaaagaattttggctataaagcagcggatgatgaagtaatttccttttatggggtctttgatggacatggtggcaaagatgcagcccattatgtccgcgataacttgccacggatcattgtagaagatgctgattttcctcttgagcttgaaaaggtggtcaagaggtcatttgtggaaactgatagtaagtttgcagagacattttctcatcacaagggcctttcttctggaactacagcacttacagcgatgatttttggaaggtctcttctggtggctaatgctggtgactgccgagcggtcctttcccggcgtggcactgccattgaaatgtccaaggaccacaggccatgctgcatcaatgaaagaaagcgtgtagagtcgcttggtggctatgtcgatgatggttatttgaacggtcagctggcagtcactagggcactgggtgactggcatctcgacggcatgaaagagatgggtgaacctggagggcccttgagcgctgagccagagctgaaaatgatcacattgacgaaggacgatgagttcttgataataggcagtgatggcatctgggacttcttctcaaaccaaaatgctgtggatttcgcacgacggaagctccaacaagaccacaatgacttgaggctgtgctgcagggagatcgtcgatgaggcaataaggcggggagccagcgacaacctaacagcagtgatggtttcgttccaccaggaggcccctccccagaccagagtgaacaggaccggcagggttgcacgtagcatatcagctgaagggcttcacaacctcagagtgctcctggaaggccagtgacggcgccattgccgccagccctgatgttgtgctacattgctgagtgttaattgtaagtagtgattttcagtatcttggtgctgttcagcaactgtctgtcgacatgccagagtgactattcttgtctgagaataaaccaatgaatctgagatctcactagctgattgtgaggcgctgtgaataataaaagttggagctaggtaaggacgagttagcagtgtgcatccagggggctttcgtggctcattatgcgatgttttcccctgaccttttgtaaataaaaccttgctgggagtatcaatgtaatcgaagtaatgttctcttatgc

SEQ ID NO: 2017 - DNA, 1680 bp, Oryza sativa
catcaaaatcgccttcgcttaataatctcctcctccgtattaaactcggtttttttagatattcccaagaatctctcctctcctttccattgttgctccgctcggattccgctcttcttcttcttctccgtctccgattcggtctcctcctcctctgctccgaccaggattctgcagcggcagcggcagctgctgcggttggtttttcaggctcggtggcggcaggcagcggcatgtgcgtggaggaactcgaaggcgcagagaggctcgattttggtggggttgcggagctcgagacaacaccggcagacttcgagatggagaaagtttgtgagaacacagtatctcttgatttcaagcaggctaggtcgagcagttttgtcccagttatccgatcaggggactggtcggatattggaggtcgcgattacatggaagatgctcatgtctgcatctcagatctagctaataattttggtcataattcagtggatgatgagattatttccttttatggggtctttgatgggcatggtggaaaagatgcagctcattatgtgcgtgataacttgccacgggttatcgtggaagatgctgattttcctcttgagctagagaaagttgtcaggaggtcatttgtgcaaactgatagtcaatttgcagagaggtgctctcatcagaatgcactttcttctggaacgacagcgcttacagcaatgatttttggaaggtctcttctggttgctaatgctggtgattgccgagcagttctttcaaggcgtggtaccgcaattgaaatgtccaaggaccacaggacttgctgcctcaacgaaagaaagcgtatagaatcacttggcggctatgttgatgatggctatttgaatggtcaattagcagtcactagagcattgggtgactggcatctcgagggtctgaaagaagtgggtgagccaggtggccccttgagcgcggaaccagagctcaagatgatcacactgacgaaggaagacgagttcttgataataggaagcgacggcatctgggacttcttctcgaaccagaatgccgtggatttcaccaggaagaggctccaagagcacaatgacttgaggttgtgctgcaagcagatcgtcgaggaggcaataaggcgaggggcctcagacaacctaacggcggtgatggtctcattccaccaggaggcccctcctcagctcagagtgaacaggacggggagggtcgagcggagcatatcggctgaagggcttcacagcctcagggtgctcctggaaggccaatgatagctccactgctatcatcagccttgaagttgtgcagaattgaagagaaaccttatcttgatgttgtgcagaattgaagagcaactgtatttagtgattttcggcatcttgctgtttacccccaatccattgtcgacattccagtgtgtgttattgtgtgagaataaaaccaacgaacctgagatctcaccttgcattgtgaggcccaggcattgtaaataagttgggagatagtaggtaaggagtgtgagtagtgtgcatccagggggctttgaggctcattatgcgatgtattcccctgtcatctgtaaaaaaataaataccgggattgttagtgtgattaaaagttctatcgtgtgatgaatacctctctgactgttca

SEQ ID NO: 2018 - DNA, 1952 bp, Zea mays
ataatacccccccgtctcccttgtgttcttttcgttcgttcccctcgccctcctccctccctccccgtcgattctttcacaacaccaccaggcaccagcggaccagcagcaagcaatcgcgcttaatcactcgcccccgttacaaatccgagatattcccaaatatcttctcttgccctcccccaccgcctccgcctcggattccatcgccgcccttttccttccttctccccttgcccgcccgcccgcccgtccaggactgtccttggcgtttcttacgcagctcgtccttcgcgcttctttgccggccgttagagagaaagagagagagtgagacaggatcactcggtagtcgggatcgcgcggcgccaccgtaccccgcccgggacatgtgcgtggaggggctagacgacgcagcagggacgctcgccttcggagaccacgagaacgacaggcgcgacggtgccgcgatggagagggtttgtgagaacaacttcgtcccgttcatccggtcaggggagtggtctgatattggaggtcgcgattacatggaagatgcccatgtgtgcatctctgatctggcgaagaattttggttctaactcagtggatgatgaagtcatctccttctacggggtgttcgatggccataacggcaaagacgcagcccattatgtccgtgataacttgccacgggtcattgtagaagatgctgattttcctcttgagcttgaaaaggtagtgaagaggtcatttgtgcagactgatagtaagtttgcagagaaattctctcatcacaagggactctgttctggaacgacggcacttacagcaatgatttttggaaggtcccttctggtggccaatgccggtgactgcagagcggtgctatcgcggcgtggcaccgccattgaaatgtccaaggaccacaggccctgctgcatgaacgagagaaagcgcgtggagtcactgggtggctacgtggacgacggctacctaaacggccagctggccgtcaccagagcgctgggcgactggcacctggaggtcatgaaagggacgggccgggcaggagggggaggggcagggggagggcccctgagcgcggagccggagctgaagatggtcacgctgagcaaggacgacgagttcctgatcatcggcagcgacggcgtgtgggactccttctcgagccagaacgccgtgtgacttggcgcggcggcgcctccaggaccacaacgacccgcggctgtgctgcagggaggtcgtggacgaggcgctgcggcggggcgccagggacaacctgacggcggtgctggtcgcgttccaccgggacgcgcctcccagggcccaggggggccgagcgagcaggagtacgggcagcagggtcgcgccgagcatatcggccgaggggcttcacagcctccgagtgctcctggacgaaggccagtgaggcagtgagtgactgcgcggcgccattgccacgttgctgagtgagtgctgactgtaaagtagcggatttggacacagtgaggcccgtggggctgcgcggcgccagtgaggcccgtggaaaccaccagcagccaggtcagcagcatccagtgctcaaaagaatttggacacagtgaacctggatggacccatccatgcaagccaagcgaacggacaagatctggtcggttgatttcacgtcgtaccatccgatctgccataaggacatgtacagtggtgtttaatgtagagtctcttaaggtgtttaagagggttatttgcaaaaaaaaaattttagaaccgtctctccgtgaagagacgcttctggctcgtaaaccaagtagcaacagacgcctcacttcccactgtacgaatttgtcgtctgttctatcgatctgatgctatacaaatacatttaattctgtatttattaatagactatgtttatagacactccattgt

SEQ ID NO: 2019 - DNA, 1758 bp, Triticum aestivum
aagaaaccagcagcaaatcccacatccgcctccgccttcccttccttttcctacccccgatcgaaacagagagctagcttagagagatattcccgcgaatcttctgctccgattccaagcccgtcccggtctcggtcgcgtcccactcccccttcaatccttcaatccttcttcaccggaacctgcggcggcagttcgagtccaatcgtgaggcagagtaacagggcgaacgcgggagccagagcgagaggtcgggaagaagaagaactcaccggcggcggcgaaccggacatgtgcgtggagggattcgaggacgcgcagatcgagaggccggcagatttcgcgatggagagagtctgtgaaaacacagtgtccattgatttcaagcaaaccaagatggtggctgggattggagagagctggcacaattttgtcccagctatccgatcaggggactggtctgacattggtggccgtgattacatggaagatgcgcatgtctgcatccccaacctagccaagaactttgggtacaacatggtggatgatgaagttatttccttctatggggtgtttgatggacatggtggaaaagatgccgcgcagtatgttcgcgacaacttgccgcgggtcatcgtggaagatgctgcttttcctcttgagcttgagaaggcagtcaggaggtcgtttgtgcaaactgacagtcagtttgcagagaagtgctctgtccaggatgggctttcttctggaacaactgcacttacagcaatgatttttgggaggtctcttctggtcgcaaatgctggcgattgccgagctgtcctttcccggcgcggcgccgcaatcgaaatgtccaaggaccacagggcctgctgcctgaatgaaagaaagagagttgaatccctaggcggctacgtcgacgacggctatctgaatggccagctagcggtcaccagagcgctcggcgactggcatctcgatggcctcaaggagatgggcgagcccggaggcccgctgagcgccgagccggagctcaagatgatcacgctgaccaaggacgacgagttcctcatcatcggcagcgacggcatctgggactacttctccaaccagaactcggtggactttgcgcggcggaggctccaggaccacaacgacctccggcggtgctgcaaggagatcgtggaggaggcgatccggcggggcgccaccgacaacctgacggcggtcatggtctcgttccaccaggaggcccctccccagatcagggtgaacaggacgggcagggtcgagcggagcatctcggccgaggggctccatagcctcagggtgctcctggaaggccagtgatctcggcggcgcgccattgtcgccgccttcttcttctgcattgttgagtgtcaactgtaagtaccgatccgccgtcgtcgtcgacatgccagtttgtggctctattgttacctgggaataaaaccaacgaacctgaagaagatctcacccgccattgtgaatcgtgaggcacctgtaaatataagttgggagcttaattagggtggtaagggagtcagtagcgtgcatccagggggctttgaggctcattatgagatgatgagatgtgttgttccccctgtttaagttttgtctgtaaaagaaaccattctctggttattgctattgtatcagtgtaccttgagttgtctcatgtgatgaaccaccaccttgttgatcactgataagatgagatgtgttcttcccccc

SEQ ID NO: 2020 - DNA, 1764 bp, Triticum aestivum
  misc_feature (672)..(672): n is a, c, g, or t
agaagagagaagagaaagaaaccagcagcaaatcccacatccgcctccgccttcccttccttttcctgcccccgatcgaaacagagagctagctagagatattcccgcgaatcttctgctccgattccaagcccgtcccggtctcggtcgcgccccactcctccttcaatccttcttcaccggaacctgcggcggcagttcgagtcgaatcgctcctcctccttcgtcgtcgtcttggcgaggcagagcaacagaggccgggaggaagaagaagtcgtcggcggcggcgaaccggacatgtgcgtggagggattcgaggacgcgcagatcgagaggccggcggatttcgcgatggagagagtctgtgaaaacacagtgtccattgatttcaagcaagccaagatggtggctgggattgaagagagctggcacaattttgtcccagctatccgatcaggggattggtctgacattggtggccgtgattacatggaagatgcgcatgtctgcatccccaacctagccaagaactttgggtacaacatggtggatgatgaagttatttccttctatggggtgtttgatggacatggtggaaaagatgccgcacagtatgttcgcgacaacttgccacgggtcatcgtggaagatgctgcttttcctcttgagctngagaaggcagtcaggaggtcgtttgtgcaaactgacagtcagtttgcagagaagtgctctgtccaggatgggctttcttctggaacaactgcacttacagcaatgatttttgggaggtctcttctggtcgcaaatgctggcgattgccgagctgtcctttcccggcgcggcgccgcaatcgaaatgtccaaggaccacagggcctgctgcctgaatgaaagaaagagagttgaatccctaggcggctacgtcgacgacggctatctgaatggccagctagcggtcaccagagcgctcggcgactggcatctcgatggcctcaaggagatgggcgagcccggaggcccgctgagcgccgagccggagctcaagatgatcacgctgaccaaggacgacgagttcctcatcatcggcagcgacggcatctgggactacttctccaaccagaactcggtggactttgcgcggcggaggctccaggaccacaacgacctccggcggtgctgcaaggagatcgtggaggaggcgatccggcggggcgccaccgacaacctgacggcggtcatggtctcgttccaccaggaggcccctccccagatcagggtgaacaggacgggcagggtcgagcggagcatctcggccgaggggctccatagcctcagggtgctcctggaaggccagtgatctcggcggcgcgccattgtcgccgccttcttcttctgcattgttgagtgtcaactgtaagtaccgatccgccgtcgtcgtcgacatgccagtttgtggctctattgttacctgggaataaaaccaacgaacctgaagaagatctcacccgccattgtgaatcgtgaggcacctgtaaatataagttgggagcttaattagggtggtaagggagtcagtagcgtgcatccagggggctttgaggctcattatgagatgatgagatgtgttgttccccctgtttaagttttgtctgtaaaagaaaccattctctggttattgctattgtatcagtgtaccttgagttgtctcatgtgatgaaccaccaccttgttgatcactgataagatgagatgtgttcttcccccc

SEQ ID NO: 2021 - DNA, 1704 bp, Triticum aestivum
gaaaccagcagcaaatcccacatccgcctccgccttcccttccttttcctgcccccgatcgaaacagagagctagctagagatattcccgcgaatcttctgctccgattccaagcccgtcccggtctcggtcgcgccccactcctccttcaatccttcttcaccggaacctgcggcggcagttcgagtcgaatcgctcctcctccttcgtcgtcgtcttggcgaggcagagcaacagaggccgggaggaagaagaagtcgtcggcggcggcgaaccggacatgtgcgtggagggattcgaggacgcgcagatcgagaggccggcggatttcgcgatggagagagtctgtgaaaacacagtgtccattgatttcaagcaagccaagatggtggctgggattgaagagagctggcacaattttgtcccagctatccgatcaggggattggtctgacattggtggccgtgattacatggaagatgcgcatgtctgcatccccaacctagccaagaactttgggtacaacatggtggatgatgaagttatttccttctatggggtgtttgatggacatggtggaaaagatgccgcacagtatgttcgcgacaacttgccacgggtcatcgtggaagatgctgcttttcctcttgagctcgagaaggcagtcaggaggtcgtttgtgcaaactgacagtcagtttgcagagaagtgctctctacaggatgggctttcttctggaacaactgcacttacagcaatgatttttgggaggtctcttctggtcgcaaatgctggtgattgccgagcggtcctctcccggcgcggcgccgcaatcgaaatgtccaaggaccacaggacctgctgcctgaatgaaagaaagcgggtcgaatccctaggcggctacgtcgacgacggctatctgaacggccagctagcggtcaccagagcgctgggtgactggcacctcgacggcctgaaggagataggcgagccgggaggcccgctgagcgcagaaccggagctcaagatgatcacgctgaccaaggacgatgagttcctcatcatcggcagcgacggcatctgggactacttctccaaccagaactcggtggactttgcgcggcggaggctccaggagcacaacgacctccggcggtgctgcaaggagatcgtggaggaggcgatccggcggggcgccactgacaacctgacggcggtcatggtctccttccaccaggaggcccctccccagatcagggtgaacagggcgggcagggtcgagcggagcatctcggccgaggggctccatagcctcagggtgctcctggaaggccagtgatcgatctccgacggcgcgccattgtcgccgccttcttcctctgcattgttgagtgtcaactgtaagtaccgatccgccgtcgtcgacatgccagttgtggctccattgttacctgggaataaaaccaacgaacctgaagaagatctcacccgccattgtgaattgtttgtgaggcacctgtaaatataagttgggagcttaattagggtggtataaaagggagtcagtagcgtgcatccagggggctttgaggctcattatgagatgatgagatgtgttgttccccctgtttaagttttgtctgtcaaagaaaccattctctggttattgctattgtatcagtgtaacttgagttgtctcatgtg

SEQ ID NO: 2022 - DNA, 1775 bp, Pseudoroegneria spicata
  misc_feature (560)..(560): n is a, c, g, or t
  misc_feature (582)..(582): n is a, c, g, or t
  misc_feature (981)..(981): n is a, c, g, or t
  misc_feature (1150)..(1150): n is a, c, g, or t
  misc_feature (1395)..(1395): n is a, c, g, or t
  misc_feature (1424)..(1424): n is a, c, g, or t
aaaccagcagcaaatcccacaccacccccctcctccgccttcctttcctttttcctgccccgcccgatcgaacagagctagatagatattcccgcgaatcttctgctccgattccaagccgtcccggtctcggtcgcatcccactccccctccctccgccttcaatccttcttcgtcggaaccagagggctcccgctgccgcagttcgagtcgaatcgctccttcgtcgtcgtcaggcagagcaacagagagagccagagagcgcgggacgggagacagggccagaggaactcgtcggcggcgaaccggacatgtgcgtggagggattcgaggacgcgcagatcgagaggccggcagatttcgcgatggagagggtttgtgagaacacagtgtccattgatttcaagcaagctaagatggtggctgggattggagagagttggcacaatttcgtcccagctatccgatcaggtgattggtctgacatcggtggccgtgattacatggaggatacacatgtgtgcatccccaacctagccaagaattttggttataacacngtggatgatgaagttatttccntctatggggtatttgatggacatggtggaaaagatgctgcacagtatgttcgcgacaacttgccgcgggtcatcgtggaagatgctgcttttcctcttgagcttgagaaggcagtcaggagatcgtttgttcaaactgacagtcagtttgcagagaagtgctctctccaggatgggctttcttctggaacaactgcacttacagcaatgatttttggaaggactcttctggtcgcaaatgctggagattgccgagcggtcctctcccggcgtggcgccgcaatcgaaatgtccaaggaccacaggacctgctgcctgaatgaaagaaagcgggtggagtctctaggtggctatgtcgatgatggctatctgaatggccagctagcggtcaccagagcgntcggtgactggcatctcgacggcctgaaggagatgggcgagccgggaggcccgctgagcgccgagccggagctcaagatgatcacgctgaccaaggacgacgagttcctcatcatcggcagcgacggcatctgggacttcttctccaaccagaactcggtggactttgngcggcggaggctccaggagcacaacgacctgaggcggtgctgcaaggagatcgtcgaggaggcgatcaggcggggcgccagcgacaacctgacggcggtgatggtctcgttccaccaggaggcccctccccagatcagggtgaacaggacgggcagggtcgagcggagcatctcggccgaggggctccatagcctcagggtgctcctggaaggccagtgatctcggcagcgcgccattctcgccnccttcttctgcattgttgagtgtcaattntaagtaccgattgcggcatcctgctgctgctgctgatgtttgtctgtccgtcatccatcgtcgtcgacatgccagtggtggctccattgttacctgggaataaagccaacgaacctgaagatctcacccgccattgtgaattgtgaggcacctgtaaatataagttgggagcttagggtaagagagtcagtagtgtgcatccagggggctttgaggctcattatgagatgatgagatgttttcttccccctgtttatagtttttgtctgtaaaagaaaccattctctggtttattattattatatcagtgtaactagagttgtctctggtcatgaaccacccaaaaaaaaa

SEQ ID NO: 2023 - DNA, 1718 bp, Hordeum vulgare
ccggaaacagagcacaacgcaaagaaaaccagcagcgaatcccacacatcctccgcctgccatctccaacccccgatcaggttggtattccggcgaaccctccactcggactccaaccagccccggtctcggccgcgtcccactccccccctgcaacccctcttcgtcggagccagaggtccccttcggcggcagttcgagccgaatcgctccttcttcctcgtcgtcaggcacagcaacagagagacagagctcaccggcggcggcggcggcgaaccggacatgtgcgtggagggattcgaggacgcgcagatcgagaggccggcagatttcgtgatggagagagtttgtgagaacacagtgtccattgatttcaagcaaactacaatggtaactgtgattggagagagttggcacaattttgtcccaactatccggtcaggggactggtctgacattggtggccgtgactacatggaagatgcgcatgtgtgcatccccaacctagccaagaattttggttttaacatggtggatgatgaagttatttccttttatggggtctttgatggccatggtggaaaagatgctgcccagtatgttcgcgataatttgccacgggtcatcgtggaagatgctgcttttcctcttgagcttgagaaggcagtcaggaggtcgtttgtgcaaactgatagtcagtttgcagagaagtgctctctacatgatggactttcttctggaacaaccgcacttacagcaatgatttttggaaggtctcttctggttgcaaatgctggtgattgccgagcggtcctttcccggcgcggcgccgcaatcgaaatgtccaaggaccacagggcctgctgcctgaatgaaagaaagcgggtcgaatccctaggcggctacgtcgacgacggctatctgaacggccagttagcggtcaccagagcgctcggtgactggcatctcgacgggctcaaggagatgggcgagccgggaggcccgctgagcgctgagccggagctcaagatgatcacgctgaccaaggacgacgagttcctcatcatcggcagcgacggcatctgggacttcttctccaaccagaactcggtggactttgcgcggcggaggctccaggagcacaacgacctgaggcggtgctgcaaggagatcgtggaggaggcgatcaggcggggcgccaccgacaacctgacggcggtgatggtcgccttccaccaggaggcccctccccagatcagggtgagcaggatgggcagggtggagcggagcatctcggccgaggggctccatagcctcagggtgctcctggaaggccagtgatcttcggcggcgcgccattgtcgccgccttgttctacattgttgagcgtcaactgtaagtaccgattgcggcctccctgctgctgctcatgtttgtccgttcgttcatcatccatcgtcgtcgtcgacatgccagtggtggctctattgttacctgggaagaataaaaccaacgaacctgaagaaggtctcacccgccattgtgaattgtgaggcacctgtaaatataagttgggagcttagggttggtaacagagtcagtagcgtgcatccagggggctttgaggctcattatgagatgagatgagatgtttttcttcccccctgtttctattttgtctgtaaaagaaacaatcctgtctgatgatcattattata

SEQ ID NO: 2024 - DNA, 1713 bp, Hordeum vulgare
agagcacaacgcaaagaaaaccagcagcgaatcccacacatcctccgcctgccatctccaacccccgatcaggttggtattccggcgaaccctccactcggactccaacccgccccggtctcggccgcgtcccactccccccctgcaacccctcttcgtcggagccagaggtccccttcggcggcagttcgagccgaatcgctccttcttcctcgtcgtcaggcacagcaacagagagacagagctcaccggcggcggcggcggcgaaccggacatgtgcgtggagggattcgaggacgcgcagatcgagaggccggcagatttcgtgatggagagagtttgtgagaacacagtgtccattgatttcaagcaaactacaatggtgactgtgattggagagagttggcacaattttgtcccaactatccggtcaggggactggtctgacattggtggccgtgactacatggaagatgcgcatgtgtgcatccccaacctagccaagaattttggttttaacatggtggatgatgaagttatttccttttatggggtctttgatggccatggtggaaaagatgctgcacagtatgttcgcgataatttgccacgggtcatcgtggaagatgctgcttttcctcttgagcttgagaaggcagtcaggaggtcgtttgtgcaaactgatagtcagtttgcagagaagtgctctctacatgatggactttcttctggaacaaccgcacttacagcaatgatttttggaaggtctcttctggttgcaaatgctggtgattgccgagcggtcctttcccggcgcggcgccgcaatcgaaatgtccaaggaccacagggcctgctgcctgaatgaaagaaagcgggtcgaatccctaggcggctacgtcgacgacggctatctgaacggccagttagcggtcaccagagcgctcggtgactggcatctcgacgggctcaaggagatgggcgagccgggaggcccgctgagcgctgagccggagctcaagatgatcacgctgaccaaggacgacgagttcctcatcatcggcagcgacggcatctgggacttcttctccaaccagaactcggtggactttgcacggcggaggctccaggagcacaacgacctgaggcggtgctgcaaggagatcgtggaggaggcgatcaggcggggcgccaccgacaacctgacggcggtgatggtcgccttccaccaggaggcccctccccagatcagggtgagcaggatgggcagggtggagcggagcatctcggccgaggggctccatagcctcagggtgctcctggaaggccagtgatcttcggcggcgcgccattgtcgccgccttgttctacattgttgagcgtcaactgtaagtaccgattgcggcctccctgctgctgctcatgtttgtccgttcgttcatcatccatcgtcgtcgtcgacatgccagtggtggctctattgttacctgggaagaataaaaccaacgaacctgaagaaggtctcacccgccattgtgaattgtgaggcacctgtaaatataagttgggagcttagggttggtaacagagtcagtagcgtgcatccagggggctttgaggctcattatgagatgagatgagatgtttttcttcccccctgtttctattttgtctgtaaaagaaacaatcctgtctgatgatcattattatagca

SEQ ID NO: 2025 - DNA, 1735 bp, Brachypodium distachyon
agtcctccgtttcataacataatcggaaactctcacacacagaacagagaaggcagcaaatccaatccctccccagttcccatctccgctgatcactgcctccgcatcaaagctttcctagatattcccgggaatcttccgctcccgcttccggctcggataccccctgctcgcttccgcctcggcctcggtcgcctctttcctccttgttattagaaagaggactcagcagctgcagttcgaatcgatttgcatcggatagaagccaggactctgcagcgggagagagagggagaggagaactcgtctgccgtttgagaactggacatgtgcgtggagggattcgaagacgccgagaggttggattttggagcagcggagatcgagaggccggccgatttcctgatggagagagtttgtgagaacatggtgtctcttgatttcaagcaaactaagatggtgtctggcactggagagagttggcacaattttgtcccagccatccgatcaggcgagtggtctgacattggtggccgtgattacatggaagatgcacatgtgtgcatatcaaacctagtgaagaattttggttgtaacaaggctgatgatgagattatttccttctatggggtctttgatggacatggtggaaaagacgctgctcactatgttcgtgataacttaccacggatcatcgtggaagacgccgactttcctcttgagcttgagaaggttgttaggaggtcatttgtgcaaactgatagtcagtttgcagagaagtgctctcgccatgatgcactttcttctggaacaactgcacttacagcaatgatttttggaaggtctcttctggttgctaatgctggtgattgtcgagcagtcctttcccggcgtggtgcggcaattgaaatgtccaaggaccacaggacttgctgcctcaatgaaagaaagcgtgtagaatcactaggcggctatgtcgatgatggctatttgaatggtcagttagcagtcacgagagcacttggtgactggcatctcgatggcctgaaagagatgggggagccaggaggcccattgagtgctgaaccagagctgaagatgatcacattaacaaaggaggacgagttcttgcttattgggagtgatggtatctgggactacttctcaaaccaaaactctgtagacttcgcaaggagaagactccaagagcacaatgacctgagattatgctgcaaggagatcatcgaggaagcaataagacgaggggccacggacaacctaacagcagtgatggtctctttccaccaggaagcccctcctcagataagagtaaacaggacaggtcgggttgagcggaccatatcagctgaagggctccacagcctcagggtcctcctggaaggtaaatgatagcggtgtgccattgtcgccgccatccttattctgtgctacattgttgagtgttaattgtatgtagaaattccggcgttgtactgctgtctatccatcatccattgttgaaatgtcagtggctattgttacctgagaataaaccagctgtgagggactgtagataagttgggtgcctggttaagggtttagcgtatctgcatccagggggctttgaggctcattgtgcgatgttttcttccccctattttatttttgggtgttaaagaaactattttgtggtcgttcaagtcaatgaaacttgagttttatcatgtgatgacca

SEQ ID NO: 2026 - DNA, 1854 bp, Triticum aestivum
gagagagagagagagaaaccagcagcgaatcccacacaggatccgccttcccttccttttcctacccccgatcgaaacagagagctagctagagagatagatattcccgcgaatcttctgctccgattccaagcccgtcccggtctcggtcccgtcccacgccccctccctccgccttcaatccttcttcatcggtaccagagcacccctgcggcggcggcagttcgagtcgaatcgctcctcctccttcgtcttcgtcaggcatgtgcgtggagggattcgaggacgcgcagatcgagaggccggcagatttcgcgatggagagagtctgtgagaacacagtgtccattgatttcaagcaagccaagatggtgactgcgatgggagaaagttggcacaattttgttccagctatccgctcaggggattggtctgacattggtggccgtgattacatggaagatgcgcatgtgtgcatccccaacctagccaagaattttggttacaacatggtggatgatgaagttatttccttctatggggtatttgatggacatggtggaaaagatgccgcacagtatgttcgcgacaacttgccgcgggtcatcgtggaagatgctgcttttcctcttgagcttgagaaggcagtcaggaggtcgtttatgcaaactgacagtcagtttgcagagaagtgctctctccaggatgggctttcttctggaacaactgcacttacagcaatgatttttggaaggactcttctggtcgcaaatgctggtgattgccgggcagtcctttcccggcgcggcgccacaatcgaaatgtccaaggaccacagaacctgctgcctgaacgaaagaaagcgtgtggaatctctaggcggctacgtcgacgacggctatctgaacggccagctagcggtgaccagagcgctcggggactggcacctcgacggcctcaaggagatgggcaagccgggaggcccgctgagcgccgagccggagctcaagatgatcacgctgaccaaggacgacgagttcctcatcatcggcagcgacggcatctgggactacttctccaaccagaactcggtggactttgcgcggcggaggctccaggagcacaacgacctccggcggtgctgcaaggagatcgtggaggaggcgatcaggcggggcgccaccgacaacctgacggcggtcatggtctcgttccaccaggaggcccctccccagatcagggtgaacagggcgggcagggtcgagcggagcatctcggccgaggggctccatagcctcagggtgctcctggaaggccagtgatctccgacgacggcgcgccattgtcgccttcttcttcttctgcattgctgagtgtcaactgtaagtaccgatccaccgtcgtcgtcgacatgccagttgtggctccattgttaccttggaggaataaaaccaacgaacctggagatctcacccgccattgtgaattgtgaggcacctgtaaatatatgttgggagcttaattagggtggtaagggagtcagtagcgtgcatccagggggctttgaggctcattatgagatgagatgagatatgttgttcccctgtttaagttttgtctgtaaaagaaaccattctctggttattgtgttattgtatcagtgtaacttgagttgtctcatgtgatgagccatcgcctcgttgatcactgatatgatgagatgtgttcttccccccgtttaagtcttgttgtatttgatcatttgtttaattgccatgtttaagtcttgttatatctatcatcctctacttggaatacaccaagaaactatttccgcctcaaaataagtggtgc

SEQ ID NO: 2027 - DNA, 1881 bp, Triticum aestivum
gaattcggcacgaggccggaatcagagcagagagagagagagaaaccagcagcgaatcccacacaggatccgccttcccttccttttcctacccccgatcgaaacagagagctagctagagagatagatattcccgcgaatcttctgctccgattccaagcccgtcccggtctcggtcccgtcccacgccccctccctccgccttcaatccttcttcatcggtaccagagcacccctgcggcggcggcagttcgagtcgaatcgctcctcctccttcgtcttcgtcaggcatgtgcgtggagggattcgaggacgcgcagatcgagaggccggcagatttcgcgatggagagagtctgtgagaacacagtgtccattgatttcaagcaagccaagatggtgactgcgatgggagaaagttggcacaattttgttccagctatccgctcaggggattggtctgacattggtggccgtgattacatggaagatgcgcatgtgtgcatccccaacctagccaagaattttggttacaacatggtggatgatgaagttatttccttctatggggtatttgatggacatggtggaaaagatgccgcacagtatgttcgcgacaacttgccgcgggtcatcgtggaagatgctgcttttcctcttgagcttgagaaggcagtcaggaggtcgtttatgcaaactgacagtcagtttgcagagaagtgctctctccaggatgggctttcttctggaacaactgcacttacagcaatgatttttggaaggactcttctggtcgcaaatgctggtgattgccgggcagtcctttcccggcgcggcgccacaatcgaaatgtccaaggaccacagaacctgctgcctgaacgaaagaaagcgtgtggaatctctaggcggctacgtcgacgacggctatctgaacggccagctagcggtgaccagagcgctcggggactggcacctcgacggcctcaaggagatgggcaagccgggaggcccgctgagcgccgagccggagctcaagatgatcacgctgaccaaggacgacgagttcctcatcatcggcagcgacggcatctgggactacttctccaaccagaactcggtggactttgcgcggcggaggctccaggagcacaacgacctccggcggtgctgcaaggagatcgtggaggaggcgatcaggcggggcgccaccgacaacctgacggcggtcatggtctcgttccaccaggaggcccctccccagatcagggtgaacagggcgggcagggtcgagcggagcatctcggccgaggggctccatagcctcagggtgctcctggaaggccagtgatctccgacgacggcgcgccattgtcgccttcttcttcttctgcattgctgagtgtcaactgtaagtaccgatccaccgtcgtcgtcgacatgccagttgtggctccattgttaccttggaggaataaaaccaacgaacctggagatctcacccgccattgtgaattgtgaggcacctgtaaatatatgttgggagcttaattagggtggtaagggagtcagtagcgtgcatccagggggctttgaggctcattatgagatgagatgagatatgttgttcccctgtttaagttttgtctgtaaaagaaaccattctctggttattgtgttattgtatcagtgtaacttgagttgtctcatgtgatgagccatcgcctcgttgatcactgatatgatgagatgtgttcttccccccgtttaagtcttgttgtatttgatcatttgtttaattgccatgtttaagtcttgttatatctatcatcctctacttggaatacaccaagaaactatttccgcctcaaaataagtggtgc

SEQ ID NO: 2028 - DNA, 722 bp, Saccharum officinarum
atcccagctaaagcaaaaccaccccgatcgagctgatcaccatttcgttccacgacacaaagaaagcaccaagaagaatcctctccatcgacgacgaaggcgaaggcgatgaggccgctgccgcagaccgtccacctcctccccgtcgccttcgtgctcgcgctcatcggctgcctcgtgggcggcgccagcgcgacggtggtgacgacgtgcagggcggcggcggacagcgacgcgcgcgtggactacggcttctgcgtggccgagctgggcatgcaccgcgagagccccgacgccgacacctggggcctcgccaaggtggccgcgctgacgggcgtcaacaacgccgacaacgccgtgtacgacatcaaggccctgctcgccatgaggcctggtggcgcggatggcccgacgcgcgcggcgctggagaagtgcgggaagctgtacgactccgtcgggttcgcgttcgccgaggcggacgacgagatcaacaaccgccgctacgccgccgggaagggcaaggtcgcggaggcggtgtccctcgcgcgccagtgcgacgacgccctcgccaaggccgccgccgttccgtcgccgctggcgcaacacaactcgtacaacgtgcggatcgctaatatctgaccggcatcaccaacctcatcaagtgaatgaatactggatatatagaatggtataggaccggataaataataacgtggtcgatc

SEQ ID NO: 2029 - DNA, 868 bp, Zea mays
ggcgtcatcaaacgtgactgcccacacttcagtcttgtccggttgtcccatcacagctaaagcaaaaccaccacccatcgagctgatcctgatcatcactcttttcccgacacaaagagggcaccaagaatcccctccatcgacgacgaaggcgatggcgccgctgccgcaggccgtccacctcctcctcgccttcgccctcgcgcttggctgcctggcgggcggcgccaccgcgacggtggtgacgacgtgcagggcggcggcggacagcgacgcgcgcgtggactacgcgttctgcgtcgccgagctgggcatgcaccgcgagagccccgacgccgacacctggggcctcgccaaggtggccgcgctgacgggcgtcaacaacgccgacaacgccgtgtacgacatcaaggccctgctcgccaacaagaggcccgacggcccgacgcgcgcggcgctggagaagtgcgggaggctgtacggctccgtcgggttcgcgttcgccgaggcggacgacgagatcaacaaccgccgctacgccgccgggaaggccaaggtcgcggaggcggtgtccctcgcgcgccagtgcgacgacgccctcgccgtggccgccgccgtcccgtcgccgctggcgcagcacagctcctacaacgtgcggatcgctgatatctgcatcgccatcactaacctcatcaagtgaatactatatatggtactgtacatttacggaaacacatgagtaccaataccatggtgtgcgtccagtacgtggtcgatcgagttgacaggtgtgacacgacacgacttcaaagtttgtacctttagaaaactttgtatacaaataataataaaggagttctgttattct

SEQ ID NO: 2030 - DNA, 1032 bp, Zea mays
actcccttaagaacagctcgacgctcacctgtctagtctagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcgacgggcccggcgccggcgcgcgcctcatcggcgtggagtacatcgtctccgagacggtgttcctgacgctgcccgacgccgagaagccgctgtggcacacgcacgagttcgaggtgaagggcggggtgctgttcatgccgggggtgcccggcgtggtggagcgccgggacctggagaaggtgtgcaagacctacggcaagaccatccacttctggcaggtggaccgcggcgacgcgctcccgctcggcctcccgcagatcatgatggtgctcacccgcgagggccagcttcggcaggacctcgctgactgtgtggagaagaagttcggtgtctccttccagaaggagagggagaaccgggcgtacatgagcggaccggagcatggtatccacccgctagcgaacgctaccggcaagggcctgaggaccgagatccgtgaggtcgatttgccggcgagtactaccgccggcgccgggagggtcttcacttgatcgccgtatcgtgtgttgccgcggcgggtctgcgtaatgtagactatatagacggtgcttggtttggtctgtagttcgtgagtacgtgctcaatcgtttgtgttctcttaagacacgaactactgttcatatgaactttgaattttcgcataataagagatggcgctctact

SEQ ID NO: 2031 - DNA, 1048 bp, Panicum virgatum
aaaacaggaagagagagagagagagagagagagagagagagagagagagagctccgagcctccgagcaatggcgtcgtcgtgccacgaggtggaggtccccggcaagccgacggagacggggacggcgctgctggagacggcgacgggcacgatccaggggttcgcgccgctggggcagatccaccagcacctgtgcgcgttccacttctacgcggacgacatggggcggcaggtggaggcgcaccacttctgcgcgcacctcaacgaggacgtccgccagtgcctcatcttcgacggccccggcgccggcgcgtgcctcatcggcgtcgagtacttcgtctccgagcccgtgttcctgacgctccccgacgaggagaagccgctgtggcactcgcacgagttcgaggtcaagggcggggtgctgttcatgcccggcgtgcccggcgccgtcgagcgccgggacctggagaaggtgtgccggacctacggcaagaccgtccacttctggcaggtggaccgcggcgacccgctcccgctcggcctgccgcagatcatgatggcgctcacccgggaggggcagctccggcaggacctcgcagactgtgtggagaagaagttcggcgtgtcgttccagaaggagagggagaaccgggcgtacatgagcgggccggagcacggcatccacccgctggcgaacgccgccggcaagggcctcaggaccgagatccgtgaggtggacatcccggcggctacaaccgccggcgccgccagggtcttcacctgatctgaatctgatcgccgcgagttgcgttgcgttgcgggtggcggacggctggagtctggtagtaatactaatatagcagatagggtagctactagtagatgatggtgcgggatagtcggtgggtggttgcttgtgtccggactccggagtgtgtcgtctgatgatctgttcttgttctctccgagacggagactcggcctccgcgctccgcgaactgtgaatttcggtaataaataatgtcttgtctggatccttcgaagtgg

SEQ ID NO: 2032 - DNA, 996 bp, Setaria italica
agaggaaagcaggggaggaggaagagagagctccgatggcggaatcgtgccacgacgtggaggttcccggcaagccgacggaggttgggacggcgctgctggagacggcgacgggcacgatccaggggttcgcgccggtgaatcagatccaccaacacctgtgtgcgttccacttctacgccgacgacatgtcccggcaggtggaggcgcaccacttctgcgcgcacctcaacgaggacgtccgccagtgcctcgtcttcgacgggcccggcgccggcgcgcggctcatcggcgtggagtacatcgtctcggagccggtgttcctgacgctgcccgacaccgagaagccgctgtggcacacccacgagttcgaggtgaagggcggggtgctcttcatgccgggcgtgcccggggtggtggagcgccgggacctggagaaggtgtgcaggacctacggcaagaccgtccacttctggcaggtggaccgcggcgacgcgctcccgctcgggctcccgcagatcatgatggcgctcacgcgagaggggcagctccggcaggacctgggtggagaagaagttcggcgtgtcgttccagaaggagagggagaaccgggcgtacatgagcgggctggagcacggaatccacccgctggcgaacgccgccggtaagggactcaagaccgagatccgtgaggtggacatcccggcgaccacgaccgccggcgccgccagggtcttcacttgatcgccgtgggtggcgtggcgagtggatccgtggatggttggagtctgcgtagtgatagtagggtagtagctactagatggtgcgggttagtcgggctttgtgttcggagtgcctccgttccttccagacagtctcggactctgcgatccgtgaactgtgaatttcggtgtataacataataataatggatcgttttgaagtgcaagatgtgtgaattggagtgaaaaatggactgatacgtgttgattgaag

SEQ ID NO: 2033 - DNA, 977 bp, Triticum aestivum
agcccaccagtaccccaacacacaaaacttgcacaggatcgaagatggcggcgtcgtgccacgacgtggacgtgccggggaagccgacggagacggggacggcgctgctggagacggcgacgggcgccatccaggggttcgccccgatcaaccagatccaccagcacctctgcgccttccacttctacggggacgacatgacgcggcaggtggaggcgcaccacttctgcgcgcacctcaacgaggacgtgcggcagtgcctcatcttcgacgggccggaggccggcgcgcgcctcatcggcctcgagtacatcgtcaccgaggagctgttcctcacgctgcccgacgaggagaagccgctgtggcacacccacgagttcgaggtcaagggcggcgtgctcttcatgcccggcgtccccggcgtcgtcgagcgccgcgacctcgagcaggtggcaaagacgtacggcaagaccgtccacttctggcaggtcgaccgcggcgacgccctcccgctcggcctcccgcagatcatgatggcgctcacccgcgagggccagctccggcaggacctcgccgactgtgtggagaagaagttcagcgtgtcgttccagaaggagagggagaaccgggcgtacatgagcgggccggcgcacggcatccacccgctggccaacgctgctgggaagggcttgaagacggagatccgcgaggtcgatcttccggctgccaatactggagccaggattttcacctgatctgcccttggcgtgttctcgtacgtgtccgagagatgggtgtgtgatagctggagatagggtagttaataaaatgtctcccacccctttgtttttcctcttggaaatggagcgagtgttcgaagaatgatggacttccgaataacagtcataggcagtggcggagcgaggaaccgaggatgtagagttagaagggatcaaatgaatcaataaactctttat

SEQ ID NO: 2034 - DNA, 999 bp, Triticum aestivum
ctcacctgagccaccagcctaccagtaccccaacacaaacacacagtctacgcaggatcgaagatggcggcgtcgtgccacgacgtggacgtgccggggaagccgacggagacggggacggcgctgctggagacggcgacgggcgccatccaggggttcgcgccgatcaaccagatccaccagcacctctgcgcgttccacttctacggggacgacatgacgcggcaggtggaggcgcaccacttctgcgcgcacctcaacgaggacgtgcggcagtgcctcatcttcgacgggccggaggccggcgcgcgcctcatcggcctcgagtacatcgtcaccgaggagctgttcctcacgctgcccgacgaggagaagccgctgtggcacacccacgagttcgaggtcaagggcggcgtcctcttcatgcccggcgtccccggcgtcgtcgagcgccgcgacctcgagcaggtcgccaggacatacggcaagaccgtccacttctggcaggtcgaccgcggcgacgccctcccgctcggcctcccgcagatcatgatggcgctcacccgcgagggccagctccggcaggatctcgccgactgtgtggagaagaagttcagcgtgtcgttccagaaggagagggagaaccgggcgtacatgagcgggccggcgcacggcatccacccgctggccaatgctgctggcaagggcttgaagacggagatccgcgaggttgatcttccggctgccaatactggagccaggattttcacctgatctgcccgtggcgtgcgtacgtgtctgcgagatgggtgtatgatagctggagatagggtagttaataaagtgtcaactaccctttgtttcgcctcttggaaatggagtgctcgaagaatgagttacgaatgacagtataggcagcgccggagggaggaaccgtgtatctagacttagaaggggccaaataaaccatcttccactcaaagatattgttttattttc

SEQ ID NO: 2035 - DNA, 977 bp, Triticum aestivum
agcccaccagtaccccaacacacaaaacttgcacaggatcaaagatggcggcgtcgtgccacgacgtggacgtgccggggaagccgacggagacgggcacggcgctcctggaggcggcgacgggcgccatccaggggttcgccccgatcaaccagatccaccagcacctctgcgccttccatttctacggggacgacatgacgcgacaggtggaggcgcaccacttctgcgcgcacctcaacgaggacgtgcggcagtgcctcgtctttgacgggcccgacgccggtgcgcgcctcatcggcgtcgagtacatcgtcaccgaggagctgttcctcacgctgcccgacgaggagaagccgctgtggcacactcacgagttcgaggtcaagggcggcatgctctttatgcccggcgtccccggcgtcgtcgagcgccgcgacctcgagcaggtggcaaagacgtacggcaagaccgtccacttctggcaggtcgaccgcggcgacgccctcccgctcggcctcccgcagatcatgatggcgctcacccgcgagggccagctccggcaggacctcgccgactgtgtggagaagaagttcagcgtgtcgttccagaaggagagggagaaccgggcgtacatgagcgggccggcgcacggcatccacccgctggccaacgctgctgggaagggcttgaagacggagatccgcgaggtcgatcttccggctgccaatactggagccaggattttcacctgatctgcccttggcgtgttctcgtacgtgtccgagagatgggtgtgtgatagctggagatagggtagttaataaaatgtctcccacccctttgtttttcctcttggaaatggagcgagtgttcgaagaatgatggacttccgaataacagtcataggcagtggcggagcgaggaaccgaggatgtagagttagaagggatcaaatgaatcaataaactctttat

SEQ ID NO: 2036 - DNA, 994 bp, Triticum aestivum
  misc_feature (978)..(978): n is a, c, g, or t
acccgagccaccagcccaccagtaccccaacacacaaaacttgcacaggatcaaagatggcggcgtcgtgccacgacgtggacgtgccggggaagccgacggagacgggcacggcgctcctggaggcggcgacgggcgccatccaggggttcgccccgatcaaccagatccaccagcacctctgcgccttccatttctacggggacgacatgacgcgacaggtggaggcgcaccacttctgcgcgcacctcaacgaggacgtgcggcagtgcctcgtctttgacgggcccgacgccggtgcgcgcctcatcggcgtcgagtacatcgtcaccgaggagctgttcctcacgctgcccgacgaggagaagccgctgtggcacactcacgagttcgaggtcaagggcggcatgctctttatgcccggcgtccccggcgtcgtcgagcgccgcgacctcgagcaggtggcaaagacgtacggcaagaccgtccacttctggcaggtcgaccgcggcgacgccctcccgctcggcctcccgcagatcatgatggcgctcacccgcgagggccagctccggcaggacctcgccgactgtgtggagaagaagttcagcgtgtcgttccagaaggagagggagaaccgggcgtacatgagcgggccggcgcacggcatccacccgctggccaacgctgctgggaagggcttgaagacggagatccgcgaggtcgatcttccggctgccaatactggagccaggattttcacctgatctgcccttggcgtgttctcgtacgtgtccgagagatgggtgtgtgatagctggagatagggtagttaataaaatgtctcccacccctttgtttttcctcttggaaatggagcgagtgttcgaagaatgatggacttccgaataacagtcataggcagtggcggagcgaggaaccgaggatgtagagttagaagggatcaaatgaatcaanaaactctttattagag

SEQ ID NO: 2037 - DNA, 939 bp, Brachypodium distachyon
gaacccgctcgaaacaaagccacaaagatagacaaacaatggcggcctcgtgccacgacgtggatgtccccgggaagccgacggagacgggcaccgctctgctcgagacagccacgggcgccatccaggggttcgccccgatcaaccagatccaccagcacctgtgcgcgttccacttctacggggacgacatgacccggcaggtggaggcgcaccacttctgcgcgcacctgaacgaggacatgcggcagtgcctcatcttcgacgggccggacgccggggcgcggctcatcgggctcgagtacatcgtcagcgaggagctgttcctcacgctgcccgacgaggagaagccgctgtggcacacgcacgagttcgaggtgaagagcggcgtgctcttcatgcccggggtgcccggcgtcgtcgagcgccgggacctcgagaaggtggccaagacctacggcaagaccatccatttctggcaggttgaccgcggcgacgctctcccgctcggcgtcccccagatcatgatggccctcacgcgcgacggccagctccggcaggatctcgccgattgtgtggagaagaagtacggcgtgtcgttccagaaggagagggagaacagagcgtacatgagcgggccggcgcacggcatccacccgctggccaacgctgctgggaagggcttgaagacggatatccgcgaggtcgatcttccaacggcgattgctggagccaggattttcacctgatgtcgtccacgaccagtgtgtctgtacgtgtgtatgcgtgacgtgccggacggcctgctcgagataggctagttcattacccctctccagtacccttgtgaagtgttgttagctagtactcgatcctagtcgtgaagtgttttaagtgtgagtttcgaaataaatggtaatgatgggaagctgttaggca

SEQ ID NO: 2038 - DNA, 1004 bp, Pseudoroegneria spicata
  misc_feature (9)..(10): n is a, c, g, or t
  misc_feature (277)..(277): n is a, c, g, or t
  misc_feature (902)..(902): n is a, c, g, or t
  misc_feature (951)..(951): n is a, c, g, or t
  misc_feature (988)..(988): n is a, c, g, or t
cagcccacnngtaccccaacacacgagctgcgcagcaaaaatggcggcctcgtgccacgacgtggacgtgccggggaagccgacggagacgggcacggcgctgctggagacggccacgggcgccatccaggggttcgccccgatcaaccagatccaccagcacctgtgcgcgttccacttctacggggacgacatgacccggcaggtggaggcgcaccacttctgcgcgcacctcaacgaggacgtgcggcagtgcctcatcttcgacgggccggangccggcgcgcgcctcatcggcctcgagtacatcgtcaccgaggagctgttcctcacgctgcccgacgaggagaagccgctgtggcacacccacgagttcgaggtcaggggcggcgtgctcttcatgcccggcgtgcccggcgtcgtcgagcgccgcgacctcgaggtcgtcgccaggacctacggcaagaccgtccacttctggcaggtcgaccgcggcgacgcactcccgctcggcctcccgcagatcatgatggcgctcacccgggagggccagctccggcaggatctggccgactgtgtggagaagaagtacggcgtgtcgttccagaaggagagggagaaccgggcgtacatgagcgggccggcgcacggcatccacccgctggccaatgctgccgggaagggcttgaagacggagatccgcgaggttgatcttccggctgccaatactggagccaggattttcacctgatctgcccttggcgtgcgtacgtgtccgcgagatgggtgtatgatagccggagataggctagttaataaagtgtctcccacccctttgtttcgcctcttggaaatggagtgctcgaagaatgacttccgaataacagcataggcagtggcgnagcgaggaaccgaggatgtagagttagaaggaatcaaatgaatcaacanactcttgataagaggagccaaaccatattctactctntaagaatttctcttca

SEQ ID NO: 2039 - DNA, 988 bp, Triticum aestivum
cccgaacacaaaactcgcacagcatcgaagatggcggcctcgtgccacgacgtggacgtgccggggaagccgacggagacggggacggcgctgctggagacggcgacgggcgccatccaggggttcgccccgatcaaccagatccaccagcacctctgcgccttccacttctacggggacgacatgacgcggcaggtggaggcgcaccacttctgcgcgcacctcaacgaggacgtgcggcagtgcctcatcttcgacgggccggaggccggcgcgcgcctcatcggcctcgagtacatcgtcaccggggagctgttcctcacgctgcccgacgaggagaagccgctgtggcacacccacgagttcgaggtcaagggcggcgtgctcttcatgcccggcgtgcccggcgtcgtcgagcgccgcgacctcgaggtcgtcgccaggacctacggcaagaccgtccacttctggcaggtcgaccgcggcgacgccctcccgctcggcctcccgcagatcatgatggcgctcacccgcgagggccagctccggcaggatctcgccgactgtgtggagaagaagttcagcgtgtcgttccacaaggagagggagaacagggcgtacatgagcggcccggcgcacggcatccacccgctggccaatgcggctgggaagggcttgaagacagagatccgcgaggtcgatcttccggctgccaataccggagccaggattttcacctgatctgcccttggcgtgcgtacgtgtccgcgagatgggtgtatgatagccggagatatatagggtagttaataaaatgtctcccaccctttgtttttcctcttggaaatggagtgagtgctcgaagaattgactttcgaaaaacagtataggcagtggcggagcgaggaaccggatgtagagttagaaggaatcaaatgaatcaacaacctctttataagagccaaaccatattctactaaaaaaaaaa

SEQ ID NO: 2040 - DNA, 1107 bp, Hordeum vulgare
gctttccctagctaccacaaagctcgcgcggcaaaaagatggcggcctcctgccacgacgtggacgtccccgggaaggcgacggagacgggcacggcgctgctggagacggcgacgggcgccatccaggggttcggccccatcaaccagatccaccagcacctgtgcgcgttccacttctacggggacgacatgacgcggcaggtggaggcgcaccacttctgcgcgcacctcaacgaggacgtgcggcagtgcctcatcttcgacggccccgacgccggcgcgcgcctcatcggcctcgagtacatcgtcaccgaggagctgttcctcacgctgcccgacgaggagaagccgctgtggcacacccacgagttcgaggtcaggggcggcgtgctcttcatgcccggcgtgcccggcgtcgtcgagcgccgcgacctcgagaaggtggccaggacctacggcaagaccgtccacttctggcaggtcgaccgcggcgacgccctcccgctcggcgtgccccagatcatgatggccctcacccgggagggccagctccggcaggacctcgccgactgtgtggagaggaagttcggcgtgtcgttcgagaaggagagggagaaccgggcgtacatgagcgggccggcgcacggcatccacccgctggccaatgctgccggcaagggcttgaggacggagatccgagaggttgatcttccggctgccaataccggagccaggattttcacatgatctgctccgtcaattaggtgtacgtgtcatcgaatcgacggctgtatgagagccctacaagatagggtgcttaataagaagctggcttccgccgcctcctttgttatgggacggcccatctgctctgcttcacttgctttcatagcaaaatggacataagagcatctataaccggacccatcatatccgtctcaaacagccccatcaatatccgtctcaaacagccccatcatatccgtctcaaatggtcggcatccggtctctgaccgttcaaatatgagatacgagggacagtccaaatatgagatatgaggcttcacttgctcgaatataaatatgaggcttcacttgctttcat

SEQ ID NO: 2041 - DNA, 1197 bp, Oryza sativa
tcgttcatccatccagcggcacacacaccaagctagcttctagtagttgagcaatggcggcgtcgtgccacgaggtggaggtgccggggaagccgacggagacggggacggcgctgctggaggcggcgacggggagcatccaggggttcggccccgtgaaccagatccaccagcacctgtgcgcgttccacttctacgccgacgacatgacgcggcaggtggaggcgcaccacttctgcgcccacctcaacgaggacatgcgccagtgcctcatcttcgacgggcccgacgccggcgcgcgcctcatcggcgtcgagtacatcgtcgccgagccgctgttcctcacgctccccgacgacgagaagccgctgtggcacacccacgagttcgaggtcaagggcggcgtcctcttcatgcccggcgtccccggcgtcgtcgagcgccgcgacctcgagagggtgtgcaagacctacggcaagaccatccacttctggcaggtcgaccgcggcgacgcgctcccgctcggcctgccccagatcatgatggctctcacccgcgacggccagctccgccaagaactcgccaaatgtgtggaggagaagttcagcgtgtcgttcgacaaggagagggagaaccgagcgtacatgagcggcccggatcacggcatccacccgctggcgaatgccgccggcaagggcttgaagaccgatctccgggaggttgatctgccggcgatgactacggcgcacgccgggagggttttcacctgatgacgacacactgatgagcgattgagcgacgactcgacggccttgctgcttctgcctgacgacggttaagtagtatgctagcatatcacgggatgctccgattagcttgtgtaccttcactcgtgttatgtatcgatctgttgtccctgagcgtttgttctgaaagaagcacactagagtatccgactgtagtacctgtagcctcttttctagcagcttgatgaacacaagaacaacagaacaggttgtgtatagctagttcaaaacgtgacatctgtacctgtctcgactcgtctcacgtctccccatctgtactgtgttgactcgtctcacgtctccccgagtctacacgtcaccacgcacgtacgtacgacgacacagaactctcacacgaaggggcaaatattttccaaatatttttcttttt

SEQ ID NO: 2042 - DNA, 818 bp, Avena sativa
acacacacacaatcgatcaaaaaatggctgcgccgtgccacgacgtggacccggtgccggggaatccgacggagacgggcacgtcgctgctcgaaaccgcgacgggcgccatccaggggttcgcgcccatcagccagatccaccagcacctgtgcgcgttccacttctacggggacgacatgacgcggcaggtggaggcgcaccacttctgcgcgcacctgagcgaggacatgcggcagtgcctcatcttcgacgggcccgaggccggcgcccgcctcatcggcctggagtacatcgtcacggaggagctcttcctcaccctgcccgacgacgagaagccgctctggcactcgcacgagttcgaggtgaagggcggcgtgctcttcatgccgggggtcccgggggtcgtggagcgccgcgacctcgagaaggtggccaagacctacggcaagaccatccacttctggcaggtggaccgcggcgacgcgctcccgctcggcctcccgcagatcatgatggcgctcacccgggacggccagctccggcaagatctcgccgagtgtgtggagaagaagttcggcgtgtcgttccagaaggagaaggagaaccgggcgtacatgagcggggcggcgcacggcatccacccgctggcgaacgctgctggaaagggcttgaagacgggtatacgcgaggtggatctcaaggacgcgggtactagacacagggtgttcacctgatctaactattctaggtgtgcgtgtccgtggaggacggaaggtgtgtgtaaggatggcgggagtcgtcaataatgtagctca

SEQ ID NO: 2043 - DNA, 747 bp, Hordeum vulgare
cgagcgctttccctagctaccacaaagctcgcgcggcaaaaagatggcggcctcctgccacgacgtggacgtccccgggaaggcgacggagacgggcacggcgctgctggagacggcgacgggcgccatccaggggttcggccccatcaaccagatccaccagcacctgtgcgcgttccacttctacggggacgacatgacgcggcaggtggaggcgcaccacttctgcgcgcacctcaacgaggacgtgcggcagtgcctcatcttcgacggccccgacgccggcgcgcgcctcatcggcctcgagtacatcgtcaccgaggagctgttcctcacgctgcccgacgaggagaagccgctgtggcacacccacgagttcgaggtcaggggcggcgtgctcttcatgcccggcgtgcccggcgtcgtcgagcgccgcgacctcgagaaggtggccaggacctacggcaagaccgtccacttctggcaggtcgaccgcggcgacgccctcccgctcggcgtgccccagatcatgatggccctcacccgggagggccagctccggcaggacctcgccgactgtgtggagaggaagttcggcgtgtcgttcgagaaggagagggagaaccgggcgtacatgaacgggccggcgcccggaatccacccgctggccaatgctgccgggcaagggcttgaggacggagatccgaaaagttgatctttcggctgccaataccggagcccggattt

SEQ ID NO: 2044 - DNA, 1878 bp, Saccharum officinarum
ccacgcgtccgaaagcgaaagacatcagtcaagagcgcgagttctagtagctagcctgctgatctgctgtgttgtttagttgggaaagccatctgtttcggcgatcatggaggacgagaggaacacccagcagcaccagggctgtgaggcccaggagaacgccggcgccgatcaggtggaggtgaaggacaggggactcctggacagccttctcggcaggaagaagcacgaggaccaggagaagaagcaggaggaggagctggccaccggcatggagaaggtcacggtggccgagcccgagaagcacgagcacaagaaggaggagcacgaggccgccggcgagaagaaggagagccttctcgccaagctgcatcgcaccagctccagctccagctcgtcgagcgacgaggaagaagaggtgatcgacgagaacggcgagatcgtcaagaggaagaagaagaagggcctcaaggagaagatcaaggagaagctgccgggccaccacaaggaccacgaggccgaccaccacacggccgtaccggccccggcggcggcgcccgcgcccgtggtggagacgcacgctcaccaccaggaggaagagcacaagccgcacttcgcggccccggcgcctcccccgcacgtggagacgcacgtccaccagcacgaccacggcgtcgtcgtccagaaggtcgaggacgacgtgaagaccgagaccccaccggcaccggaggaggagaagaaaggcctgctggacaagatcaaggagaagctccccggtggccacaagaagccggaagacgcttccgctgctgccgcaccggccgtcgtccacgcgccagcgccggcgccgcacactgaggacgtgagcagcccggatggcaaggagaagaagggcttgctgggcaagatcatggacaagatacccggctaccataagagctcaggtgaagacgaccacaaggacgccgccggcgagcacaagaccagctcctaaggtcgcaacgtgtcctggccgggccttgatccatcagaagcgttggcgtgtgttttggttctggtttgctttttaagaagtttgtttcaaggtggatcgcgtggtcaaggtccgtgtgctttaagccccaaccggcactggcagtgagtgttgttgcttgtgtaggctttggtacgggctttagtttggttccaagtcagggtttggatgttgtgtacttgggtttgttgaattattatgtttagttgcgtattgtaattcggctgggctacctggacatgcattagtaattgctttggtttctgcccagcacatatattatcacgttgtgatccttgtcaattatcattcggatgctgccattgcctaaacttcctatccagcgcatctctctggacacctcacatccgcacttccacccattcctcctcttctcccttcctcctgtctcctccctctcctatttctcctccttcctcttctctctctctcctctcctcctcccccctcaccctttccccccctctcttcttctccattctctcctcttactctgcctccctccccccgtccactctgctctcctaccccctgcccctcgctctcttctctcctcctcttcctctctccttccttttgccccctccttccccttccctctcctcccttatctcaccccgcccctctccctcctcccctttcttccttcccttcccttctcttcctttcctcccctcccttttctcccctccccccccctctctatccccccccctctcttcttcgcccctccttttcctccctcacccaactcttttccgcccgctctcccgctccctcctcttctccgccgctctcacccttcctccccccttctcttcctt

SEQ ID NO: 2045 - DNA, 1257 bp, Panicum virgatum
caaagcgagtctcaccagtcaaagaacgagttctagtagctttgctgatctgttctgctgtttttagtttggaaagcctttagttccggcgatcatggaggacgagaggaacacccagcaccaccaggtcggcgaggcccaggagaaggccgccgatcaggtggaggtgaaggacaggggcctcctggacactcttctcggcaggaagaagcccgaggaacaccaggaggaggagctggtgaccggcatggagaaggtcacggtggccgagcctcagaagcacggcgagcacaaggaggagcacgagaccggggagaagaaggagagcctcctcgccaagttgcaccgcaccagctccagctccagctcgtcgagcgacgaggaagaggaggtgatcgacgagaacggagagattgtcaagaggaagaagaagaagggcctcaaggagaagatcaaggagaagctacccggccacaaggaccacgccgagggcgaccaccacacggccgtgccggccccggcgcccgcgcccgtgggaacgcacgcttacaaggaggacgagcacaagccgtacgtgccggccccggctcccccgcccgcggtggagacgcacgtccaccaccacgaccacgccgtcgtcgtccagaaggtcgaggacgactccccaccggcgccggaggaggagaagaagggcctccttgacaagatcaaggagaagctccccggcggccacaagaagccggaggacgccgccgccgccgccgcgcccgctgtccacgcgccagcgccggcgccgcacgcagaggacgtgagcagcccggacggcaaggagaagaagggcctgctgggcaagatcatggacaagatacccggctacaacaagggttccggcgaggaggaccacaaggccgccgccggcgagcacaagaccagttctttttaagatggcccgcgcgtcgtgaccttgatcggaagcgtttgtttgccgtgcgtttggttctgctttgctttattaagtttgtttcaagatgggattgcgcggtcaaggcccggctttagtttggttccgagtcggggactggaagttgttgggtttgttgaattattatcagcagttgcgtcggtattgtaattcggctgggctacctggggattatgccttaacatttatatctttggtttctgcctagcatatatattgttgtcccattgtgatccttatgtattatatctagaaacatgatgcctagttacccc

SEQ ID NO: 2046 - DNA, 1404 bp, Setaria italica
cagcagtcaagagcgagttctagtagcgtgctgatctgttctgttgtttttagttgggaagcctttagtttgatcatggaggatgagaggaacacccagctgcaccaccagggcggcgaggcccaggagaaggccgccgatcaggtggaggtgaaggacagggggatcctggacacccttctcggcaggaagaagcccgaggaccaggagaagaagcaggaggaggagctggtgaccggcatggaaaaggtcacggtggccgagcctgagaagcacgagcacaagaaggaagagcacgaggccggggagaagaaggagagcctcctcgccaagctgcaccgcaccagctctagctctagctcgtcgagcgacgaggaagaggaggtgatcgacgagaacggcgagatcgtcaagaggaagaagaagaagggcctcaaggagaagatcaaggagaagctgcccggccacaaggaccacgccgagggcgagcaccacacggccgtaccggccccggcgccagcgcccgtggagacgcacgcttacaaggaggacgaccacaagccgtacgtcccggcgccggctcccccgcccgtggagacgcacgtccaccaccatgaccacgccgtcgtcgtccagaagatcgaggacgacgcgaagaccgacgccccaccggcaccggaggaggagaagaaaggcctccttgacaagatcaaggagaagctccccggcggccacaagaaaccggaggacgctgccggcgcacccgccgtccacgcgccagcgccgacaccgcacaccgaggacgtgagcagcccggacggcaaggagaagaagggcttgctgggcaagatcatggacaagatacccgggtacaacaagggctccggcgaggaggaccacaaggccgccggcgctgctgccggcgagcacaagaccaccagctcttaagctcgcccgcgtgtcctgaccgggccttgatcagaagcgtttggcgtgcgtttggttctgcagttctgctttgctttagtaagtttggtttcaagatgggttgcgcggtcaaggccccggtgtgttgatgcccgtaccggccagtgctggtagtgagcgttgctgctttgttgtttgctctggtacgggcttagtttggttccaagtcagggtctggatgttgggtgttgcgtattgtaattcggctgggctacctgggcattatgcctcaatatttactttggtttctgcccagcatatatattgtcacgttgtgatccttgtgtattatcatttgaaaggggagttctagaaatctagctacctcattatcttacttctagagctcacgcaatggcatcctcaatgtaacttatattatgcaaaaaataaaagacagtgtgactttttcccaaa

SEQ ID NO: 2047 - DNA, 949 bp, Pennisetum glaucum
gcacttcaccaccgaatcgaagaacgcacagcagatctatcgccagttcgccactcatcacagttgaatcgagtcgtagcattgagcgagggacagagggagtgagctagggagaacgaaggcatgacggagatgttcgacgcggccgtgaccagcctgctccaccttccggaggtgctcgaccgcctcgccgccgcggacggcgaccgccgctcgggcggacagcacggcgcgcaccaccaccaccacggtcacgctcgcgtccacgggctcggcggcggcagcggcggcgcgccggtggacatcatggagacccccggcgagtacaccttcgtgctcgacgtccccggcctctccaagtccgacatccaggtgacgctggaggaggaggaccgggtgctggtgatgaagggcggcagcaacggcgggaagcggaagcgcgaggaggaggaggaggaggagcgcgaggggtgccgctacatccggctggagcgccgcgcgtcgccgcggtcgttcgtgcgcaagttccggctgccggaggacgcggacgcgggcggcgtcgcggcgcgctgcgagaacggcgtgctcaccgtcaccgtcaagaagcagccgccgccggagaagaagaccaagtccgtgcaggtcaccatcgcctgagcgcccccgcgcgagggggagccagcagtagtcactccggtcaccagtggacagtctagcagtagggagtgcgtaacgtgctagaaggttggatgctctgtgtgtgtcagtgtgtgtgttccgttctggagtagtagtaggcctgcctgttcgttgccgagttggttagtgttcgtcttctgtggatggatggatggatgtcgctgttaacgctgtggagtcgaacgatgggtcagaatgtcacagttgctatcactttgcaatagattcccagggtttcggtaaaaaaaaa

SEQ ID NO: 2048 - DNA, 1373 bp, Saccharum officinarum
cgttcgaatgccgcaccggaatcgtatggtcgagtcgacccacgcgtccgcaaataagcacgacaccggccaccaaaagctgctcaaaagtcaaaaccaagcggcaaaaaatgtggaatcccaaacccctcctgctcgtcatctcactctgcatcctggcgttgtcgtcgtcactatgcacggcagcccgtggcggcggcaagcccctggtgaccgccgtcaccaaggacgcgtccacctccctctacacggcgccgcttaaggacggccacccgctgcttctcgacctctccagcccagtcatctcgctgacgacgtgctcctccaagaacggcacggtcacgacgctctccgcgaacgccaccgacggccagaacccgttgttcccggtctccttctctgccgtcgcctcctgcacgccacaggcaaaggtccctgccggtgccgtcggcgtcgcggggctcgcgccctcgtcccagtcgttcccggcgcaggtggcgcgcacgcagaaggtcgccaataagatcacgctctgcctcccgagcgacggcaagtccacaaccggcaacagcgtcggcgtggccatcttcggcggtggtcccttggtcttcccggaccggggcgacttcaccacgatgctggccggcacggcgccgctgcgtgggttcaacggctctcccgggtactacgtctccgccaccggcatcgccgtggagcagagtcgcgtaggcacctccggcgggccgctcgtcgttgcgctgagctccacgaccccgtacacatctctccggcccgacgtgtacggtccgttcgtaagggcgttcgacgcggcggcgacggggcccaacttcccgtggatgtcgagggtgaccgcggtggcgccgttcgagcggtgctacgactcgacgaagctgccgccgacgcggctcggctacgccgtgccgcagatcgacgtgatgctgaagggcgggcagaactactcggtgctcggcgggaactccatggtgcaggtgaacggcaacacgggctgcctgggttcgtcaggcggcggggcggaggcaccgcgggcggcatcgggggtttccacttgagaccaccttgtggtgctcgacgtggagaaaaacagttcgggttaccacgttcttcaagcgaatcggctttcatgccacaactttcaattcactcttgccggctaatgctggtggaataagaaactttactactggggcacggttgataattaatgaatgggaataaatggggtgggagggttccaaaaaaaaaaaaagagggctggccgtttaaaggaatacatttatcgaccagtgggtgcagagatagcttgtttataggtaccaaagacagtaacgagg

SEQ ID NO: 2049 - DNA, 1653 bp, Setaria italica
gtgcccggagccgacgtgcgtccaccacgacccgtcccgcgccctcggcgacctgacgggcatcaagaagcacttctgccgcaagcacggcgagaagaagtggaagtgcgacaagtgctccaagcgctacgccgtgcagtcggactggaaggcgcactccaagatctgcggcacccgcgagtaccgctgcgactgcggcaccctcttctccaggagggacagcttcatcacccacagggccttctgcgacgcgctggcggaggagagcgcccggctgccgccgacgagcctcagcagcctaaccggccacctctacggcgccacgaacgcgggcaacatggcgctcagcctctcgcaggtgggctccaacctcacctccacgctccaggacggcggccaccaccaccaacaccaccacccaagctgcacaaaccaaccggcagaaatgtggaaccccaagcccctcctcctcgtcatctcgctctgcatctctgccttgtcaccatgcacagcggccaccggcggcaagcccctggtcacggccgtcaccaaggacgcggccacctccctctacaccgcgccccttaaggacggccgcccgctcgtcctcgacctctccggcccggtgatctcgctgacgacgtgctcctccaagaacgggacggtcacgacgctctcctccaacgccacgaacggcgcgaacccgctgttcccggtgtccttctccgccgtggcctcctgcgcgccggggcagcctaacctgccggcgggcgccgtcggcgtcgcggggctcgcgccctcgacccagtccttcctcgctcaggtcgcgcgcacgcagaaggtcgccaacaagctcgccctctgcctcccgagcgacggcaagatcacgaccggcaacagcgtgggcgtggccatctacggcgggggtcccttgatcttcccggaccggggcgacttcacgacgatgctcgccggcacggctccgctagtcgggttcaacggatcccccgggtacttcatctccgccaccggcatcgccgtggagcaaagcctcgccggcaaccccgggacgctcgtggtcggactgagcacgacggccccgtacacggcgctccgccccgacgtgtacgacccgttcatgaaggcattcgaccaggccgcgaccggatccaacttcccgtggatgacgagggtcgcctccgtcgcaccgttcgaacggtgctatgactcgacgaaactgccgccgacgaggctcggctacgccgtgccgcagatagagttcgtcctcaagagcgggagcaactactcggtggtgggcggcaactccatggtgcaggtgaacgtcaacacggcctgcctcgggttcgtcaaggcgtccggccaggcgccggcggcgattatcggtgggttccagatggagaaccgcctgctggtgctcgacgcggagaagaagaccctcggcttcaccacgttcctcaacggggtagggctttcatgcagtaacttcaatttcacccttgccgcctagtgggtcggtgaatctcgatcctgtactgtattgtaacaagaactttcgctgtgtatcaataaattgggaataaattggagtgttccagaattgatcatacggatttacatcctcccaacagattg

SEQ ID NO: 2050 - DNA, 1212 bp, Panicum virgatum
taatcagcccaaaccaaaccagcagcaatgtggagctccaagcccttcctcctcgccatctccctctgcatctcggccctgtcgacatgcacggcggccggtggcggcaagcccctggtctccgccgtcaccaaggacgcgtcgacgtccctctacacggcgccgcttaaggacggccgcccgctggtcctcgacctctccgggccggtcatctccctgacgacgtgctcctccaagaacgggacggtcacgacgctctcagcgaacgccaccgacggcgcgaacccgctgttcccggtgtccttccgcgccgcggcctcctgcggcacgccgcccaagctgccggcgggcgccatcggcgtcgcggggctcgggccgtcgagccagtcgttcctggcgcaggtcgcgcgcacgcagaaggtcgccaacaagctggcgctctgcctcccgagcgacggcaagacgacgagcggcaacagcgtgggcgtggcaatcttcggcggggggcccctgatcttccccgaccggggcgacttcacgacgatgctggccggcacggctccgctccgcggattcaacgggtccccagggtactacgtcaccgccaccggcatcgccgtggagcagactcggatcggcgtgtccgggccgctcgtcgtcgggctgagctcgacggccccctacacggcgctgcgccccgacgtgtatgccgccttggtgagggcgttcgaccaggccgcgaccgggcccaacttcccctggatgtcgagggtcgccgccgtcgcgcccttcgagcggtgctacgactcgacgaagctgccgccgacgcggctgggctacgccgtgccgcagatcgacctgaacctggagggcgggagcacctacttcttgaccggcggcaactccatggtccaggtgagcgccaacacggcctgcctcgggttcgtccgggcggccgggcaggcgccggcggcagtgctcggcgggttccagatggagaaccgcctgctggtgctcgacgtggagaagaagcagctcggcttcaccacctttctcaatgcggtagggctctcctgcagcaacttcaacttcaccctcgccgcctagtgggggtgctgaatctcgatgctgcactgggttgtgttgtaataacagctttcgctgtgtatcaataaaattggaatgaattggagttttccagactgatcgatc

SEQ ID NO: 2051 - DNA, 1319 bp, Panicum virgatum
agctaataatcagcccaaaccaaccagcacaatgtggagccccaagcccttcctcctcctcgtctccctctgcatctcggccctgtcgacatgcacggcggccggtggcggcaagcccctggtctcggccgtcaccaaggacgcgtccacctccctctacacggcgccgcttaaggacggccgcccgcttgtgctggacctctccggcccggtcatcaccctgacgacgtgctcctccaagaacgggacggtcacgacgctgtccgcgaacgccaccgacggcgcgaacccgctgttcccggtgtccttccacgccgcggcctcctgcggcgcgccgccgaagctgccggcgggcgccgtcggcgtcgcggggctcgggccctcgagccagtcgttcctggcgcaggtcgcgcgcacgcagaaggtcgccaacaagctggcgctctgcctcccgagcgacggcaagacgacgagcggcaacagcgtgggcgtggccatcttcggcgggggccccctgatcttcccggaccgcggcgacttcacgaccatgctggccggcacggctccgctccgcgggttcagcgggtcccccgggtactacgtcaccgccaccggcatcgccgtggagcagacccggatcggcgtgactgggccgctcgtcgtcgggctgagctcgacggccccctacacggcgctccgccccgacgtgtacgccgccttggtgagggccttcgaccaggccgcgaccgggcccaacttcccctggatgtcgagggtcgccgccgtcgcgcccttcgagcggtgctacgactcgacgaagctgccgccgacgcgttcgggctacgccgtgccgcagatcgacctggtcctggagggcgggagcacctacttcgtgaccggcggcaactccatggtgcaggtgagcgccaacacggcctgcctcgggttcgtccgggcggccggccaggcgccggcggcggtgctcggcgggttccagatggagaaccgcctgctggtgctcgacgtggagaagaagcagctcggcttcaccaccttcctcaacggggtagggctctcctgcagcaacttcaacttcaccctcgccgcctagtggggtgcggaatctcgacgacgctgcactggattgtgttgtaataacagctttcgctgtgtatcaataaattcggaataaattggactgatctagactgatcgatcgatgatgatgcggatcagcactgcagcaaattatgacagctatccatcccgacgtactgtttgtcctttctgttctctattactcggatctcattctcatc

SEQ ID NO: 2052 - DNA, 1439 bp, Zea mays
agcagcagcagctgtcgccagtcgcccagtaagtcagtcagtcagtcgtccctcctgttctgctcctgcctccgctcgtcgtccttcttaaggcgcaggccgcgactgggcgcgcacggcacggccacagctgactgactcctcctgcgttggctgataatcatggctagagctccgctgctcctcgcgctgctgtgcgcgtgcgccgccgccgccggctccgccaatgcggcggggaggaagatggtcggcgtgtacgagctcaaggcgggcgatttctccgtcggcgtcaccaactggggcgccaccatcacctccgttgtgctgccggactccaaaggggattttgctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgatggcaacaacacgcttcatggtggccatagggggttcagtcaggttgtatggacggttaaagagttcgtcggtggcggtgactcgccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggggcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccccaatttcccctcccagatcgtcaggccggggcaggtgtacaagcacgacatggtgttcaagttctccttctagccgctctctgtataggcaacaacaccctggtccctggctaatcaatctactagtacctgttatgattgtcactggcaaagtggcaactgggccttattgggactggagacacacgttacatgatttcaagtcaatttgttttgcggaccgtaattaatgtttatcgcaaagattatgtactaacc

SEQ ID NO: 2053 - DNA, 1406 bp, Setaria italica
ccatgatgcatccgtccatctccatcccgggtagctgtcgccggtcgccccgtcgactccttccgtcctcgtctccttcctcctttttacgtcgaggggcctgacaagctgacacacacttgctgtgttcgggaaggccgcatcatggctagagccccggccccgctgctgctcctcgcgctgctggccgccctcgccgcggccgccggcgcaaatgcggccgggaggaagatggtcggcgtgtacgagctccggaagggcgatttctccgtcaaggtcaccaattggggcgccacgctcacctccgtcgtcctgccggactgtaaagggaatctggctgacgttgtcctcggctatgacaccattgctgattacgtgaatggcagtaattattttggagcgctcgtcggccgcgtagccaacagggtagctaacgcgcgatttgtgctcgatggaaaagtctatcatctggtccctaacgatggcaagaatgccctccacggtggtaagagggggttcagcaaggttatttggactgtgaaggactatgtcggtggcggtgactccccgtacatcacgttgtactaccacagcttcgacggcgaagaagggttccccggcgacctggacgtgtacgtgacgtaccggctgttgggccgctacgagctgagcctgcacatgaacgcgacggcgctggacaaggcgacgccggtgaaccttgcgaaccacgcgtactggaacctagccgggcagggccgcggcgacatcctcggccacaccgtgcagctgttcgcgtcgcggtacacgcccgtggacggcgccctgatcccgacgggcgcggtggtgcccgtggccggcacgccctacgacctccgcgcgccgacgcccgtgggcgcgcacgtccgcgcgatctacggcggcaaggccgggatctacgggtacgacaccaactacgccgtggacgggggcgccggggcggcggcgctgcggaaggtggccgtggtccgggacggcggcgggtccgggagggcgatggagctgtgggcgaaccagcccggggtgcagttctacacgggcaacttcctcaaggacgtcaaggggaagggcgggaaggtgtacgggcagtacggggcgctgtgcctggagacgcaggggttccccgacgccgtgaaccaccccaacttcccctcgcagatcgtcaggcccgggcaggtgtacaggcacgacatggtcttcaagttctcgttctagctggctgctgtactatcgagacgactgtcacctgggagctgagagcctgagaggctgagacacaataaaaatatctgatctgaagtcaatttgcaaatactaatgttttatcgccgagatttgtgtgtgcccacgacttgtgcaatcaaatttag

SEQ ID NO: 2054 - DNA, 2674 bp, Zea mays
ccaaaaccaaacccgaggctgcgcctgcgctgcacagcagttccacacctaaacccctcgccgccggcgcctccgaatccggcgatgtcgtcgtcgccgcctcgccggccgcagcgccgcgcggcgtcgtcgcggccggcgtcgtacgatgagtccctcctcgacgccgagctgcaggcctacctcggcgacgccgcctcgcgccgcgtgcggcggctgcgccggctctcggcggaggagcggcagcgggagacggagacggaggcgctcatcgcgctctccctgggattccccatagacgagctgctccccgaggagcggcccctcctgcccgcccacatcgccgacgcgcccaacgactacatcgtcgtccgcaaccacatcctcgcctcctggcgcgcagacccgggggcgccgctgccgctcgcgcgcgtcctcgagacggtcagcgccacctacgaccgcctcgtcgccgccgcccatgggtacctcgcccgcgagggccacatcaacttcggcgtctccgccgccttccctgccgcgccgcccccggacgccgccagccagggcgcggcatccgtcctcgtcgtcggcgcggggctcgcgggtcttgccgccgcgcgccagctcgtccgcttcggtcttcgagtgctcgtcctcgagggccgcgcgcgccccggtggccgcgtctacacggcccggctaggtgaggacaaggccgccgttgagctcggcggcagcgttatcaccggtatccacgccaacccgctcggcgtgctcgcgcggcagcttgcccttccgctgcataaggtgcgtgaccgctgcccgctctactacccggacggccggaccgtggagaccaggctggataggagcatcgatctggtgttcaacacgcttctcgaccacgccaccaggctccgggagtctctcaatgaggctgcggagaggatctcgctgggggaagctatagacaagctcaggaggctctaccatgtggccaggtcggatgacgagaggatgttattggattggcattttgcaaatctggaattctccaatgccggttgcctatgggagctttcgctcgcgcactgggatcaggacgatccttatgagatggggggagaccattgtttcttagccggagggaattcccggctcatacatgcattgtgtgatggggtgccggtcttgtatgagaagaatgtgacacggattgagcatggagtggacggggttagtgtcacagtggaagaagggcagatttttcaggctgatatggtgctatgtaccgtgccccttggggtgctcaagagtgggagcatagtatttgacccagagttgcctgaagagaagcttggggcaataaagaggttggggtttgggttgttgaataaggtagccatggtgtttcccagtgtgttttgggatgaagatattgacacatttgggtgtttgaataaggagagcagcaagcgtggagagttctttctcttctacagctaccacactgtctctggtggtgcggttcttgtcgcacttgttgcaggagaggctgctttagagtttgaaaaggttgatcctgttgttgcacttcatcgagtacttggcattctaaaaggtatctatggcccaaaaggcgttactgttcctgatccggttcaatcagtttgcacgagatggggcagtgatcctttttgctcaggttcatactcgcacatcagagttgggtcttccggtgctgactatgacattctttccgagagtgtgaatgaccgactcttcttcgctggagaagccacgaaccgcgcgtaccctgcaaccatgcacggggccctattgagcgggttaagagaagcttccaaaatctatcgtgcctcagatagcttagtgaattatgaccagaagaagaattcactgccaaagagcctcaaaccaccagatggtgcccttctagatctcttcttggagccggacctagcattcgggagattctcgttcgtgttctcctcactgacacccgatgatccagcggctccagggttacttcgggtttcgctcgacaagcgtttccttctgcagcccaattataattcagagctaaagggcgaccaaaaggatcacagccacagccacgcatctggggccttccatctgtacgccgctgtctctcgggagcaggcagatcggctacgaaggtcaagcgaagatgacagaactaggttaggagtattatgcaaggatcgtactgtaaagctaatgggttacgatagtacttgcgacgtaggtagcgatctgatctcgagcatcttgggtgcgcggaaagccaggaaactgctgcagcacccaaagaactccaagatcccgcgttgatgtgtacccggttcctctctttttttcttctttgtagaacagaatgcattcttttgttatgtacacaaggtacgaagggccggccgccggctggtggagctcagattttgctgtggcgtgtacaggctacgaactgtgacgcttcggcaggaacgtaactgagatcctccatgttctggtcctcacttgtaaaaattgccgttcatgtgacttcagacttcagttgattagatattgttctgtggatttaactgcaggcaccattgtgatcttgctctatctatctttcgcctgagta

SEQ ID NO: 2055 - DNA, 965 bp, Saccharum officinarum
ccgtgccattccattccaccaccagtctatatatcgcattcccaaattttcctcatcggcttcgcttcccccaaatcgaatccccatcgctcggctccatccatggcgactctcaccatgcagccgatcggtcccacccccgcccctgctgcgcaggaagaccagaggaagggggagaatcctcctaccgcggatggtaccgatttgagtgacatcgagtcgggctgggttatcctcaagaactcggatattgtttccgcggatttggcagccgccgccgtcagtggcggtcagcgtctaggctcttccacgattcctagctgggcacggtgggttgtcggaggtgtggtgtacacggtcgtgccattctacaacagagttaggcatctcgaagacgagaccgtggggttcgtggagaatgctgtggaggttgtggagcatatagctgaagtaacagagaagctagctgcgaatgtggctaagcaacttcctgaagatgggtctctgcagaaagcagtagaggaggttgagcacattgctgaggtagtggatgatgatgcagagaagtttgaagcagtcgctgaaaagatcgacaaggtcagtgatgagattgatgctgctgtggagccagtcatcgaagagcttgaaaaggaactcgatcagagtacaacgtccgacgatggagttaacacgaagaattgatcaacaacctgttaggagtgctcctcgttgtacatagtgtgtgtactattattttcttctcttcactttggaaaaactgcttgtacatatgtatggtgttgtgtatgaattgcaccccaccatgatcatagcaaggcatggagattgtgtgccgggtgctcatagatgaagaaccgaagactgttatgatgttgaactagaaaaaatatccaagaattattggtactctatcaagtcattatgcaaaaataaatacatattgg

SEQ ID NO: 2056 - DNA, 953 bp, Zea mays
gaggccccctccccattctatctcattcccaattcctcatctgcttcgcttccccccaaatcgaatcctcatcgctccgtctatggcgactctaaccatgcagccgatcggtcccacccctgctccggctgcgcagcaagacccaagcaagggagagaatcctcctaccgtggatggtaccgatctgggtgacatcgactcgggctgggttatcctcaagaactcggatgtcgtttccgcggatttggcagccgccgccgtctgtggcggtcagcgtttaggctcttctacgattcctagctgggcacggtgggttctcggaggtgtggtttacacgctcgtgccgttctacaacagagttaggcatctcgaagacgagacggtgggattcgtggagaatgctgtggaggttgtggagcatttagctgaagtaacagagaagctagctgcgaatgtggctaagcaacttcctgaagatgggtctctgcagaaagcagtggaagaggttgaacacattgctgaggtagtggatgatgatgcggagaaggttgaagcagtcactgaaaagatcgacaaggtcagtgatgagattgatgctgctgtggagccggtcatcgcggagcttgaaaaggaactcgatcagagcacaacctcagacgatggagttgacacaaagaattgatcaactgcatgttaggtgtgctcttcattgtacatagcgtgtgtactgttgtttttcttctctctctcctctttggagaaactgcttgtacatatgtatgtatggaccatgaagattattggtactctatcaagtcactatccataaataaatacacgttggcctgtgaaaaaaaatatactagctcgcagagctgtgaattattgattcgcattcgtttctatgtaaattgttgccctcccgttttgtctttttgtatcacaaaaacaat

SEQ ID NO: 2057 - DNA, 995 bp, Setaria italica
caccagtctcaatccaatcaagcgtctcctcatcggcttccctcaaatcgatccccatcgctccgctccatccctccatggcgaccctcaccatgcagccgatcggccccagccccgccccggctgcccaggaagaccagaggaagggggagaaccctgctgcggatgctgccgatttgagtgacatcgactcgggctgggttgtcctcaagaactcggatatcgtctcggcggacttggccgccgccgccatcagtggcggtcagcgtttaggctcttcagcgattcctagctgggcacgatgggttcttggaggtgtggtgtacacggtggtgccattctacaacagagttaggcagcttgaagaagagacagttgggtttgtggagaatactgtggaggttgtggagcatgtagctgaggtaacagagaagctagctgcaaatgtggctaagcaacttcctaaagacgggtctctgcagaaagcagtggaagaggttgagcacattgctgaggtagtggatactgatgcagagaaggttgaagcagtcactgagaagatcgacaaggtcagtgatgagattgacgctgctgtggagcctgtcatcaaggagcttgaaaaggaactcgaccagggcacaacatccgacaatggagttaacgcacagaagtgatcagtgggctgttaggagtgctcctcaatgtacatagcgtgtgtaatgttgttttttcttctctcctcttttgaaggactgcttgtacatatgcgtgttgttgtgtatgaatttcaccctgccatgatcgcataataaggtgtgaagattgtgcgcggggtggtcgactggtcgtagatgaagtgtggagaactgaaaacagttcagacattcgtttcaaaaaaaaaaacagttcagacgtggaactagattaatattcatgaattatttgtacactatcaaatcattacatacataaatgcatattggcctcttcgcaaa

SEQ ID NO: 2058 - DNA, 2067 bp, Panicum virgatum
tgatatcttagtgaagcatgtatctaggcttgaaagggaaaagattgattacgaaaagaggaatccattgggtgaaggatggaccaacgtgccacatgatcagcgaaagaatggtaacaatgcccaaccatttgaaagtttagatcaagtcttagtgaagcatgtaagtcgactagaaagggaaacaatggaatctgagaagaggaatgcagtgggaggaggaaccaacatgcagaatgacaagcaaaggccctgtaacagtgccattgctgcggacagtttagatcaagtcttagtcaaacacatatccaggcttgaaaaggagaagattgagcatgaaaaggagggaggtatgatcttgctaaagaaaaatcatgcacaatgtggaaccaacatgcagaatgacaagcaaaggccctgtaacagtgccattgctgcggacagtttagatcaagtcttagtcaaacacatatccaggcttgaaaaggagaagattgagcatgaaaaggagggaggtatgatcttgctaaagaaaaatcatgcacaatgtacagatggaggagcagcaggaagtttgactgacatctttgtcaagcgtccaacaaaacttgagcaggccaagctagcatctgctgccgaagaaacaccactcagtggcttaaaccctgtggaagagcgtagaagagcaagagagaaggaacttctggatgcgtggggaggaatgggccttgggaactcgatgaagcctcgtgtgtcaaagattgagagagctaaggctgcttggaggatagctgaggatgaacagaagcagatggttgctgcaagggagctatgacttgtctgaatcggatggtgctccagctcggaggaaaaatgcaagctctgaactccttccttctgccgaacacaactagcgattgtttgttaggatcagtatccagggcatcttgacctgccgtaaagcttgacattgtcaacaggttactagatgatatccacgatagatttgctagactctactattatttatcccccgcttgttgctcaatgcagttgtctagctgcagttactaattcttttttgtatgcatgcatttttatcaaaaaaaaaaaaaaactcaatccaacccagcctctcctcaccagcttcccccaaatcgatccccatcgctccgctccatccatccatggcgaccctcaccatgcagccgatcggccccagccccgccccggctgcccaggaagaccagaggaaggcggagaaccctgctgtggatgctgccgatttgagtgacatcgactcgggctgggttgtccttaagaactcggatatcgtttcggcagatttggccgccgccgccgtcagtggcggtcagcgtctaggctcttccacgattcctagctgggtacggtgggttattggaggcgtggtgtacacggtcgttccattctacaacagagttaggcagcttgaagaggagacagtggagtttgtggagaattctgtagaggttgtggagcatgtagccgaggcaacagagaagctagctgcaaatgtggccaagcagcttcctgaagatgggtctctgcagaaagcagtggaggaggttgagcacattgctgaggtagtggatgctgatgcggagaaggttgaagcagttgctgagaagatcgacaaggtcagcgatgagattgacgctgctgtggagcctgtcatcgaggagcttgaaaacgaactcgatcagggcgcaacgtccgacagtggcgtcaacgcacagaagtgatcagtggtctgttaggagtgctcctcaatgtgcatagcgtgtgtactgttgttttttctcctctcctctcatttgaagcaatgcttgtacatatgcatgatgttgtatgaattgcacccggccaccatcatagtaaggtgtgaagattgtgtgcggggtgctcgtagatgaagccgtggagaactgaagacagttcagatgtggaactagatgaatattcgtgaattattggtatgctatcaaatcattacgtaaataaatacatactggcccgtgaacattt

SEQ ID NO: 2059 - DNA, 962 bp, Panicum virgatum
ctcaatccaaccctgcctctcctcatcggcttcccccaaatcgatccccatcgctccgctccatccatccatccatggcgaccctcaccatgcagccgatcggcgccagccccgccccggctgcccaggaagaccagaggaaggcggagaaccctgctgtggatgctgccgatttgagcgacatcgactcgggctgggttgtcctcaagaactcggacatcgtttcggcagatttggccgccgccgccgtcagtggcggtcagcgtctaggctcttccacgattcctagctgggtgcggtgggttgttggaggcgtggtgtacacggtcgtgccattctacaacagagttaggcagcttgaagaggagacagtggagttcgtggagaattctgtagaggttgtggagcatctagctgaggcaacagagaagttagctgcaaatgtggccaagcagcttcctgaagatgggtctctgcagacagcagtggaggagattgagcacattgctgaggtagtggatgctgatgcagagaaggttgaagcagtcactgagaagatcgacaaggtcagcgatgagattgacgctgctgtggagcctgtcatcgaggagcttgaaaacgaacttgatcagggcgcaacatcagacaacggagtcaacgcacagaattgatcagtggtctgttaggagtgctcctcaatgtgcatagcgtgtgtactgttgttttttcttctctcttctctcatttgaaggactgcttgtacatatgcttgatgctgaatggctcgcacccggccatgatcatagtaaggtgtgaagattgtgtgcggggtgctcgtagatgaaccgtggggaaccgaagacagttcagatgtggaactagatgaatattcatgaattattggtatgatatcaaatcattacgtaaataaatacatattggcctgtgaacatttactgatt

SEQ ID NO: 2060 - DNA, 2087 bp, Sorghum bicolor
tccacggcgaagcgcctcgaagccaaagcttccacattccacacgccaacaaaagcagcaaagcaaaagctaccgtcaccgacccgacgttccaagaaacgaaacggccatgatgatgatgggagagggagcttacgcgccgccgtggcagcagtcaccggcggccagcatggacgcggatgaggcggcgtcgccgtacgccctcctggcggcgctgcagcattacctgccgtccaacgaggtgtcggcggcggcggcgccgtacgacgaggacgacgaggaggcggccctggcggccggggtggacgcgtacgcctgcgacgagttccggatgtacgagttcaaggtgcggcggtgctcccgcgggcggagccacgactggacggactgcccctacgcgcacccgggggagaaagcccggcgccgcgacccgcggcggtaccactactccggcgcggcgtgcccggacttccgcaagggcgggtgcaagcgcggcgacgcgtgcgagtacgcgcacggggtgttcgagtgctggctccacccgtcccgctaccgcacgcagccctgcaaggacggcaccggctgccgccgccgcgtctgcttcttcgcgcacacgccggaccagctccgcgtcctgccgcagcagcagcagtccagcccgaggggcgcgtcggcggcgtcgccgctggccgagtcgtacgacggctcgccgctccgacggcaggcgttcgagagctacctcaccaagagcggcatgatcatgtcgtcgtcgccgaccagcacgctcgtctcgccgccgaggtcgccgccgtcggagtcgtccccgccaatgtcgccggacgctctccgccgcgggtcgtggccgggcgtcggctcgcccgtcaacgaggtgctcgcctcgctgcgccagctccgcctcggcgcgggcggaggctcgccgaggtcagccccatccagcgggtcgtcgttcggcggcggctacccgttcgggtccccaaagtcaccggcggctgggctgtacagtctcccgtccacgccgacctgtaggccgtccccggtgacggtgaccaccgcctccggcgccaccatcatgaccgtggaccgcctcaacctcggactcatcggcgacgaggaagagccggtcatggagagggtcgagtccggcagagccctccgcgagaaggtgttcgagcggctcagcaaagaagccaccgtgcccaacgacaccgccgcctccgccaacgttgagggagcagctccggatgtcggctgggtctccgacctcatcaactgatgagggaaactcatgaaactatcagcatcaaccgtgcctcctctgaaactgtgcttagccatggtaagtgggaagcttggaggcatcactgcacaacaggagaagaaatttcaggggaaaaaacaaaaacaaaaaagatttttttcttagatttctactaagattctcctgatctttctacatatgttcctctctgtgtgaatattcttggatggatggttgttcaagggagggcagggaggtaagaggcaggaagacgggcatgtcagtgaagtgtgaaggtagaagaagcctaggaggagacaagaggtggcagcaaaacatggtgtggggaaaatggatcaagaagacatggcaggcgaccatgcatgtatatgagttatctagatgtacatagcgtatgtgttcgtgtgtgcgtgtgcgtgtgtggaggtgtagcgtggagggaggcgatcatggcggcgatccaagaccggagaagaagaagactgggatttatgtcaccgccggcgcctccggtgaggttatccgggaagcaggcctggaacttctaatttccgcaagcgattccagaaaaagcgtcgtcttttgagttgatgtttactcgcattccagcgttcattctgccttctatttgatgtttaagatcgacgagttgttattactgctctgtaagtttctcaatgtattctccttattgatctactgcttcagcttatggggagcatgtaccttgtaccatgtaatatttttgctgataaggaattaattaagttaaaaaaccgcccttgtt

SEQ ID NO: 2061 - DNA, 2218 bp, Saccharum officinarum
taggacccacgcgtccgagctccccgaagccaaagaaagcttccactagagcacgagatcgcagccacaggccaacaaagcaaaagctgccgtcaccgaccgacgttccaagaaacgaaacgaccatgatgatgatgggagagggagcgcacgcgccgccgtggcagcagtcgccggcggcggccatcagcggcggcagcatggacgcggacgaggcggcgtcgccgtacgccctcctgtcggcgctgcagcattacctgccgtcgaacgaggtggcggcggcggcgtacgacgaggacgacgaggaggcggcggccctggcggccgtggacgcgtacgcctgcgacgagttccggatgtacgagttcaaggtgcggcggtgcttgcgcgggcggagccacgactggacggactgcccctacgcgcacccgggggagaaggcccggcggcgggatcccaggcggtaccactactcgggcgccgcgtgcccggacttccgcaagggcgggtgcaagcgcggcgacgcgtgcgagttggcgcacggggtgttcgagtgctggctccacccgtcccgctaccggacgcagccctgcaaggacggcacagggtgccgccgccgcgtctgcttcttcgcgcacacgccggaccagctccgcgtgctgccgccgccgcagcagcccagcgccagcccgaggggcgcggcggcggcggcgtcgccgctggccgagtcgtacgacggctcgccgctccgccggcaggcgttcgagagctacctcaccaagagcggcatgatcatgtcgtcgtccccgaccagcacgctcgtctcgccgccgaggtcgccgccgtcggagtcgtccccgccaatgtcgccggacgcgctccgccgcgggtcgtggccgggtgtcggcggctcgcccgtcaacgaggtcctcgcatcactgcgccagctccgcctcggcggcggaggcggctcgccgagatcggcgccttccggcggcgggtcgttcttggctggctgcggctacccgttcgggtccccaaagtcaccggccgggctgtacagtctcccgtccacgccgaccaggccgtcccctgtgacggtgaccaccgcctccggcgccaccatcatgaccgtggaacgcctcaacctcggactcatcggggacgaggagccggtcatggagagggtcgagtccgggagagccctccgcgagaaggtgttcgagcggctcagcaaagatgccaccgtgcccaacgacaccgccgccgcctccgccaacgttgagggagcggccgccccggatgtcgactgggtctccgacctcatcaactgagggaaactcatgaaactatcaggatcgaccgtgcctcctctgcatggtgcttactgcttatccgtcaaggtaagtgcgtgggggaagcttggatggaggcatcactgcacaacaggagaagaaagttcaggaaaaaaaaaaaaaaaaaagttttttttagatttctactaagattctcctgatccttgtacatatgttcctcctgtgaatattcttggatggttgctgaaggaaggggaggcaggggagggttgagttgttctggggtttcagatgatggcatgtcagtgaaggtagaaagaagcccaggagacaagaggtggcagcaaaacatggtgggaatggatcaagaagacatggcaggcgaccatgcatgtatatgagttatctagatgtacaaagtgtctgtgttcgtgtgcgtgtgtggaggtgtagcgttggaggcgatcatggcggcgatccaagaccggagaagatgactggatttatgtcaccgccggcacctccggtgacgtttccggcaggcaagcaggcctggaacttctattttccgcgagcgattccagaacgtcgtcgtcttgagttgatgtttactcgcattccagcgttcattctgctatttgcctttaagatcgacgagttgtttattactgctctgtaattttctcaatgtatttccttattgatctactgcttctgcttatgggaagcatgtaccttgtaccatgtaatatttttgctgataaggaattaattaaaaccgccaaaaaaaaaaataaaatacctctcaatatcaattaataattaaaacaaatccatcatatactactaatcctcataatataatcttttatatcttaataaatggacactctttttaagat

SEQ ID NO: 2062 - DNA, 1883 bp, Zea mays
tccccgtccacgcctccacggccaagcgcctcgaaggcaaagcttccactagccacaggccaacgaaatcgcaaagcgaagctacggccaccgaccgacgttccaagaagcgaaacgaaacgaaaatgatgatgatgatgggagagagagcgcacgcgcctccgtggcagcgctcgccggcggccagcggcgtcacggacgcggacgacgcgtctccgtacgccctcctagcggcgctgcagcattacctgccgtcgaacgaggtggcggcgtacgacgaagacgacgaggaggcggccctggcggcggcgaccgccgccgtcgacgcgtacgcctgcgacgagttccggatgtacgagttcaaggtgcggcggtgctcgcgcgggcggaaccacgactggacggcctgcccctacgcgcacccgggggagaaggcccggcggcgcgaccccaggcggtaccactactccggcgccgcgtgcccggacttccgcaagggcgggtgcaagcgcggcgacgcgtgcgagttcgcgcacggggtgttcgagtgctggctccacccgtcgcgctaccggacgcagccctgcaaggacggcaccggctgccgccgccgcgtctgcttcttcgcgcacacgccggaccagctccgcgtgccgccgccgcggcagtccagccctaggggcgcggcggcggcggcgtcgccgctggccgagtcgtacgacggctcgccgctccgccgccaggcgttcgagagctacctcaccaagagcggcatcgtgtcgtcgccgccgccgaccagcacgctcgtctcgccgccgaggtcgccgccgtcggagtccccgccaatgtcgccagacgccgccgccgcgctccgccgcggctcgtggccgggcgtagggtcgcccgtcaacgaggtcctcgcgtcgatgcgccagctgcggctcggcggcggctcgccgaggtcggcgccttccggcgggtcgttcttgggcggaggctacccgttcgggtccccaaagtcaccggccgggctgtacagcctcccgtccacgccaaccaggccgtccccggtgaccgtgaccaccgcctccggcgccaccgtcctcaccgtggaacgcctcaacctcggactcatcggggacgaggagccggtgatggagagggtcgagtccgggagagccctccgcgagaaggtgttcgagcggctcagcaaagaagccgccgttcccagcgacaccgccgcatccgccaacgttgagggagcggcccccgccccggatgttggatgggtctccgacctcatcaactgagggaactcgtggaactaccagctcagaagttcaggggggaataacaaaaaaaaagtaggaagatttttaattttttagttctttacaaatattttcctggtccttgtacagatgttcctgctttgtgaatagtcttggatggttgtcgaagggaggggaggcagggaatggttgatttgttatgaggtttcagatgatggcatgtcggtgaaggagacaaggtgcccagcaaaccatggtggaaaatggatcaagaagacatgtgcaggcgaccatgtatacgggttgtctagatgcacatggtgtcttccctgcctgtgaggtgggagcatgggaggcgatcatggcggcgatccaagaccgaacccataatttccgcgagcgattccagaacgaacggcgtcttgagttgatgttcattctgctatttgccttttaagattcgacgagttattactgctctgtgatttttctcaaagtatttccatattgatctatgcatgcatgtacaatgtcagtactgctactttcgctgatactccgtaacaaaattaattaaaaccggcgttgcta

SEQ ID NO: 2063 - DNA, 2003 bp, Panicum virgatum
caagcctcctcaaagagagttcgagatcgcagctagagaccaccagcaaagcaaccgccaccgacgttccaagaaacgtaaccgaccatgatgatgatgggagagggagcgcacgcgccgccgtggcagcagcagccgccggccagcgccggcatggacggggacgacgcgtcgccgtacagcctcctggcggcgctgcggcattacctgccgtcgaacgaggccgcggtggcggcgtacgacgaggacgatgaggaggcgtctctggcggcggtggacgcctacgcctgcgacgagttccggatgtacgagttcaaggtgcgccggtgctcgcgcgggcggagccacgactggacggactgcccgtacgcgcacccgggggagaaggcccgccgccgcgaccccaggcggtaccactactccggcaccgcgtgcccggacttccgcaagggcggctgcaagagcggtgacgcctgcgagttcgcgcacggcgtgttcgagtgctggctccacccggcgcgctaccggacgcagccctgcaaggacggcaccgcctgccgccgccgcgtctgcttcttcgcgcacacgccggaccagctccgcgtcctgccgccgcagcagtccagctccagccccaggggcgccgcgccgtcgccgctcgccgagtcgtacgacggctcgccgctccgccgccaggcgttcgagagctacctcaccaagaccggcatcatgtcctcgtccccgacgagcacgctcgtctcgccgccgaggtcgccgccctcggaatccccgccaatgtcaccggacgccgccggcgcgctccgccgcggctcctggccgggggtcggctcgcccgtcaacgaggtcctcgcctcgctgcgccagctccgcctcggcggcggcggctcgccgaggtcggcgccgtccggcggctcgttcctggccggctacccgttcgggtcccccaagtccccggccgcgctgtacagcctcccgtcccccccgaccagaccgtccccggtgacgttgaccaccccctccggcgccaccgtcatgaccgtggagcgcctcaacctcgggctcatcggggacgaggagccggtgatggagcgggtggagtccgggagagccctccgcgagaaggtgttcgagcggctcagcaaagaagccaccgtgcccaacgacaccgccgccgccgccaacgcggagggcgcggcccctgccgccgccccggacgtcgggtgggtctcggacctcatcaactgaggggactcgatcgagaagccagcaccatccgtggctcctctgaacattgcccatccattgtaagtgggggaagaggaggcagcgctgcacatcaagagaagaaaacccaaaagcaaaactaaaaaaaaagttattttttcttcttatttccaagattctcccgatccttgtacatgtgttcttccttcctatgtgaatattcttggatggttgttggagggaggggaggcagaaaagggttagatttgttttggggcttcagatggtggcatgttggagggagaaggagacaagttgccaacaaaacatggtagaaatggatgaagatgcggcgaaccaccgtgtatatgggttgtgtagatgtgcgtagtgtctggtgtttgtgtgtgtgtggagggggagcatgggaggcgacgatggcggcgatccaagactgaagaaggtgaccggatcctgcagatccacaccgccggccggcagcccggccgcctccggtgacctcgccgggcggtagcctggggagcttctaatttctacgaccgattccagaacgtcctaggttgatgtttactattttcttattccaccgttgattctgtaattcactctgtattttaccctatgtattttccttaattgatctagtactgcccacgaagcatgtacccttgcaccatgtactatttttgctgataaggaatcaaaaccgccatgttaattactcttttctcttccct

SEQ ID NO: 2064 - DNA, 2033 bp, Panicum virgatum
gcctcctcaaagagagttcgagatcgcagctgcctccagaccaccagcaaagcaaccgccaccgacgttccaagaagcgtaaccgaccatgatgatgatgggagagggagcgcacgcgccgccgtggcagcagcagcagcagccggcggccagcgccggcatggtggacggggacgacgcgtcgccgtacagcctcctggtggcgctgcggcatttcctaccatcgaacgaggccgcggcggcggcgtacgacgaggacgacgaggaggccctggccgcggtggacgcctacgcctgcgacgagttccggatgtacgagttcaaggtgcgccggtgctcgcgcgggcggagccacgactggacggactgcccgtacgcgcacccgggggagaaggcccgccgccgcgaccccaggcggtaccactactccggcaccgcctgcccggacttccgcaagggcggctgcaagcgcggcgacgcctgcgagttcgcgcacggggtgttcgagtgctggctccacccgtcgcgctaccggacgcagccctgcaaggacggcaccgcctgccgccgccgcgtctgcttcttcgcgcacacgccggaccagctccgcgtcctgccgccgcagcagtccagcgccagccccaggggcgctggcgccgcgccgtcgccgctcgccgagtcgtacgacggctcgccgctccgccgccaggccttcgagagctacctcaccaagaccggcatcatgtcctcgtccccgaccagcacgctcgtctcgccgccgaggtcgccgccctccgagtccccgccaatgtcgccggacgccgccgccggcgcgctccgccgcggctcctggccgggggtcggctcgcccgtcaacgaggtcctcgcctcgctgcgccagctccgcctcggcggcggcggctcgccgaggtcggcgccgtccggcggctcgttcttggccggctacccgttcgggtcccccaagtccccggccgcgctgtacagcctcccgtccaccccgacccggccggccccggtgacggtgaccaccccctccggcgccaccgtcatgaccgtggagcgcctcaaccttgggctcatcatcggtgacgaggagccggtgatggagcgggtggagtccgggagagccctccgcgagatggtgttcgagcggctcagcaaagaagccaccgtgcccaacgacgccgccgcctccgccaacgctgagggcgctgccccagccgccgccccggacgtcggctgggtctccgacctcataaactgatgagggagctcgagaagccagcaccatccgtggctcctctgaacattgtccatctatggtaagtgggggaagaacctgagaggcagcgctgcacaacaggggaagaaaatccaaaagcaaaacaaaaaaaaaagatccgagttattttttcttcttatttccaagattctcctgatccttgtacatatatgttcttccttcctatgtgaatattcttggatggttgttggagggaggggaggcagagaagggttgatttgttttggggcttcagatggtggcatgtcagtggagggagaaggagacaagttgccaacaaaaacatggtagaaatgggtgaagatgcggcgaaccaccgtgtatatgggttgtgtagatgtgcatagtgtctggtgttcatgtgtgtgtgtgtgtgtgtgtgtggaggtggagcatgggaggcgaccatggcggcgatccaagactgaagaaggtgaccggatcctgcagatccacgccgccggcagcccggccgcgcctccggtgacctcgccgggaggcagcccggggagcttctaatttctacgaccgattcgaacgtcctaagttgatgtttactgctatttcttattccgccgttgattcactctgtattttgcccaatgtattttccttaattgatacactgcctagtacgaggcgtcgtgtacctttgcaccatgtactatttttgctgataaggaatcaaaatcgcccatgttaattactc

SEQ ID NO: 2065 - DNA, 1886 bp, Zea mays
ccacgcccgccagttataaatagccaagcgtatggttggggccacagacagagagagaccctcccctctggcggtctggcctccgtccccacaaccaaactgcgcgagcgcgaaggagcacggacagcacagcggcacagcgcagacgcggcggcggcccaatccggagggcgcgaccgttcctttttctgtccgtcccttcctccctcccttcgttcgttggcctcctcctcctgttcctcttcttggcgcggcaagaggaggaatagcaggagaggggcgccccgatccatagggcaacgaccaacggcacgccgccgccgccgctgccacgacaagatggcgcggttcatccttagcctgatggagctcggggtcagcgccaccgtgcacatgctcttcggcctctacgtcttcagcacggccgtcgccgcagacatctcgcaggcggccgcggcgtcggggtgtctcctactgcgccggccaccccccgcggcggcgggctcgaccgggggagcgctcgtcgacgtcgccgcggcgggtgagagcgacgagctcaggggcgccgcgcccgtcatcctcgatgcatcgccgccgcccatcgtcctcgtccacggcatcttcggcttcggcaaagggaggctcggtggcctctcctacttcgccggcgccgagaagaaggacgaccgcgtgctcgtgccggatttggggtcgctcaccagcatccatgacagggcgcgtgagctcttctactacctcaagggtgggcaggtggactacggcgaggagcacagcaaggcttgcggccacaacaggtttggaagaatatatcacacagggcactatcctgtgtgggacgagcacaacccagtgcattttgtggggcactctgctggcgcgcaggttgtgagggtgctgcatcagatgcttgccgacaaggctttccctggtcatgatacttctgaagattgggttgtaagcctgacttccttgtcgggtgcacttaatggaaccacaagaacttactacgatggcatgctggtcgtagatggtaggtccatgaaatctatctgtcttcttcagctctgccggctcggagttattgtctacgattggctagacattccttggctgaagaattactacaattttggttttgaccactatgagatgtcgtggaggaaagtaggcttttcaggtctaattaatctactgctggggcacacgggcccatttgccagcggggattggattctacctgacctcacaatccaaggatccatgaaactaaactctacacttaggacctttcccaatacattctacttcagctatgctacaaagaaaacaagaaaaatatttggaattacagttccttcaagtgttcttggagtgcaccccattctctttctgagagtcctccagatgtgtatgtggcggcaccctcaaaatgcacctctgccttacaaaggatacagggatgaagattgggaagacaacgatggggctttgaacacaatctctatgacacacccccgcattcccatcgagcatccacaccattttgtagtcgatgattctgactgccatcctttgcaacctgggatatggtattacaagattattgaagctgaccacattctattcattgtgaaccgggaaagagctggagtgcagtttgatttgctgtacgatggcatttttcagcgctgcaggaaacatgcctttaggaagagcccacctactgtaccaaacgaaacgagccgatagcaaaactaagctgaagtatgtgtaggtagtacataggaagaaacaaggtgccacgacattttcattaactgtaaattacattgttgattgaacggcaataacatatttgcttctcc

SEQ ID NO: 2066 - DNA, 2197 bp, Setaria italica
ggaggggggcgcgaccggttcggttcgttggtccgctcgtctcctcctcctattcctcttcttggggggggacgccaaggagaggaatagcaggagagggagggaggcgggggtgagccagcgggcgacgaccgacgacgaccaacggcacgccgccgttgttgtcggcgtttgtaggccaggccgccgcggccgctcggtcgggctgaggaggccgttggtgcgaccgacgagggaagatggcgcggttcatcctgagcctgatggagctcggggtcagcgcggcggtgcacctcatcttcggcttctacgtcttcagcacggccgtggccgccgacatctcgcaggcggccgcggcatccgggtgcctcctgctgcgccggccgccaccctccgcgggcgcgggcgagggggcgctcgtcgacgtcgccgcggccggggagcgcgacgagcgcaggggcgccgggcccgtcgtgctcgacggctcgccgccgcccatcgtcctcgtccacggcatcttcggcttcggcaaggggaggctcggggggctctcctactttgccggcgccgagaagaaggacgaccgcgtgctcgtgccggatttggggtcgctcaccagcatccatgacagggcgtgcgagctgttctactacctcaagggcgggcaggtggactacggcgaggaccacagcaaggcttgcggccacacgaggttcgggagaatctatcacacagggcactatcctgtgtgggatgaccagaacccggtgcactttgttgggcactcggccggcgcgcaggttgtgagggtgctgcatcagatgctagccgacaaggctttcccaggtcatgatacttctgaagactggattctaagccttacttccttgtctggcgcacttaatgggacaacgagaacttactatgacggcatgctggttgaagatgggaggtttatgagatctatctgtcttcttcagctctgccggcttggagttattgtctacgactggctggacattccttggctgaagaattattacaattttggttttgaccactatgagatgtcacggaggaaagtagggttttcaggtttaattgatctgctgctggggcgcactggcccatttgccagcggagattggattttacctgacctcacaatccagggatctataaagcttaactctagtctgaggacatttcccaatacattctacttcagttatgctacaaagaaaacaagaaagctatttggaattacagtgccttcaagtgttcttggagtccatcccatgctctttctcagagtccttcagatgtgtatgtggcggcaccctcagaatgctcctctgccctacaaaggatacagggatgaagattgggaagacaatgatggggctttgaacacgatctctatgacttacccacgcattcctatagagcatccacaccgttttgtagtggacgattctgactgccatcctttgcaacctgggatatggtattacaagattattgaagctgaccacattctattcattgtgaatcgggaaagagctggagtgcagttcgatttgctgtacgatggaattttccagcgctgcaggaagcacgcatttaggaagagcctgcctactgtaccaaatgaaacgagtcaatagcagattaatcccaaaccgaagtatttataggttgtagagaggaacaaaggaggaaccacagtgttttcagaactgtaaattacattgctgatttgacgagcatcgcgatctctcctgttcttggaagaggggctcatggaggctggtggctgggaacttgcatccttccttggccctctgaccgcctagtgaacgcttcggcttcactgaccttatactccaatgcaaggaagcttttggatttgccttccagtattgattctccatggaacgaattgatcaacggctgcagttactcattacctgactgtggttatgataggttcacagatatgtttaaaaagtgatttgtagatattgagtgttgcgtggatggtgtaacattgtaaccagcagggttcggtgaaaagaagtggttcatgaattattatttacattctttggcaattatcaggattggatctttgtttggtctgaagtctcctggcaggcagctggaaatacagatataattttttttcggaagatga

SEQ ID NO: 2067 - DNA, 2059 bp, Oryza sativa
aggggttcgcggcgctgttgctggctgaccccaccaaacttagcgagggggaagggagaacgggggtgaacagcgcgacggacgacggttagcgagcgagcgacgacgcaacggaagaagaaaaagaggaggacacggcggcgcacgggagggaggaaagaagaggaggacgacgacgcgcgcgcgcgcgcgccaatccggaggcgccaccaccggttcgtcgtccctcccccctccttcctcctgttcctcttcttgtgaggccgccaggaagagggataggagaggaggcggaggcggcgcgacctgacccgtcgcgcgccagcagcggttgcgacggcgtcggcggcgtggttgtgtagatagattggtttggtttggttgccggggaagagagagagagaagagagaggggatggcgaggttcatcctgagcctgctggagctcggcgtcagcgcgacggtgcacctgctcttcgggctctacgtcttcagcacggccgtcgcggcggacatctcgcaggcggcggcggcctcggggtgcctgctgctgcgccgcccggcggcgccggggctcgtcaacgtcgccgcggccggggaggaggaggagcggaggggcgccgcgcccgtcgtgctcgacggctcgcctccgcccatcgtcctcgtccacggcatcttcggcttcgggaaagggaggctcggcgggctctcctacttcgccggcgccgagaagaaggacgaccgcgtgctcgtgccggatttggggtccctcaccagcatccatgacagggcgcgcgagctgttctactacctcaaaggagggcaggtggattatggcgaggagcacagcaaggttttcgggcacacgcggttcgggaggacgtatgacacaggacattacccggtctgggacgagcaaaacccggtgcactttgtcgggcactcggccggcgtgcaggttgtgagggtgctgcatcagatgcttgccgataaggctttccctggacatgatacttctgaagactgggttcttagccttacttccttgtcgggtgcgcttaatggaaccactagaacttactatgatggcatgctggctgaagacggaagatccatgaaatcaatctgtcttcttcagctctgccggattggagttatcgtctatgattggctagacattccttggctgaagaattactacaattttggttttgaccactttgagatgtcatggaggaaagtgggcctctcaggtctaattgatctgttgctggggcacactggcccatttgcctcaggagattggattctgcctgatcttacgattcaaggatctctaacacttaactctacattgaggaccttcccaaatacattctacttcagttatgctacgaagagaacaagaaagctttttggaattacagtgccttcaagcgtccttggaattcaccccatgctcttcctccgagtcctccaaatgtgtatgtggaggcaccctcaaaatgcacctctaccttacaaaggatacagggatgaagattgggaagataatgatggggctttgaacacaatctccatgacgcaccctcgcattcctacagagcatccaaaccgtttggtagtggatgattctgattgccatcctttgcagcctgggatatggtattacaagataattgaggctgatcacattcttttcattgtaaatcgtgaaagagccggagtgcagtttgatttgctgtatgatggcattttccaacggtgcagaaagcacgcatttaggaggagcccccctactgtaccaaatgaatcgagtcaaagtcaatagcagactacaccaaaaatgaaatctatctagaaagtagaatggaaggaaaaaaaggaatcacgacggtttttctgcttctctttcgcccccggcaaccatgtagatgtaaacaacattgtaaactgtaaattacattattcatttgactatgtgaggagcattgcatacatacctctctgattcctgggagtgagtgaagttcaagctaacagtttggccctgaaaaaa

SEQ ID NO: 2068 - DNA, 2324 bp, Avena sativa
cagagaagagaggaggagggagaaagatcgcacgacgcgccaccgggaggagaccgcaacgagacgctgggagagcgcgacgcgacgtgccgcgacgtccccctcggcctcggccacggccacggcgagcgacagcgagcggtttgccagcggcgaaagcaagggagggggaggagagagataaaacgcagcgcgccggaggcgcagtgacgggctctcctgttcctcttcttgtggggaggcaagaggaggaataggggaggggggcacggaccgcgcggattggtcgctgctcctgtggctcgcgacagcgcgctggtgagcgggtccgcggagagaggggggggggatggcgaggttcatcctcagcctggtggagctcggggtcagcgccacggtgcacctgctcttcggcttctacgtcttcagcaccgccgtcgcggcggacatctcgcaggccgccgcggcgtccgggttccccttcctgcgccgccccgccacgcccggcgccgcggggctcctcgacgtcgccgctgcgggcgaggaggaagagcggaggggcgacgcgccactcgtgctcgacggctcgccgccgcccatcgtcctcgtccacggcatattcggcttcggcaaggggaggctcgggggcctgtcctacttcgccggcgccgagaagaaggacgaccgcgtgctcgtgccggatttgggttcgctcaccagcatccatgatagggcgcgcgagctgttctactacctcaaaggaggacaggtggactatggcccggagcacagccaggtctatggccacacaaggttcgggaggatctatgatacagggcattatccggtgtgggacgagcagaacccggtgcactttgtggggcactcggccggcgcgcaggttgtgagggtgctgcatcagatgcttgctgataaggctttccctgggcatgatacttcggaagactgggttttgagcctgacttccttgtcaggcgcgcttaatggaaccacaaggacttacttcgatggcatgctggctgaggatgggagatccatgagatcgatttgtcttcttcagctatgccggattggtgtcattgtctatgactggctagacattccttggctgaagaattactacaatttcggttttgatcactttgaaatgtcatggaggaaagttgggttttctggtttagttgatctgctgctggggaataccgggccattttcctcaggagattggattctccctgacctgacaatccaaggatcgctaagacttaactctacattgaggacctttcccaatacattctacttcagttatgctacaaagaaaactcggaagctatttggaattactgtgccgtcaagcgtccttggagttcacccaatgctctttctcagagttctccagatgtgtatgtggcggtaccctcaaagcgcgcctctaccttacaaaggatacagggatgaagattgggaagataatgatggggctttgaacacaatatccatgacgcaccctcgcattccagtagagcatcctaaccgttttgtactagatgattctgactgccatcctttgcagcctgggatatggtattacaagatcattgaaggcgatcacatcctgttcatcgtaaatcgggaaagagctggagtgcagtttgatttgctgtacgatggcattttccagcgctgcagaaagcatgcatttaggaagagccccccaaccatgccaaacgaaacaagccaatagaagattacatctcagcgttctaggtagtagtgagcaaaaaacaaggtcgccacacggggcttttttcgcttctctccatctccggcctccatgcatgctgatgtaacttccatattgtgaactgtaaatctcattgtccgttcaatcaaatggcatgcttgatttttccggtttcttggaagcaggagcgttgcagcttgctcttctctgcccttacagcacaatgcacttgaaggaagcttgtacttgagcaggatgttacagatcagcaccagcatctgtccatgaccttaatgagggcttattgagattgactcgcatgtatcccaatgtggctgtacatattacagactgtctcaatggaataactctgtgttggcactttgcacagattttggtgaaagaactgctctatgattctagtgttttaggtagttcatgactaaatctggtacagctattaccagggctggacagctgctgctttttgttagggttctcttgtaatcgtgtgtgacagaagttattagacgcctggactgtcgttttcggctgc

SEQ ID NO: 2069 - DNA, 1805 bp, Brachypodium distachyon
gaggaggatggcgagattcatcctcggcctggtggagctcggggtcagcgcggccgtgcacctgctcttcggcttctacgtcttcagcagcgccgtcgcagcggacatctcgcaggccgcctccgcgtccgggtgcctcctcctgcggcgcccgcccgccgcgggggcgctcgtcgacgtcgcggccaagggggaggaggaggagcggagggccgccgcgcccgtcgtgcttgacggctcgccgccgcccatcgtcctcgtgcacggcatattcggcttcggcaaggggaggctcggggggctgtcctacttcgccggcgccgagaagaaggacgaccgcgtgctcgtgccggatttgggttcgctcaccagcatccatgacagggcgcgcgagctattctactacctcaagggaggactggtggactacggcccggagcacagccaggtttatgggcacacccggtttgggaggatctacgatacagggcattatccggtgtgggatgagcaaaacccgctgcattttgtggggcattcggctggcgttcaggttgtgagagtgctgcatcagatgcttgccgacaaggctttccctgggcatgatacttctgaagactgggttttgagccttacttccttgtcaggcgcacttaatggaaccacgaggacttattacgatggcatgctagctgaagacgggagatccatgaaatcaatttgtcttcttcagctctgccggcttggagttattgtctatgattggctcgacattccttggctgaagaattactacaattttggttttgatcactttgaaatgtcatggaggaaagttggtttttcaggtctagttgatctgctgttggggcacactgggccgtttgcctcgggagactggattctgcctgatctcacaatccaaggatctctaaaaattaactctacattgaggacctttcccaatacattctacttcagttatgctacaaagagaacacgaaagctattcggaattacagtgccctcaagtgtcctcggagttcatcccatgctctttctcagagttctccagatgtgtatgtggcggcaccctcaaaatgctcctctaccttacaaaggatacagggatgaagattgggaagataatgatggggctttgaacacaatctccatgacacaccctcgttttcctacagagcatccaaaccgctttgtactagatgagtctgactgtcatcctttgcaacctgggatatggtactataagatcattgaaggcgatcacattcttttcattataaatcgggaaagagctggagtgcagtttgatttgctgtatgatggcattttccagcgctgcagaaagcatgcattccggaagaaccccccaactgtaccaaacgaaacaagccaatagaagattacacccgaagctccctacagccccttttttctcttctctttgtctccggcctccataactttttgtgaactgtaaattgcattgtccatttgatcagcagtgcaaacttgacttttgctggttcttggaaggaggggttttgcagcttgctcttcgccacccttgcagcataatgcaacgaaggaagtttggaattgatcaggaggaccaggaggttacagctcgaaacccgcatttgtctatgaccttaatggggcttattgagatttaactcacttgtatcccgaggtggtttgtacatatccaagattgtatcaatggaatgttttagcaatggtattggaaagaactgatctatgattgttgtgtttctgagttt

SEQ ID NO: 2070 - DNA, 2228 bp, Triticum aestivum
agttagcgacgcgcaaaggggaaggaagggagggcggacggagaacgggcgcgccagcgtgagacggcgacgacgctgggaggaggagcgcgcgacaggcagcccgccagcggtttgccttgccagcgacggaagggagggaggagaggagaggagagagataaaacgagggcgccccccggccccggcccggaggcgtgaccggctcctctccgactcgtcctcttcctcttcctcttcccgcggggaggcgagggggggaggaggggaaggggggaggcgcggcgcccgcccaccgcgggtcgttggcggagcgcgatggcgaggttcatcctgggcctggtggagctcggggtcagcgcggccgtgcacctgctcttcggcttctacgtcttcagcacggccgtcgcggcggacatctcgcaggccgccgccgcgtccgggtgcccgctgctgcgccgcccgcccccggccgcggggctcgtcgacgtcgccgccgccgcggccgaggaggaggacgaacgcaggggcgtcgtgctcgacggctcgccgccgcccatcgtcctcgtccacggcatattcggcttcggcaaggggaggctcggcgggatgtcctacttcgccggcgccgagaagaaggacgaccgcgtgctcgtgccggatttggggtcgctcaccagcatccatgacagggcgcgggagctgttctactacctcaaggggggacaggtggactacggcgtggagcacagccaggtttatgggcacacgcgcttcgggaggatctatgaaacagggcattatcctgtgtgggacgagcagaaccctgtgcactttgtggggcactcggccggcgcgcaggttgtgagggtgctgcatcagatgctcgctgagaaggctttccctgggcatgatacttctgaagactgggttctgagccttacttccttgtcaggcgcccttaatggaaccacacggacttactacgacggcatgctggctgaagatgggagatccatgaaatcaatttgtcttcttcagctctgcaggcttggagtcattgtctatgattggctggacattccttggctgaagaattactacaatttcggttttgatcactttgaaatgtcatggaggaaagttggtttttctggtttagttgatctcctgctagggaatactgggccgttttcctcaggagactggattctccctgacctcacaattcaaggatctctaaaaattaactctaccctcaagacctttcccaatacattctacttcagttatgctacaaagagaactcggaagctatttggaattacagtaccatcaagcgtccttggagttcaccccatgctctttctcagagttctccagatgtgtatgtggcggcaccctcaaaacgcacctctaccttacaaaggatacagggatgaagattgggaagataatgatggggctttgaacacaatctccatgacgcaccctcgcattcccatagagcatcctaaccgttttgtagtggatgattctgactgcaatcctttgcaacctgggatatggtatcacaagatcattgagggtgatcacattcttttcattgtaaatcgggaaagagctggagtgcagtttgatttgctgtatgatggcattttcgagcgctgcagaaagcatgcatttaggaagagcccccctaccatgccaaacgaagcaagtcaatagaagattaaactaagcattctaggtagtagtgaggaagaaacaaggtggccatggagcttttttcgcttctcttcatctccggcctccatgcacttggatgtaacttcaacattgtaaactgtaaattaatttgtccatttgagcaaatggcacgcttgataccgccggttcttggaaggaggggttttgcaacttgctttccgctgcccttacggcacaatgcaaggaaggaggggttttgcaacttgctttccgctgcccttacggcacaatgcaaggaaggaagcttgtaatcgagcaggaggttacagatcaataccagcatttatctatgaccttaatggggcttgtacatattaaggattgtatctaaattgtatccatggggctactttgtatgttaggcaatggttttgacggaagagctggtctatgattgcactgtttgtttcagtgagtttgtcatttgaattgggtagcaattataagggttggatctc

SEQ ID NO: 2071 - DNA, 1748 bp, Panicum virgatum
ggcctccgggtccttcctgctgcgccgcccgccgccgccccccgcggccgagggggcgctcgtcgacgtcgccgccgcgggggagcgcgacgagcgcacgggcgccgcgcccgtcgtgctcgacggctcgccgccacccatcgtcctcgtccacggcatcttcggcttcggcaaggggaggctcggcgggctctcctacttcgccggcgccgagaagaaggacgaccgcgtgctcgtgccggatttggggtcgctcaccagcatccatgacagggcgcgcgagctgttctactacctcaagggcggccaggtggactatggcgaggatcacagcaaggcttgcgaccacacgcagttcgggagaatctatcctacagggcactatcctgtgtgggacgaacagaaccccgtgcactttgtcgggcactcggcaggcgctcaggttgtgagggtgctgcatcagatgctagccgacaaggctttcccaggccatgatacttctgaagactggattctgagccttacttctttgtcgggcgcactcaatgggacaacgagaacttactatgacggcatgctggtcgaagatggcaagtccatgagatctatttgtcttcttcagctctgccgtcttggagttattgtctacgattggctagacattccttggttgaagaattactacaattttggttttgaccactatgagatgtctcggaggaaagtaggattttcgggtttaattgatctgctgctggggcacaccggcccatttgccagtggagattggattttacctgatctcacaatacagggatctataaaacttaactctagactgaggacctttcccaatacattttacttcagttatgctacaaagaaaacaagaaagctatttggaattacagtgccttcaagtgttcttggagtccaccccatgctctttctcagagtccttcagatgtgtatgtggcggcaccctcaaaatgcacctctgccttacaaaggatacagggatgaagattgggaagacaatgatggggctttgaacacaatctctatgactcacccacgcattcctatagagcatccacaccgttttgtcgtggatgattctgactgccatcctttgcaacctgggatatggtattacaagattattgaagctgaccacattctatttattgtgaaccgggaaagagctggcgtgcagttcgatttgctgtatgatggcattttccagcgatgcagaaagcatgcatttaggaagagcccacctactgtaccaaacgaaacgagtcaatagcagataatcccaaagcaaagtatttctaggttgtagacaggaacaaatgaggaaccacagcgttttcgtaagctgtaaattacttgctgatgatgatttgacgagcatttcatacttgatctctcctgttcttggaagaggggctcatggaggctggggacttgcatccttgtcggatactccgactgcctagggaacgcttcggctcggccaaccatgtacactccaatgcaaggaagattttggatttgccttccatggaacaaacaggagacaatggatcagacggctgcagttactgattacctaactgcggctgtgataggttcacatgtatgtttaaaaagtgagatgtaaatatcgagggttgcgtggatggtgtaaccttgtactagcagaaggattttgtgaaaagaagtggttcatgaattatcattgc

SEQ ID NO: 2072 - DNA, 1433 bp, Zea mays
gccgagggcagtgtgaaaacggcactgtccccgcaaagaaaagcagacccctcgccgccgcgtacctcctcgttggagcacgatcttgctggacgtcgccgcattcccaaatccgttaggcaatggcgccccctctcctctcgccaccgctgcttgccgacgcactcgcgacgccgccgcggtctttcctctgctcccgcccaacgcggcaactgccaaccgtcgggctcgccggagccgtacgtggcgaccgggggagatggagtgtgcggagaagggatcccagggtatttgccacctccacggaagcggatcgtgaaaggtcggaggaggatgtcgccgacgattactattccgttctgggtgtgatgccagatgcaacccctgaggaaattaagaaggcatactacagttgcatgaaggagtgccaccctgaccttagcggggaccaccctgacgtgacaaacttctgcatgttcatcaacgaagtttactcggtgttgagtgatccagcacagcgtgctgtgtatgatgagatccatgggtacacagcaacagcaatcaaccctttctttgatgacagtgcaccgaaggatcatgtgttcgttgatgagtttacctgcattggatgtaaaaactgtgccaatatttgccctggagtctttcaaattgaggaagactttgggaggtcaagagtctattcccagtcaggtagcacagagctaattcaagatgccattgatagttgcccagttgattgtattcactggacttccgctgcacagctgtcactcctcgagaacgagatgcgtagagtagagagggtgaatgttggtttgatgcttgctggtatgggagcttccatcaatgttttccggatggcaagtgctcgttgggaaaagaggcaagcaaaagtcttggagaaagccagaacacggatggtgaaacaggagacgtcagacacgaggagctcttggagcgaggtctgggcatcatccccaccacgagacgaccaaagcaacggcgatggggaagcatcggagagggccaagagagcagcagctgctgccaggcggtggcgagagttctccaggcgaggtgcggacaggcctccaacgcacaagcttcccgaggcagtgggcaacaaggattagtagtagtagtaaatttgatcatattggctaaatgtacagtgccattgtctgtagaggcttgcagtgccttcccagctttgcacgcactcatgtgctccatttgtaaaatctaggtgagtaggtatatagtgatgttgataacctgaacctgtacgtagaagacaacaagcacccagtgctgcagaacaaaggtcaaacatgtacaatacaatagaacgaatacaagtgtatacatacattcgctgtaccatcgcggtacgtagaacccctgtaaccgca

SEQ ID NO: 2073 - DNA, 1430 bp, Panicum virgatum
gtgctaacatgtcggagtcccgcaaagaaaagcaaaccagtcgccgccgcctgcccgcctcctcgttcgagtccgatcttgctggaggtcgccgcattctgaatccggttaccaatggctcctcccctcctctcgctgccgctgctccccgactcgctcgcgacactgccgcggtctttcccttgctcccgccccacgcggcagctggccaccgtcgggttcgccggagccgttaggagcgaccgccaggggagttggagtgcgcggaggagggggaacctcaggattcgagccactgcggcggaagcggatcacgagaggccggaggaggatgtcgccgaggattactattccgttctgggtgtgatgccagatgcaacacctgaggaaatcaagaaggcatactacagttgcatgaaagcgtgccaccccgaccttagtggggacgaccctgacgtgaccaacttctgtatgttcatcaatgaggtttattcggtgctgagcgatccagcacaacgtgcagtgtatgatgagatccatgggtacacagctacagcaataaaccctttctttgatgacagtgcacccaaggatcaagtgttcgttgatgagtttacctgcattggatgtaaaaactgtgccaatatttgccctaacgtctttcaaattgaagaagattttgggaggtcaagggtctactcccagtcgggtagcaccgaacttatccaggatgccattgatagttgccctgtcgactgtatccactggacttctgcagcacaactgtcactcctcgagaatgagatgcgcagagtagagagggtgaatgttggtttgatgcttgctggtatgggagcttcagtcgatgttttccgaatggcaagtgttcgctgggaaaagaggcaagcaaaagtcttggaaaaagtcagaacacggatggtgaaccaagaaaattcagacacaggctggtcttggagcgatgtctggggatccccaccacgagatcaaaacaatgaggaagaagcgtcagagagaaccaagagagcggcggcggctgccagaaggtggcgagaatactcaaggcgaggcgcagacaggcctccgacatacaagcttccagaagcagtgggcaacaaagattagtccactgaatagagaaaacatctgccattgtttggccaaatttggcaaacctgtactgtacagtgtcgttgtttgcagaggtgatccgaaggtttgctttgccttcccagtcgacacccatgctgctcctgtaaatctagacgtagcgatgttgataacctgtagaagacatgcaccaaatatattacgtgtatattcaagctgtaatataaacaaatgcacatgtatatcttgctggatgtggtactagatgaaaacatgagttattgtatgtgatgtcattttat

SEQ ID NO: 2074 - DNA, 1341 bp, Setaria italica
aaatggcacagcgcagtcccgcaaagaaaagcaaaccccttgccgccgcccccgcctcgttcgagtccgatcttgctggaggttaaccaatggctccccctctcctctcgccgccgctgctcgccgaaccactcgtggcgctgccgcgctctttcccctgctcccgccccacgccgcagctggccaccgtcgggttcgccggagccgtacggagcgaccggcaggggagctggagcgcgcggagaaggagggatctcaggatccgtgccactgcaacggaagcggattacgaaaggccggaggaggatgtcgccgacgattactactccgttctgggtgtgatgccagatgcaacccctgaggaaatcaagaaggcatactacagttgcatgaaagcgaccttagtggggacgaccctgacgtgaccaacttctgcatgttcatcaacgaggtttactcggtgctgagcgatccagcgcaacgtgcagtgtatgatgaaatccatgggtacacagcaacagcaatcaaccctttctttgatgacagtgcacccaaggatcatgtgttcgttgatgagtttacctgcattggatgtaaaaactgtgccaatatctgccctaacgtcttccaaattgaggaagattttgggaggtcaagggtctactcccagtcaggtagcacagaactaatattgatagctgcccagtcgattgtatccactggacttccgctgcacaactatcactcctcgagaatgagatgcgtagagtagagagggtgaatgttggtttgatgctttctggtatgggagcttcagttgatgtttttcggatggcaagtgttcgctgggaaaagaggcaagcaaaaatcttggaaaaggtcagaacacggatggtgaaccaagagaattcggacacaggcaggtcttggagcgatatctggggacccccaccacgagatgaaaacaacgaggaagaagcatcagagagagccaagagggcggctgctgctgctagacgttggcgagagttctcaaggcgaggcgcagacaggcctccaacatacaaacttccagaggcagtgggcaacaaggattagcccacagaatagagaaacacgtggcattatttggcgaattttggctacctgtacagtgtcattgtttgtagctcccagcccacacccacgctccatttgtaaatctagacgtagtgatgttgataacctgtagaagacaagcaccaaatgtattatatatacattcaaggtgtaataaaaacaagtgcacatatatgtacattcaccgttgcagtaaatatatagtacattgtaataaaaaca

SEQ ID NO: 2075 - DNA, 671 bp, Triticum aestivum
cagacacaccaaaacgtacgcgtgcttctcgatcgatcgatcgaacctgcagcaggtgtccaagcgtcatggcggcagcgagcagggcgtctctggtgctgttcctggtggtggcgacgagcgcggtggtggcgagcatgctggccgtggccccgggcgcgggcgcggcgacgacggcgtgcgtcccgacgcagctgaccccgtgcgcgccggccatcgtggggaacgcggcgcccaccgcggcgtgctgcgcgaggctcaaggcgcacccggccagctgcttctgccagtacaagaagaaccccaacatgcagcgctacgtcaactcccccaacggcaagaaggtcttcgccgcctgcaaggtgcccctgcccaagtgctgaatcaagtgcatgcagctagagtagtgcctagtctgttccttgtcgatgtcgaccttgacctctcgcgggcacgcacgcactctcgtgtatggtacttatgaatacttggctgagttagtattttgcttgagaataaacggagacgtagtaattcagtactacttcgtagttggtacagtgtgagtcctctgctctgtgcagacttggtatgtcatgtatttatacgtgtcacacgtatactatgtatgatgttacaaaatgaataaaagtgttgccacttctgagttg

SEQ ID NO: 2076 - DNA, 718 bp, Saccharum officinarum
acacaacacatcaaaacgtacgttcttctcgctctcacctgcagggtgtccaagtccaagcaagcatggcagcagcgagcagggcgtctctggtgctgttcctggtggtggcgagcgcggtgctgagcctgctggccccgggcgcgggcgcggcgacatgcgcaccgacgcagctgaccccgtgcgcgccggccatcgtggggaacgcggcgcccaccgcggcgtgctgcgcgaggctcaaggcgcacccggcgagctgcttctgccagtacaagaagaaccccaacatgcagcgctacgtcaactcccccaacgccaagaaggtcttcgccgcctgcaaggtgcccctgcccaagtgctgaatgaagtgcatgcctgcccccagtgcccagtccgttcctgcttgtcgacgtcgacctcgacctcgcgggcacgcatgcactctcgtgtatggtactcctgtatacttagctgagttagtattacttgagaataaacggagacgtactactacggtagttggtgagttctgctctgcagactttgatatgtcatgtatttatacgtgttacgtatactatgtatgatgttacaaaacgaataaaagtgcatgcttgctgttcgctttgccaaaaaacacacaaactataataatcattatagtgaatcatttatagtactacttttatactaatgtttctatcacccgatatgttta

SEQ ID NO: 2077 - DNA, 1656 bp, Zea mays
acgcatcgcattcgcatcgcatcgcaggtcgcatccgacgctagcggctagcctagccgaacagcctgagcgcgcgaagatggcgcccgccgacggcgagtcctccccgccgccgcacgtggccgtggtcgccttcccgttcagctcccacgcggcggtgctgctctccatcgcgcgcgccctggctgccgccgcggcgccgtccggggccacgctctcgttcctctccaccgcgtcctccctcgcgcagctccgcaaggccagcagcgcctccgccgggcacgggctcccggggaacctgcgcttcgtcgaggtaccggacggcgcgcccgcggccgaggagaccgtgccggtgccgcggcagatgcagctgttcatggaggccgcggaggccggaggggtgaaggcctggctggaggcggcccgcgccgcggcgggcggcgccagggtgacctgcgtggtgggcgacgcgttcgtgtggcctgcggcggacgcggccgcctccgcgggggcgccgtgggtgccggtgtggacggccgcgtcgtgcgcgctcctggcgcacgtccgcaccgacgcgctccgggaggacgtcggcgaccaggccgcaaacagggtggacgagccactgatctcccacccgggcctcgccagctaccgcgtccgtgacctcccagacggcgtcgtctccggcgacttcaactacgtcatcaacctcctcgtccaccgcatggggcagtgcctcccgcgctctgccgccgccgtggcactcaacacgttcccaggcctggacccgcccgacgtcaccgcggcgctcgcggagatcctgcccaactgcgtcccgttcggcccctaccacctcctcctcgccgaggacgacgccgacaccgccgcaccagccgacccgcacggctgcctcgcctggctgggccgccaacccgcgcgcggcgtcgcgtacgtcagcttcggcacggtggcgtgcccgcggcctgacgagctccgcgagctggcggccgggctggaggcctcggccgcgccgttcctgtggtcgctgcgcgaggactcgtggacgctcctcccgccgggtttccttgaccgcgccgcgggcaccgggtccgggctcgtggtgccctgggcgccgcaggtggccgtgctgcgccacccttccgtgggcgcgttcgtgacgcacgccgggtgggcgtcggtgctggagggcgtgtccagcggggtgcccatggcgtgccgccccttcttcggcgaccagcggatgaacgcgcggtccgtggcgcacgtgtgggggttcggcgccgcgttcgagggcgccatgacgagcgccggagtggccgcggccgtggaggagctgctgcgcggggaggaaggggcgcggatgagggcaagggccaaggagctgcaggccttggtggccgaggcgttcgggccaggcggtgagtgcaggaagaacttcgacaggttcgtcgagatagtctgtcgcgcgtgaaaggtcgtcttgctgttcagaggttttaccaacagaagaacataatttgtagttgatacatgagttgcagcagcagtaacagcctcctgtatcttggctttggatctgtattcctgtcaccagttgtctgaaagcatcaagaaccttctgtcttctagcag

SEQ ID NO: 2078 - DNA, 1452 bp, Panicum virgatum
caccgacgccagcctattgctttcaaccgcccgccatggcgcccgacgcgtcctccccgacgccgcacgttgccgtggtagcgttccctttcagctcccacgcggcggtgctgctcgccttcgcgcgcgcgctggccgccgccgcggcgcccgcggggggcacgctctcgttcctctccaccgcgggctccatcgcgcagctccgccgggcggtcggcgtcgagctcccgggaaacctgcgcttcgtggaggtcccggacggcgccgggccgcccgcggcgaagggcgccgtgccggtgccgatgccgcggcagatggagctgttcatggccgccgcggaggccggcggggtgaaggccgggctgcaggcggcccgcgccgcggcgggcggcgccaaggtgagctgcgtggtcggggacgcgttcgtgtggcccgcggcggaggcggcagccgcggcgggggcgccgtgggtgccggtgtggacggccgcgtcgtgcgcgctcctggcgcacctccgcaccgacgcgctgcgggcggacgtcggcgaccaggccgcgagcagggcggatgagctgctggtctcgcacccgggcctcggcagctaccgcgtcggcgacctccccgacggcgtcgtctccggcgacttcaactacgtcatcagccgccttgtccaccgcatggggcagctactcccgcgtgccgccgccgccgtggcactcgatactttcccgggcctggacccgcccgacgtcaccgcagctctcgacgagacgctcccgaactgcctcccgctcggcccctaccacctcctcctccccaaggacaccaccgacgccgcgtcgcaagcagccggcgacccgcacggctgcctcgcctggctcgacgcccacccggcgcgctccgtggcgtacgtcagcttcggcacggtggcgtcgccgcgccccgacgagctccgagagctggcggccgggctggagtcctccgacgcgccgttcctgtggtccctgcgcgaggactcgtggccgctcctgcccgcggggttcctggcccgcgccaccgccgctggcgccgggctcgtggtcccctgggcgccgcaggtggccgtgctgcgccacgcgtccgtgggcgccttcgtgacgcacgccgggtgggcttcggtgctggagggcgtggccagcggcgtgcccatggcgtgccgccccttcttcggggaccagcggatgaacgcgcggtccgtggcgagcgtgtgggggttcggattggcgttcgagggcgccacgatgacgcgcgccggtgtggccgccgccgtgggggagctgctacgcggggaggaaggggcgaggatgagggccagggcgcaggagttgcaggccgcggtggccgcagcgttcgtgccgggcggcgcgtgcaggaggaacttcgacgagttcgtgcagatagtctgtcgcgtgt

SEQ ID NO: 2079 - DNA, 1843 bp, Panicum virgatum
ccacccgcgcgccacgcaacgccacgcgcgcgcgacgccaacggaggccgggccgagccgagcagagccgcgcggccaatcgatcgaatcgaccgaaccagtcgtgttcgtgccatggggcggcggtcgagcgcgtcggcggagcccctgctgccgccggcgctgaagcgcggggtggcggcggtggagcgctgcgcgtcgcgggccgacgacgagctgcggtggttccgctcctgccttcgctgggcgtgcatggaccactcgggccccgcgcaggcggcgctctcctggctcctcttcctcgcgctcggcgtcctcgcccccgccgccgcgcacttcctcctcgtcctccgcgactcgcgccgccccttctccgccgtcgtccagctctcgctctccgccgccgccgccgccggcttcctctgcctctccgcctccttccgccgcgtcggcctccgccgcctgctctacctcgacaagctccgcaccaagagcgaccgcgtccgggcccactacaccgcgcgcctcgccttctccttccgcctcctcgccgcgctcgtcgcgccctgcttcgccgccgaggccgcctacaaggtctggtggtacgccacctccgccgcaggcgcacccttcttcggcggcgacgtgctcggggacgtcctcgcctgctccgtcgagatggcctcctggatgtaccgcagcgccgtctacctcctcacctgcgtcctcttccgcctcatctgccacctccaggggctacggctcgaggacttcgcggggacgctgctcgaggaggtcgaggagggacgggccgggatcgaccgcgtcctgcgggagcacctcgacatccgcaagcagctcaaggtcatcagccaccgcttccgcaagttcatcgtcgccgcactgctcatcgccaccgccagccagttcgcatccgtgctcctcaccacgcgccgcgactccgtcgacgacctcctcaacaccggcgagctcgcgctatgttcggtcgtgctcatgtccgggctcatcataatcctgagcagcgccgcgaagatcacccaccaggcgcaagcgctcacgggccacaccaccaagtggcacgcctgctgcaccatcgcgcccgtgccggacgaggaaggggagcccgggtccaaccagaactccatgatcgagcaggacccctcgagcgacagtgacaccgagtccagcgaggagaccggcgacgaggacctgctggagaacaccaagatccaccttccgcaggcgcacgtcatctccttccagaagcggcaggcgctagtgacgtacctggagaacaacagagccgggatcacggtgttcgggttcacgctggaccgatcgtacctgcacaccatcttcatgctcgagtggacactgttcctgtggctgctcggcaagacgatcggcttctcgtgatatgaaatggaagacggcggtggggggaacggtgcatatacatacggcgtacgtccaggtggtcgttcgttcttggaagctgaaacgagttttgggttgcattttttttttctggtgatgacctgtgcattattggatcggtgtgaaatgggggaaggccttttcgtgtacgcgaccggctggcgcgagagtgtttgtgcgtgcatgtatagtagcgatagcgaattcgtatggcgcttgtaaattgcgtgctgatattgcccgtgcatgtagatgcgtgttgtagagtatctgggatttacttaatttttacgatgtgaagattattgggttctgtttcagttgtttgcatacgtggaactcgtgaaatgatatttcagattgttggccctagcatttcctgaga

SEQ ID NO: 2080 - DNA, 1802 bp, Brachypodium distachyon
cgaattgttggatcgatccgatggggcggcggtctagcgcctcaccggtcgggtccgtggagccgctgctgccggaggtgttcaagggcggcggcggcggcaggggggcggcgacgttgcagcggtccgtgtcgcgggcggacgacgagctgcagtggttccggtcgtgcctgcggtgggtgtgcatggaccactcggccccgggccgcgccgccatgtcgtggctgctcttcctgctcctcggcgtcgtcgtcccggccgtggcgcacttcctcctcgccttccgggcctcaaggcggcccttcaacgccgtcgtccagctctcgctctccgccgcctccgccgccagcttcctctgcctctcctcctccttccgccgcatcggcctccgccgcctgctctacctcgacaagctccgcaccaagagcgaccgcgtcaggctcaactacaccacgcgcctctccttctccttccgcctcctcgcctccctcgtcgctccttgcttcgccgccgaggccgcatacaaggcctggtggtacgcaacctccgccgaccgcgtccccttcttcgccaacgacgtcctcagcgacgtcgtcgcctgctccctcgagatggcctcatggatgtaccgcagcgccatctacctcctcacctgcgtcctcttccgcctcatctgccacctccaggggctcaggctcgaggacttcgccggctcgctgctcgtcgaggtggaggaggggaggatcggggtggagcgcgtgctcagggagcaccttgacatccgcaagcagctcaaggtcatcagccaccgcttccgcaggttcatcgtcgccgcgctgctcatcggcaccgccagccagttcgcctccgtgctcctcaccacgcgccacgactccgtcgacgacctcctcaacaccagtgagctcgcgctatgttcagtagttctcatgtccgggctcatcataatcctgagcagcgctgccaagatcactcaccaggcgcaggccctcaccggccagaccaccaagtggcacgcctgctgcaccatcgaaccggtcccggacgaagaagtggatcccggatccaaccagaactccatgctggaagagtaccctgagagcgacagtgactgcgaatccagcgaggagactggggacgaggacttgctggagaacaccaggttcatgctgccgcacacagtacacgtgatctccttccagaagaggcaggcattagtgacctacctggagaacaacaaggccggcatcaccgtgttcgggttcacgctggatcggtcgtacctccacacgatattcatgctcgagtggacgctcttcttgtggctgctggggaagacagtcggtttctcgtgaatttgtcctttccaggtggttcgttcgttggctcgttgctcttcacccacacatgtatggttgctcgatttggttggcaattttttttttgcggttgctcgatttggttggcatcctggaaggttgagtttcaggagaagttggtggctttttttttgtgtgcgggtggcacgtgagtggtgtgcgcttgtacgtgtaagtatgggatttgtatatatgacgacgggtgtaaattatgggttgattgctcgtgacaccgcgaggtgtaaacggtgtatgtaaaattgtacttctagatgagtgtttgtttgtagagtcccgtgcgtgcgtgcagcttggtgttgcaggtttataacctcgagttgtaagccaacaatagttgtagagcaaattttacgatgttgattaaagttttgttttgtttctcct

SEQ ID NO: 2081 - DNA, 1717 bp, Sorghum bicolor
ttcagttcagttcaggcagcagccacctccactgcctcgcgtttccacctacagctctcagctgatcacgtacgtgcgcgtcatggcaatggcatcgtctctgccgccgttcacggtgcggcgcggggagcccgtgctggtggcgccgtcgtcgccgacgccacgggagacgaagccgctgtcggacatcgacgactccgagggcatgcggttctacagctccggcatccacctgtaccgcgccaacccagccaaggccggccaggacccggccacggtcatccgcgaggcgctggcgcaggcgctcgtcccctactacccgctcgccggccgcctccgcgaggtggaaggcaggaagctcgtcgtcgactgcgccgcgcagggcgtcctgttcgccgaggccgacgccgacctcaccgccgacgacttcggcgacgtccagagcccgccgttcccgtgcttcgagcagttcatcctcgagagcaccaccgtcgccggagtcgagcccgtcgtcgaccgccccttgctgtacgtccaggtcacccgcctggcgtgcggcggcttcatcttcggccagcgcttctgccactgcgtcgtggacgccccgggcgggatgcagttcgagaaggccgtgtgcgagatcgcacgcggcgccgccgcgccgtccgtcgcgccggcctggggcagggagatgttcatggcgcgcaacccgccgcgcccggcctacccgcacgtcgagtaccgcgagcccgcgggcggcgttggcgtcgaccggatgctgaccactcccgccgctgacatggttcgcgtgcccttcttcttcggggcacgggagatcgctgggctgcgccagcgcgcgccgcccgggatgcgctgctcccggttcgagctcgtcgccgcgtgcatctggcgcagccgcaccgccgcgctcgggtacgcgcccgatgaggaggtgcgcctgtccttcatcgtgaacgcacgcggccggcccgacatcccgctccccgagggattctacgggaacgccttcgcctactccgtcgcggcgaccaccgccggggagctctgcggcggggacctcggtttcgcgctggagctcgtgaagatggccaagtcggcggtgacctacgactacctggtgtcggtggcggacctgatggtgctcacggggcggccgctgttcgaggtgtcgagaacgtacatcgtgtcggacatcagccacgccgggttcaagagcatcgacttcggctggggtgaggccgtctacggcgggccggcgaaaggcggcgaagggccgctccccggcgtcaccaactacttctccagggccaagaacggcaagggggaggaaggcaccgtcgtgcccatctgcctgcccaaggacgccatggagaagttccagctcgaggtggaaggcctcaccgccgagctctaggcgatccaccgccgcgcaccggccggccggccggccggccggggtgcatgcatatatacatgtcagggtgtgcgcatgtataaaattagtctgccaaggcatgatcgcaactacatactgtaggtagaacgtcatcaagtacgtactgtgaaaatgcgccgtgttcgtctcgtcgatgacgtgtgttgtttttcgtactatatacacagctgtacgtacgcaacgaaatacggtggtgctgtgcacttgttttgtggaaaggtaacttggaaacaattcata

SEQ ID NO: 2082 - DNA, 1825 bp, Sorghum bicolor
agttcacgcagcagagacctcgacgcactcaccacacagcctcgcgtttccacctacagcgacacaggccactaccagctagctacctcggcacgcccagccggccagctctcagctgatcacgtccgtacgcgtcatggcaatggcatcggctctgccgccgttcacggtgcggcgcggggaacccgtgctggtggcgccgtcgtcgccaacgccgcgggagacgaagccgctgtcggacatcgacgactccgagggcatgcgcttctacagctctggcatccacctgtaccgcgccaacccatccaaggccggccaggacccggccacggtcatccgcgaggcgctggcgcaggcgctcgtcccctactacccgctcgccggccgcctccgcgaggtggaaggcaggaagctcgtcgtcgactgcgccgcgcagggcgtcctgttcgccgaggccgacgtcgacctcaccgccgacgacttcggcgacgtccagagcccgccgttcccgtgcttcgagcagttcatcctcgagagcaccaccgtcgccggcgtcgagcccgtcgtcgaccgccccttgctgtacgtccaggtcacccgcctggcgtgcggcggcttcatcttcggccagcgcttctgccactgcgtcgtggacgccccgggcgggatgcagttcgagaaggccgtgtgcgagatcgcgcgcggcgccgccgcgccgtccgtcgcgccggcctggggcagggagatgttcatggcgcgcaacccgcctcgcccggcctacccgcacgtcgagtaccgcgagcccgcgggcggcgttggcgtcgaccggatactgaccactcccgccgctgacatggttcgcgtgcccttcttcttcggggcacgggagatcgctgggctgcgccagcgggcgccgcccgggatgcgctgctcccggttcgagctcgtcgccgcgtgcatctggcgcagccgcaccgccgcgctcgggtacgcacccgacgaagaggtgcgcctgtccttcatcgtgaacgcacgcggccggcccgacatcccgctcctcgagggattctacgggaacgccttcgcctactccgtcgcggcggccaccgccggggagctctgcggcggggacctcggtttcgcgctggagctcgtgaagaaggccaagtcggcggtgacctacgactacctggtgtcggtggcggacctgatggtgctgacggggcggccgctgttcgaggtgtcgagaacgtacatcgtgtcggacatcagccacgccgggttcaagagcatcgacttcggctggggtgaggccgtctacggcgggccggcgaaaggcggcgaagggccgctccccggcgtcaccaactacttctcaagggccaagaacggcaagggggaggaaggcaccgtcgtgcccatctgcctgcccaaggacgccatggagaagttccagctcgaggtggaaggcctcaccgccgagctctaggcgatccaccgccgcgcaccggccggccggccggggtacatgcatatatacatgtcagggtgtgcgcatgcataacaatagcctaccaaggaaggcatgagcgcaactttacactactgtagatagaacgtcgtcatcaagtacgtacaccataaatgcgtcctgttcgtctcgtcgatatggcggtatatatacgcgtgttttgttttcttactatatacacagctgtacgtacgcaccgaaatatatacggtggtgtgttctccaccgaaatatcacttgcagatttgcaatgtcaatcccggctcaagttgcaagtaggcttctaccatatat

SEQ ID NO: 2083 - DNA, 1341 bp, Artemisia annua
acgagtgcgtataaatcaccatctaaacaaaaaccaaactcatttcatatctaaaaaaaaagaaaaaaaaaaaataaaaaatggcaggagcagttccaagaatcaaactaggatcacaaggtctagaagtgtcagcacaaggcttaggatgtatgggcatgtccgctttttacggagctcctaaacccgaacccgatatgatcaagcttattcatcatgctattaactctggtgttacctttcttgacacttccgatatttatggccccaaaactaatgaaatccttcttggcaaggctttgaaggatggggttagggagaaagtggagttggctactaagtttgggataaggtacgatggtgtcagggaggttcgaggtgatcccgagtatgtaaggagtgcttgtgaagctagtttggaaagacttggtgttgcttgtattgatttgtattatcagcacaggattgatactcgtttgcctatcgaaatcacgatgggagaactgaaaaagttggtggaagagggaaaaattaaatatgttggattgtcggaagcatcagcatcaaccattagacgagcccattctgtgcacccaattacagctgtacaactcgaatggtccttgtggtcaagagatgtcgaagaagatatcattcctacttgcagagaactagggatcgggattgtggcatacagtcctcttggacgagggttcttctcatctggtccaaagcttttggagaaattggaagagggtgacttccgcaagtacctgccgaggttccaacctgaaaatcttgagcacaacaagattttgtacgagcgcgtcaatgaaatagcagcaaagaaggggtgcaccccttcacagcttgcattagcgtgggttcaccatcaaggaaatgatgttgtgcctattccaggaaccaccaagatagaaaatcttgaacaaaacataaaagctttatctgttaagctaacaccagaagagatggctgaacttgagtctattgcatcagctgattcagtcaagggggcacgatatggtgctggtcttactacatatgcagaatcagatacccctccactatcatcatggaaagcttaatcaatgttttgtgtctgttgtttgttgtgtgtttgttttagtctgtaagcatgctttaaatcatagctggagagtcttgttttcatgtgctgctatacacgtatgagcttagtttccttgtaagaaacgtgttttgcatttcagagcatcgtcaaagccaatcagacgtgtgattttaccgctgcaatgtaagagttttgaggtttatgagtaacaaataaagacaggtttctgt

SEQ ID NO: 2084 - DNA, 1211 bp, Centaurea maculosa
caaatttcaaaaatggcaggaggaattccaagagtgaagcttggttcacagggtctggaggtatcagctcagggcttaggatgtatggggatgtccgccttctacggagcagctaagcctgaaccagacatgatcaaactcatccaccacgccattaacgccggcgttacctttctcgatacctccgatatgtacggccccaaaaccaacgaaatccttctcggcaaggctttgaagggagggataagggagaaagtggagctagctacgaaatttggaatcaaattcgaaggtggagtgagggagatttgcggagatccggcgtacgtgaggtctgcttgtgaggctagcttgaagcgactcgatgtcgattgcattgatctctactatcagcacaggatcgacactcgtttgcctatcgaaatcacgatgggagaactaaagaagttggtagaagaaggaaaaattaagtatgttggattatcagaggcatcggcatcaaccataagaagagcccatgctgtgcacccaattacagctatacaactagaatggtccctatggacaagagatgttgaagaagagatcattcctacttgcagagaacttgggattgggattgttgcatacagtcctctaggacgaggtttcttatcatctggtccaaagatgatggagaagctggaagatggtgatttccgtaagtacctgccaaggctccaacctgaaaatcttgagcacaacaagatcctatttgaaagggttaacgagatagctgcaaagaaggggtgcaccccttcgcagctagcattggcctggattcaccaccagggaaacgacgtggtgcccattccgggaaccaccaagatcgaaaatcttgaacagaacataggagctttatccgttaagctaacagcggaagagatggctgaactggaatccattgcttcagctgatgcggtgaaggggggacgatacactgctggtatttcgacgtatcttgattccgacactcctccattgtcatcttggaaagcctaattaatgctgctggaagtctgatgtttgtttgtaagcatggtttgagagttttccacacacacatatcacctctgttttcctgtaagaaaatgtgttaaacttgactaggcctgtggttcctttgagtatttaatagcaataaaaataaaagacggttttgtttgggtgta

SEQ ID NO: 2085 - DNA, 1350 bp, Helianthus annuus
atacactccctttaaattggcatcactttcgcagatcagatcagtacaacacaagaaacatgtcgagagttccacgaatcaaactgggttcacagggcctagaagtatctgctcaaggtctaggttgtatgggcatgtccgccttctacggagccccgaaacccgaacccgacatgatcaacctcatccaccacgccattaacgctggcatcacctttctcgacacctccgatatttacgggcccaaaaccaacgagatccttctcggcaaggctttaaagggaggaatgagggggaaggtggagctggctactaagtttgggattaagtatgatggtgtgcgggagattcgcggagatccggagtatgttcgggcttgttgtgaagctagtttggagcggcttggggtggagtctattgatctgtattatcagcataggattgacactcgtgtgcccattgaaatcacgatgggcgaactaaagaagctggtggaagaaggaaaaattaaatatgttggattatcagaggcatcggcatcgaccatcagaagagcccatgctgtgcacccaataaccgccatacaactagaatggtccttatggacaagagatgttgaacaagatatcattcctacttgcagagaacttgggattgggatcgttgcatacagtccgctcggacgagggttcttctcttctggtcctaagatgctcgagaagttggaagatggcgacttccgtaagtacctaccgaggttccaacctgaaaatctggagcacaacaagatcttgttcgagagggttaacgaacttgcatcaaagaaagggtgcaccccttcacagctatcgctggcctgggttcaccaccagggaaatgacgtagtccccattccaggaaccaccaagatcgaaaatcttgaacaaaacataggagcgttatccgtcaagctaacgccagaagagatggctgaacttgaatccattgcatcagctgattcagtcaagggagagcgatatggttcgggtctttccacgtatgcggactctgacactcctccattgtcatcttggaaagcttaatcttaaccgctgctgctatcggttttttgtgtaaacatatcatagctgcaagttgtttgtgagtcatatgcttgtatacacttaaatcgctatgtattcctgtaataaccttgtatcgtgttttgaaacttggttgtgatgtaagcagccgagaccttgagcagaataaatacatgcgggttcatgttaaaaactactttgttcgtcttcatgttggttctcgttcccttcgcttccgaagagagtgtgatgaaggtgacagaagcga

SEQ ID NO: 2086 - DNA, 1257 bp, Helianthus annuus
attcgtgatccaacaacaacaaagatcgaaaaacaatggcaaaagttccaagagtgaaactgggttcacagggtttacaagtctcagctcagggcttaggctgcatgggcatgtccgctttctacgggccacccaaacccgaatccgacatgatcaagctcatccaccacgccattgacgccggtgtcaccttcctcgacacttctgatgtctacggccccaaaaccaatgaaatccttcttggcaaggctttgaagggaggggtgagggagaaagtggagctggctaccaaattcggggccaaatacgacggcgagtgggcaattcagggagatccggcgtatgtaagggctgcttgtgaagctagcctgcagcgacttgaggtcgattgcattgatctctattatcagcacaggattgatactcgtgtgccgattgaaatcacgatgggagaactaaagaagctggtggaagaaggaaaaattaagtatgttggattatcggaggcatcagcatcaaccatcagaagagcacatgctgtgcacccgataactgccatacaactagaatggtccttgtggtcaagagatgttgaagaagatattattcctacttgcagagaacttgggatagggattgttgcatacagtcctctaggacgggggttcttctcatctggcccgaagttgttggatgagttgcaagatggtgacttgcgtaagtacatgccgaggttccaacccgaaaatcttgaacacaacaagatcgtgtacgagaaggttaatgaaattgcgtcaaagaagggttgcacaccttcacaactatcattggcctgggttcaccaccagggaaatgacgttgtgcccattccaggaaccaccaagatccaaaatcttgaacagaacattggagctttatcggttaagctaacaccagaagagatgactgaacttgaatccattgcagcagctgatctagtcaagggggatcgttatggtgcgggtatttccacatatctggactcggagactcctccgctctcatcttggaaagctcaatcttaattgttgctataggtcgcgtgttgctatctgtttttctgtaagcgagcttgttcatagctgcgagtttggctagtcgggttgggttttcgtcttgctgtacctttatggcgctacttagtactacattaaaccactcttgcctttgggtttctagttgacttcgattgactttttttcataaaaagtatttaag

SEQ ID NO: 2087 - DNA, 1277 bp, Carthamus tinctorius
  misc_feature (81)..(81): n is a, c, g, or t
  misc_feature (452)..(452): n is a, c, g, or t
ccagaacaacagcagaagtttctcaatggcgggaatcccaagagtgaagctcggttcacagggtctggaggtatcagctcngggtctaggatgtatggggatgtccgctttctacggagccgctaaacctgaaccagacatgatcaacctcatccaccacgccattaacgccggcgttacctttctcgatacctccgacatgtacggccccaaaaccaacgaaatccttctcggcaaggctttgaagggagggattagggataaagttgagctagctacgaaatttgggatcaaaatcgagggtggagctagggagatttgcggagatccggcatatgtaaggtctgcttgtgaagctagcttgaagcgactcaatgtcgattgcattgatctctattatcagcacaggatcgacactcgtttgcctatcgaaatcacgatgggagaactanagaagttggtagaagaaggaaaaattaagtatgtaggattatcagaggcatcagcatcaaccataagaagagcccatgctgtgcacccaattacagctatacaactagaatggtccttatggacaagagatgttgaagaagaaatcattcctacttgcagagaacttgggattgggattgttgcatacagtcctctaggacggggtttcttatcatctggtccaaagatgctggagaagctggaagatggtgatttccgtaagtacctgccgaggctccaacctgaaaatcttgagcacaacaagatcctattcgaaagggttaacgaaatagctgcaaagaaggggtgcaccccttcgcagctagcattggcctggattcaccaccagggaaacgacgtggtgcccattccgggaaccaccaagatcgaaaaccttgaacagaacataggagctttatccgtgaagctaacagcacaagagatggctgaactggaatccattgcttcagctgatgcggtgaaggggggacgatacgctgctggtatttcgacgtatcttgattccgacactcctccattatcatcttggaaagcttaattaatgctgctggaagtctgatgtttgtttgtaaggatggtttgagggttttgcacacatatcacctctattttcctgtaagaaaatgtgttaaagtcgactaggcgtgtggttcctttgagtttttggtaacaataaaaataagagggttttgtttgggtgtatacttgagcagttatccatggtaaatatctggaaatacaaaatataagaaacttgaggttcc

SEQ ID NO: 2088 - DNA, 1219 bp, Cynara scolymus
  misc_feature (49)..(49): n is a, c, g, or t
  misc_feature (193)..(193): n is a, c, g, or t
  misc_feature (268)..(268): n is a, c, g, or t
  misc_feature (864)..(864): n is a, c, g, or t
  misc_feature (899)..(899): n is a, c, g, or t
  misc_feature (1159)..(1159): n is a, c, g, or t
gggactgctcttcatcatcgtataacagcaacaaatttcgagaatggcnggaattccaagaatcaaattgggttcacagggtttagaagtatcagctcagggtttaggttgtatgggcatgtccgctttctacggatcccccaaacctgaacctgacatgatcaacctcatccaccacgccattaacgccggngttacctttctagacacctccgacatgtacggtcccaaaactaatgaaatccttcttggcaaggctttgaagggngggataagggaaaaagtggagctagctacgaaatttgggttcaaattcgagggtggagcgagggagatttgcggagatccggcctatgtaaggtctgcttgtgaagctagcttgcagcgactcgatgtcgattgcattgatctctattatcagcacaggattgacactcgtttgcctatcgaaatcacgatgggagaactaaagaagctggtagaagaaggaaaaattaaatatattggattatcagaggcatcagcatcaaccataagaagagcccatgctgtgcacccaataacagctatacaactagaatggtccttgtggacaagagatgttgaagacgaaatcgttcctacttgcagagaacttgggattgggattgttgcatacagtcctctaggacggggtttcttatcatctggtccgaagatgctggagaagctggaagatggtgatttccgtaagtacctgccgaggttccaaccctgaaaatcttgatcataacaagattctgtatgaaagggttaatgaactagcagcaaagaaagggtgcaccccttcgcagctggcattggcctgggttcaccaccaggganacgatgtggtgcctattccaggaaccaccaggatngaaaatcttgaacagaacataggagctttatcagttaagctaacagcagaagacatggctgtactggaatccgttgcttcagctgattcggtgaagggggcacgatatggtgctggtatttcgacatatctggattcggatactcctcctttatcatcttggaaagcctaattaatgctgtttgtaaaagcatatatggtttgagagttttgtttgtggtgtgcagcacacgtatcaccctctattttcttgtaagaaangtgttcgactcgacttttgagtttttggcaaaaataaataaagagggttttatttttttt

SEQ ID NO: 2089 - DNA, 1248 bp, Helianthus annuus
aatcaatcagtacgtacaagaagatattaaatttaaaagaaagttcgatcgaaaatggcaagcagagtaccaagaaggcaattgggttcacagggtttagaggtctcagctctgggtttaggatgcatgggcatgtccgatctgtacggtgctcccaaacctgaacctgacatgatcaagctcatccaccacgccatcaacgccggtgtcaccctcctcgacacctccgatgtctacggccccaaaaccaacgaaatccttctcggcaaggctttgaaaggggggatgagggacaaagtgcagctggctaccaaatttgggatcaagctcgatggttcctgggaggtccaaggcgatcccgcctatgtcagggctgcctgcgaagccagcctcaagcgacttgaggtcgactgcattgatctctattatcagcacaggattgatactagcgtgccaatcgaaatcacgatgggggaactaaagaagctagtggaagaaggtaaaattaaatacgttggattatcagaggcatcagcatccaccattagaagagctcacgccgtgcatccaattactgcggtacaactggaatggtccttgcagtcaagagatgtagaagaagaaattattcccacttgcagagaacttgggatagggattgttgcatatagtcctctaggacgtggttttttctcacatggtccaaatatgttggagaagttggaagaaagtgacgcccgtaagtacttgccaaggttgcaacctgaaaatctcgaacacaacaagatcatgtatgagaggattaatgacctagcgacaaagaaagggtgcacaacttctcagctagcattagcatgggttctccaccaaggaaatgatgttgtacccattccaggtaccaccaagatagaaaattttgagcacaacattggagctttatctgttaaattaacaccagaagatatggctgaacttgaatctattgcatcacctgattcaatcaagggggatcgatatggtgctggtttaaaaacatataaggactcagagactcttccattatctgcatggaaagcttaatcaaaccatacgagtgttttgtttattcgtgtgctcctatatccataatatcatatttgttttcttttaagagatgttttttagtttttaaaccttcgttgcacttgataagcgtttactttactattgcatgtaattttgagaagaataaataaaggcagttttttt

SEQ ID NO: 2090 - DNA, 1284 bp, Helianthus annuus
ggggaaataggattgaatcataccttcatttcatcattcaatcagtacgtacaagaagatattaaatttaaaacaaatctgtaacaaaaatggcaagcagagtaccaagaaggcatttgggttcacagggtttagaggtctcagctctgggtttaggctgcatgggcatgtccgatctctacggagctcccaaacctgaacccgacatgatcaagctcatccaccacgccattaacgctggtgttaccctcctcgacacatccgatgtctacggccccaaaaccaacgaaatccttctcggcaaggctttgaaaggggggatgagggacaaagtggagctggctaccaaattcgggatcaaactcgacggttcgtggcaggtccaaggcgatcccgcctatgtcagggctgcttgtgaagctagcctcaagcgacttgaggtcgattgcatcgatctctattatcagcacaggattgatactagtgtgccaatcgaaatcacgatgggcgaactaaagaagttggtcgaagaaggtaaaattaaatatgttggattatcagaagcatcagcatcgactattagaagagcacacgctgtgcatccaattactgccgtacaaatggaatggtccttgcagtcaagagatgttgaagaagaaattattcccacttgcagagaacttgggatagggattgttgcatatagtcctctaggacgtggttttttctcacatggtccaaagatgttagagaagttggaagaaagtgacgcccgtaagtacttgccaaggttacaacctgaaaatcttgaacacaacaagattatgtacgagaggattaatgacctagcgacaaagaaagggtgcacaacttctcagctagcattagcctgggttcttcaccaaggaaatgatgttgtacccattccaggtaccaccaagatagaaaattttgagcacaacattggagctttatctattaaattaacaccagaagatatggctgaacttgaatctattgcatcacctgattcaatcaagggggatcgatatggtgctggtttaaaaacatataaggactcagagactcttccattatctgcatggaaagcttaatcaaaccatacgagtgttttgtttattcgtgtgctcctatatccataatatcatatttgttttcttttaagagatgttttttagtttttaaaccttcgttgcacttgataagcgtttactttactgttgcatgtaattttgagaagaataaataaaggcagtttttttt

SEQ ID NO: 2091 - DNA, 1298 bp, Cichorium intybus
ggatcctcctagaagaagaacaatctcaaaatggcaggagttcgaagagtcaaactgggttcactgggtttagaggtatcagctcagggtttgggttgtatgggcatgtccgccttctatggagcccccaaacctgaacctgacatgatcaagctcatccaccacgccatcaactccggaattaccttcctcgacacctccgacatctacggccctaaaaccaacgagatccttctcggcaaggctttgaagggaggaatgagggagaaagtggagttagctaccaaatttgggatcagagaagtgaacggagctagagagtactgcggagatccggcgtatgtaagagctgcttgtgaagctagcttggagcgacttggcgtcgattgtatcgatctgtattatcagcacaggattgacactcgtttgcctatcgaaatcacaatgggagcattaaaggagctagtggaagaaggaaagatcaaatacgttggattatcagaggcatcagcatcaacaatcagaagagcccacgctgtgcacccattaacagccatacaactcgaatggtccttatggacaagagacgttgaagaagaaatcatccctacttgcagagaacttggaatcgggattgttgcatacagtccactaggacgaggtttcttctcatctggtccaaaaatgctcgagaagttagaagctggtgatttccgtaagtatcttccaaggtttcaagctgaaaaccttgagcataacacgatcatgttcgagagggtgaatgcgatggcggctaaaaaggggtgcacaccatcgcagctatcattggcgtgggtccaccaccagggtgatgatgttgtccccattccaggaaccacgaagatagagaatctagaacagaacattggagctttatctgtgaagttaacaccagaagacatggcggaacttgaagccattgcttcagctgattcggtgaagggggacagatatggtgctggtattgcaacttataaggattccgagactcctccattgtcatcttggaaagcttgagcaattgtgtgaatctgttgcgactgttttgtgttttattagttggttaaagaataaaactagataaggtgtgtgttttgatgataataaaaaaagatgagtttctgtttagggtctatgatggagtaggtgtcatgaatttaaggtacttcaagcatcaaaagggtgaagtccatgattttcaatatccccacaattggtcaagctttccaaaaaaaaagggccgctcggcccaattccat

SEQ ID NO: 2092 - DNA, 1153 bp, Lactuca sativa
caaagctcgaaaatggcaggagttcgaagagtcaaactgggttcacagggtttagaggtatcagctcagggtttgggttgtatgggcatgtccgctttctatggagccccaaaacctgaacctgacatgatcaagctcatccaccacgccattaacgccggcgttaccttcctcgacacctccgacatctacggccctaaaaccaacgaaatccttctaggcaaggctttgaacggaggaattagggagaaagtggagttggctaccaaatttgggatcagagaagtgaatggagcgagggagtactgcggagatccgacgtatgtaagagctgcttgtgaagctagcttggagcgacttggcgtcgattgtatcgatctgtattatcaacacaggattgacactcgtttgccaatcgaaatcacaatgggagcactaaaagagctggtggaagaaggaaagatcaaatatgttggattatcagaagcatcagcatcaaccatcagaagagcccacgctgtgcacccattaacagccatacaactagaatggtccttgtggacaagagatgttgaagaagatatcattcctacttgcagagaacttgggattgggattgttgcatacagtcctcttggacgtgggttcttctcatctggcccaaagatgctcgagaagttggaagatagtgactttcgtaagtatctgccgaggttccaagctgaaaatcttgaacacaacacgaaaatgttcgagagggtgaatgagatggcgacaaagaaggggtgcaccccatcgcagctatcattggcttgggttcaccaccagggaaacgatgtggtgccaattccaggaactacaaagattgagaatcttgaacagaacattggagctttatctgtaaagctaacaccagaagatatggctgaacttgaagctattgcttcagctgattcagtgaagggggagagatatggtgctggaattgcaacatataaggattccgagactcctccattgtcatcttggaaagcttgatcaatggtgtgaatctttaggagtgttttgtttgaaatgttcttgtaacttagtttttctgtaggaacactgttttgtaagcgtatgagtttttgagaataataaatgaagacga

SEQ ID NO: 2093 - DNA, 1249 bp, Helianthus annuus
gcgggattcaatcagtacaagaagaaaataaatttaaaacaaagctgtatcaaaaatggcaagcagagtaccaagaaggcatttgggttcacagggtttagaggtctcagctctgggtttaggctgcatgggcatgtccgatctctacggagctcccaaacccgaacccgacatgatcaagctcatccaccacgccattaacgctggtgttaccctcctcgacacatccgatgtctacggccccaaaaccaacgaaatccttctcggaaaggccttgaaaggggggatgagggacaaggtgcagctcgctaccaaatttgggatcaaactcgacggttcgtggcaggtccaaggagatcccgcctatgtgagggctgcttgtgaggctagcctcgagcgacttggcgtcgattgcatcgatctctattatcagcacaggattgatactagtgtgccaatcgaaatcacgatgggtgaactaaagaagttggtcgaagaaggtaaaattaaatatgttggattatcagaagcatcagcatcgaccattagaagagcacacgctgttcatccaattactgccgtacaaatggaatggtccttgcagtcaagagatgttgaagaagaaattattcccacttgcagagaacttgggatagggattgttgcatatagtcctctaggacgtggttttttctcacatggtccaaagatgttagagaagttggaagaaagtgacgctcgtaagcacttgccaaggttacaacctgaaaatcttgaacacaacaagattatgtacgagaggattaatgacctagtgacaaagaaagggtgcacaacttctcagctagcattagcctgggttcttcaccaaggaaatgatgttgtacccattccaggtaccaccaagatagaaaattttgagcacaacattggagctttatctgttaaattaacaccagaagatatggctgaacttgaatctattgcatcacctgattcaatcaagggggatcgatatggtgctggtttaaaaacatataaggactcagagactcttccattatccgcatggaaagcttaatcaaccatacgagtgttttgtttattcgtgtgctcctatatccataatatcatatttgttttcttttaagagatgttttttagtttttaaaccttcgttgcacttgataagcgtttactttactgttgcatgtaattttgagaagaataaataaaggcagtttttttt

SEQ ID NO: 2094 - DNA, 1201 bp, Taraxacum officinale
gaagaaaaaaaatatttcattttagaagtacgaaaatggcgaatgttccaagaataaaactgggttcacagggtttggaggtatcagctcaaggtttgggttgtatgggcatgtccgctttctatggacccccaaaacccgaacctgacatgattagcctcatccaccacgccatcgatgccggtgtcacccttctcgacacctccgatgtctatggccccaaaaccaatgaaatcctacttggaaaggctttgaagggagaggtaaggaagaaagtagagttggctaccaaatatgggatcaacactgaggatggagcttatgagatccgtggtgatccagcatatgtgagggcggcttgtgaagccagcttgaagcggcttgatattgattgcattgatctctattatcagcacaggattgacacacgtgtgcccattgaaatcacgatgggagaaatgaagaaactggtggaagaaggaaaaataaaatacatagggctttcagaagcctcggcttccaccattagaagagctcatgcagtgcacccaataactgctgtccaattagagtggtccttatggtcaagggatgtggaacaggaaatcattcctacttgcagagaacttggcattggaattgtggcatatagtcctctaggtcgcggatttctttcattgggtcccaaaatggctgagaatttaacagatggcgattttcgtcagtctctaccaaggttccaaggtgaaaaccttgagcataacaagatgttgtatgagaaggttagtgcgattgcagaaaagaaagggtgcactccatcacagctggcattggcgtgggtccaccaccaggggaatgacgtggtgccaataccaggaaccactaagattgaaaaccttcaacaaaacatcggagctttatctgtgaaattgacgacagaagacatggctgaacttgaatccattgcttcagatgatgcaaccaaaggtgataggtacatggatggttttcctacgtttctgaattctgataccccacccttgtcttcatggaaagcttcataaatatttcagattttgctatgagaatttcatgtcatgtttgtggtccattttcgagtttgtgacatgaatctatatatatcgttgtatgttttgttcttgcctttgcctttgagtgtataataataaaccttaaccca

SEQ ID NO: 2095 - DNA, 1172 bp, Taraxacum officinale
ccgtagtagaagaaaaaggtcgaaaatggcaggtgttcgaagagtcaaactcggttcacagggtcttgaggtatcagctcagggtttgggttgtatgggcatgtctgctttctatggatcacccaaacctgaaccagacatgatcaagctcatccaccacgccattaactccggaattaccttcctcgacacctccgacatctacggccctaaaaccaacgagatccttctcggcaaggcattgaagggaggtatgagggataaagtggagttagctaccaaatttgggatcagagaagtgaatggagctagggagtattgcggcgatccggcgtatgtaagatctgcttgcgaagctagcttggagcgacttggcgtcgattgtattgatctgtattatcagcacagaatcgacaatcgtttgcctatcgaaatcacgatgaaagcactgaaggaactagtggaagaaggaaagatcaaatacgttggattatcggaggcatcagcatcaactatcagaagagcccacgctgtgcacccattaacagccatacaactggaatggtcgttgtggacaagagacgtcgaagaagaaatcattcccacttgtagagaactcggaatcgggattgttgcatacagtcccctaggacgagggttcttttcatccggcccaaagatgctcgagaagctagaagctagcgacttccgtaagtacctcccaaggttccaagcagaaaaccttgaacataacacgatcatgttcaagaaggtgagtgacatggcggcaaagaaggggtgcaccccatcgcagctatcattggcgtgggtccaccaccagggaaatgatgtggtccccattccaggaaccaccaagattgagaatcttgaacagaacatcggagctttatccgttaagctatcaccagaagacatggctgaattggaagccattgcttcagctgattcagtgaagggggacagatatggtgctggtattgcaacatataaggattccgagactcctccattatcatcttggaaagcttaatcttggagtcttttgtttggcatgtgcttgtaattctgttttgtgttttattactttgaggcaagtgttagatgatggtgtatgtaagcatatgaggataataaataaaggggtaatttct

SEQ ID NO: 2096 - DNA, 1197 bp, Helianthus annuus
ccaaaacaaatcattaagttggaaaatggcaatcaacgtaccaagaaggaaattgggttcacagggtctagaggcctcagctcttggtttaggctgcatgggcatgtccgctttgtacggggcgcctaaacctgaacccgacatgatcaagctcatccaccacgccattaacgctggtgttaccctccttgacacctccgatatctacggccccaaaaccaacgaaatccttattggcaaggccttgaaaggggggatgagggacaaagtggagctggctaccaaatttgggatcaaactagatggttcgtggcaggtcctaggcgatcccgcctatgtcagggctgcttgtgaagctagcctcaagcgacttgaggtcgattgcattgatctctattatcagcataggattgatactagtgtgcccatcgaaatcacgatgggtgaactaaagaagctagtggaagaaggtaaaattaaatatgttggattatcagaggcatcagcagcgaccatcagaagagcccacgccgtgcatccagttactgctgtacaactagaatggtccttgcaatcaagagatgttgaagaagaaattattcctacatgcagagaacttgggatagggattgttgcatatagtcctctaggacggggttttttctcacatggtccaaagatgttggagaagttggaagaaagtgacgcccgtaagaccttgccaaggttgcaacctgagaatcttgaacacaacaagatcatgtacgagaggattaatgaactagcgacaaagaaagggtgcacaacttcacaactggcattggcttgggttctccaccaaggaaatgatgttgtgcccatcccaggaaccaccaaaattgaaaattttgaacacaacctcggagcattatctgttaagctaacagcagaagatatggctgaacttgaatccatcgcatcacctgattcaatcaagggtgatcggtatggtgttgctgttaaaacatataaggactccgacactcctcctttgtcatcatggaaagcttaatcaacgatacgactgttttctttatctgcaagctgctatacccataatatcatatttgttttcctttaagaactatgttttttttttctataataaacgtctactttactattgcatgtaattttgagaagaataaataaaggcag

SEQ ID NO: 2097 - DNA, 1280 bp, Vitis vinifera
agagggtaaagagtgtaagggaggatgagtagtgtaaagaggatgaagcttggctcacagggcctcgaggtttcagcacagggacttgggtgcatgggcatgtccgccttctacggccctcccaagccagaacaagacatgatcgctctcatccaccacgccgtcaacagcggcatcactttcctcgacacctccgacatctacgggcccttcaccaatgaaatccttctcggcaaggctctcaaaggaggagtgagggagaaagttgaattggctaccaaattcggggttatatacgacgacagggtgcgtgacgcgcgcggcgacccggcttacgtgagggcgtgctgcgaggcgagcttgaagaggctggaggttgattgtattgatctctattaccagcatcgcatcgacactcgcgtgcccattgaagtcacggtgggagaactgaagaaattagttgaagagggtaagataaagtacataggtctgtctgaggcctctgcttcaacaatcagaagagcacatgcagttcatcccataacagctgtgcagttggagtggtccttgtggtcaagagatgtagaggaagacatagttccaacttgcagagaacttggcattgggatcgttgcatatagccctctaggacgtggattcctttcttcaggggccaagatggttgagaacttatcagacaatgactcgagaaagtactttccaaggttccagccagagaatcttgagcataataaaatcctttatgagcgggttagtgaaattgcgacaaggaaggggtgcactccatcacaactagcactggcctgggtccatcaccagggggatgatgtgtgtcccataccaggaactaccaagattgaaaacctcaaccaaaacataggggctttgtccgtgaagctaactccagaagaaatggctgaactagaatccattgcttcagcagatgtggttaagggtgacagataccagagcaccacatttacctggaagaactctgacactccaccccttgcttcctggaaggcttgaaagagacatgatcgttgcagcactatagtgataaactccttattgcgccttgtaaactcttatgtattagtgtttttttgtgctgaaaagctatggggttcctagaggatgtatgtgttactgcatcatagggtgagttttgtgtgaggcagtgtgtttgtgttatttcctgaggatcagaatactaaagttctaataaaaaggagttgaataaattaggaacttgaaca

SEQ ID NO: 2098 - DNA, 1182 bp, Helianthus annuus
aaatggcaagcagagtaccaagaaggcatttgggttcacagggtttagaggtctcagctctgggtttaggatgcatgggcatgtccactttgtacggggcgcctaaacctgaacccgacatgatcaagctcatccaccacgccattaacgctggtgttaccctcctcgactcatccgatgcctacggccccaaaaccaacgaaatccttattggcaaggccttgaaaggggggatgagggacaaggtgcagctcgctaccaaatttgggatcaaactcgacggttcgtggcagatcctaggcgatcccgcctatgtcagggctgcttgtgaagatagcctcaagcgacttgacgtcgattgcattgatctctattatcagcataggattgatactagtgtgcccatcgaaatcacgatgggtgaactaaagaagttagtggaagaaggaaaaattaaatatgttggattatcagaggcatcagcatcaaccatcagaagagcgcacgccgtgcatccagttaccgccgtacaactagaatggtccttgcaatcaagagatgttgaagaagaaattattcctacatgcagagaacttgggatagggattgttgcttatagtcctctaggacggggtttttttctcacatggtccaaagatgttggagaagttggaagaaagtgacgcccgtaagaccttgccaaggttgcaacctgagaatcttgaacacaacaagatcatgtacgaggggattaatgaactagcgacaaagaaagggtgcacaacttctcagctagcattagcatgggttctccaaggaaatgatgttgtgcccattccaggtaccaccaagattcaaaattttgaacacaacattggagctttatctgttaagctaacaccagaagatatggctgaacttgagtctattgcatcacctgattcaatcaagggggatcgatatggtgctggttttaaaacatataaggactcagagactcttccattatcggcctggaaagcttaatcaactatacgagtgttttgtttattcgtgtgctcctgtacacagaatacatattcgttttcttttaagaaatgtcttttagtttttaaagcttcgttgcacttgatcagcgtttactttactattgcatgtaattttgagaagaataaataaagt

SEQ ID NO: 2099 - DNA, 765 bp, Helianthus annuus
atcattctgttataaaactactacatctcatttccagttcttcaatcgctttctacaacaacaatcgaaatggaattcagtctgatgggattagacactccgttcctccgaaacctccaccacatcctcgaatccaccgatgacgacacaaccggcaacaagtccaacaacggcggtccttctcgggcttacgtccgcgacgcaagggcggcggcaacctctgctgacgtgaaggagtatcctaactcctacgtgtttattgtggatatgccggggctgaagtcgggagatataaaggtgcaggtggaagacgacaacattttggttataagcggagagaggaaccgagaggaagagaaggaaggagtgaagtatgtgaggatggagaggaggattgggaagttcatgaggaagtttgcattgccagagaatgcgaatacggataagatatcggcggtttgtcaggacggtgtgcttacggtgactgtggagaagctgcctccgcccgagcccaagaagccgaagacaatccaggtgcaggtggcttgaagaatgcgtatgaataataatgaatcggatgtttgatctgtaatggaatgttatggggtttaaagaattttagtggatatctggtttgttgtttggctctgtatgctaccataatcgacgtgctgtttgtttattttgggtttaaattcatggatatttgatttcatttgaatgattttagtagaaatgatgaacagcacgtcgattatggtagca

SEQ ID NO: 2100 - DNA, 651 bp, Parthenium argentatum
acaatcgctaaaaatatctcagttccaatttaacttctacaacaaatcaacaaaaccaacctaaatggacataagtactctaatgggattcgacgcaccattcctccgaaacctccaacacatcttggaagcaacagacgacaacacaacaaacaacaagtcaaacaacaacagcggtccatcacgcgcatacgtacgcgacgcaagagcaatggctgcaaccccagcagacgtgaaggagtacccaaactcatacgtgtttattgtggacatgcctgggctgaagtcaggggacataaaggtacaagtggaagacgacaacgtgttggtcataagcggagagaggaaccgagaggaagagaaggaaggagtcaagtatgtgaggatggaaaggaggattgggaagtttatgagaaagtttgcgttgcctgagaatgcgaatatggataagatttccgcggtttgtcaagacggtgtgcttacggttacggttgagaagctgcccccgcccgagccgaaaaagccgaaaacgatccaggtgcaggtggcttgaagaacagaatcgaatgcatatgtggcaatcttgttactagtaagaaactatgaataatgaatgggatgttagatggttaatggaatgttatgagtaat

SEQ ID NO: 2101 - DNA, 644 bp, Helianthus annuus
catcaaccgatcgacaacaatcaaaatggaatacagtcttttgggattagactctccattcctctgcaacctccaccacatcctcgaagccactgacgacaacaccaccggaaacaagtcaaacaacagcgctccatctcgcgcttacatccgtgacgccagagcaatggcggtaactcctgctgacgtgaaggagtatccaaactcctacgtgtttattgtggacatgccagggctgaagtcaggggatataaaggtgcaggtggaagacgacaacgttttggtgataagcggagagaggaaccgagaggaagagaaggaaggagtcaagtatgtgaggatggagaggaggattgggaagttcatgaggaagtttgcattgccagagaatgcgaatacggataagatatcggccgtttgtcaggacggagtgcttacggtgactgtggagaagctgcctccgcctgagcccaagaagccgaagacgattcaggtgcaggtggcttgaagaagtcgtatgcgatatgggaatgaaggatgtttggtgtgttatgagttaaggggtttgaagcatgttttgttgttttgctctgtttatagtgaatctgatatcagattcattatcgtatcaaacagagcacctg

SEQ ID NO: 2102 - DNA, 678 bp, Taraxacum officinale
catcactgatttgtcgacattcacttaatcgtccaatcgcgttcgaattttgggaaaagctcatcaacaaacatcaaaatggatatcagcctgatgggattcgacaccccatttttccgcaacctccatcacatcctcgatggcaccgacgacaacacaaccaacaacaaatcaagcaatgccaccggacctactcgcgcttacgtccgtgacgccagggcaatggctgcaactccggccgacgtgaaggagtatcccaactcttacgtgttcatcgtggacatgccgggtctgaaatcaggagacatcaaggtccaggtggaggacgacaacgtgttggtgataagtggagagaggaaaagggaacatgatcaggaagagaaggaaggggtcaagtacgtgaggatggagaggagaataggaaagtttatgaggaagtttgtattgccggaaaatgctaatatggagaagatatctgcgatttgtcaagatggagtgcttaccgtaacggtggagaaactgccgccgccggagcccaagaagccgaagatgattcaggtccaggttgcttgaataacaaaatcggattgattttgcttatgcagtgagtttttataaatattcgtggatcctgttaaaagtgttaagccgttcctagttgatatctgtaatgctctg

SEQ ID NO: 2103 - DNA, 783 bp, Lactuca sativa
catcataaaatatcgcgattcttatcggtatcttcaaccttgctccaattttggtaaaacaccattaacaaagttcgaaatggatatcagtctgatgggtttcgacacgccgttcttccgcaacctccaccacattcttgaagccaccgacgacaccaccaccaacaacaaatcaagcaatgccggacctactggcgcttacgtccgtgacgctagagcaatggctgcaactccggctgatgtgaaggagtatcccaactcatacgtcttcatcgtcgacatgccgggtctgaagtccgaagatatcaaggtccaggtggaggaagacaacgtgttggtgataagtggagagagaaaaagggaacacgatcaggaagagaaggaaggagttaagtacgtgagaatggaaaggaggatcgggaagtttatgaggaagtttgcgttgccggaaaatgccaatatggagaagatatcggcgatttgtcaagatggagtgcttacagtgacggtggagaaactgccacctccggagcccaagaagccgaagacgattcaggtacaggttgcttgaagaacagaaacggagtttgtatgtggtgaaatttcttttaaagatcctgaatcgtgtgagaaggatcctagtgaagtgcgatcgataatgttggttataagaactagttgcttcattgatatctgtaatggtttgttattttgatcagtatttctagtgttatttcttatttgtataatcaaaatattgtgggtttgtgagggctgtatgac

SEQ ID NO: 2104 - DNA, 600 bp, Arnica chamissonis
taaatctgatttctgaattgttttctgcactcgcgatcagatctctgtaaaattaagatcataaaaaacagaattccaaatggacatcagtttgatgggtttcgacactccgttcttccgcaacctccaccacatcctcgaagacaacaccaccaccaacaaatcaaccaactcggagcccactcgtgcctacgtccgtgacgccagagcaatggcggcaactccggcagacgtgaaggagtatcctaactcctacgtgttcatcgtcgacatgccgggcctcaagtccggtgacatcaaggtgcaggtggaggaggagaacgtgctggtgattagcggggagaggaagagggagcatgatgaggaagagaaggaaggagtgaagtatgtgaggatggagaggagaatcggtaagtttatgaggaaatttgcgttgccggaaaatgccaacgttgagaagatatcggcgatctgtcaagacggtgtgcttaccgttacggtggagaaactgccaccgccggagccaaagaagccgaagacaattcaggtgcaggttgcttgaatcggatggggtaatatggttatgaataatgagtaggg

SEQ ID NO: 2105 - DNA, 736 bp, Cynara scolymus
  misc_feature (563)..(563): n is a, c, g, or t
  misc_feature (657)..(657): n is a, c, g, or t
  misc_feature (695)..(695): n is a, c, g, or t
  misc_feature (717)..(717): n is a, c, g, or t
ctgtatcccgtagatctcaactacaacacttcaattcgctcgaatttcgtaagaagatcaacaactcgaaatggatatcagtctgatgggtttcgacacccctttcttccgcaacctccatcacatccttgaagttaccgatgacggcaacagcaacaagtcaaacaccgccggtcctactcgcgcttacgtccgtgatgcaagagcaatggctgcaactccggctgatgtgaaggagtatcccaactcttacgttttcatcgtggacatgccgggtctgaaatccggtgatatcaaggtgcaggtggaggaggagaacgtgttggtgataagtggagagaggaaaagggaacacgaacaggaagagaaggaaggcgtaaagtatgtgaggatggagagaaggatcggtaagttcatgaggaagtttgtattgccagagaatgcgaacacggagaagatatctgcgatctgtcaagatggggttcttacagtaactgttgagaaacttcctccaccggagcccaaaaagcccaagttgatccaggttcaggttgcttgaatcnaagtggatcatgtggggtgtttctatgagcaatatggtttgaagaacgtcgacactcgatcgacatgtctaataatctgttgttttccgattgntattactgtaaccaatctgctgttgttggatcctgttncccttttggtctttatgaaatntatggcgatgttgatggtt

SEQ ID NO: 2106 - DNA, 764 bp, Cynara scolymus
cgggacctgtatccggtagatctcaactgcaactcacttcaattagctcgaacttcgtaagaagatcaacaactcgaaatggatatcagtttgatgggcttcgacacccctttcttccgcaacctccatcacatcctggacgccaccgatgacggcaacaacaacaagaagtcaagcaccgccggtcctactcgcgcttacgtccgggatgcaagggcaatggctgcaactccggctgatgtgaaagagtatctcaactcttacgtcttcatcgtggacatgccgggtctgaaatccggcgatatcaaagtccaggtggaggacgataacgtgttggtgataagtggggagaggaaaagggaacacgaacaggaagagaaggaaggagtaaagtatgtgaggatggagagaaggatcggtaagttcatgaggaagtttgtattgccagagaatgcgaacacggagaagatatctgcgatctgtcaagatggagttcttacagtaactgttgagaaacttcctccaccggagcccaaaaagcctaagttgatccaggttcaggttgcttgatgtggtaagaaattttacgaataatctgtatcttgtttctagaatagtagtgtgtttctatgagcaatatggtttgaatttttgaagaacgagtggggcataagtcgctcgatatatgtaatggtttgttgttttgctatgtatctctatcgctagctattactgtaatcaatctgtggtgtttgattttgttc

SEQ ID NO: 2107 - DNA, 769 bp, Taraxacum officinale
gtgctcgattcgtcattctgcatcaaaaatatctcgattcatacctacattgttcaatcgtgctcgaattttgggaaaaggtcgtcagcagatatagaaatggatatcagccttatgggattcgacacatcgtttttccgcaacctccaccacatcctcgaagcaactgacgacggcaccacaaacaacaaatcaatcaattgcggtcctactggcgcttatgtccgtgacgccagagcaatggctggaactccggctgatgtgaaggagtatcccaaatcttacgtgttcatcgtcgatatgccgggtctgaagtctggagatatcaaagtccagatcgaggaggacaacgtgttggttataagtggagagaggaaaagggagcatgatcaggaagagaaggaaggagtcaagtacgtgaggatggagaggaggatcggaaaattcatgaggaagtttgcgttgccagagaatgcgaatacggagaagatatctgctatttgtaaagacggaattcttaccgtgacggtggagaaactgcctccgccggagccgaagaaaccgaagacgatccaggtccaggttgcttgatgaacaatatggaatttgctcgtattcctgtgtgtggtaaaatttcagtgaataatctggatcctgtcattacttaagttttgatgttttagtggataactggatatggcgattggttagctacttacttgtaggctgttaaaatgaataaacattgtcggttttaggggatttgatc

SEQ ID NO: 2108 - DNA, 739 bp, Lactuca sativa
tcggtcacgaagatctcatttataattatattgttcaatcgcgttcgaattttagaaacagatcgtcaacaaagatcgaaatggatatcagtctgatgggtttcgacacgcctttcttccgcaacctgcatcacatcctcgacgccaccgaagacaacagcaacagcaaatcaagcaatgccggacctactcgcgcttacgtacgtgacgccagagcaatggctgcaactccggctgatgtgaaggaatatcctaactcttacgtcttcattgtcgacatgccaggtctgaagtccggagatatcaaggtccaggtggaagaagacaacgtgttggtgataagtggggagagaaaaagggaacatgatcaggaagagaaggaaggagtaaagtacgttataatggaaaggaggatcgggaagtttatgaggaagtttgctttgccggaaaatgctaatacggagaagatatctgcgatttgtaaagatggggtacttactgtcacggtggagaaactgccgccgccggagccgaaaaagccgaagacgatccaggttaacgttgcttgaataaccaaatcggattgctggaatgtcggtaaatggtgaaattctataaataatctggattctgtcagtaggtaggatcctagtgtaatgttatgggtaatgtagggttgaatttgatgaaccggttattccatatctgtaatggtttgttttgctctgtttgctttaga

SEQ ID NO: 2109 - DNA, 763 bp, Cynara scolymus
cgggacctgtatccggtagatctcaactgcaactcacttcaattcgctcgaaattcttaaagaagatcaacagctcgaaatggatatcagtctgatgactttcgacgcccctttcttccgcaacctccatcacatccttgaagccaccgatgacggcaacagcaacaagtcaagcaccgccggtcctactcgcgcttacgtccgggatgcaagagcaatggctgcaactccggctgatgtgaaggagtatctcaactcctacgtcttcatcgtggacatgccgggtctgaaatccggcgatatcaaagtccaggtggaggacgataacgtgttggtgataagtggagagaggaaaagggaacacgaacaggaagaaaaggaaggagtaaagtatgtgaggatggagagaaggatcggtaagttcatgaggaagtttgtattgccagagaatgcgaatacggagaagatatctgcgatctgtcaagatggagttcttacagtaactgttgagaaactccctccgccggagcccaaaaggcctaagttgatccaggttcaggttgcttgatgtgtttaagttctttacgaataatctggatcttgtttctaggatggtagtgtgtttctacgggcaatatggtttgaatttgaagaacgagtggggtataagtcactggatatatgtaatggtttgttgttttgctatgtatctgtatcgctggctatttctataatcaatctgtgttgttagattttgttcaag

SEQ ID NO: 2110 - DNA, 704 bp, Helianthus annuus
tccctcaaaatcccatatcagacataaattctataaccaatcgaaatggacatcgatagtttgatggggttcgatccgttactccgcaacctccactacatcctcgaagccactgacgacaacaccactggaaacaagtccaacaacagcggtccgtctcgcgcttacgtccgcgacgcaagagcaatggcggcaacccctgctgacgtcaaggagtgtcctaactcctacgtgtttattgttgatatgccggggctgaagtcaggggatataaaggtgcaggtggaacgcgacaacgttttggtgataagcggaaagaggaaccgagaggaagagaaggaaggagtcaagatggggaagttcatgaagaagtttgcattgccagaggatgcgaatacggataagatatcggcgatttgtcaagacggagtgcttacggtgactgtggagaagctgcctccgcctgagcccaagaagccgaagacgattcaggtgcaggtggcttgaagaattcgtatgcgatatgggaatgaaggatgtttggtgtgttatgagttaaggggtttgaagcatgttttgttgttttgctctgtttataatgaatctgatatcaggtgctctgtttgatacgataatgaatctgatatcagttttttaaaaacagagcaaaacaacaaaacatgcttcaaaccccttaactcata

SEQ ID NO: 2111 - DNA, 733 bp, Centaurea maculosa
  misc_feature (411)..(411): n is a, c, g, or t
tcagtaatagttctccattttgctacttactgatttcaattctctcaaattccagttaaaacaccaaccacaacaactcaactagaaaaatggacatcagctttatgggcttcgacacccctttcttccgcaacctccatcacatcctcgatgacgaaaacaccaacagcaagaagtcgagcaccgcctccggaccgactcgtgcctacgtccgtgacgccagggcaatggccgcaacccctgccgatgtgaaggagtacccgaactcttacgtcttcatcgtcgacatgcccggtctgaaatcgggcgatatcaaggtccaggtggaggatgaaaacgtgttggtggtaagtggtgagaggaagagggaagaggaagagaaggaaggggtgaagtatgtgaggatggagnggaggatcggaaagtttatgaggaagttcgtgttaccagagaatgctaacaccgaaaagatatctgccatctgtcaagatggggttttgatggtaacggtcgagaaactcccgccaccggagcctaaaaagcccaagttgatccaggttcaagttgcttgaacactgaatggagatgtggtttaggtttaatttctatgaataatggatcttgtttgtaggatggtggtgtgagaattatgtatggtgtttgatatatgtaatggtttgttgttttgctattgctatttgtattactctaatcaatgtgtcttgtgttgtcc

SEQ ID NO: 2112 - DNA, 785 bp, Carthamus tinctorius
cctggtttcttcttcttcttcctcagaatccacctcttccttcccctgcttcttcttctcccttataaatccacaaccaaaatgcttatctcgtcatcattcaatctcactaaatatatccgttgcttctgattttcaactccctcgaatttccgttattaaaacatcatcaacaacaactccaatcgaaatggacatcagctttatgggtttcgacacccctttcttccgcaacctccaccatatcctcgaagccaccgatgacgataacaacaagaagtcaaccaccaccggaccaactcgagcctacgttcgcgatgccagggcaatggcggcaactccggctgatgtgaaggagtaccccaactcatacgtcttcatcgtctacatgccgggtctgaaatccggcgatatcaaggtccaggtggaggaggaaaacgtgctggtgataagcggagagaggaaaagggaagatgaagaaagagtaaagtatgtgaggatggagaggaggaccggaaagtttatgaggaagtttgtattgccggagaatgctaatttagacaagatatccgccgtctgtcaagatggagttctgacggtaactgttgagaaactccctccaccggagcccaaaaagcccaggctgatccaggttcaagttgcttgaatcctgaatggagatgtggttaggttaatttctatgaataatggatctggatcttgtttttaggatggtggtgtctttttgtgtgagaattatggtgtttgatatatgtaatagtttg

SEQ ID NO: 2113 - DNA, 668 bp, Artemisia annua
agacgcactcaaaacatctcagttagctaattcaaaagaatcttcaatcactttcgaattccatcaaacaaacaatcaaaaatggacatcttcatgggcttggactcgcctttcttcattcacaacctccacaacatcctcgacgacacaaccaacaacaagtcaaccaaatccgaaccaacacgcgcttacgttcgcgatgcaagagcaatggcggcaacaccagcagacgtgaaggaatatccaaacgcgtacgtcttcattgtggacatgcctggattgaaatcaggtgatatcaaggttcaagttgaagacgacaatgttttggtgataagtggagagaggaaacgcgaagaggaagaaaaggaaggtgtgaagtatgtgcgaatggagagaaggattggtaagtttatgaggaagttttctttgcctgaaaacgcgaatattgacaagatttcggctgtttgtcaagatggagtgttgactgttactgttgagaagctgcctccacccgaggctaagaagcccaaattggttcaggttcaagttgcttgaatggattaggatttaaaatggaatgtgtttagtgtggtagatgtttttatgaataactagtgtgatgttctcaaagtatgagtaatgtagtttgtcgacttgctctggttaaa

SEQ ID NO: 2114 - DNA, 803 bp, Vitis vinifera
cacttctacattcgcaattgcagttgttcacattctcacaccaacaaatctctggaacccaacatggattcgaggatgatgggcttcgattctccactcttctctgccctccaacacatgctagacgccaccgatgactccgacaagtccgtcagcgcccccactcgcacctacgtccgcgacgccaaggccatggcggcgacgcctgctgacgtcaaggagtacccgaattcctacaccttcatcgtcgacatgccggggctgaagtccggcgacatcaaggttcaggtggaggacgacaatgtgctggtgatcagcggagagaggaagcgcgaggaagagaaggaaggcgtcaagtacgtgagaatggagaggagggtaggcaaatttatgaggaagtttgcgttgccggagaatgcgaatactgataagatctccgcggtttgtcaagatggagtactgaccgtcaccgttgagaagctaccaccgccggagcccaagaagcccaagaccattgaggtcaagatcgcttaaatctccgtgatttctgagtgggtaattgccgataagctggtctaattgggatttctgtgaatttggtcagggtatgatattgggtcattggcttctacatagaagctgatgatttctttacaaatattctagttttgagtatgaatgaaagccttcctgctctgtttttcttcttctttggtgtatctctcttctggttggaagcttcattgtatgcgtagagaagatgggaaaactgatcttcctaagaaatattaccctgaaactat

SEQ ID NO: 2115 - DNA, 567 bp, Arnica chamissonis
aaaccggcgaaaatgcagatcttcgtgaaaacccttacgggtaagacgatcacgttggaggttgaatcctctgacacaatcgacaatgtcaaggcaaagatccaagacaaggaaggcatcccgccggaccagcagcgtctcatcttcgccggaaaacagctcgaggacggcagaaccctagccgattacaacatccagaaggagtcaactcttcatctcgtcctccgtctacgcggtggcgcgaagaagcgtaagaagaagacctacacgaagccgaagaagatcaagcacaagcataagaaggtgaaattgagcgtgttgcagttctacaaggtcgatgattcaggaaaggtgcagaggttgaggaaagagtgccctaatgctgagtgcggagctggaactttcatggcgaatcatttcgatcggcactactgcggtaagtgtggacttacctatgtttaccagaaagcttgagttcaatccaattttctaagtatttcaactctgtttacatgttatggattatcgtcgtgtatttcgtactagttttatcgaaaactttgattt

SEQ ID NO: 2116 - DNA, 929 bp, Arnica chamissonis
atagcccatattctgatgttatgtaagcccaataaacccaagatagaacctttcgtcatagaagccctagccctataaataatcgtttcttttttattcaaaccctagtttcagtttctcactcgaaagcggcgaaaatgcagatcttcgtgaaaaccctaacgggtaagacgatcacgttggaggttgaatcctccgacacaatcgacaacgtgaaggcaaagatccaagacaaggaaggcatcccgccggaccagcaacgtttaatcttcgccggaaaacagctcgaagacggcagaaccctagccgattacaacatccagaaggagtccactcttcaccttgtcctccgcctccgaggtggcgcaaagaagcgcaagaagaagacctacacgaagccaaagaagatcaagcacaagcataagaaggttaagttgagcgtgttgcagttctacaaggtagatgattcaggaaaggtgcagaggttgaggaaagagtgccctaacgccgagtgcggagctggaactttcatggcgaatcatttcgacaggcactactgtggtaagtgtggtcttacttatgtttaccagaaggcttgagttttctttccaattagtcaaatatcgaatttcctttacatgttggttcttaattgtctcgcaaaccttgattaaggaggttgttttttaattgaaaacgctcagtgatttggtttagcagcagatctagatttatcagcatatcacaaagatatggttataggtttcatgattaggggtgtttgggcatgtgttttgtgaattataatctgattttggatattaggtatcataaaattaagaacaagatcggtggtcatttgtgtttgtattaatgcaagacctttggaataatgataaagcacaaacagaagcacaattctaaggcat

SEQ ID NO: 2117 - DNA, 692 bp, Cynara scolymus
  misc_feature (651)..(651): n is a, c, g, or t
cgcgggacctatcggccgtatcaagtcagtttggcgaaatgcagatcttcgtgaaaaccctaacgggtaagacgattacgttggaggttgaatcctccgatacgatcgacaatgtgaaggccaagatccaagacaaggaaggcatcccaccggaccaacaacgtctcatttttgccggaaaacagcttgaggacggcagaacccttgctgactacaacatccagaaggaatcgactctccacctggttctccgtcttcgtggtggcgcgaagaagcgcaagaagaagacctacactaagccgaagaagatcaagcataagcacaagaaggtgaagttgagtgtgttgcagttctacaaagtcgatgattccgggaaggtgcagcggctgagaaaagagtgtcctaatgctgagtgtggtgcggggactttcatggcgaatcatttcgataggcactattgcggcaagtgtggtctcacatatgtttaccagaaggcttaaggttgagtaacttagatatgtttcagttgtcctttctgagttatggattataatcttggatttttgttgttattttgtgttaagcctgaattttaggatttttgatttgaaattggaagttttttgttatcaacatatcaagaaatcttanttgtctgcagtgattgcttactacgtggctgtttatttttt

SEQ ID NO: 2118 - DNA, 808 bp, Taraxacum officinale
cggcggggaagttccaaatctcaatcgaaatcggcgacgatgcagatctttgtgaaaaccctaacgggtaagacgatcacgttggaggtagagtcctctgacacgatcgacaacgtgaaggcaaagatccaggacaaggagggaatccccccggaccaacaacgtctcatcttcgccggaaagcagctcgaggacggcagaaccctagccgactacaacatccaaaaggagtcaactcttcatcttgtccttcgtctccgtggtggtgcgaagaagcgcaagaagaagacttacaccaagccaaagaagatcaagcacaagcataagaaggtgaagttgagcgtgttgcagttctacaaggtcgatgattccggtaaggtgcagcggttgaggaaagagtgccctaacgccgagtgcggagctggaacgtttatggccaaccatttcgataggcactactgtggtaagtgtgggcttacttatgtttaccaaaaggcttgagttttgaattagacaagtgtcgattttaccttacatgttatgaatttctgtaatttctcggtgtataaccatgatttcagaggttgttttcgaattaaacttattgaatgctttgcatttttagatatggatgtttgattatgttggtttttggattttgcttctttttaggtagaaagatgtttttgagtgaatggtcttagatcatatttgttacttgataagaatcgtatctcaattttgaactaaactgtacaaaataagacgacattgcacatttgttagtgcatgggacattgagatatcg

SEQ ID NO: 2119 - DNA, 642 bp, Gerbera hybrid cultivar
atctcccccaaaatcggcgaaaatgcagatcttcgtgaaaaccctaacgggtaaaacaatcacgttggaggtcgaatcctccgacacgatcgacaatgtcaaggcaaagatacaagacaaggaaggcatcccgccggaccaacagcgcctgatcttcgccggaaaacagctcgaagacggcagaaccctagccgactacaacatccagaaggagtcgactcttcaccttgttcttcgtctccgtggtggtgcgaagaagcgtaagaagaagacgtacaccaaaccgaagaagatcaagcacaagcataagaaggtgaagttgagtgtgttgcagttctacaaggttgatgattcagggaaggtgcagaggttgaggaaagagtgccctaatgctgagtgcggtgcggggactttcatggcgaatcatttcgatcggcactattgcggcaagtgtggtcttacctatgtgtaccagaaggcgtaagttcgattgaattagataagtatcaaatttcgttttcatcttatggattatgattatgcgtttcgtcgttattttcttgtaaaccttgatttcgagtattgtttttgaatcgaaaaatttggatgctttagtttatcaataaaaaaaaaaaaaaaaaa

SEQ ID NO: 2120 - DNA, 639 bp, Lactuca sativa
ccgtatctccatcacaaatcggcgaaatgcagatcttcgtgaaaaccctaacgggtaagacgatcaccttggaggttgaatcctccgacacgatcgacaatgtgaaggcgaagatccaggacaaggaaggcattccaccggaccaacagcgactcatcttcgccggaaagcagcttgaagacggtagaacacttgccgactacaacatccagaaagagtcgactctccacttggtcctccgcctccgcggtggcgcaaagaagcgcaagaagaagacatacacgaaacccaagaagatcaagcacaagcacaagaaggtgaaactgagcgtgttgcagttctacaaggttgatgattccggtaaggtgcagaggttgaggaaagagtgcccgaatgccgagtgtggtgctgggactttcatggccaatcatttcgatcgccactactgcggcaaatgcggacttacctatgtctaccagaaagcttgagtttgattgaattagataagtaatttttatatgttctggatgatgtttctgaatttttgtggttatttttgattaaaaatggataattatgttgtttttttttacttaatttgaatgctttcactagagtatgacatgattttcaccaaaa

SEQ ID NO: 2121 - DNA, 798 bp, Lactuca sativa
gatagccatttttctcggaaccctagtcctataaaagttatccttttcctttcaactctagttcctgaatcccacacgaaatcgccgacgatgcagatcttcgtgaaaaccctaacgggtaagacgatcacgttggaggtagagtcctctgacacgatcgacaatgtgaaagcaaagatccaggacaaggagggcatcccaccagaccaacaacgtctcatcttcgccggaaagcagctcgaggacggcagaaccctagccgactacaacatccagaaggagtcaactcttcaccttgtcctccgcctccgtggtggcgcaaagaagcgtaagaagaagacctacaccaagccaaagaagatcaagcacaagcacaagaaggtgaagttgagcgttttgcagttctacaaggtcgatgattcagggaaggtgcagcggttgaggaaagagtgccctaatgctgagtgcggagctggaacgtttatggcgaaccatttcgataggcactactgtggtaagtgtggacttacctatgtttaccaaaaggcttgagttttattcaattagataagtatcgatctttcttttacatgttatgtatttctgtagttgatctgtttctaaccttgattttggaggtttgtttttgaattcagcatcttgaatgctttacattttgggttatggatgtgttctaaaattaataatctttgctgcagttagtaagattattcaaaactataatcatctttagtgtagctattaagattttattcgaaaggataccaggcggggaga

SEQ ID NO: 2122 - DNA, 594 bp, Lactuca sativa
caaatcggcgaaatgcagatcttcgtgaaaaccctaacgggtaagacgatcaccttggaggttgaatcctccgatacgatcgacaatgtgaaggctaagatccaagacaaggaaggtattccaccggaccaacaacgactcatcttcgccggaaagcagcttgaagacggtagaacacttgccgactacaacatccagaaggagtcgactctccacttggtcctccgtctccgtggtggcgcaaagaagcgcaagaagaagacatatacgaagcccaagaagatcaagcacaagcacaagaaggtgaagctgagcgtgttgcagttctacaaggttgatgattccggtaaggtgcagaggttgaggaaggagtgcccgaatgccgagtgtggtgcagggactttcatggccaatcattttgataggcactactgcggcaaatgtggacttacctatgtctaccagaaggcttgaggttgatttaattagataagtactttttatatgttatggatgatatttctgaattttgtggttattttgattaaacatggataatgatggtgtttttttttacttaatttgaatgctttc

SEQ ID NO: 2123 - DNA, 609 bp, Lactuca sativa
ccgtatctccatcacaaatcggcgaaatgcagatcttcgtgaaaaccctaacgggtaagacgatcaccttggaggttgaatcctccgacacgatcgacaatgtgaaggcgaagatccaggacaaggaaggcattccaccggaccaacagcgactcatcttcgccggaaagcagcttgaagacggtagaacacttgccgactacaacatccagaaggagtcgactctccacttggtcctccgtctccgtggtggcgcaaagaagcgcaagaagaagacatacacgaaacccaagaagatcaagcacaagcacaagaaggtgaaactgagcgtgttgcagttctacaaggttgatgattccggcaaggttcagaggctgaggaaagagtgcccgaatgccgagtgtggtgctgggactttcatggcaaatcatttcgataggcactactgcggcaaatgcggacttacctacgtctaccagaaagcttgaggttgattgaattagataagtgctttttatatgttatggataacaattctgaattcatgtggttatttttgattaaaaatggataatgatgttgttttttttacttaatttgaatgctttc

SEQ ID NO: 2124 - DNA, 631 bp, Carthamus tinctorius
cggggaaccccaatcggcgaaatgcagatcttcgtgaaaaccctaacggggaagacgatcaccttggaggtcgaatcctccgatacgatcgacaacgtgaaggccaagatccaggacaaggaaggcatcccgccggaccagcagcgcctcatcttcgccggaaaacagctcgaggacggcaggaccctagccgactacaacatccagaaggagtccaccctccacctggtcctccgcctccgcggcggcgccaagaagcgcaagaagaagacctacaccaagccgaagaagatcaagcacaagcacaagaaggtgaagctgagcgtgctgcagttttacaaggtcgacgactcggggaaggtgcagaggctgaggaaggagtgccctaacgccgagtgcggagctggaaccttcatggcgaaccacttcgatcggcactattgcggtaagtgtggtctcacctatgtctaccagaaggcttgaggttagatcgaattagatataagtatattttttctatatgttttggatgattttgattctggaattttgttgttgttttttggtgaaacatggatgatgatgatgttgctgatttcagtttgatgaattcgagtgttttgtttcatta

SEQ ID NO: 2125 - DNA, 553 bp, Tragopogon dubius
aatcggcgaaaatgcagatcttcgtgaaaaccctaacgggtaagacgatcacgttggaggtagagtcatccgacacgatcgacaatgtgaaggcaaagatccaggacaaggaaggcatcccaccggaccagcaacgtctgatcttcgccgggaaacaactcgaggacggccgaactctagccgactacaacatccagaaggagtcaactcttcatcttgtcctccgcctccgtggtggcgcaaagaagcgcaagaagaagacgtatacaaagccaaagaagatcaagcacaagcataagaaggtaaagttgagcgttttgcagttctataaggtggatgattccgggaaggtccagaggttgaggaaagagtgccctaatgcggagtgcggagctggaactttcatggcgaatcatttcgataggcactactgtggtaagtgtgggcttacctatgtttaccagaaagcatgattttcatcgaattagatcagttttgaacttggtttacatgttataattttcagtaattctgttgcaaaccttgattatgg

SEQ ID NO: 2126 - DNA, 608 bp, Guizotia abyssinica
gtttcatctaatcggcgaaaatgcagatcttcgtgaaaaccctaacgggtaagacgatcacgttggaggtcgaatcctccgacacaatcgacaatgtgaaggtgaagatccaggacaaggaaggcattccaccggaccagcaacggctaatattcgctggaaagcagctggaggacggcagaaccctagccgattacaacatccagaaggagtcgactctccacctcgtcctccgtctccgcggtggcgcgaagaagaggaagaagaagacatacacgaagccgaagaagatcaagcacaagcataagaaggtgaagctaagcgtgttgcagttctacaaggtggatgattccggtaaggtgcagaggttgaggaaggagtgccctaacgcagagtgcggagctggaactttcatggcgaatcattttgataggcactattgtggtaagtgtgggcttacttatgtttaccagaaggcttgagctttttttttttatcaattagaactttgttggaatattatggttttgtttttgaaagtaattgtctggcaaaccttgactacggaggttgtttttgaattgaaatatttcaatattttggtttag

SEQ ID NO: 2127 - DNA, 598 bp, Cynara scolymus
tctgacccactccaatcggcgaaatgcagatcttcgtgaaaaccctcacgggtaagacgatcacgttggaggttgaatcctccgacacgatcgacaacgtgaaggcaaagatccaagacaaggaaggcatcccaccggaccaacagcgtctcatcttcgccgggaaacagctcgaagacggaagaaccctagccgactacaacatccagaaggaatcaactcttcaccttgtcctccgcctccgtggtggcgcaaagaagcgcaagaagaagacctacaccaagccaaagaagatcaagcacaagcataagaaggtgaagttgagcgtgttgcagttctacaaggtcgatgattcggggaaggttcagaggctcagaaaggagtgccctaacgccgagtgcggagctggaactttcatggcgaatcatttcgataggcactactgtggtaagtgtggacttacctatgtttaccagaagccgtgagttctattgaattagattattatcgaacttcctttacatgttatggattatggttttgaatttggaagccttgactatgaggctgttttttaattgaaaattttgaatccttt

SEQ ID NO: 2128 - DNA, 754 bp, Taraxacum officinale
cagtgcattcggtgaaatgcagatcttcgtgaaaaccctaacggggaagacgattacgttggaggttgaatcctccgacacaatcgacaatgtgaaggccaagatccaagacaaggaaggcatccccccggaccagcaacgtcttattttcgccggtaagcaacttgaggacggcagaactctcgccgactacaacatccagaaggagtcaactctccacctggttctccgtcttcgtggaggagccaagaagcgcaagaagaagacctacacgaaaccgaagaagatcaagcataagcacaagaaggtgaagttgagtgtgttgcagttctacaaggttgatgattcaggaaaggtgcagaggttgaggaaagagtgtccgaatggtgagtgtggtgcggggactttcatggcgaaccatttcgataggcactattgtggcaagtgtggtctcacttatgtctaccagaaggcttgaaatggatcaaattagataagtgttcgttgttatttttgagttgagagttataatttgaattttgctagttatatcttgttatgaacctggatttgtagggttgtttttgaattgctgaaattgattgctttttacattgatctgcattctacttagatagtgtgttaatattcatgaatctgttatagcttttctgatttggctttaggtactaaaagcttaaataacatgatagatttatcaaatgaattcattgccttccaaaaaaaaaaaaaa

SEQ ID NO: 2129 - DNA, 573 bp, Taraxacum officinale
tccaagtcggcgaaatgcagatcttcgtgaaaaccctaacgggtaagacgatcaccttggaggttgaatcctccgatacgatcgacaatgtgaaggccaagatccaagacaaggaaggtattccaccggaccaacaacgtctcatcttcgctggaaaacagcttgaagacggtagaacacttaccgactacaacatccagaaggaatcgactcttcacctggtgctccgtcttcgtggtggcgcaaagaagcgtaagaagaaaacctatacgaagccgaagaagatcaagcacaagcacaagaaggtgaagctgagcgtgttgcagttctacaaggttgatgactccggtaaggtgcagagattgaggaaagaatgcccaaatgctgagtgcggtgccgggactttcatggctaatcatttcgataggcactactgtggcaaatgcggacttacctatgtctaccagaaggcttaaagttgaatgaattagataagtttttctatattttgtggatgatatttctggattttgtggttattttggttaaacctggatgttaatgttgtttttt

SEQ ID NO: 2130 - DNA, 635 bp, Gerbera hybrid cultivar
gccctatcggcgaaaatgcagatcttcgtgaaaaccctaacgggtaagacgatcaccttggaggtcgaatcctccgacaccatcgacaacgtgaaggccaagatccaagacaaggagggcatcccgccggaccaacaacgtctcatcttcgccggtaaacagctcgaggacggccgaaccctcgccgactacaacatccagaaggaatcaactctccaccttgttctccgactccgcggtggcgcgaagaagcgcaagaagaagacctacaccaagccgaagaagatcaagcataagcacaagaaggtgaagcttagcgtgttgcagttctacaaggttgacgattccggcaaggtgcagaggttgaggaaagagtgtcctaatgctgaatgtggcgccggaactttcatggcgaatcattttgataggcactattgcggtaagtgtggtctcacttatgtttaccagaagggttaaggtttgatctgattaaattagttaagtatcaattatcagttatgagttttcaattatgattctggattttttaggtattttgggtaagaccttaaagtttaggtttgcttttgattttgtgaaattgaaagcctttgtttatcaaaaaaaaaaaaaaa

SEQ ID NO: 2131 - DNA, 655 bp, Senecio madagascariensis
agaaacatagccacccacctccctcaaaatgcagatcttcgtgaaaaccctaacgggtaaaaccatcaccctcgaggttgaatcctcggacaccatcgacaatgtcaaggccaagatccaagacaaggaaggcatcccacccgaccagcaacgtctcatcttcgccggaaagcagctcgaagacggacggactttagccgactacaacatccagaaggagtccactcttcatctggtgctgcgcctacgtggtggggcgaagaagaggaagaagaagacgtacaccaagccaaagaagatcaagcacaagcataggaaagtgaagctgtcggtgttgcagttttacaaggtcgatgattccgggaaagtgcagaggttgaggaaagagtgtccgaatgccgagtgtggggccgggactttcatggcgaatcattttgataggcattattgtggtaagtgtgggttgacctatgtttaccagaaggcttgagaagatggatttcatgattcaggttgttttctgaatttaggtttatgtttttcttattcatgttttatggattataattttggattatgttgtttttgagacttatggttgtttatgctacttttcatattatcaatctgaaatggttttacttttttaaaaaaa

SEQ ID NO: 2132 - DNA, 664 bp, Tragopogon dubius
ggggaatcaccgtttctgcgtcccaaatcggcgaaaatgcagatcttcgtgaaaaccctaacgggtaagacgatcaccttggaggttgaatcctccgatacgatcgacaatgtgaaggccaagattcaagacaaggaaggcatcccaccggaccaacaacggctcatcttcgccggaaaacagcttgaggacggcaggacacttgccgactacaacatccagaaagagtcgactctccacctggtcctccgtctccgtggtggcgcaaagaagcgcaagaagaagacatacacaaaacctaagaagatcaaacacaagcacaagaaggtgaagctgagcatattgcagttttacaaggttgatgactctggaaaggttcagaggttgaggaaagagtgtcctaatgccgagtgcggtgcaggaaccttcatggctaatcatttcgataggcattactgcggcaaatgtgggcttacctatgtctaccagaaggcttaagattacttcagttagataagtacttttcatatgtcatgaattataattctggattttgtggttaattttgtgtaaacctggatgattttgttgcttttgtgctgagtttgaatgcttttgttgattgcttaccgaaaaaaaaaaaaaaaaagcactctgcgttgat

SEQ ID NO: 2133 - DNA, 763 bp, Malus domestica
aaattaacctcaactttccaccacttttgtttgaaacgcatctgattaaacttcccaatacaaaatccaacatcatatcaaaattaacaatcagcaaacaaacgattgataacaaaattagggtaatcattccatctgggatatgcaatagaaacaacgaaaacgcctaaagtctcatgggttcttcaagcatgaaattaaaatcccaaagcaccataaagcatcgaaatttaaaatccatggcgatataattcgaaattaaaaattctaaattactctaatcaccgccagccttctggtaaacataggtcaatccgcacttgccgcagtagtgcctgtcgaagtggttcgccatgaaagttccagcgccgcactcggcattggggcactccttccgcagcctctggaccttgccggaatcatccaccttgtagaactggagcactgcgagcttcaccttcttgtgcttgtgcttgatcttcttgggcttggtgtaggtcttcttcttcctcttcttggcgccaccgcggaggcggagcaccaggtggagggtggactccttctggatgttgtagtcggcgagggttcggccgtcctcgagctgcttgccggcgaagatgaggcgctgctggtccggggggatgccctccttgtcttggatcttggccttgacattgtcgatggtgtcggaggactcgacctctagggttatggtcttacccgttagggttttcacgaagatctgcatggttgcggccgcaga

SEQ ID NO: 2134 - DNA, 543 bp, Platanus occidentalis
aggaagagaccctagcggtagcttaccgtcctctcccttctcttactcagcgaagatgcagatcttcgtgaaaaccctaacagggaaaacgataaccctagaggtcgaatcctcggacaccatcgacaatgttaaggccaagatccaagacaaggaaggcatccctcccgatcagcagcgcctgatcttcgccggaaaacagctcgaggacggaagaactctagccgattacaacatccagaaggaatcgacgcttcacctggttctccgtctcagggggaggagcgaagaagcgaaagaagaagacctacacgaagcccaagaagatcaagcacaagaagaagaaggttaagctcgctgtgttgcagttctacaaggtcgacgattcgggtaaggttcagaggctcagaaaggagtgccccaatgctgagtgtggtgccgggacgttcatggctaaccattttgatcgtcactattgtggcaagtgtggccttacctacgtctatcagaaggctggaggtgagtgagagagatatggtggtg

SEQ ID NO: 2135 - DNA, 673 bp, Cicer arietinum
gattttccgagcgggccgcccgggcaggtcgagagagcttgacacactttccaccaagatgcagatcttcgtgaaaaccctaacgggtaagacgatcaccctcgaggtggagtcttccgacacaatcgacaatgtcaaagcaaagatccaagacaaggaaggaattccaccagaccaacagcgtctcatcttcgccggaaagcagttggaagacggccgcactctcgccgactacaacatccagaaggaatcaactctccaccttgtcctccgtctccgcggtggcgctaagaagcgtaagaagaagacctacaccaagccaaagaagatcaagcacaagcataagaaggtgaagctcgctgttcttcaattctacaaggttgatgattctggaaaggtgcagaggttgaggaaggagtgtcctaatgctgagtgtggtgctggaactttcatggcgaatcatttcgatcgtcattactgtggtaagtgtggactcacctacgtttaccagaaggctgaagcttgagtttctatattttagttttgcgttttgttttggctgaactttttaatgttttggttttaatggattcgttttgaaacttttaatattttgttagttgaatataaaatatcagattctgatatgttttgaattatgattgttggggca

SEQ ID NO: 2136 - DNA, 765 bp, Vigna unguiculata
aagcacaaaccctgcaagtaaaccctagccgtcgcgatgcagatattcgtgaaaaccctcacggggaaaaccatcacccttgaggttgagtcttcggacacaatcgataatgtgaaggccaagatccaggacaaggagggtatcccgccggatcagcagcgtctcatcttcgccggaaagcagctcgaggacggccgcaccctcgccgactacaacatccagaaggagtccactctccacctcgtcctccgtctacgtggcggcgccaaaaagcgcaagaagaagacctataccaagcctaagaagatcaagcacaagcacaagaaggtgaagctcgccgtcttgcagttctataaggttgacgactccggcaaggtgcagaggctccgcaaggagtgccctaacgctgagtgcggcgccggaaccttcatggctaaccatttcgatcgtcactactgcggcaagtgcggcctcacttatgtctaccagaaggccggtgcctaagttgtaatgcatttgcttttcttactgttatttttagttcttaaagttttgtttaatgttttgttcttttagtgttgcgactgtttcggtttaattaaacttttatcaatactttatggatttcgattatctgttattcgcatccatattttgttaatcccgttgaagtagtttatgctcgaattgctgtggtggttaattcttctatgaagattaaaggggattttagggtaaaattgatctcgtgaaagtgcttctttt

SEQ ID NO: 2137 - DNA, 804 bp, Vigna unguiculata
gtccgcaacttagcagcacaaaccctgcatcgaaaccctaggtctcagcaacgatgcagatattcgtgaaaaccctcacggggaagaccatcacccttgaagtagagtcttcggacaccatagacaatgtgaaggccaagatccaggacaaggagggcatcccgccggatcagcagcggctcatcttcgccggaaagcagctcgaggacggccgcaccctcgccgactacaacatccagaaggagtccaccctccaccttgtcctccgcctccgcggcggagccaagaagcgcaagaagaagacctacaccaagcctaagaaaatcaaacacaagcacaagaaggtgaagctcgctgtgttgcagttctacaaggttgacgactccggcaaggtgcagagactccgcaaagagtgtcccaacgctgagtgtggcgccggaacgttcatggccaaccacttcgatcgccactactgcggcaagtgcggcctcacctatgtttatcaaaaagctgatgcttaattctaattaatgtcgttttattagtatataaaattgggaatgataggttccatttgtactgttttggtgaaactttgaaactttgatgctctcctcattttcttcaatatattgttatttttgttagaatgaaattgactcatacttattcataaggttgtttttgtatgttgaggtctaggattttgaaaagattaaattagagtttgatgaatttggatttgagattttgggttggattggattgtgtaagttaaatttgtgaaaactcgacggtgttttc

SEQ ID NO: 2138 - DNA, 718 bp, Vigna unguiculata
aagaacaaaccctggaagtaaaccctagcgctccgtcgcgatgcagatattcgtgaaaacccttacggggaaaaccattacccttgaggttgagtcttcggacacaatcgataatgtgaaggccaagatccaggacaaggagggcatcccgccggatcagcagcgtctcatcttcgccggaaagcagctcgaggacggccgcaccctcgccgactacaacatccagaaggagtccactctccacctcgttctccgtctccgtggtggtgccaagaagcgcaagaagaagacctataccaagcctaagaagatcaagcacaagcacaagaaggtgaagctcgctgtcttgcagttctacaaggttgacgactccggcaaggtgcagaggcttcggaaggagtgccccaacgctgagtgcggcgctggaaccttcatggctaaccatttcgatcgtcactactgcggcaagtgtggtctcacttatgtctaccagaaggccggtgcctaagttgtaacggatttgcttttcttacttttatttttagttcttaaagttttgtttcatgttttgttcgtttagtgttgcgactgtttcggtttaattaagcttttctcaatactttatcgatttggattgtcaattattcgcatccatattttgttaattccgttgaagtagtttatgatcgaattgctatggcggttaattgttctatga

SEQ ID NO: 2139 - DNA, 685 bp, Cyamopsis tetragonoloba
cacgaggccgagacagaaaccctagccgtatccctcctatagccgaagatgcagatcttcgtgaaaaccctaacggggaagacaatcaccctcgaggttgaatcttccgacacaatcgacaatgtgaaggcgaagattcaagacaaggagggaatcccaccggaccagcagcgtctcatcttcgccggaaaacagctcgaggacggtcgcaccctcgccgactacaacatacagaaggaatccaccctccacctcgtcctccgtctccgcggtggtgccaagaagcgcaagaagaagacctacaccaagcccaagaagatcaagcacaagcataagaaggtcaagctcgccgttcttcagttctacaaggtggatgattctggaaaggttcagaggcttcgcaaggagtgccctaacgccgagtgcggcgctggtacattcatggccaaccacttcgaccgccactactgcggcaagtgtggcttgacctatgtttaccagaaggcttctgcttgatttatttcagtttcgatgttttgttagtattaattaaagttttgaactatcgtttcttcgaatagttggtagacgtttttgcgtttcaatatttgtttgagacttctgtgaacactattccgtgttggtttgtttatgaattatgtttctcttaaaaatagcaaaaagg

SEQ ID NO: 2140 - DNA, 658 bp, Gerbera hybrid cultivar
gcaaagatgcagatcttcgtgaaaaccctaacgggaaagacgataaccctagaggtcgaatcctccgacacaattgacaatgtgaaagccaagatccaagacaaagaaggcatcccaccggaccaacaacgcctcatcttcgccggaaaacagctcgaggacggcagaaccctggccgattataacattcagaaggaatccactctccatcttgtcctccgtctccgtggtggtgcgaagaagcgtaagaagaagacctacacaaagcctaaaaaaatcaagcacaaacataagaaggtcaagcttagcgtattgcagttttacaaggtcgacgataatggaaaggttcagaggttgaggaaggagtgccctaatgccgagtgcggtgccgggacgttcatggcgaatcactttgatcgacattattgcggtaagtgtggcctcacttatgtttatcagaaggctggtggtgattaatttctacttgttttattaacttttcgtttagatttactttccagcagtaatgttgcactgcgattcaaacattcattataagtttttgcctttatgatatgacatatgatacttagttgcgagttattttgataggtgatttaatttttctctgattttgagcaaaaaaaaaaaaaaaaaa

SEQ ID NO: 2141 - DNA, 793 bp, Glycyrrhiza uralensis
atataaaagcctctaaggaacgaaactcctctctcgttacaaccctaatttaccttgtgctctctcacatctcatcaccggcgctgagtacactatccgaagatgcagatcttcgtgaaaaccctaacggggaagacaatcaccctagaggtggagtcttccgacacaatcgacaacgtgaaagcgaagatccaagacaaggaagggattccaccggaccagcagcgactcatcttcgccggaaagcagctcgaagacgggcgaaccctcgccgactacaacatacagaaggagtcaacacttcacctcgtcctccgcctccgcggtggcgcaaagaagaggaagaagaagacttacaccaagcccaagaagatcaagcacaagcataagaaggtgaagcttgcagtgctccagttctacaaggtggatgactctgggaaggttcagaggctgaggaaggagtgccccaatgctgagtgtggtgctgggactttcatggctaaccactttgatcgccactactgcggcaagtgtggcttgacctatgtttaccagaaagctggtgcctaattaccgttttacccttcccccccgttattggattttggtattttagtatttgaagttttgctttttgtttatttagacaaatggggtagacgtttttcgcttttatccatatgactgcctgaatgtttcgtttttaatagcctggtattgaacactatttcgtgttactttttatttatatttgaatcggataaatctggcatcttataaatcattgtgtcct

SEQ ID NO: 2142 - DNA, 718 bp, Glycyrrhiza uralensis
gcccctgaaaccgatactctccaatccaatcctcttggtttggttgaggaagcagcagcagcagcaatttggttgcaacaagatgcagatcttcgtgaagaccctaacggggaagacgataaccctagaggttgagtcttcagacacaatcgacaacgtgaaggcgaagatccaggacaaggaagggatcccaccggaccaacaacgcctcatcttcgccgggaagcaactggaggacggtcgcacactcgccgactacaatatccagaaggagtcgacgctccacctcgtcctccgactccgcggcggcgcgaagaagaggaagaagaagacatacactaagcctaagaagatcaagcacaagcacaagaaggtcaagctcgctgtgctacagttctacaaggtcgatgactcagggaaggtacagaggctaaggaaggagtgccctaatgctgagtgcggcgctggaacgttcatggctaaccacttcgaccgccactactgtggtaagtgcggcctcacctatgtctaccagaaagccgctgcctgaaactgaaactgaaactcatccgattcgatttttcaatgtttttttttattttaatagcttggttttgaatgaaactttattatatgttactgctatttgagtataaatcagattctgctcctttattatgattatgttggtgtgctactggctttattaaatttaatt

SEQ ID NO: 2143 - DNA, 754 bp, Glycine max
ctgagagaaaccctagctagccacaatgcagatattcgtgaaaaccctaacggggaagacgataaccctagaggtagagtcatcggacacaatcgacaatgtgaaggcgaagatccaggacaaggagggcatcccgccggaccagcagcgcctgatcttcgccggtaagcagctggaggacggccgcaccctcgccgactacaacatccagaaggagtccacgcttcacctcgtcctccgcctccgcggcggcgccaagaagcgcaagaagaagacctataccaagcctaagaagatcaagcacaagcacaagaaggtgaagctcgctgtcttgcagttctacaaggttgacgactccggcaaggtgcagaggctccgcaaggagtgccccaacgctgagtgcggcgccgggactttcatggccaaccacttcgatcgccactattgcggcaagtgtggtttgacctatgtttaccagaaggctgaggcttagggttacatttcgttttttctagtttctggattttggaattttattattagtataatactctgtttttttgtctgtattttggtcgcatattattatgactgcctgaatgttctgccttttcataatttagtttcaatgttttatgaattgtgttgcatcttttgttttttaaaattggttttaattttgaaatgaattgatatgtagttggttgattttactaagtttaatggaagtttgtaggtaaaatcaattcaataa

SEQ ID NO: 2144 - DNA, 1650 bp, Capsicum annuum
caccaagtggtgaaaaatgcagatctttgtgaagaccctgacgggcaagactattaccttagaggtagagtcatccgacaccatcgacaacgtcaagaccaagattcaagacaaggaaggcatcccgccggaccagcagaggttgattttcgcaggtaagcagctcgaggatggccggacactagctgactacaacatccagaaggagtccactctccaccttgtccttcgtctccgtggtggtgctaagaagcgtaagaagaagacatacactaagccaaagaagatcaagcacaagaagaagaaggtcaagctcgctgtcctccagttttacaaggttgatgattccggcaaggtccagaggctccgtaaggagtgcccaaatgctgagtgtggtgccgggaccttcatggctaaccatttcgataggcactattgtggtaaatgtggtcttacctatgtttaccagaaggctggtggtgattagatgagtgttagtaatgtcttactcttatgacaatacttttgtaatgtcttgtttgttacaagatgtaatgaattttgaattatcagattatgttgcctgcttataagaagtttcaagactttttgtcaagaaaaaaaaaaaaaaaaaaaactcgagactagttctccctcgtgccgaattcggcaagaggaactagtaaccccctcactttcctctttataaaccatggcagctgctactatggctctttcttccccttcttttgccggacaggcagtgaagctctcaccatctgactcagaaatctctggaaatggaaggatctccatgagaaagactgcctccaagccagccgcatctagcagcccatggtatggtccagaccgtgttaagtacttgggcccattctctggtgagcccccaagctacttgactggtgaattccctggtgactatgggtgggataccgctggactttcagcagaccctgaaacctttgccaagaaccgggaactcgaggtgatccactgcagatgggctatgcttggtgctcttggatgtgttttccccgagctcttggcccgtaacggtgtccagtttggtgaggctgtgtggttcaaggctggatcccagatcttcagcgagggtggacttgactacttgggcaacccaagcttggttcatgcacagagcatcttggccatctgggcttgccaagttgtcttgatgggagccgttgagggataccgtattgctggtgggcctcttggtgaagtcgtcgacccactctaccccggtggcagcttcgacccattaggtcttgctgatgatccagaggcatttgctgagctcaaggtaaaggagattaagaacggtagacttgctatgttctctatgtttggattctttgttcaagccattgttactggaaagggtccattggagaaccttgctgaccaccttgcagatccagttaacaacaacgcatgggcctacgccacaaactttgtccccggaaaatgaaaatcttaaaattttattgtttattggtcttgtaaagttgttatgagcagtcacttgacaatagaatggatttttttctcatattccaataattgtgtagttctgagttacattttccaaagccatgaataaaatttttt

SEQ ID NO: 2145 - DNA, 729 bp, Malus domestica
ccaccgtctgcggccgcaaccatgcagatcttcgtgaaaaccctaacgggtaagaccataaccctagaggtcgagtcctccgacaccatcgacaatgtcaaggccaagatccaagacaaggagggcatccccccggaccagcagcgcctcatcttcgccggcaagcagctcgaggacggccgaaccctcgccgactacaacatccagaaggagtccaccctccacctggtgctccgcctccgcggtggcgccaagaagaggaagaagaagacctacaccaagcccaagaagatcaagcacaagcacaagaaggtgaagctcgcagtgctccagttctacaaggtggatgattccggcaaggtccagaggctgcggaaggagtgccccaatgccgagtgcggcgctggaactttcatggcgaaccacttcgacaggcactactgcggcaagtgcggattgacctatgtttaccagaaggctggcggtgattagagtaatttagaatttttaatttcgaattatatcgccatggattttaaatttcgatgctttatggtgctttgggattttaatttcatgcttgaagaacccatgagactttaggcgttttcgttgtttctattgcatatcccagatggaatgattaccctaattttgttatcaatcgtttgtttgctgattgttaattttgatatgatgttggattttgtattgggaagtttaatcaga

SEQ ID NO: 2146 - DNA, 844 bp, Malus domestica
gagagagttgaaaaccctagccgaatctcccccaatctctctgtgtcttctgcggagagcaaaggatgcagatcttcgtgaaaaccctaacggggaagacgataaccctagaggttgagtcttccgacaccatcgacaatgtgaaggccaagatccaggacaaggagggcatcccgccggaccagcagcgcctcatcttcgccggcaagcagctggaggacggccgtaccctcgccgactacaacatccagaaggagtcgactctgcacctggtgctccgcctccgcggtggcgctaagaagcgtaagaagaagacctacaccaagcccaagaagatcaagcacaagcacaagaaggtgaagctcgccgtcctccagttctacaaggtcgacgattccgggaaggtccagaggctgaggaaggagtgccccaacgctgagtgcggcgccgggactttcatggccaaccattttgacaggcactactgtggtaagtgtggtctcacctatgtttaccagaaggccggcggcgactgagttaaacgcaccgtttaatatgttcgtttctgaaacagatggttaagtttaaataattttgatttagacttggaacggtggttgttatggattatggttgatgtttttgatatggtactttagaattttaatttcgactttgaagttcaatggttagctatcacaattttgttttattatttgtcctgtgattttgtgtgccttagattattgaatggatggataaactcgttgttattgaattggtacaatctggtttccgattgtttctgctgcgatggcgtgtaattggttgcgtaataacgtaa

SEQ ID NO: 2147 - DNA, 645 bp, Fagopyrum esculentum
gcgccgaatagcgaagatgcagatctttgtgaaaacactaaccgggaagacgataaccctagaggttgaatcttccgacaccatcgacaatgtgaaagcgaagatccaggacaaggaaggcatcccaccggaccagcagcgtctcatcttcgccggcaaacagctagaggacggtcgtaccctcgccgactacaacattcaaaaggagtctaccctccacctggtgctccgtctccgtggtggcgcgaaaaagaggaagaagaagacttacaccaagccaaagaagatcaagcacaagcacaagaaggtgaagctcgctgttctccagttctacaaggtggatgattctggaaaggttcagaggttgaggaaggagtgccctaacgctgagtgtggtgccggtaccttcatggccaaccacttcgatcgtcattactgtggtaagtgcggtcttacttatgtttaccagaaggccggtggtgattgatgtttcagtagaaatgttgttctgaggttttgatttagatttgcgttttggattttcgatttcactatgttcaagttacaatgatgaatgccagtttttttgtgaaaccgaattcgcaatttcgatggtagtttaattttgaatggtcttttgtttct

SEQ ID NO: 2148 - DNA, 673 bp, Fagopyrum esculentum
caaagatgcagatcttcgtcaagaccctaacggggaagacgataaccctagaggttgaatcctccgacaccatcgacaatgtcaaggcaaagatccaggacaaggaaggaatcccaccagaccagcaacgactaatcttcgccggaaagcagctagaggacggccgaaccctcgccgattacaatatccagaaggagtcgacgctccacctggtgcttcgtcttcgtggtggtgcgaagaagaggaagaagaagacctacactaagccgaagaaaatcaagcacaagcataagaaggttaagctcgctgttttgcagttctataaggttgatgattctggaaaggtccagaggctgaggaaggagtgtcctaacgctgagtgtggcgctggaactttcatggcaaaccactttgatcgccattattgtggtaagtgtggtctcacttatgtttaccagaaggcaggtggtgattgatttttcttgttatccgtcgttttaatgttgtctgagaattcgtaggcggtctagtatcgcattttttgattttgaagtattggattatatggtgacgatttgaatgacgagctctcgatggttttcaattgctagtttgttttgtttaatttctgttgattttgtactgttgatatcatttgcaagtcgtttaaagg

SEQ ID NO: 2149 - DNA, 683 bp, Fagopyrum esculentum
gcgatcgactgctacgatgcagatattcgtgaagacactaacggggaagacgataaccctggaggttgagtcttccgacaccattgacaatgtgaaggctaagatccaggacaaggaaggcatcccaccggaccagcagaggttaatcttcgccggaaaacagcttgaggacggtcgtacgctcgccgactacaacattcagaaggagtcgacacttcatctggtgctccgtctccgtggtggtgcgaagaagaggaagaagaagacctacaccaagccaaagaagatcaaacacaagcacaagaaggtgaagctcgctgttctccaattttacaaagttgatgactctggaaaggtccagaggctgaggaaagagtgtcctaacgcggagtgcggtgctggtactttcatggcgaaccacttcgatcgccattactgcggtaagtgcggtcttacttatgtttaccagaaggccggtggcgattgatgttattgcatagatcgctatccgataggcaatttggggatatttgttatattttagtttcctgctacactttctgaattgtatgcttttggttttcgcgggatacaattgagtattatgcggacctgctgttactattagtattgaagttgtttgattaatctccctgcctgagttatcttgttttatagcaaag

SEQ ID NO: 2150 - DNA, 837 bp, Fagopyrum esculentum
ggggaaaccctagccgtgtaagagaaagagaggcgaagatgcagatcttcgtgaaaaccctaacggggaagacgataaccctcgaggttgagtcatccgataccatcgacaatgtgaaggccaagattcaggacaaggagggaatcccaccggaccagcagcgactcatcttcgccgggaagcagctcgaagacggccgtactctcgccgactacaacatccagaaggaatcgacgcttcacttggtgcttcgtcttcgtggtggtgcgaagaagaggaagaagaagacctacaccaagcctaagaagatcaagcataagcataagaaggtgaagctcgctgttttgcagttttacaaggttgatgattctggtaaggttcaaaggttgaggaaggagtgccctaatgccgagtgtggtgctggaactttcatggcgaatcactttgatcgtcattattgcggtaagtgtgggctcacctatgtttaccagaaggctggcggcgattgatctctttgagaatttcaattttagttttttttagttgaatacagttatgattgatgtaatgcgttcgaactggaaccagaatgttaaattttgatgatgaatgattagacaatttcccgttattgatcaattgcagtttatctttagttgaattctctatagtctgcttttgatttttacatactgcaaatcgtgaagtttcgatttttaccggttatttatcaattgccgtaggaaatccagaacttttagacttttttggtatcgatatctctgctgaaaatatactacagatgttttcagttaagtttcttctatgaaaatgaag

SEQ ID NO: 2151 - DNA, 650 bp, Fagopyrum esculentum
agagagctcagaggcgccgaattgcgaaaatgcagatttttgtgaaaacgctaactgggaagaccataaccctagaggttgaatcttccgacaccatcgacaatgtgaaagcgaagatccaggataaggaaggcatcccaccggaccagcagcgtctcatcttcgccggcaaacagctagaggacggtcgtaccctcgccgactacaacattcaaaaggaatcgaccctccacctggttctccgcctccgtggtggcgcgaagaagaggaagaagaagacttacaccaagccaaagaagatcaagcacaagcacaagaaggtgaagctcgctgttctccagttctacaaggtggatgattctggaaaggttcagaggttgaggaaggagtgccccaacgccgagtgtggtgccggtactttcatggcgaaccacttcgatcgtcattactgtggtaagtgcggtcttacctacgtttaccagaaggccggtggtgattgatgtttgagtagaattgctgttctgaggttttgatttagatttgtgttatggattttagatttcactatgttcaagttacaatgatgaatgtcagtttttttgtgaaaccaatttgaaatttcgatgttaatttaatgctgaatgatcttt

SEQ ID NO: 2152 - DNA, 779 bp, Trigonella foenum-graecum
caaagcccaatatcgaaaccctggaagataaattgagcagaaaccctaatcgcctcattcactgagagctgcacagacacacacacatccaccagcaacaagatgcagatcttcgtgaaaaccctaacggggaagacgataaccctcgaggttgagtcttccgacacaatcgacaacgtcaaagccaagatccaagacaaggaaggaattccccctgaccagcagcgtctcatcttcgccggaaagcagttggaagacggccgcactctcgccgactacaacatccagaaggagtccactctccaccttgttctccgtcttcgtggtggcgctaagaagcgtaagaagaagacctacaccaagcctaagaagatcaagcacaagcacaggaaggtcaagcttgcggttcttcagttttacaaggttgatgattctggaaaggtgcagaggttgaggaaggagtgtcctaatgctgagtgtggtgctggaactttcatggcgaatcattttgatcgtcattattgtggtaagtgtggtcttacctatgtttaccagaaggctgaagcataagtgtttcaatgtttcgatgttttagtatttcgcttttgttgttattgttgaacttatgaatgtttcggtttaattagatctattttgaaacaattattatatgctgttagttcaatgtcgaatacaattttgcgccttttgaattatgattgttgtgttgttttgtgatggtggttttattactatatgttgatgataatctgaattga

SEQ ID NO: 2153 - DNA, 682 bp, Trigonella foenum-graecum
caaccacaaaaccctaattccgcacactataaattcctcaaaaactcacttcatcgtgttacacccatttcactctctaccggcgcaaaccctaatctccgaagatgcagatcttcgtcaaaaccctaaccgggaagacgataaccctagaggttgaatcttccgacaccatcgacaacgtcaaggccaagatccaagacaaggaaggaatcccaccggatcaacaacgtctcatcttcgccggaaaacagctcgaagatggccgcactctcgccgactacaacatccagaaggaatcaactcttcaccttgttctccgtctccgtggtggtgcgaagaagaggaagaagaagacttacacaaagccaaagaagattaagcataagcataggaaggtgaagcttgcggtgctgcaattctataaggttgatgattctgggaaggtgcagaggctgaggaaggagtgtcctaatgcagagtgtggtgctggaactttcatggccaatcactttgatcgtcattattgtggcaagtgtggtttgacctatgtttatcagaaagctgatgcttaattttgagtttggtttatgtttttgatattttggataatttagtttttaaagatttggtttttatggatttggatatgtcgggttgatgacaatttttgttattgttatga

SEQ ID NO: 2154 - DNA, 712 bp, Tripterygium wilfordii
cttcaaccctagcatagaaggaaccctttcgtttttctgtgatctgcatctggaacaaggcaaagatgcagatcttcgtgaagactttgactgggaaaaccatcacgttggaggtggagtcctctgacaccatcgacaacgtgaaggccaaaatccaagacaaggaaggcatccctccggaccagcagcgactcatcttcgctggaaaacagcttgaggacggccgcactctcgcggactacaatatccagaaggagtcaaccctccacctggtgcttcgcctccgcggtggtgctaagaagcgcaagaagaagacctacaccaagcctaagaagatcaagcacaagcacaagaaggtgaagctcgctgtactccagttctacaaggtcgatgactctggtaaggttcagaggctacgcaaggagtgccccaatgctgagtgcggtgccggaactttcatggccaatcattttgataggcactactgtggtaagtgcggactcacctatgtctatcagaaggccggtggtgactgattgattgtggtcggttgtttttacaattaggattttcctaaatgttttgctttaataattgttggacctaattatatcgaatggtacttttataatttttgaattttgtggttcatatgtttcttttgatgtgtttgattttgtctgagttatctgctcaactgattatgccattg

SEQ ID NO: 2155 - DNA, 836 bp, Vinca minor
caaaatgcagatcttcgtgaaaaccctaacggggaaaacaatcactctcgaggtcgaatcttcagacacaatcgacaatgtcaaggccaaaattcaagacaaggaaggaattccaccggaccaacaacgtttaatcttcgccggaaaacagctggaagacggcagaaccctagccgactataacatccagaaggaatcgacacttcacctcgttctccgtctccgtggtggtgcgaagaagcgtaagaagaagacttacaccaagccaaagaagatcaagcacaagcataagaaggttaagcttgctgttttgcagttttacaaagttgatgattctggtaaagttcagaggctgagaaaagagtgtcctaacgctgagtgtggtgccggaactttcatggctaatcattttgataggcactattgtggcaagtgtggtcttacctatgtttaccagaaggctggcggtgactaaaaatcacttctttttgctcaattgttagttttaaagtttgaatcttaaggttttggtttaggtctatgtattttatataacttatgacggttgttttggcttatggattttattactccagatatgtctacaatctgtttgactaatatgcgcattttattttgattttctgttctcttgaaatgattgctctcttatcattttttgccttttctttttgctatttggtttggagttattcatatacttgggatatggtttatggtagggttcatatgaaatggtgtgggtgaattggtattaggtggtgagttagtactttgggtgggggttcgacaccctatatttcaaaggaatattt

SEQ ID NO: 2156 - DNA, 535 bp, Vinca minor
gcaaaatgcagatcttcgtgaagacccttacgggtaagacgatcacccttgaggtcgaatcctcggacaccatcgacaatgtcaaggccaaaattcaggacaaggaaggaattccaccggaccagcaacgtctcatcttcgccggaaagcagctggaggacggcagaaccctagccgactacaacatccagaaggaatccactcttcaccttgtgcttcgtctccgtggtggcgctaagaagcgtaagaagaagacctacaccaaaccaaagaagatcaagcacaagcataagaaggtcaagctcgctgttcttcagttctacaaggtcgatgactctggtaaggttcagaggcttaggaaagagtgccctaatgctgagtgtggtgctggaactttcatggctaatcattttgacaggcactattgtggcaagtgtggccttacctatgtttaccagaaggctggcggtgattaaatacccctccttgtttttgttctattagtttttaagtaccaattttgacttttggtttt

SEQ ID NO: 2157 - DNA, 685 bp, Triticum aestivum
tgccgactacaacatccggaaggagtccaccctccacctggtgctccgccttcgcggtggtatgcagatcttcgtgaagaccctgacgggcaagaccatcacgctggaggtggagtcctcggacaccatcgacaacgtcaaggccaagatccaggacaaggaggggatcccgccggaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgccgagtgcggtgccgggaccttcatggccaaccacttcgaccgccactactgcggcaagtgcggcctcacctatgtctacaaccagaaggcttagaggtggcttgcgtttgctctgctcttttacctatcgaggatagaactcatttatatgtgtccctgtttgtatttgaaaactgaaaccttggagtattatgtttcctagatatttgattgcctaatgctgagatgctatgcgagcttaaattttggt

SEQ ID NO: 2158 - DNA, 755 bp, Triticum aestivum
agatccaggacaaggagggcattcttcggaccagcagcgcttcatcttcgctggcaagcagctcgaggatggccgcacccttgctgactacaatatccagaaggagtccaccctccacctggtgctcaggctccgtggtggcatgcagatcttcgtgaagaccctgacgggcaagaccatcacgctggaggtggagtcgtcggacaccatcgacaacgtcaaggccaagatccaggacaaggaggggatcccgccggaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccactggcaaggtcaccaggctcaggaaggagtgccccaacgccgagtgcggcgccgggaccttcatggcaaaccacttcgaccgccactactgcggcaagtgcggcctcacctacgtctacaaccagaaggcttagaggtggcttgcgattgctcttcaaatcgaactcatttatatgtgtcccgtttgtctttgaaaactgaaatcttggagtattatgttatgtttcccggatatttgatcgcctattgctgagatgggatgtgagcttaaattttggt

SEQ ID NO: 2159 - DNA, 758 bp, Glycine max
ggtctgagagaaaccctagctagccacaatgcagatattcgtgaaaaccctaacggggaagacgataaccctagaggtagagtcatcggacacaatcgacaatgtgaaggcgaagatccaggacaaggagggcatcccgccggaccagcagcgcctgatcttcgccggtaagcagctggaggacggccgcaccctcgccgactacaacatccagaaggagtccacgcttcacctcgtcctccgcctccgcggcggcgccaagaagcgcaagaagaagacctacaccaagcccaagaagatcaagcacaagcacaagaaagtcaagctcgccctcctccagttctacaaggtcgacgactccggcaaggtccagaggctccgcaaggaatgccccaacgccgagtgcggcgccgggactttcatggccaaccacttcgatcgccactattgcggcaagtgtggtttgacctatgtttaccagaaggctgaggcttagggttacatttcgttttttctagtttctggattttggaattttattattagtataatactctgtttttttgtctgtattttggtcgcatattattatgactgcctgaatgttctgccttttcataatttagtttcaatgttttatgaattgtgttgcatcttttgttttttaaaattggttttaattttgaaatgaattgatatgtagttggttgattttactaagtttaatggaagtttgtaggtaaaatcaattcaataac

SEQ ID NO: 2160 - DNA, 804 bp, Malus domestica
cttttcactctgcagccctgcgcctccctgctcctcccctgcgatcctgaagccccccaaccatgcagatcttcgtgaaaaccctaacgggtaagaccatcaccctagaggtcgagtcctccgacaccatcgacaatgtcaaggccaagatccaagacaaggaaggcattccgccggaccagcagcgcctcatcttcgccggcaagcagctcgaggacggccgcaccctcgctgactacaacatccagaaggagtccaccctccacctggtactccgcctccgcggtggcgcaaagaagaggaagaagaagacctacaccaagcccaagaagatcaagcacaagcacaagaaggtgaagctcgccgtgctccagttctacaaggtggatgattccggcaaggtccagaggctgaggaaggagtgccccaatgctgagtgcggcgccgggactttcatggccaaccacttcgacaggcactactgcggcaagtgcggattgacctatgtttaccagaaggctggcggtgattagagtaattttgaattatatcgttatggatttaaattttgatgctttatgatcgttttggatttcaatttccgtgcttgaagaacctatgagctttagttcttatcgttgtttcaattgcatatgccacatcaaattatcctaattttgttgtttttggctgatgatttgatgttggtttttgttttgggtagtttgatcagatgcattttcacacagcaggagtagaaagttaggttaatttaaactatgagcttcaattgcttaaaaaaaa

SEQ ID NO: 2161 - DNA, 786 bp, Malus domestica
gccgaaagttgaaaccctagccgattctccctctgtgtcttgtgcggacagcaaagatgcagatcttcgtgaaaaccctaacggggaagacgataaccctagaggttgagtcttccgacaccatcgacaatgtgaaggccaagatccaggacaaggagggcatcccgccggaccagcagcgcctcatcttcgccggcaagcagctggaggacggccggacccttgccgactacaacatccagaaggagtcgactctgcacctggtgctccgcctgcgcggtggcgccaagaagcgtaagaagaagacctacaccaagccgaagaagatcaagcacaagcacaagaaggtgaagctcgctgtcctccagttctacaaggtcgacgattctggaaaagtccagaggctgagaaaggagtgccccaacgctgagtgtggcgccgggactttcatggccaaccatttcgacaggcactactgtggtaagtgtggtctcacctatgtgtaccagaaggctggcggcgactgagtcaaacgcaccgttttatatggttgttgagagtatcgttaactatcataattttgatttagacttggaaccgtggttgttgtggattatgtttgatatattttgatatggtatttagaattttaatttcaaattgttggagttgaatggttagctatcataattttgttatattatttgtcctgccattttctgtggcatagtttattgaatggatgcatgaagtcagattgttgttatcgaattggtgcaaaaaaaa

SEQ ID NO: 2162 - DNA, 799 bp, Malus domestica
tgcagccctgacccttagcctccggccctcaccaacgctagcagaagtgagttcgggggaagccgtgaaattgtcggttacaactacaaagcgcgcatttggagagagagttgaagaccctagccgaatctcccccagtctctctgtgtcttgtgcggacagcaaaagatgcagatcttcgtgaaaaccctaacggggaagacgataaccctagaggttgagtcttccgacaccatcgacaatgtgaaggccaagatccaggacaaggagggcatcccgccggaccagcagcgcctcatcttcgccggcaagcagctggaggacggccgtaccctcgccgactacaacatccagaaggagtccactctgcacctggtgctccgcctccgcggtggcgctaagaagcgtaagaagaagacctacaccaagcccaagaagatcaagcacaagcacaagaaggtgaagctcgccgtcctccagttctacaaggtcgacgattccgggaaggttcagaggctgaggaaggagtgccccaacgctgagtgcggcgccgggactttcatggccaaccattttgacaggcactactgtggtaagtgtggtctcacctatgtttaccagaaggccggcggcgactgagttaaacgcaccgtttaatatgttcgtttctgaaacagatggttaagtttaaataattttgatttagacttggaacggtggttgttatggattatggtttatgtttttgatatggtactttagaattttaatttcgactttgaagttcaaaaaaaaaaaa

SEQ ID NO: 2163 - DNA, 819 bp, Malus domestica
tgcagccctgacccttagcctccggccctcaccaacgctagcagaagtgagttcgggggaagccgtgaaattgtcggttacaactacaaagcgcgcatttggagagagagttgaagaccctagccgaatctcccccagtctctctgtgtcttctgcggagagcaaaagatgcagatcttcgtgaaaaccctaacggggaagacgataaccctagaggttgagtcttccgacaccatcgacaatgtgaaggccaagatccaggacaaggagggcatcccgccggaccagcagcgcctcatcttcgccggcaagcagctggaggacggccgtaccctcgccgactacaacatccagaaggagtcgactctgcacctggtgctccgcctccgcggtggcgctaagaagcgtaagaagaagacctacaccaagcccaagaagatcaagcacaagcacaagaaggtgaagctcgccgtcctccagttctacaaggtcgacgattccgggaaggtccagaggctgaggaaggagtgccccaacgctgagtgcggcgccgggactttcatggccaaccattttgacaggcactactgtggtaagtgtggtctcacctatgtttaccagaaggccggcggcgactgagttaaacgcaccgtttaatatgttcgtttctgaaacagatggttaagtttaaataattttgatttagacttggaacggtggttgttatggattatggtttatgtttttgatattggtactttagaattttaatttcgactttgaagttcaatggttagctatcacaattttgttttatta

SEQ ID NO: 2164 - DNA, 672 bp, Phaseolus coccineus
ttatggccggggcagaacaaaccctgcattggaaaccctagttccccgcagcaatgcagatattcgtgaaaaccctcacggggaagactatcacccttgaggtggagtcttcagacaccatcgacaatgtcaaggctaagatccaggacaaggagggaatcccaccggatcagcagcgtctcatctttgccggaaagcagcttgaggacggtcgcaccctcgctgactacaacatccagaaggagtccaccctccaccttgtcctccgtctccgcggtggtgccaagaagcgcaagaagaagacgtacaccaagcctaagaagatcaagcacaagcacaagaaggtgaagctcgccatcttgcagttctataaggttgacgactccgggaaggtgcagaggctccgcaaggagtgccctaacgctgagtgcggcgctggaacgttcatggctaaccacttcgatcgccactattgcggcaagtgcggcctcacttatgtctaccagaaggctggtgcctaatttgtaacggatttgcttttttatcattatttttagtttttaaagttttggttcatgttttgttcgtttagcgttgctactgttttggtttaattctaatgaatactctatcgtttttgaattatatattattcgcattcctatattatta

SEQ ID NO: 2165 - DNA, 647 bp, Phaseolus coccineus
gggagcacaaaccctggaaaccctagccaccagcagcgatgcagatattcgtgaaaacccttacggggaaaaccatcacccttgaggtggagtcttcggacaccatcgacaatgtcaaggccaagatccaggacaaggagggcatcccgccggatcagcagcgtctcatcttcgccggaaagcagctcgaggacggccgcaccctcgccgactacaacatccagaaggagtccaccctccaccttgtcctccgtctccgcggtggtgccaagaagcgcaagaagaagacctacaccaagcctaagaagatcaagcacaagcacaagaaggtgaagctcgccatcttgcagttctacaaggttgatgactccggcaaggtgcagaggctccgcaaggagtgccccaacgctgagtgcggcgccggaacgttcatggccaaccacttcgatcgccactattgcggcaagtgtggcctaacctatgtttatcagaaggccggtgtctaattcctaattgttttcgttattagtatataaatttgggaatgttctgtccgtttaatactggtttgataaaacttttatggatactctttattctctccaatgtgttgttatttttgttagaatgaaatttagaatttggtt

SEQ ID NO: 2166 - DNA, 820 bp, Brachypodium distachyon
tagcctccacccaaacccaaacccaaaccctacccccgccgtcgccgccgccgccgcggaggcgaccccccccaccgccgctaagatgcagatcttcgtgaagaccctgacgggcaagaccatcacgctggaggtggagtcctcggacaccatcgacaacgtgaaggccaagatccaggacaaggagggcatcccgccggaccagcagcgcctcatcttcgccggcaagcagctcgaggacggccgcaccctcgccgactacaacatccagaaggagtccaccctccacctggtgctccgcctgcgcggtggcgccaagaagcgcaagaagaagacctacaccaagcccaagaagcaaaagcacaagcacaagaaggtgaagctcgccgtcctccagttctacaaggtggacgacgccaccggcaaggtcaccaggctccggaaggagtgccccaacgcagagtgcggcgccgggacattcatggccaaccacttcgaccgccactactgcggcaagtgcggcctcacctacgtctacaaccagaaggcgtagaggtggcttttgcggggctctctgcttttttaccctaccgtatcatgaactctgctgaggtgttcgttacatctcgtttagatatgtgttccgtttgtctttaaaactgaaacctggagtagtatgtttcatggataatatttgattgcctattgctgagctgttgcgatgcaagtttaaattttggttaaatatgctatccttctgggtgacgttaatttacctgatcggatatcgtgttatcgtattctcgcacttgttgatctg

SEQ ID NO: 2167 - DNA, 1091 bp, Cenchrus ciliaris
  misc_feature (428)..(428): n is a, c, g, or t
  misc_feature (868)..(868): n is a, c, g, or t
  misc_feature (908)..(908): n is a, c, g, or t
ccccaccccgccgctccaaaccctatccagccgccgccgtcgccgccgccgctgcgcggaggcgaccccccaccgccgtcaagatgcagatcttcgtgaagaccctgacggggaagaccatcacgttggaggtggagtcctcggacaccatcgacaacgtgaaggccaagatccaggacaaggagggcatcccgccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagatcaagcacaagcacaagaaggtgaagctcgccgtgctgcagttctacaaggtggacgacgccaccggcaaggtnacccgcctccgcaaggagtgccccaacgccgactgcggcgcgggcaccttcatggccaaccacttcgaccgccactactgcggcaagtgcggcctcacctacgtctacaaccagaaggcgtaatcgcttcgcttgcatcgctttgcttagctttacccgcctacctatcatgaattgagctgttggttacctgaattgaatatcatttagatctgtctgtggttgaaacttaaatggagtagcagtatctaccttctttgaacgcctgttactgagctgatgtgatgcgagtttaattttggttccaactttttatctttcctgatgattatgtcccttcatcatttcgttaccattcattggtcgcttaaaaaaaaaaaaaaaaaaactcgagcttcagcaagtaagaagaaatggcgagcgtggcctcctcgaggtgncccggcctcctcctcccgccgagcctcgccggagcgcgangctgctcgcgtccgccctcttccctccgcctccgttcgcggtggggccggtgccgcccgagtaccctcgcctgcgtggcgccgccggattccgcggagccacagacggatgagcagactgtgaaacctgagtcgactgaagaagaggctcagacaaccagcgcaccgcaggatgctggacttc

SEQ ID NO: 2168 - DNA, 768 bp, Cenchrus ciliaris
  misc_feature (55)..(55): n is a, c, g, or t
tgggtaccgggcccccccccgccgccgcaggcgagaaccagagcctcccccgtcntccacctcaggtaagggcggccgccgtcgggaagggcgcgcctgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcacgctcgccgactacaacatccagaaggagtcgacgctgcacctggtgctccgcctcaggggaggggccaagaagcgcaagaagaagacgtacaccaagcccaagaagatcaagcacaagcacaagaaggtgaagctcgccgtgctccagttctacaaggtcgacgacgccaccggcaaggtcacccgcctccgcaaggagtgccccaacgccgagtgcggcgcgggaaccttcatggccaaccacttcgaccgccactactgtggtaagtgcggcctcacctacgtctacaaccagcaggcgtagggtgctccgctgttatgttgggagaagaaaaatggaaagacttgttagattataatctcttttttgtcgcatgtttaaagtagttttgttgaaacagaacacctggcatctcttatgatgatgcgtacttttggtttgatgatatcgtgtcgttatgatcctatcaagcactgttgaattccgattatgtttgtta

SEQ ID NO: 2169 - DNA, 692 bp, Cicer arietinum
ggcttttcacccattttccttccctcggcgcaaaccctaatcgaccgaagatgcagatcttcgtgaaaaccctaacgggtaaaacaatcaccctcgaggttgaatcctctgacacaatcgacaacgtcaaagccaaaatccaagacaaggaagggattccaccggaccaacaacgactcatcttcgccggaaaacaactcgaagacggccgcactctcgccgactacaacatccagaaggaatcaactcttcaccttgttctccgtctccgtggtggtgctaagaagcgtaagaagaagacctacactaagccaaagaagattaagcataagcataagaaggttaagctcgctgttcttcagttttataaggttgatgattctggaaaagttcagaggttgaggaaggagtgtcctaatgctgaatgtggtgctggaactttcatggctaatcactttgatcgtcattactgtggcaagtgtggtttgacttatgtttaccagaaaaccgatgcttgattttgatttctgtttttttaatgctaccctaaatgttttttatttttggtattttagttttttaagatttggtatttatgaatttggaatagtggggtagacaatttttgttattgttatgacttgttgaatgatttttattttaataccatattttgcgtttatttagttcga

SEQ ID NO: 2170 - DNA, 770 bp, Vigna unguiculata
aagacaaaccctagccctgagcaacgatgcagatattcgtgaaaacccttacggggaagaccattacccttgaggttgagtcttcggacacaatcgataatgtgaaggccaagatccaggacaaggagggtattccgccggatcagcagcgtctcatcttcgccggaaagcagctcgaggatggtcgcaccctcgccgactacaacatccagaaggagtccaccctccaccttgtcctccgtctccgtggcggagccaagaagcgcaagaagaagacctacaccaagcctaagaagatcaagcacaagcataagaaggtgaagctcgctatcttacagttctacaaggttgacgactccggcaaggtgcagagactccgcaaggagtgtcccaacgctgagtgtggcgctggaacgttcatggccaaccacttcgatcgccactactgcggcaagtgcggcctcacctatgtttatcaaaaggccgatgcttaattctagttaatgttccatttgaactgtttttgatgaaactttgatgctctctttattgtctccaatatatcgttatttttgttagaatgaaattgactcatatttaattagagtttgatgaatttggttgagattggatgttggattgaattatttaattgattctcggttaatttttgtgttgaaatctagatttgtaggcaaacatgtttttgttttttcattcctactgcttgattggaaacttcaatggagaattatgttttgggtgtcgga

SEQ ID NO: 2171 - DNA, 590 bp, Cyamopsis tetragonoloba
caggatgcagatcttcgtgaaaaccctcacggggaagaccatcaccctcgaggtcgaatcctctgatacgatcgacaatgtgaagactaagatccaggacaaggaaggaattccaccggatcagcagcgtttgattttcgccggaaaacagcttgaagatggccgcaccctcgccgattacaacatccagaaggagtcaaccctgcatctcgtgcttcgtctccgtggtggcgccaagaagaggaagaagaagacctataccaagcctaagaagatcaagcacaagcataagaaggtgaagctcgctgttctccagttctataaggtcgatgattctggaaaggttcagaggctcaggaaggagtgccctaacgccgagtgcggcgctggtaccttcatggctaaccacttcgatcgccactactgcggcaagtgtggcttgacctatgtctaccagaaggccggtgcctaatttattcgatttccatagatttgatgattttctcaattttagtatttaatagtgggtagacattttcccttatggtttatgacttcatgaatgtttgattttgaaaagttttctacca

SEQ ID NO: 2172 - DNA, 476 bp, Eschscholzia californica
cttctgcaacgatgcagatcttcgtgaaaaccctaactgggaaaaccataaccctagaggttgaatcctcagatacgatcgacaatgtcaaagccaagatccaagacaaggaaggaatcccacctgatcaacaacgattgattttcgccgggaaacaactggaagatggacgaaccctagctgattacaacatccagaaagaatcaactcttcatttggtgcttcgtcttcgtggaggagcgaaaaagaggaagaagaagacttacacaaagccaaagaagatcaaacacaagcataagaaagtaaagcttgctgttttacagttttacaaagttgatgattctggaaaagttcaaaggttaaggaaagaatgccctaatcaagaatgtggtgctggtactttcatggctaatcattttgatcgtcattactgtggaaagtgtggattaacctatgtttatcaaaaagctggtggt

SEQ ID NO: 2173 - DNA, 717 bp, Lotus japonicus
ccatttcgtccacttccattgccgccactgcgagagagagcgagagaaaaccctaattccgatccgaagatgcagatcttcgtgaaaaccctaacggggaagacgatcaccctcgaggtggagtcatccgacacaatcgacaacgtcaaggccaagatccaagacaaggagggaatcccaccggaccagcagcgtctcatcttcgccgggaagcagctggaagacggccgcacacttgctgactacaacatccagaaggagtccactctccaccttgtcctccgtctccgcggtggcgctaagaagcgcaagaagaagacctacaccaagcccaagaagatcaagcacaagcataggaaggttaagctcgctgtgttgcagttctacaaggttgatgactctggcaaggttcagaggttgaggaaggagtgccctaatgcggagtgcggtgctgggactttcatggcgaaccattttgatcgccattactgtgggaagtgcgggctcacctatgtttaccagaaggctgctgcgtaatgagtttttctctatttgaatttatgaagttttggtcatttatgtttgaatagtgggtagacattttaccttaatcgctatgactgtttggatatttcggttttaatagttttggaatttatgtgaacactgttttgtgttggttaattatggttccctttcatatattgttaattgggt

SEQ ID NO: 2174 - DNA, 953 bp, Zea mays
cccagcgcatggaacactgactcctgcacgatccagccgtcagattctcaagcccctagatccaacagtccatgtcgtttttctcctctatataggcgcacacaaccgagaacacagaaaccctagactgcacccccatcccgcagcagccaaaacctacctagccgccgccgcaggcggccccccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccactggcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgccaacctatcaagcattcagatgttggttactcaaattgtatctcatttagatctgtctgaggttgaaacttaaatggagcagtagtatctatcatattggtacccctgttactgagtataattttgttttcatatccatccttacagacgattgcactttttgcccgtttcaccatgattttttgattcgtaggtcgatgatagtagtattgcataattggattgatttatgtttgcttgattattttaattgctactaa

SEQ ID NO: 2175 - DNA, 670 bp, Medicago truncatula
attccgaaaccattcgtttgtgagagttgcagcaaccaacgaagcaagatgcagatcttcgtgaaaaccctaacagggaagacgataaccctcgaggttgagtcttccgacacaatcgacaatgtcaaagccaagatccaggataaggaaggaattccacctgaccagcaacgtctcatcttcgccggaaagcagttggaagacggacgcactctcgccgactacaacatccagaaggaatccactcttcaccttgtcctacgtcttcgtggtggcgctaagaagcgtaagaagaagacctacaccaagcctaagaagatcaagcacaagcataggaaggtgaagcttgctgttcttcagttttataaggttgatgattctggtaaggtgcagaggttgaggaaggagtgtcctaatgctgagtgtggtgctggaacttttatggctaatcattttgatcgtcattattgtggtaagtgtggtcttacctatgtttaccagaaggcggaagcttagattcaatgtttcaatgatgatgttctagtgtttctgttttgttattgttgttgaactttttaatgtttcagtttcggtttaattagcttcgtttggaaaacaattattatatgttctagttgaatatccaatacaattttgtgcgttttgaatt

SEQ ID NO: 2176 - DNA, 630 bp, Medicago truncatula
atcttccacccatttcattctccaccggcgcaaaccctaatccgcgaagatgcagatcttcgtgaaaaccctaaccgggaagacaataaccctcgaagttgaatcttcagacaccatcgacaatgtgaaagccaagatccaagacaaagaaggaatcccaccggaccaacaacgtctcatcttcgccggaaaacagctggaagacggccgcactctcgccgactacaacatccagaaggaatccactcttcaccttgttctccgtctccgtggtggcgcgaagaagaggaagaagaagacctacactaagccaaagaagattaagcataagcataggaaggtgaaacttgcggtgttgcagttttataaggttgatgattctgggaaggtgcagaggctgaggaaggagtgtcctaatgcagagtgtggtgctggaacgttcatggcgaatcactttgatcgtcattattgtgggaagtgtggtttgacctatgtttatcagaaagctgatgcttgattttggtttatgtttttgtcactaccctagtattttaaattttggataatttatgacaattattgttatgactgaatgaatggtttcattttaatacattattgtgttacttt

SEQ ID NO: 2177 - DNA, 904 bp, Pennisetum glaucum
tggttggatgcacatgtctgctgctacaatcaatctctcccatacgacccgccacggtgggcatacgaatttccagggccacctgtccccatgtttccataaccaccaggccccatgttcccatagcctctgccaccatagtacccaccacgggaacggccgccacctcggtatccacgggcaccgccggaagggcgcgcctgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcacgctagccgactacaacatccagaaggagtcgacgctgcacctggtgctccgcctcaggggaggggccaagaagcgcaagaagaagacgtacaccaagcccaagaagatcaagcacaagcacaagaaggtgaagctcgccgtgcttcagttctacaaggtcgacgacgccaccggcaaggtcacccgcctccgcaaggagtgccccaacgccgagtgtggcgcgggaaccttcatggccaaccacttcgaccgccactactgcggtaagtgcggcctcacctacgtctacaaccagcaggcgtagggtgctccgctgttatgttgggagaagataaatggaaagtcttgttagattatagtctctttttgtcgcatgttaaagtagttttgttggaacagaacacctgcatctcttatgatgatgcgtacttttggttttgatgatattttgtcgttatggatcctatcaagcactgttgaataccagttatgtttgtgctaatcctatactatttgataaacgttgatgtca

SEQ ID NO: 2178 - DNA, 704 bp, Pennisetum glaucum
aaaccctatccagccgccgtcgccgccgccgctgcgcggaggcgaccccccaccgccgccaagatgcagatcttcgtgaagaccctgacggggaagaccatcacgttggaggtggagtcctcggacaccatcgacaacgtgaaggccaagatccaggacaaggagggcatcccgccggaccagcagcgcctcatcttcgccggcaagcagctcgaggacggccgcacgctcgccgactacaacatccagaaggagtccaccctccacctggtgctccgcctccgcggtggcgccaagaagcgcaagaagaagacctacaccaagcccaagaagatcaagcacaagcacaagaaggtgaagctcgccgtgctgcagttctacaaggtggacgacgccaccggcaaggtcacccgccttcgcaaggagtgccccaacgccgactgcggcgcgggcaccttcatggccaaccactttgaccgccactactgcggcaagtgtggcctcacctacgtctacaaccagaaggcgtaatcgcttcgcttgcttagttttacccgcctacctatcatgaattgagctgttggttacctgaattgaatatcatttagatctgtctgtggttgaacttgaatggagtagcagtatctatcttattggaacgcctgttactgagctgatgtgatgagagtttaattttggttcct

SEQ ID NO: 2179 - DNA, 681 bp, Petunia hybrida
aatctatctcagcgccactcgtctccttctattctgggtgcacatagtgggaaaaaatgcagatcttcgtgaagaccctgacggggaagactataaccctagaggttgagtcttcagacaccattgacaatgttaaggctaagattcaggacaaggaaggcattccaccagaccagcagcggttgatttttgcaggtaagcagcttgaagatggccgaacactagctgactacaacatccagaaggagtccactctccaccttgtccttcgcctccgtggtggtgcaaagaagcgtaagaagaagacctacaccaagcctaagaagatcaagcacaagcataagaaggttaagctcgctgtcctccagttttacaaggttgatgactctggtaaggttcagaggctccgcaaggagtgcccaaatgctgagtgtggtgccgggactttcatggctaaccattttgacaggcactactgtggtaaatgtggccttacctatgtttaccagaaggctggtggtgattagttcagagttactttaccgtcactctggtagtactagtttttgttccccataactcttgctctatactttcctatttctcgcttgtggcgagatgtaatgaatttgatttatggattatgttttgcagttcaagtggttacggattttgtcagct

SEQ ID NO: 2180 - DNA, 688 bp, Cajanus cajan
aagcagtggtaatcaacgcaggagtacggggggtacgcagcagaagcgaaaccctaggccgtgacgatgcagatcttcgtgaaaaccctaacgggtaaaacgataaccttggaggtggagtcttcggacaccatcgacaacgtcaaggccaagatccaggacaaggagggcattccgccggaccagcagcgcctcatcttcgccggaaagcagctcgaggacggccgcaccctcgccgactacaacatccagaaggagtccactctccacctcgtcctccgcctccgcggcggcgccaagaagcgcaagaagaagacctacaccaagcccaagaagatcaagcacaagcataagaaggttaagctcgctattcttcagttctacaaggtcgacgactctggcaaggtccagaggctcaggaaggagtgccccaatgccgagtgcggcgccgggactttcatggccaaccacttcgaccgccactactgcggcaagtgcggtttgacctatgtctaccagaaggctggtgcttaatttatgccttttcatttattagtatttaaagttttggtttatgttttgctcgtactttagtatttcactgttttggttttaattaaacccgcatgaatactgtttttgtgttggattattttttattcggtttaatatattgttagttcggtct

SEQ ID NO: 2181 - DNA, 721 bp, Secale cereale
  misc_feature (89)..(89): n is a, c, g, or t
  misc_feature (204)..(204): n is a, c, g, or t
  misc_feature (586)..(586): n is a, c, g, or t
  misc_feature (593)..(593): n is a, c, g, or t
  misc_feature (610)..(610): n is a, c, g, or t
ttccaccccgccgcccagcccaaaccccaaccccgccgccgcactgccgtcgccgccgcagcgcgcggaggcgaccaccccaccgccgncaagatgcagatcttcgtgaagaccctgacgggcaagaccatcacgctggaggtggagtcctcggacaccatcgacaacgtcaaggccaagatccaggacaaggaggggatcccnccggaccagcagcgcctcatcttcgccggcaagcagctcgaggatggccgtactctcgccgactacaacatccagaaggagtccaccctccacctggtgctccgcctccgcggtggtgccaagaagcgcaagaagaagacgtacaccaagcccaagaagcaaaagcacaagcacaagaaggtgaagctcgccgtcctccagttctacaaggtcgacgacgccactggcaaggtaaccaggctcaggaaggagtgccccaacgccgagtgcggcgccgggaccttcatggccaaccacttcgaccgtcactactgcggcaagtgcggcctgacctatgtctacaaccagaaggcttagaggtggctctgctcttttacctgtngagaagngaactcatttatatgtntccctgtttgtatttgaaaactgaaaccttggagtattatgtttcttagatatttgatcgcctattgctgagatgctatgcgagcttaaattttggtcattctgaatgacg

SEQ ID NO: 2182 - DNA, 712 bp, Glycine max
atctcttctcacccccaaactctgcatcggaagaaaccctagccactctcccggcgtcacgatgcagatcttcgtgaaaaccctaacgggtaaaacgatcacgttggaggtggagtcttcggacaccatcgacaacgtgaaggccaagatccaggacaaggaaggcatccctccggaccagcagcgcctcatcttcgccgggaagcagctggaggacggccgcaccctcgccgactacaacatccagaaggagtccacgcttcacctcgtcctccgcctccgtggcggcgccaagaagcgcaagaagaagacctacaccaagcccaagaagatcaagcacaagcacaagaaggtcaagctcggcattcttcagttctacaaggtcgacgattctggaaaagtccagaggctccgcaaggagtgccccaacgccgagtgcggcgccggcaccttcatggccaaccacttcgaccgccactactgcggcaagtgcggcttgacctacgtctaccagaaggccgatgcttaatttgcggttttaattttattttagtatttaaaagttttggtttatgtttttgttcaattagtgttatgactgtttgggctttgattaaacctttattcaatactgttttgcgttggattacttatcatccgctttaaatatattgttagttcggtttataaaccgccaatgcttgcttccttc

SEQ ID NO: 2183 - DNA, 771 bp, Panicum virgatum
ccacgcgtccgatccccccacccgccgcccctcaaccctacccagccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccactggcaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctacctatcatgaaattgagctgttggtttctcgagttggatatcatttagatctgtctgaggttgaaacttaaatggagtagcagtatctattttctcggaacgcctgttactgagctgatatgatgcgagtttaattttggttccattttctatcttgcttgatgattatgtct

SEQ ID NO: 2184 - DNA, 808 bp, Panicum virgatum
tacaacatccagaaggagtccaccctccatcccccacccgccgcgcctcaaccctacccagccgccgctgtcgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaaacgcaagaagaagacctacaccaagcccaagaaaatcaagcacaagcataagaaggtgaagctcgccgtgcttcagttctacaaggtcgacgacgccaccggcaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctatctatcatgaaattgaactgttggtttctcgaattgaatatcatttagatctgtttgaggttgaaacttaaatggagtagcagtatctatcttcttggaacgcctgttactgagctgttgcgtgatgcaagtttaattttggttccattttctatcttgatgattatatatctcttggttatttcgctatc

SEQ ID NO: 2185 - DNA, 822 bp, Triticum aestivum
cgccgccgcgcccaaacccaacccgccgccgccactgccgtcgccgccgcagcgcgcggaggcgaccaccccaccgccgccaagatgcagatcttcgtgaagaccctgacgggcaagaccatcacgctggaggtggagtcctcggacaccatcgacaacgtgaaggccaagatccaggacaaggaggggatcccgccggaccagcagcgcctcatcttcgccggcaagcagctcgaggacggccgcaccctcgccgactacaacatccagaaggagtccacccttcacctggtgctccgcctccgtggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgcggagtgcggtgccgggaccttcatggccaaccacttcgaccgccactactgtggcaagtgcggcctcacctacgtctacaaccagaaggcttagaggtggcttgcgtttgctctgctcttttacttgtcgagaatcgaactcatttatatgtgtccctgtttgtatttgaaaactgaaaccttggagtattatgtttcctagatatttgatcgcctaatgctgagatgctatgcgagcttaaattttggtcattctgaatgacgttaatctatctcatggcagctatcatattttatgctttgttgatctgatggtgatgcgatcatggaaacatgcatcttgttgatacatgtgttcttgagc

SEQ ID NO: 2186 - DNA, 756 bp, Triticum aestivum
aattcgccacgccgcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacaaggagggcatcccgccggaccagcagcgcctcatcttcgccggcaagcagctcgaggacggccgcaccctcgccgactacaacatccagaaggagtccaccctgcacctggtgctccgcctccgcggtggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgagtgcggcgccgggaccttcatggccaaccacttcgaccgccactactgcggcaagtgcggcctcacctacgtctacaaccagaaggcttagaggtggcttgcgtttgctctgctcttttacctatcgaggatagaactcattatatgtgtccctgtttgtatttgaaaactgaaaccttggagtattatgtatcctagatatttgatcgcctgctgctgaaatgctatgcgagcttaaattttggtcattctgaatgacgttaatctatctcattgcagctatcgtaaaaa

SEQ ID NO: 2187 - DNA, 695 bp, Triticum aestivum
caaccaaaccccaccgcgccgccgccgccgccaccgtcgccgccgcagcgcgcggaggcgaccaccccgccgccgccaagatgcagatcttcgtgaagaccctgacgggcaagaccatcacgctggaggtggagtcgtcggacaccatcgacaacgtcaaggccaagatccaggacaaggaggggatcccgccggaccagcagcgcctcatcttcgccggcaagcagctcgaggacggccgcaccctcgccgactacaacatccagaaggagtccacgctccacctggtgctccgcctccgcggtggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgagtgcggcgccgggaccttcatggccaaccacttcgaccgccactactgcggcaagtgcggcctcacctacgtctacaaccagaaggcttagaggtggcttgcgtttgctctgctaaaatcgaactcatttatatgtgtcccgtttgtctttgaaaactgaaatcttggagtattatgttatgtttcctggatatttgatcgtctattgctgagatgggatgcgagcttaaaaaaaaaa

SEQ ID NO: 2188 - DNA, 725 bp, Triticum aestivum
cgccgcccagcccaaacccaaccccgccgccgccactgccgtcgccgccgcagcgcgcggaggcgaccaccccgccttcgccaagatgcagatcttcgtgaagaccctgacgggcaagaccatcacgctggaggtggagtcctcggacaccatcgacaacgtcaaggccaagatccaggacaaggaggggatcccgccggaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccactggtaaggtcaccaggctcaggaaggagtgccccaacgctgagtgcggcgccgggaccttcatggcaaaccacttcgaccgccactactgcggcaagtgcggcctcacctacgtctacaaccagaaggcttagaggtggcttgcgattgctcttcaaattgaactcatttatatgtgtcccgtttgtctttgaaaactgaaaccttggagtattatgttatctttcctggatattactgatatgcgatgtgggcttaaattttggtcattctgatgacgttaatctatttcatgtcggctatcat

SEQ ID NO: 2189 - DNA, 1081 bp, Triticum aestivum
cgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttagccggcaagcagctcgaggatggccgtacccttgctgactacaacatccagaaggagtccaccctccacctggtgctccgccttcgcggtggtatgcagatcttcgtgaagaccctgacgggcaagaccatcacgctggaggtggagtcctcggacaccatcgacaacgtcaaggccaagatccaggacaaggagggcatccccccggaccagcagcgcctcatctttgccggcaagcagctcgaggatggccgtacccttgctgactacaacatccagaaggagtccaccctccacctggtgctccgccttcgtggtggtatgcagatcttcgtgaagaccctgacgggcaagaccatcacgctggaggtggagtcctcggacaccatcgacaacgtcaaggccaagatccaggacaaggagggcatccctccggaccagcagcgcctcatcttcgccggcaagcagctcgaggatggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgccgagtgcggcgccgggaccttcatggccaaccacttcgaccgccactactgcggcaagtgcggcctcacctatgtctacaaccagaaggcttagaggtggcttgcgtttgctctgctcttttacctatcgaggatagaactcattatatgtgtccctgtttgtatttgaaaactgaaaccttggagtattatgtatcctagatatttgatcgcctgctgctgaaatgctatgcgagcttaaa

SEQ ID NO: 2190 - DNA, 621 bp, Primula obconica
cctctctttctctttctctcacttggtttcaggatgcagatcttcgtgaagaccctgacggggaagacgatcaccttggaggttgagtcatcagacaccatcgacaatgtcaaggccaagattcaggacaaagagggcatcccaccggaccagcaacgcctcatcttcgccggaaaacagcttgaagacggcagaaccctagctgattacaatatccagaaggagtctactctgcaccttgtgcttaggctccgtggtgggactaagaagaggaagaagaagacttatactaagcctaagaagatcaagcataagcataagaaggtcaagcttgctgttcttcagttctacaaggttgaggactctggcaaagtgcagaggctgaggaaggagtgacccaaatgcagagtgtggagcgtgggactttcatggccaaccatttcgataggcactattgcggcaagtgtggattgacctattgtttaccagaaggctggtggtgattagtttgctttctgtttcacttgttatttcgactatgaaattgctcttttttagttgagaaatggtctgaatttctctttaatttttcgatattcatgtctgagttctctttaattt

SEQ ID NO: 2191 - DNA, 622 bp, Ipomoea nil
ggtgtgagcggagacgcgacgcgaaaatgcagatctttgtgaagaccctgacggggaagacgataaccctagaggtcgagtcatcggacaccattgacaatgtgaaggcgaaaatccaggacaaggagggcatcccaccagaccagcaacgcctcatcttcgccggaaagtagctcgaggacgggcgcacccttgcagactacaacatccaaaaggattctaccctccacctcgtccttcgcctccgcggcggggcaaagaagcgcaagaagaagacatacacgaagcccaaaaagattaagcacaaacacaagaaggtgaagctcgccgtcttgcagttctacaaggttgatgattctggaaaagtacagaggctccgtaaagagtgccccaacgcggagtgcggtgctggcacattcatggccaaccattttgacaggcactactgtggcaaatgtgggcttacctatgtctatcataaggctggcggtgactgatacttttcttctactttcatttcattatgaatcctttatataattttagaccgtgatgtttggccgtataatggttttgaaactcttttggctttttccaaatcctattttcctgctatattttg

SEQ ID NO: 2192 - DNA, 473 bp, Trigonella foenum-graecum
ttcgcccatcgccaagatgcagatcttcgtcaaaaccctaacggggaagactataaccctagaggtcgagtcttcggacaccattgacaatgtcaaagctaagatccaagacaaggaaggcattccacctgaccaacaacgtcttatcttcgccggcaagcaactcgaagatggccgcaccttagccgactacaacatccagaaggaatccactctacaccttgtcctccgtctcaggggaggtgcgaagaagagaaagaagaagacctacaccaagcccaagaagatcaagcacaagaagaagaaggtcaagctcgctgtcctccagttttacaaggtggatgagtccgggaaggttcagagactgagaaaagagtgccctaatgcggaatgtggcgccgggaccttcatggctaaccattttgataggcactattgcggtaagtgtgggctcacttacgtttaccagaagg

SEQ ID NO: 2193 - DNA, 621 bp, Lactuca sativa
attcggcaaaaatgcagatcttcgtgaaaaccctaactgggaagacgattacgttggaggttgaatcctccgacacaatcgacaatgtgaaggcgaagatccaagacaaggaaggcatcccaccggaccagcagcgtcttattttcgccgggaaacaacttgaggacggcagaacccttgccgactacaacatccagaaggagtcaaccctccacctggttctccgtctccgtggtggcgcaaagaagcgcaagaagaagacctacaccaagccgaagaagatcaagcataagcacaagaaggttaagttgagcgtgttgcagttctacaaggttgatgattccggaaaggtgcagaggttgaggaaagagtgtcctaatgctgagtgtggtgctgggactttcatggctaaccacttcgacaggcactattgcggcaagtgtggtctcacttatgtccttgattagataagtgttcatcgtcgttttttgagttatgaattataattctgagttttcttgttatatcttgtggtaaacctggatttctagggttgtttttgaattgatgaaactgaatgcttttgtttatcaacatttcaagctatctaaactgatttac

SEQ ID NO: 2194 - DNA, 698 bp, Lactuca sativa
ttcggcaaaaatgcagatcttcgtgaaaaccctaacggggaagacgattacgttggaggttgaatcctccgacacgatcgacaatgtaaaggcgaagatccaagacaaggaaggcatcccaccggaccagcagcgtcttattttcgccgggaaacaacttgaggacggcagaacccttgccgactacaacatccagaaggagtcaaccctccacctggttctccgtctccgtggtggtgcaaagaagcgcaagaagaagacctacaccaagccgaagaagatcaagcataagcacaagaaggtgaagttgagcgtgttgcagttctacaaggttgatgattccggaaaggtgcagaggctgaggaaagagtgtcctaatgctgagtgtggtgcggggactttcatggccaaccatttcgataggcactattgcggcaagtgtggtctcacttatgtccttgattagataagtgttcattgtcgttttttgagttatgaattataattctgagtttttttgttatgtcttgtggtaaacctggatttgtagggttgtttttgaattgctgaaattgaatgcttttgtttatcaaacattttaagccatctaaattgttttacttactacttagctactcctgtaggtgtcatgatcctgtttaaaacatattgttattctgaatttgtaggtttcgatc

SEQ ID NO: 2195 - DNA, 858 bp, Aristolochia fimbriata
gggggaaccctagacgaattgcgccctcgcccgcccaaaccctagctgcgcttcaatctgcgaaaatgcagattttcgtcaaaaccctaacggggaagacgatcaccctcgaggttgaatcgtctgataccatcgacaatgtcaaggccaagatccaggacaaggagggcatcccccctgaccagcagcgtctgattttcgccggcaagcagctcgaggacggccgaactctcgccgactacaacatccagaaggagtccaccctccatctcgtgcttcgccttcgcggtggtgccaagaagaggaagaagaagacctacaccaagccgaagaaaatcaagcacaagaagaagaaggtcaagctcgcggtgctccagttttacaaggtggacgattctggcaaagtgcagaggctgaggaaggagtgcccgaacgctgagtgcggggctgggacgtttatggcgaaccatttcgatcgtcactactgcggcaagtgcgggctgacctacgtctaccagaaggcgggaggtgattgaatctgatgattgaggtttagggactggaagggtttagttattttgagacttggttttgttcgatgaaaactatatctttactagtttcttagctttatttcatgttttgttatttgagtatgaactccgattcttagcggtactattttggattatgttataaagtcatactttcggtatcaatccttttacttcggttctcttaatacagggcgttaaagtgtattgtattttattttgttcattgattggctctctgttcgatttttctactgctataatgcctagtatcgcctcctttagagggtttcaggtagagcaa

SEQ ID NO: 2196 - DNA, 652 bp, Theobroma cacao
gttacttcatttcccaatccctctcgccctcgccgcgccacccaaaacccgcaaccatgcagatcttcgtgaaaaccctaacgggtaagaccataaccttggaggtcgaatcctccgacaccatcgacaacgtcaaggccaagatccaagacaaggaaggcatccctccggaccaacaacgtctcatcttcgccggcaagcagcttgaagacggccgtaccctagccgactataacattcagaaggagtccaccctccatttggtcctccgcctccgcggtggcgccaagaagagaaagaagaagacttacaccaagcccaagaagatcaagcacaagaagaagaaggtgaagctcgctgtgcttcagttttacaaggtggatgattctggaaaagtccagaggttgaggaaagagtgccctaatgctgagtgtggtgccggcactttcatggccaatcatttcgataggcattactgtgggaagtgtggcttgacctatgtttaccagaaagctggtggtgattagcttttttgtctgggttttaatggtattattatgaggttttatatttgatgttttggttttagtttaatggcacttatttgttgaatttagtacttttggaatagatggtaattgttggattttga

SEQ ID NO: 2197 - DNA, 750 bp, Citrus clementina
taaaaccctaatgaaacactatataagcccctctacgcagcaaaagtttctcatccttttatttcactgaaatttgctgggtctctcctcatctgcagccatgcagatcttcgtgaaaaccctaacgggaaagaccataaccctagaggtcgaatcatcggacaccatcgacaatgtcaaggccaagatccaggacaaggaggggattccaccggaccagcagcgtctcatcttcgccggaaagcagctcgaggacggcagaaccctagccgactacaacatccaaaaggagtcaacactccacctcgtcctccgtctccgtggtggcgcgaagaagcgtaagaagaagacctacaccaagccgaaaaagatcaagcacaagaagaagaaggtcaagctcgccgtcttgcagttttacaaggtcgatgattctggaaaggtccagaggctgaggaaggagtgtccgaatgctgagtgtggagccggcaccttcatggctaaccactttgacaggcactactgcggcaagtgtggactcacctatgtttaccagaaggctggcggtgattgatcgagattaggtggttgttttgctatttttaattagtattaattactatggtttttgtggttcaaaaattatgactctttcgtaattttgtttgactatatacttgtttgctggagcgttttaattaaatggttatctgttttaaattttaattgatgaatcttttatgatttctgctt

SEQ ID NO: 2198 - DNA, 682 bp, Citrus clementina
aaaagcttctcatcctttcatttcactgaaatttgctgggtctctcctcatctgcagccatgcagatcttcgtgaaaaccctaacgggaaagaccataaccctagaggtcgaatcatcggacaccatcgacaatgtcaaggccaagatccaggacaaggaggggattccaccggaccagcagcgtctcatcttcgccggaaagcagctcgaggacggcagaaccctagccgactacaacatccaaaaggagtcaacactccacctcgtcctccgcctccgtggtggcgcgaagaagcgtaagaagaagacctacaccaagccgaaaaagatcaagcacaagaagaagaaggtcaagctcgccgtcttgcagttttacaaggttgatgattctggaaaggtccagaggctgaggaaggagtgtccgaatgctgagtgtggagccggcaccttcatggctaaccactttgacaggcactactgcggcaagtgtggactcacctatgtttaccagaaggctggcagtgattgattgagattaagtggttgttttgctatttttaattagtattaattactatggtttttgtggttcaaaaattatgactctttcgtaattttgtttgaccatatacttgtttgctggagcgtttttattaaatggttatctgttttaaattttaa

SEQ ID NO: 2199 - DNA, 684 bp, Cucurbita pepo
agctctgcaggcaagcctcccaaccatgcagatcttcgtgaaaaccctaacgggtaagaccatcaccctagaggtcgagagctccgataccatcgacaatgtcaaggccaagatccaggacaaggagggaattccgccggaccagcagcgtctgatttttgccggaaagcagcttgaggacggccgaaccctcgccgactacaacatccagaaggaatccacgcttcaccttgttctccgtctcaggggaggcgccaagaagcgtaagaagaagacctacaccaagccgaagaagatcaagcacaagcataagaaggtcaagcttgccgttctccagttctacaaggtcgatgactctggaaaggtacagaggctgaggaaggagtgccctaatgccgagtgcggcgctggaactttcatggctaaccactttgaccgccactactgtggtaaatgtggtttgacctacgtttacaacaaagctggtggtgattaggtttatcgttgtttttcatcatgttttgttttatctaaacgttttatgttgttgaatttatctagaatttctactccagcttgtggagttcagtttttgacatggattttgatttcttaatgtctatttactaccgttttcagtaagatccacatacttagtattttgtgattcttatccttgacact

SEQ ID NO: 2200 - DNA, 620 bp, Cucurbita pepo
ccgtggagctctgcaggcaagccttccaaccatgcagatcttcgtgaaaaccctaacgggtaagaccatcaccctcgaggtcgagagctccgataccatcgacaatgtcaaggccaagatccaggacaaggaaggaattccgccggaccagcagcgtctgatttttgccggaaagcaacttgaggacggccgaaccctcgccgactacaacatccagaaggaatccacgcttcaccttgttctccgtctcaggggaggcgccaagaagcgtaagaagaagacctacaccaagccaaagaagatcaagcacaagcataagaaggtcaagcttgctgttctccagttctacaaggtcgatgactctggaaaggtacagaggctgaggaaggagtgccctaatgccgagtgcggcgctggaactttcatggctaaccactttgaccgccactactgtggtaaatgtggtttgacctacgtttacaacaaagctggtggtgattaggtttatcgttgtttttcatcatgtttttgttttatctaaacgttttatgttgttgaatttatctagaatttctactccagcttgtggagttcagtttttgacatggattttgatttct

SEQ ID NO: 2201 - DNA, 725 bp, Cucurbita pepo
agttcagtcgtgcggctctgcgaacaagcctcccaaggatgcagatcttcgtgaaaaccctaacgggtaagaccatcactctcgaggtcgagagctccgataccatcgacaatgtcaaggccaagatccaggacaaggagggaatccccccggaccagcagcgtttgattttcgctggaaagcagcttgaggacggccgaactcttgccgactacaatatccagaaggaatccacgctgcaccttgtgctccgtcttaggggaggcgccaagaagcgaaagaagaagacctacaccaagcccaagaagatcaagcacaagcataagaaggtcaagctcgccgtccttcagttctacaaggtcgatgactctggaaaggtgcagaggctcaggaaggagtgccctaatgccgagtgcggtgctgggactttcatggccaaccactttgatcgccactactgcggcaaatgtggtttgacctacgtttacaacaaagctggtggtgattaggtttatccgttgtttcatgttttcgttttatctaaatgtttaattgtcgttgaattttatctagaattgctcatcaagcttgtttgagtctagttattgacatggattttgttttcttattgtcgatttattatcgtttttatgaagatcctcatatttagtcactcctttgcgattatcatccttgaaaaaactatttaattttaatgaattata

SEQ ID NO: 2202 - DNA, 513 bp, Eucalyptus grandis
atcccctcgccccgtgcgccgcgccgtcgccggaaaggagccatgcagatcttcgtgaagaccctgacggggaagacgataaccctcgaggtcgagtcgagcgacaccatcgacaatgtgaaggccaagatccaggacaaggagggcatcccccccgaccagcagcgcctcatcttcgccgggaagcagctcgaggacggccgcaccctggccgactacaacatccagaaggagtccaccctccacctcgtcctccgcctccgcggcggcgccaagaagcgcaagaagaagacctacaccaagcccaagaagatcaagcataagaagaagaaggtcaagctcgccgtcctccagttctacaaggtcgacgactccggcaaggtccagcgcctccgcaaggagtgccccaacgccgagtgcggcgccggcaccttcatggccaaccacttcgaccgccactactgcggcaagtgcggcctcacctacgtctaccagaaggccggcggtgattga

SEQ ID NO: 2203 - DNA, 886 bp, Euonymus alatus
tcccctccccatcacggattgcgcaaccatttcaagccctagcagagaagaagaaccccattcgtttttctgtgatctgcatccggaacaaggcaaagatgcagatcttcgtgaagactttgactgggaagaccatcacattggaggtggagtcctctgataccatcgacaacgtgaaggccaaaatccaagacaaggaaggcatccctccggaccagcagcgactcattttcgccggaaaacagcttgaggacggccgcactctcgccgactacaacatccaaaaggagtcaaccctccacttggtgcttcgccttcgcggtggtgctaagaagcgcaagaagaagacctataccaagcctaagaagatcaagcacaagaagaagaaggtgaagctctctgtactccagttctacaaggtcgatgactctggtaaggttcagaggctacgcaaagagtgccccaatggtgagtgcggtgccggaaccttcatggccaatcattttgataggcactactgtggtaagtgcggactcacctatgtctaccagaaggccggtggggactgattgattgtggtcggttgtttttacatttaggattttcttaaatgttttgctttaatcattgttggacctaattatatcgtatgacacttctataatttttgaattttgtggttcacatggttcttttgatctggtcaactgattatgctgttgcacctttatctcaatgtggaattgcaatttctcaatcaacctggcattgatcgcatcttgtttcttgactggattaaggttttgtttagtgtcggtctagataagaactccatggaataaatgatactgggtactgactctgccattatgttttctccataggt

SEQ ID NO: 2204 - DNA, 754 bp, Euonymus alatus
gcgcatccatttcatcctcagccgtagccgagaagaagaaacccttttcgtttctctgatctgcatctggaacgacgcaaagatgcagatcttcgtgaaaactttgactgggaagacgatcacgttggaggtggaatcctcagacaccatcgacaacgtgaaggccaaaatccaggacaaggaaggcatccctccggaccagcagcgactcatcttcgccggaaagcagctcgaggatgggcgtactctcgccgactacaacatccagaaggagtcaaccctccacttggtgcttcgcctccgcggtggtgctaagaagcgcaagaagaagacctacaccaagcctaagaagattaagcacaagcacaagaaggtgaaactcgctgtgcttcagttttacaaggtcgatgattctggtaaggttcagaggctacgcaaggagtgccccaacggtgaatgcggtgccggaaccttcatggccaatcattttgataggcactactgtggtaagtgtggtcttacctatgtctaccagaaggccggtggcgactgattgattgtgggtcggcggttttacaaatagatttttcttaaatgttttgcttaaataattgttggacctaattatatcgtatggtacttttggataatttataatttgaggaattttttattcatttgtttattttgatgtgtttgagcttaccctctagtaagctgattcggctattgcgttatctcaacttgttcctcg

SEQ ID NO: 2205 - DNA, 662 bp, Fagopyrum esculentum
gccgtgtaagagaaagagaggcgaagatgcagatcttcgtgaaaaccttaacggggaagacgataaccctcgaggttgagtcttccgacaccatcgacaatgtgaaggccaagattcaggacaaggagggaatcccaccggaccagcagcgactcatcttcgccgggaagcagctcgaagacggccgtactcttgccgactacaacatccagaaggaatcgacgcttcacttggtgcttcgtcttcgtggtggtgcgaagaagaggaagaagaagacctacaccaagcctaagaagatcaagcataagcataagaaggtgaagctcgctgttttgcagttttacaaggttgatgattctggtaaggttcaaaggttgaggaaggagtgccctagtgctgagtgtggtgctggaactttcatggcgaatcactttgatcgtcactattgcggtaagtgtggtctcacctatgtttaccagaaggctggcggcgattgattttgaagttagtttcgtttcgtttgagaaattaattttagtgtttttttgagttgaatacagttatgattgatgtaatgctttcgtactggaaccagaattttaaatttgatgatgaatgattagacaatttcccgttaatgatctatagcagtttatctttag

SEQ ID NO: 2206 - DNA, 670 bp, Fagopyrum esculentum
gtttataaactcccttcgcataggtattgccatattattcgaaacaaaccctagccgatcgagaactcgagagagacgcaaagatgcagattttcgtcaaaaccctgacgggtaagacgataaccctcgaggtcgaatcctccgacaccatcgacaatgtgaaggcaaagatccaggacaaggaaggaattccaccagaccagcaacggctaatcttcgccggtaagcagctagaggatggccgaaccctcgccgattacaatatccagaaggaatcgacgctccacctggtgctccgtcttcgtggtggtgccaagaagaggaagaagaagacctacaccaagccgaagaaaatcaagcacaagcataagaaggttaagctcgctgttttgcagttctataaggttgatgattctggaaaggtccagaggctgaggaaggagtgtcctaacggtgagtgcggcgctggaactttcatggctaaccactttgatcgccattactgtggtaagtgtggtctcacctatgtttaccagaaggccggtggtgattgattttcttattatccatcgttttatgctgtctgagaattcgtaggcggtctagtaccgcattttttaaattttgaagtattggataatatggtgacgatttgaatgacgagctctat

SEQ ID NO: 2207 - DNA, 655 bp, Fagopyrum esculentum
ccgaaaccctagccgtgtaagagaaagagagtcgaagatgcagatcttcgtgaaaaccctaacggggaagacgataaccctcgaggttgagtcctccgacaccatcgacaatgtgaaggccaagatccaggacaaggagggaatcccaccggaccagcagcgactcatcttcgccgggaagcagctcgaggacggccgtactcttgccgactacaatatccagaaggaatcgacgcttcacttggtgcttcgtcttcgtggtggtgcgaagaagaggaagaagaagacctacaccaagcctaagaagatcaagcataagcataagaaggtgaagctcgctgttttgcagttttacaaggttgatgattctggtaaggttcaaaggttgaggaaggagtgccctagtgctgagtgtggtgctggaactttcatggcgaatcacttcgatcgtcactattgcggtaagtgtgggctcacctatgtttaccagaaggctggcggcgattgatattgaatttcaagtttagtttattgtttgagttgaatacagttatgattgaagtaatgctttcgtactggaaccagaatgttaaattttgatgatgaatgattagacaatttcccgttaatgatcaattgcagtttatcttagttg

SEQ ID NO: 2208 - DNA, 611 bp, Fagopyrum esculentum
gagccaaagatgcagatcttcgtgaaaaccctaacggggaagacgataaccctcgaggtggagtcatccgataccatcgacaatttgaaggccaagattcaggacaaggagggaatcccaccggaccagcagcgactcatcttcgccgggaagcagctcgaagacggccgtactctcgccgactacaacatccagaaggaatcgacgcttcacttggtgcttcgtcttcgtggtggtgcgaagaagaggaagaagaagacctacaccaagcctaagaagatcaagcataagcataagaaggtgaagctcgctgttttgcagttttacaaggtagatgattctggtaaggttcaaaggttgaggaaggagtgccctaatgctgagtgtggtgctggaactttcatggcgaatcactttgatcgtcattattgcggtaagtgtgggctcacctatgtttaccagaaggctgggggcgattgatctcgaagttagtttcgtttgagaatttcaagtttagtttttattatgagttgaatacaattatgattgatgtaatgctttggtactggaaccagaatgttaaattttgataatgaatgattaggcaattt

SEQ ID NO: 2209 - DNA, 817 bp, Humulus lupulus
cgaaaatcacacctatctcctcttgtcgtctcacctctttctgcagtcatgcagatcttcgtgaaaaccctaacgggtaaaaccataaccctagaggttgagtcttccgacaccatcgacaatgtcaaggccaagatccaggacaaggagggcatcccaccggaccagcagcgtctcatattcgccggaaagcagctcgaggacggccgaaccctagcggattacaacatccagaaggagtcgactctccacttggtgctccgtctcaggggaggagccaaaaagaggaagaagaagacctacactaagccaaagaagatcaagcacaagaagaagaaggtgaagctctcgctcctccagttctacaaggtcgatgactcaggcaaggtccagaggctgaggaaggagtgccccaatgctgagtgtggcgccggtactttcatggcgaatcacttcgaccgacactactgcgggaagtgtggtttgacttacgtttatcagaaggccggcggcgattaggtttctttttcgcttttttttttattttataaaaacaagaaattatcgaattttggtattttgtttgcgatggtgctgtttaatttcattcaatagcttttggtttatgcaattatgctaaatgcttaggtatatcgactgttttggattattttttagttgatgaattggccgctttaaatagcatttgaattatgctcatggagatttttgttttcatgatttgttactcttgaaattgatgattcaacatggttgaactgtgtttttatcttttaataatgtaactagtttattg

SEQ ID NO: 2210 - DNA, 722 bp, Humulus lupulus
aaccctctcggcgcctctctctttctgcaatcatgcagatcttcgtgaaaaccctaacgggtaaaaccataaccctagaggttgagtcttctgacaccattgacaatgtcaaggccaagatccaggacaaggagggcatcccaccggaccagcagcgtctcatcttcgccggaaagcagctcgaggacggccgaaccctagcggattacaacatccagaaggagtcgactctccacttggtgctccgtctcaggggaggagccaaaaagaggaagaagaagacctacactaagccaaagaagatcaagcacaagaagaagaaggtgaagctctcgctcctccagttctacaaggttgatgactcaggcaaggtccagaggctgaggaaggagtgccccaatgctgagtgtggcgccggcactttcatggcgaatcacttcgaccgacactactgcgggaagtgtggtttgacttatgtttatcagaaggccggcggcgattaggtttctttttcgtcttttttttttgaaattttataagaaacatgaaatgatcgaatttggtattttgtttgagtatgtactgtttaatttaatagcgattttccgactttgtttgatgattacataatttggtttatgcgattatgctaaatgcttaggtttattgactgttttgaaattttgtctttttagttatatttttaattgatgaaatggccg

SEQ ID NO: 2211 - DNA, 746 bp, Humulus lupulus
gacacataggagaaccctctcggcgcctctctgtttctgctatcatgcagatcttcgtgaaaaccctaacgggtaaaaccataaccctagaggttgagtcttctgacaccatcgacaatgtcaaggccaagatccaggacaaggagggcatcccaccggaccagcagcgtctcatcttcgccggaaagcagctcgaggacggccgaaccctagcggattacaacatccagaaggagtcgactctccacttggtgctccgtctcaggggaggagccaaaaagaggaagaagaagacctacactaagccaaagaagatcaagcacaagaagaagaaggtgaagctctcgctcctccagttctacaaggtcgatgactcaggcaaggtccagaggctgaggaaggagtgccccaatgctgagtgtggcgccggcactttcatggcgaatcacttcgaccgacactactgcgggaagtgtggtttgacttatgtttatcagaaggccggcggcgattaggtttcttttccgctttattttattttttgaaattttataagaaacatgaaatgatcgaattttggtattttgtttgagttggtactgtttaatttaatagcgattttccgactttgtttgatgattacataatttggtttatgcgattatgctaaatgcttaggtttattgactgttttgaaatttcgtctttttagttatatttttaattgatgaaatggccgcttctaa

SEQ ID NO: 2212 - DNA, 815 bp, Humulus lupulus
aggagaaccctctcggcgcctctctgtttctgctatcatgcagatcttcgtgaaaaccctaacgggtaaaaccataaccctagaggttgagtcttctgacaccatcgacaatgtcaaggccaagatccaggacaaggagggcatcccaccggaccagcagcgtctcatcttcgccggaaagcagctcgaggacggccgaaccctagcggattacaacatccagaaggagtcgactctccacttggtgctccgtctcaggggaggagccaaaaagaggaagaagaagacctacactaagccaaagaagatcaagcacaagaagaagaaggtgaagctctcgctcctccagttctacaaggtcgatgactcaggcaaggtccagaggctgaggaaggagtgccccaatgctgagtgtggcgccggtactttcatggcgaatcacttcgaccgacactactgcgggaagtgtggtttgacttacgtttatcagaaggccggcggcgattaggtttctttttcgcttttttttttaatttttataaaaacaagaaattatcgaattttggtattttgtttgcgatggtactgtttaatttcattcaatagcttttggtttatgcaattatgctaaatgcttaggtatatcgactgttttggattattttttagttgatgaattggccgctttaaatagcatttgaattatgctcatggagattttttgttttcatgatttgttactcttgaaattgatgattcaacatggttgaactgtgtttttatcttttaataatgtaactagtttattgttactt

SEQ ID NO: 2213 - DNA, 757 bp, Humulus lupulus
tacacacctatctcctcttgtcgtctcacctctttctgcagtcatgcagatcttcgtgaaaaccctaacgggtaaaaccataaccctagaggttgagtcttccgacaccatcgacaatgtcaaggccaagatccaggacaaggagggcatcccaccggaccagcagcgtctcatcttcgccggaaagcagctcgaggacggccgaaccctagcggattacaacatccagaaggagtcgactctccacttggtgctccgtctcaggggaggagccaaaaagaggaagaagaagacctacactaagccaaagaagatcaagcacaagaagaagaaggtgaagctctcgctcctccagttctacaaggtcgatgactcaggcaaggtccagaggctgaggaaggagtgccccaatgctgagtgtggcgccggcactttcatggcgaatcacttcgaccgacactactgcgggaagtgtggtttgacttatgtttatcagaaggccggcggcgattaggtttctttttcgctttattttattttttgaaattttataagaaacatgaaatgatcgaattttggtattttgtttgagttggtactgtttaatttaatagcgattttccgactttgtttgatgattacataatttggtttatgcgattatgctaaatgcttaggtttattgactgttttgaaatttcgtctttttagttatatttttaattgatgaaatggccgcttctaatagcatttgaat

SEQ ID NO: 2214 - DNA, 830 bp, Momordica charantia
attacgccggggggcgtatgattacaaagagagaggctcgagtgggggactctaattcggccgctgcaaccaagcctccaaccatgcagatcttcgtgaaaaccctaacgggtaagacgatcaccctcgaggtcgagagctccgataccatcgacaatgtcaaggccaagatccaggacaaggagggaatccccccggaccagcagcgtctgattttcgccggaaagcagctcgaggacggccgaacccttgccgactacaacatccagaaggaatcaaccctccaccttgtcctccgtctcaggggaggcgcgaagaagcgcaagaagaagacctacaccaagccgaagaagatcaagcacaagcacaagaaggtcaagctcgccgtcctccagttctacaaggtcgatgactctggaaaggtgcagaggctgaggaaggagtgccctaatgccgagtgcggcgccgggactttcatggccaatcactttgaccgccactactgcgggaagtgtggtttgacctacgtttacaataaagccggtggtgattagttttatcgtcgttttgcttcatgttttccctttatctaaatgttgaatgttgttgaatttatctagaattgctgctccagcttgtggagcatagttcgcgacatggattttgttttcttaatgtcgatttattatcgttttcatttagatccacatatctagtcagttttttatgcgattattatcctttatataaactgtttcatttggattttggtttaatggatgatatgctttctcgttaacttgaaaaataggcgctgattagttttctag

SEQ ID NO: 2215 - DNA, 616 bp, Olea europaea
aacagagaccaccaaaaaaaccctagcttgccgaagatgcagatcttcgtgaaaaccctaacggggaagaccataaccttggaggtcgaatcctctgataccattgacaatgtgaaggccaagatccaggacaaggaaggaatcccaccggaccagcagcgtctcatatttgcaggaaagcagctcgaggacggccgcacactcgctgactacaacatccagaaggagtccactctccacctcgttctccgcctccgtggtggtgccaagaagcgcaagaagaagacctacaccaagccgaagaagatcaagcataagcacaagaaggtgaagctagccgtcctgcagttctacaaggtcgatgattcaggaaaggtccagaggcttcgcaaggaatgccctaacgctgagtgtggtgcgggaactttcatggctaaccattttgataggcactactgtggtaagtgtggcctcacctatgtttacaataaggccggcggcgattgagatctgaacaatttttattattaattatgagtttctgtagttgagagtcggaacctttagttcaatttgcagttacgcttgttgctgaattaatgtcatcgttattcgt

SEQ ID NO: 2216 - DNA, 737 bp, Olea europaea
tcgactcagcctttagacggaagaactgagagcgcccaaaaaaccctagctggcagtttcccttcactgcgaagatgcagatcttcgtgaaaaccctaacggggaagaccataaccttggaggttgaatcgtccgacaccatcgacaatgtgaaggccaagatccaggataaggaaggcatcccgccggaccagcagcgtcttatattcgccggaaagcagctggaggacggtcgcaccctcgccgactacaacatccagaaggagtccactcttcacctcgttctccgcctccggggtggtgccaagaagcgcaagaagaagacctacaccaagccgaagaagataaagcacaagcataagaaggttaagctcgctgttctgcagttctacaaggttgatgattctggaaaggtccagaggctccgtaaggaatgccctaatgctgagtgtggtgcgggaactttcatggctaaccattttgacaggcactactgtggtaagtgtggcctcacctatgtttacaacaaggctggtggcgattgaggaaaggttttcttgcctatgaaatttactgtttttttgtctagatcatttaatataacaattatattatttagggtttttaattatgagattgtgtttgattgacttggtgagggtcggaaacttatttttactttaattcagtttacagttactcttgttgctgaattattctgatcaattccatcagta

SEQ ID NO: 2217 - DNA, 746 bp, Citrus sinensis
ccctaatgaaacactatataagcccctctacgcagcaaaagtcttctcatcctttcatttcactgaaatttgctgggtctctcctcatctgcagccatgcagatcttcgtgaaaaccctaacgggaaagaccataaccctagaggtcgaatcatcggacaccatcgacaatgtcaaggccaagatccaggacaaggaggggattccaccggaccagcagcgtctcatcttcgccggaaagcagctcgaggacggcagaaccctagccgactacaacatccaaaaggagtcaacactccacctcgtcctccgtctccgtggtggcgcgaagaagcgtaagaagaagacctacaccaagccgaaaaagatcaagcacaagaagaagaaggtcaagctcgccgtcttgcagttttacaaggtcgatgattctggaaaggtccagaggctgaggaaggagtgtccgaatgctgagtgtggagccggcaccttcatggctaaccactttgacaggcactactgcggcaagtgtggactcacctatgtttaccagaaggctggcggtgattgatcgagattaggtggttgttttgctatttttaattagtattaattactatggtttttgtggttcaaaaattatgactctttcgtaattttgtttgactatatacttgtttgcttgagcgttttaattaaatggttatctgttttaaattttaattgatgaatcttttatgatttctactt

SEQ ID NO: 2218 - DNA, 669 bp, Lippia dulcis
agcaaaaccctagcttttctgcggcggtcgcgaagatgcagatcttcgtgaaaaccctaacggggaagacgatcaccctcgaggtggagtcgtccgacaccatcgacaacgtcaaggccaagatccaggacaaggaaggcatcccgccggaccagcagcgcctcatcttcgccggcaagcaactcgaagatggtcgcaccctcgccgactataacatccagaaggagtccacgctccacctcgtcctccgcctccgtggtggcgctaagaagcgcaagaagaagacctacaccaaaccgaagaagatcaagcacaagcacaagaaggtcaagctcgccgttcttcagttctacaaggtcgacgactccggcaaggttcagcgcctcaggaaggagtgccccaacgctgagtgcggggctggaaccttcatggccaatcattttgaccgccattactgcggtaagtgcggcttgacctacgtctataataaggccggcggcgattgagtttgagtttagtgcatttttctttcgtactataagcccttaaaagatgaatttcattgttgttagtatttggacatgagattatcatattttggtcactatgcttaaatcagttttacaatttaatcttactatagttttgattaactgcatgataattggt

SEQ ID NO: 2219 - DNA, 760 bp, Platanus occidentalis
agaggaacctgaaacctagcagctggttatcgtcccccccttttcccgcgaagatgcagatcttcgtgaaaaccctaacagggaaaacaataaccctagaagttgaatcctcggacacaatcgacaatgtgaaggcgaagatccaagacaaggaaggcatccctcccgatcaacaacgcttgatctttgccgggaaacagctcgaagacggaagaaccctcgccgattacaatatccagaaggagtcaacgcttcacctggttctccgtctcaggggaggagcgaagaagcgaaagaagaagacctacacgaagcccaagaagatcaagcacaagaagaagaaggttaagctcgctgtgctgcaattctacaaggttgacgattcgggtaaggttcagaggcttagaaaggagtgccccaatgctgagtgtggtgctgggacgttcatggccaaccattttgatcgtcactactgtggcaagtgtggccttacttacgtttatcaaaaggctggaggtgagtgagagagatatggtggtgttgcaatgcaacttttcccttcgtttctgtcttttagggttcttaagatgatggttttagtgttttatgttggattaatagactcgtcctttctctctaaatagagagaaggtggtgaacatgggtaggatattgtgtttcaattttgagatagcttatcgtaattggagatattttgataagactgggtaaaattttgatgtttaatttatgttttatt

SEQ ID NO: 2220 - DNA, 634 bp, Primula obconica
aaacccccctagcctctctttctctttctctcacttggtttcaggatgcagatcttcgtgaagaccctgacggggaagacgatcaccttggaggttgagtcatcagacaccatcgacaatgtcaaggccaagattcaggacaaagagggcatcccaccggaccagcaacgcctcatcttcgccggaaaacagcttgaagacggcagaaccctagctgattacaatatccagaaggagtctactctgcaccttgtgcttaggctccgtggtggggctaagaagaggaagaagaagacttatactaagcctaagaagatcaagcataagcataagaaggtcaagcttgctgttcttcagttctacaaggttgaggactctggcaaagtgcagaggctgaggaaggagtgcccaaatgcagagtgtggagctgggactttcatggccaaccatttcgataggcactattgcggcaagtgtggattgacctatgtttaccagaaggctggtggtgattagtttgctttctgtttcacttgttatttcgactatgaaattgctcttttttagttgagaaatggtctgaattctctttaattttcgatattcatgtctgagttctctttaatttttggat

SEQ ID NO: 2221 - DNA, 572 bp, Scabiosa columbaria
ccctagtactaatctcaatatctcagcccccaaatccttagccactgaaacagcgaagatgcagatcttcgtcaaaaccctaacgggcaagaccataaccctcgaggtcgagtcctccgacaccatcgacaatgtcaaggctaagatccaggacaaggaaggcatcccgccggaccagcagcgtctcatcttcgccggaaagcagctcgaggacggccgaaccctagccgactacaacatccagaaggaatcgacgctgcaccttgtgttgaggcttcgtggtggtgcgaagaagcgaaagaagaagacctacaccaagccgaagaagatcaagcacaagcataagaaggttaagctcgcggtgctccagttctacaaggttgatgattctggtaaggtgcagaggttgaggaaggagtgtcctaatgctgagtgtggagctggaactttcatggcgaatcatgctgaccgtcattactgcggtaagtgtggtctcacttatgtttatcagaaggccggcggcgattgatcgcggtaatacttttccggtgattaaattagctttatgttat

SEQ ID NO: 2222 - DNA, 923 bp, Fragaria vesca
aatccctaatttcacaaccacagcgcctcatctccttcagagctgagtgagccgcaaccatgcagatcttcgtgaaaaccctaacggggaagaccatcaccctcgaggtggagtcctccgacaccatcgacaacgtcaaggccaagatccaggacaaggagggcatcccgccggaccagcagcgcctcatcttcgccggcaagcagctcgaggacggccgcaccctcgccgactacaacatccagaaggagtcgactctccacctcgtgctccgcctccgcggtggcgctaagaagaggaagaagaagacctacaccaagcctaagaagatcaagcacaagcataagaaggtcaagctcgctgtgctccagttttacaaggtggatgactctggaaaggtccagaagctcaggaaggagtgccctaatgcggagtgcggcgccgggactttcatggccaaccactttgacaggcactactgcggcaagtgtgggctgacctatgtttaccagaaggccggcggcgattaggttgttagtgctttattatgttatcgtattcgatttaagtttggtactccgtactctgttatgttttgttttaatttcgtgcttttataagctctggatatttaggtattttgtttttggatgatatattttgatgctgggattatgacaattttatctatttaaagttctgttttgtctatctggttgtttggattgatttgctatatactgtgatacctgttcgttgtttgttgaatcgttattggtttgtcgaatcgttattggtttggtattgatttggtgatgaaaatgaggttggagtgtgcatatgattgctatttgtagagtagtgatatatatgaattacggtttttgacaattggatggtcaaacgggccagttttgaggatt

SEQ ID NO: 2223 - DNA, 607 bp, Vinca minor
gcagatcttcgtgaaaacactaacaggaaaaacaatcacactcgaggttgaatcttcagacacaatcgacaatgtcaaggccaaaatccaagacaaggaaggaattccaccagatcaacaacgtttgatcttcgcaggaaaacagctcgaagatggtagaaccctagctgattacaacatccagaaggaatcaacacttcaccttgttcttcgtctccgtggtggagcgaagaagaggaagaagaagacttatactaagccaaagaagattaaacataagcataagaaggttaagcttgctgttttgcagttttataaagttgatgattctggtaaagttcaaagacttagaaaggagtgtcctaatgctgagtgtggtgcgggtactttcatggctaatcattttgataggcactattgtggcaagtgtggtcttacctatgtttaccagaaggctggcggtgactaaattactaaattacccctctctttttttatgaattattagttttaattaagtatggattttaatttttttggtttagggctattgatgattttatatagctttaaagaccattggtttgtcttatggattttattttat

SEQ ID NO: 2224 - DNA, 712 bp, Vinca minor
gaagagatgcagatcttcgtgaaaaccctaacggggaagacgatcactctcgaggttgaatcctcggacaccatcgacaatgtgaaggccaagattcaggacaaagaaggaattccaccggaccagcagcggctcatcttcgccggaaagcagctggaggacggcagaaccctagccgactacaacatccagaaggaatcaacgcttcaccttgtgcttcgtctccgtggtggagcaaagaagcgtaagaagaagacttacaccaagccaaagaagatcaagcacaagcataagaaggttaagctcgccgtgttgcagttctacaaggtggacgattctggtaaggttcagaggctcaggaaggagtgtccaaatgctgagtgtggcgccggaacctttatggctaatcattttgaccgtcactactgcggcaagtgcggcctcacttatgtttacaacaaggctgctgaagagtaatctttaccagtcgttagcagtgtcacttttgcattttattcatatggattttagttttactttattcaaatattatgatgtttaagacctttgggagttgacaactgaaatagttatttgctatggattaattttggatattgcaatctttgttattctcctagtctaatttatcctgaatggttctctgctttcattttaggtactagtattatgtgatgaattcaatcctctg

SEQ ID NO: 2225 - DNA, 702 bp, Vinca minor
ggaaaattgcgaagatgcagatcttcgtgaaaaccctaactgggaagaccatcactctggaggttgaatcctcggacaccatcgacaacgtgaaggcgaagatccaggacaaggaaggcatcccaccggaccaacagcgtctcatcttcgccggaaagcagcttgaggacggtagaaccctagccgactacaacatccagaaggaatcaactcttcaccttgttcttcgtctccgtggtggcgcaaagaagcgtaagaagaagacttacaccaagccaaagaagatcaagcacaaacacaagaaggttaagctcgccgtgttacagttctacaaggtggacgattctggtaaggttcagaggctcaggaaggagtgtccaaatgctgagtgtggcgccggaacctttatggctaatcattttgaccgtcactactgcggcaagtgcggcctcacctatgtttacaacaaggccgttgaagaatgatcccattttatctcgttagcagtgtcagttttgcattttatttatatggattttagttttgctttattaaaatattataatgtttgagacctttttggagttggcaactgaaaatgattacttttggatattgaaatttttggtatcctgctagtacaagtacccaaaaccggatctggtgaacatttatcaaatactttgcacctaaatatatacc

SEQ ID NO: 2226 - DNA, 651 bp, Antirrhinum majus
atagccgcacagcgaagatgcagatcttcgtgaaaaccctaacgggcaagaccatcaccctggaggtcgaatcctccgacacgatcgacaatgtgaaggccaaaatccaggacaaggaaggcatccctcccgatcagcagcgcctcatattcgccggaaaacagctcgaggacggtcgcacactcgccgattacaacattcagaaggaatcgactctccatctggtgctccgattgcgaggcggagcgaagaagcgcaagaagaagacctacacgaagccgaagaagatcaagcacaagcacaagaaggtgaagctcgctgtgcttcagttctacaaggtcgatgattcggggaaagtgcagaggctgaggaaggagtgccctaacgcggagtgtggagcggggactttcatggcgaatcattttgacaggcattactgtggtaagtgtggccttacttatgtctacaataaggctggtggagattagagaattagatttgtgttttttgagatcgttttgtttttgttatcagagtttgatgatttttgtttaaattgtggattttgttgaagtattatgttttgctgactcggatatttgaatgttaatttttcagtttcttaatgttacttttatctgtgttgtgatg

SEQ ID NO: 2227 - DNA, 714 bp, Theobroma cacao
  misc_feature (540)..(540): n is a, c, g, or t
  misc_feature (709)..(709): n is a, c, g, or t
cgggggttacttcatttcccaatccctctcgccctcgccgcgccacccaaaacccgcaaccatgcagatcttcgtgaaaaccctaacgggtaagaccataaccttggaggtcgaatcctccgacaccatcgacaacgtcaaggccaagatccaggacaaggaaggcatccctccggaccaacaacgtctcatcttcgccggcaagcagcttgaagacggccgtaccctagccgactataacattcagaaggagtccaccctccatctggtcctccgcctccgcggtggcgccaagaagagaaagaagaagacttacaccaagcccaagaagatcaagcacaagaagaagaaggtgaagctcgctgtgcttcagttttacaaggtggatgattctggaaaagtccagaggttgaggaaagagtgccctaatgctgagtgtggtgccggcactttcatggccaatcatttcgataggcattactgtgggaagtgtggcttgacctatgtttaccagaaagctggtggtgattagcttttttntctgggttttaatggtattattatgaggttttatatttgatgttttggttttagtttaatggcacttatttgttgaatttagtacttttggaatagatggtaattgttggattttgaaattttggttggttaattagatatttgatatatgtcgattttaagttaaagnggcta

SEQ ID NO: 2228 - DNA, 845 bp, Ricinus communis
gcacaactacaaaaccctaaaattcccttcatatctaaagcgagccacaccggcatttgaaaccctagccgaaaagacctcttcatattcctacactctcttttctctgcatcggtggcggaaagatgcagatcttcgtgaaaaccctaacgggtaagaccataaccctagaggttgaatcctccgataccatcgacaatgtgaaggccaagatccaagacaaggaaggcatcccaccggaccagcaacggctaatcttcgcaggaaagcaactcgaagacggccgtacacttgcggactacaacatccagaaggagtctactttgcatctggtgctgcgattgagaggaggggcgaaaaagagaaagaagaagacgtacaccaagcccaagaagatcaagcacaagaagaagaaggtgaagctcgctgtccttcagttttacaaggtcgatgatagcggaaaagtgcagaggttgaggaaagagtgtccgaacgcggagtgtggtgctggcacttttatggctaatcattttgataggcactactgcggtaagtgtggtcttacttatgtctaccagaaggctggtggtgattagggcaacaaatttaagtcctttgagtactatgtcattttgagattattgttggaccaagtattatggcatttcttttgttgttatgagttttgtttggataattttggatggtacttctttttgaagttataatggataattagtggctcattttatatctatagatatgcttctgttggtttggttgtttgttcattgagctctgttgatgcttggtactttctgaggtgaactgcaggatttcttgat

SEQ ID NO: 2229 - DNA, 691 bp, Citrus sinensis
ccacgcgtccactgaaatttgctgggtctctcctcatctgcagccatgcagatcttcgtgaaaaccctaacgggaaagaccataaccctagaggtcgaatcatcggacaccatcgacaatgtcaaggccaagatccaggacaaggaggggattccaccggaccagcagcgtctcatcttcgccggaaagcagctcgaggacggcagaaccctagccgactacaacatccaaaaggagtcaacactccacctcgtcctccgtctccgtggtggcgcgaagaagcgtaagaagaagacctacaccaagccgaaaaagatcaagcacaagaagaagaaggtcaagctcgccgtcttgcagttttacaaggtcgatgattctggaaaggtccagaggctgaggaaggagtgtccgaatgctgagtgtggagccggcaccttcatggctaaccactttgacaggcactactgcggcaagtgtggactcacctatgtttaccagaaggctggcggtgattgatcgagattaggtggttgttttgctatttttaattagtattaattactatggtttttgtggttcaaaaattatgactctttcgtaattttgtttgactatatacttgtttgctggagcgttttaattaaatggttatctgttttaaattttaattgatgaatcttttatgaaaaaa

SEQ ID NO: 2230 - DNA, 751 bp, Coffea canephora
ggcacacccacgaaagcgttaatcaacccctttattctcaatcccctttattcatttcccaaaaccctagcagcagcagcggaggcggcagccgccgtcgtcaaagatgcagatcttcgtgaaaaccctgacggggaagaccatcacccttgaggtggagtcttccgacaccatcgacaatgtcaaggccaaaatccaggacaaggagggcatacccccggaccagcagcgcctcatcttcgccggcaagcagctggaggacggccgcaccctagccgactacaacatccagaaggagtccaccctccacctcgtcctccgcctccgtggtggcgccaagaagcgcaagaagaagacctacaccaagcccaagaagatcaagcacaagaagaagaaggtcaagctagccgtccttcagttctacaaggtcgacgactccggcaaggtccagaggctcaggaaggagtgccctaatgctgagtgtggcgctgggactttcatggccaatcattttgacaggcactattgcggcaagtgtggcctcacctatgtttaccagaaggccggcggtgactgagggaacttctctccccctttttgtttttataaactttatggttactagtctaattgaacattagcagcatgttcttattttgaagattttgttctttattgggtttgatatattactctctgaaaccgttggattttcctttttatggcttcgtttcctccctaatactacttt

SEQ ID NO: 2231 - DNA, 796 bp, Cucumis sativus
aaaggcaagcattcttctcccccaaacccttgttattcccaatcggccgtgcggcaaccgaagcctctcaaccatgcagatcttcgtgaaaaccctaacgggtaagaccatcactctcgaagtcgagagctccgataccatcgacaatgtcaaggcaaagatccaggacaaggaaggaatccctccggaccagcagcgtttgattttcgccggaaagcagcttgaggacggccgaacactagccgactacaacattcagaaggaatccacgctccaccttgtgctccgtctcagaggaggtgccaagaagcgtaagaagaagacctacaccaagcccaagaagatcaagcacaagcacaagaaggtgaagctcgccgtccttcagttctacaaggtcgatgactctggaaaggtgcagaggcttaggaaggagtgccctaacgctgagtgcggcgctggaactttcatggccaatcactttgaccgccactactgcggtaaatgtggtttgacctacgtttacaacaaagctggtggtgattaggtttaatctgttgttttttttttcccatcatgttttcgttttatctaaatgtttgatgtcgttgaatttatctagaattgctactcctgtttgtggagtttagttcttgacatggattttgttttcttaatgtcgatttattatcgtttttattgagacccacatacttagtccgtcttcttgcgattattatccttgaaataactgttaaattttgggttttggtttaatagattatatgcttctcgtaaa

SEQ ID NO: 2232 - DNA, 666 bp, Solanum melongena
agctctgtgtagcggcacttttcaccttcaaattcgggttcaccaagtggtgaaacatgcagatctttgtgaagaccctgacgggtaagactattaccttggaggtagagtcatcagacaccatcgacaatgttaaggctaagattcaggacaaggaaggcattccaccagaccagcagcggttgattttcgcaggtaagcagcttgaggatggacgaacactagctgactacaacatccagaaggagtccaccctccaccttgtccttcgtctccgtggtggtgccaagaagcgtaagaagaagacttacactaagcctaagaagatcaagcacaagaagaagaaggttaagctcgctgtcctccagttttacaaggttgatgatactggcaaggttcaaagactccgtaaggagtgccccaacgctgagtgtggtgccggaaccttcatggctaaccattttgataggcactattgtggtaaatgtgggcttacctatgtttaccagaaggctggtggtgattagatgagtgttagtttgcttagtttttgcccacatttgtgtccctatactcttctttaatgtcttgtttgtgacaagatgaatgaatttgaattatgggattatgtttgcagcttataagaagctatggattttgtcagct

SEQ ID NO: 2233 - DNA, 792 bp, Solanum melongena
atttcatcttcttcctcaatcctcattcaactctctgagcagcggcattcttcaccttcaaatctgggagcaccaagtggtgaaaaatgcagatctttgtgaagaccctaacgggcaagactattaccttagaggtagagtcatctgacaccattgacaatgtcaaggctaagatccaggacaaggaaggcattccaccagaccagcagaggttgattttcgcaggtaagcagctcgaggatggacgaacactagctgactacaacatccagaaggagtccaccctccaccttgtccttcgccttcgtggtggtgccaagaagcgtaagaagaagacttacactaagcctaagaagatcaagcacaagaagaagaaggttaagctcgccgtcctccagttttacaaggttgatgattctggtaaggttcagaggctccgtaaggagtgccccaacgccgagtgtggtgccgggaccttcatggctaaccattttgataggcactattgtggtaaatgtggtcttacctatgtttaccagaaagcaggtggtgattagatgagtgttaaattgcctatgactctttgttgcttttcgccaacagtctaggtttttcctatatactctcctaatggatcttgtttgttacaagatgtaatgaatttgaattatgggatcatggttgttagcagtgcgtatcggtcggttcggtttaattatatgtattattaattcagttgatcggcttttgatttttaaacatgttaaaccaataacaacttaattaggtccc

SEQ ID NO: 2234 - DNA, 824 bp, Eucalyptus grandis
gccctcctcccttcctgcaccagaaaaacgcaaaccctagccgatctcccccccttccccccagcggctgcagaccatcaccaatccctccctgggtctgcatcgccggcggccaagatgcagatcttcgtgaagaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactataacatccagaaggagtccaccctccacctcgtcctccgcctccggggcggcgccaagaagcggaagaagaagacctacaccaagcccaagaagatcaagcataagaagaagaaggtcaagctcgccgtcctccagttctacaaggtggacgactccggcaaggtccagcggctccggaaggagtgcccgaacgccgagtgcggcgccgggaccttcatggccaaccacttcgaccgccactactgcggtaagtgcgggctaacctatgtttaccagaaggccggcggtgattgagatcgatagagagatagataatttaaattatggagtctgtagcggtaatctttttactgggtttagtttatgttgctttcggatgatgattgtgggattcaagtgtggattttggagctcgaagttagctttttgaaatgattacttatgaaaccattttgctctagctcgagtcgcttctctcgtttggagtttggttctatggcgttgattgataagtgattgtgcttctgatt

SEQ ID NO: 2235 - DNA, 750 bp, Eucalyptus grandis
cggaattatggagtctgtagcggtaatctatttactgccgatctcccccccttccccccagcggctgcagaccataaccaatccctccctgggtctgcatcgccggcggccaagatgcagatcttcgtgaagaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactataacatccagaaggagtccaccctccacctcgtcctccgcctccggggcggcgccaagaagcggaagaagaagacctacaccaagcccaagaagatcaagcataagaagaagaaggtcaagctcgccgtcctccagttctacaaggtggacgactccggcaaggtccagcggctccggaaggagtgcccgaacgccgagtgcggcgccgggaccttcatggccaaccacttcgaccgccactactgcggtaagtgcgggctaacctatgtttaccagaaggccggcggtgattgagatcgatagagagatagataatttaaattatggagtctgtagcggtaatctatttactgggtttagtttatgttgctttcggatgatgtttgtgggattcaagtgtggattttggagctcaaagttagctttttgaaatgactacttatgaaaccattttgctct

SEQ ID NO: 2236 - DNA, 572 bp, Panax ginseng
aaatgcagatcttcgtgaaaacactcacgggtaagaccataaccctagaggtagaatcctcggacactattgataatgtcaaggccaagatccaagacaaggagggcattcctccggaccagcagcgcctcatcttcgcgggaaagcagctggaggacggcagaaccctagcggactacaacatccagaaggaatccaccctccacctggtcctccgtctccgcggtggtgcaaagaagcgtaagaagaagacctacacgaagccgaagaagataaagcacaagaagaagaaggtgaagctcgcggtgttgcagttttacaaggtggatgattctggaaaggtccagaggctgaggaaggagtgtccgaatgcagagtgtggcgccggaactttcatggccaatcattttgaccggcactactgtggcaagtgtggccttacctatgtttatcagaaggctggtggtgattaatgcttctataccttttttgaaatgtctaatcgaatgtgtttctgaaaattatagagtcgatgtttttaagttaaatgatgaatttgaatgatttagttg

SEQ ID NO: 2237 - DNA, 697 bp, Vitis vinifera
ctgaaggccctccacagaaaaggagccaagatgcagatcttcgtgaaaaccctaacggggaagaccataaccctagaggttgaatcgtctgacaccatcgacaatgtcaaggctaagatccaggacaaggaaggcatcccaccggaccagcagcgtctcatcttcgctggaaaacagctggaggacggccgaaccctagccgactacaacatccagaaggagtcgaccctccacctggtgctccgcctccgtggtggcgccaagaagcgcaagaagaagacctacaccaagcccaagaagatcaagcacaagaagaagaaggtcaagctcgctgttttgcagttctacaaggttgatgattccgggaaggttcagcggctgaggaaggagtgccccaatgctgagtgcggtgcgggtacctttatggcaaaccattttgatcggcactactgtggtaagtgtggcctcacctatgtttaccagaaggctggcggagattaggggttataacttgaactacttttagtccctgttttgcgtttcggttttgtagaattctagagattataattttgattcgaatggattggaatttgactttgaacttgaatgatctatatatgttttaatcatgaattttgcgccgtatgaggggcttatactgatctaaatcttacaagggcttatattgttgtaa

SEQ ID NO: 2238 - DNA, 826 bp, Vitis vinifera
cacaaccatgaaaccctaatatgggctctcttttaacctagcgagtcgcaactacatccaaaccctagaaaccctaatccttacccctcttcccctgacgcgaagatgcagatcttcgtgaaaaccctaacgggtaagaccataacccttgaggtggagtcctctgacaccatcgacaatgtgaaggccaagatccaggacaaggaaggcattcctccggaccagcaacgcctcatattcgccgggaagcagctcgaggacggccggaccctagctgactacaacatccagaaggagtctaccctccacctggtgctccgcctcagaggtggcgccaagaagaggaagaagaagacctacacaaagcccaagaagatcaagcacaagaagaagaaggtgaagctcgccgtgttgcagttctacaaggttgatgactccggcaaggtccagaggctgaggaaagagtgccccaacgctgagtgtggcgccggcactttcatggccaaccactttgaccgtcactattgcggtaagtgtggtttgacttatgtttaccagaaggccggtggtgagtgagagagatgacgccgtctctgatttcatctttgttctagggtgttgagatcaataatgaggtttaggacttggtttggtggatttatcatgttttgttatgctttatgatactttaaagtcacagttttggagttcaaaatgctgttttagttgttagattctggattatcgttgttgaatttgatatggcctgataacttcgatgggtttttaaaattgatcacaatgctattattttgattctatgtta

SEQ ID NO: 2239 - DNA, 1000 bp, Mesembryanthemum crystallinum
  misc_feature (1)..(1): n is a, c, g, or t
  misc_feature (14)..(17): n is a, c, g, or t
  misc_feature (26)..(26): n is a, c, g, or t
  misc_feature (34)..(35): n is a, c, g, or t
  misc_feature (756)..(756): n is a, c, g, or t
  misc_feature (760)..(761): n is a, c, g, or t
  misc_feature (763)..(764): n is a, c, g, or t
  misc_feature (768)..(769): n is a, c, g, or t
  misc_feature (772)..(786): n is a, c, g, or t
  misc_feature (788)..(792): n is a, c, g, or t
  misc_feature (794)..(798): n is a, c, g, or t
  misc_feature (800)..(808): n is a, c, g, or t
  misc_feature (811)..(813): n is a, c, g, or t
  misc_feature (815)..(816): n is a, c, g, or t
  misc_feature (818)..(818): n is a, c, g, or t
  misc_feature (820)..(820): n is a, c, g, or t
  misc_feature (824)..(824): n is a, c, g, or t
  misc_feature (826)..(828): n is a, c, g, or t
ngattacgcactannnngagtcgttncagaggtnngagagagaaagagagcaattctccattgttggcgaagatgcagatctttgtgaaaaccctaacgggtaagaccatcactttggaggtcgaatcctcagacaccatcgacaatgtcaaggccaagattcaagacaaggaaggcatcccaccagaccagcagcgtctcatcttcgccggaaagcagctcgaagacggtcgcacactcgctgactacaacatccagaaggaatccactcttcacttggtgcttcgtttgaggggaggtgctaagaagaggaagaagaagacctacaccaagcctaagaagatcaagcacaagaagaagaaggtcaagctcgctgttcttcagttttacaaggttgatgattctggcaaggttcagcgtcttcgcaaggagtgccccaatgctgagtgtggtgccggaactttcatggcgaatcattttgaccgccattactgtggtaagtgtggtctcacctatgtctaccagaaggccggcggcgattaaggataaaggaggagtttgcctttctctttctctctcctagggtttctggtttggtttttgtttttatataacattattattattatgtcagtttcaagcatttcgatcgagctttgttggtagttgtagtgttttgaggacggtcaatttacattgagaaatgttggatcaacaattttgaaccttattattactataggctcttttcatgtnaaannannaaannaannnnnnnnnnnnnnnannnnnannnnngnnnnnnnnnggnnncnnantncccncnnntaatgtgtcccggttttaccacattcgtacaggtgaaaatacttgggttactcaaatttaagtgcctttgggtggaatattccctttatttcctgcctggttgtaatcacgtaggggtcttctccaacattatcttactcatatattatttcacaccccatactgggtacac

SEQ ID NO: 2240 - DNA, 593 bp, Ipomoea batatas
ttggtgtgagccgagacgagacgcgacgcgaaaatgcagatcttcgtgaagaccctgacggggaagacgataaccctagaggtggagtcatcggacaccattgacaatgtgaaggcgaagatccaggacaaggagggcatcccgccagaccagcagcgcctcatcttcgccggaaagcagctcgaggacgggcgcacccttgcagactacaacatccaaaaggagtctaccctccacctcgtccttcgcctccgcggcggggcaaagaagcgcaagaagaagacctacacgaagcccaaaaagattaagcacaaacacaagaaggtgaagctcgccgtcctgcaggtctacaaggttgatgattctggaaaagtacagaggctccgtaaagagtgccccaacgcggagtgcggtgctggcacattcatggccaaccattttgacaggcactactgtggcaaatgtgggcttacctatgtctatcagaaggccggcggtgactgatacttttctttcgccaaacttctactttcatttcattatgaatcctttgtataatttgagaccttgatggatatctatggttttggata

SEQ ID NO: 2241 - DNA, 677 bp, Actinidia deliciosa
cgccgtttctgcaacagcagcagcgaaaatgcagatcttcgtgaaaaccctaacgggtaagaccataaccctcgaggtcgagtcctcggacaccatcgacaacgtcaaggccaagatccaggacaaggagggaatcccaccggaccagcagcggctcatcttcgccggaaagcagctcgaggacggccggactttggccgactacaacatccagaaggagtcgactctgcacctggtgctccgcctccgcggcggcgccaagaagcgcaagaagaagacctacaccaagcccaagaagatcaagcacaagaagaagaaggtcaagcttgcggtgctccagttctacaaggtggatgactccgggaaggtgcagaggctgaggaaggagtgccccaacgcggagtgcggtgccgggacattcatggcgaaccattttgaccggcactactgcggcaagtgtggactgacctatgtttatcagaaggccggtggtgattaatcgttttaatctgtttttcgtctatggttatttgcattttagtatttgagattatggattgtctttaatttgagatatctgtggttgaattttgattggtttggttgctagacatgggatgaattttgcttaaatgaacccaatttcaatccatcatgattatgttaaaaaaaaaaaa

SEQ ID NO: 2242 - DNA, 899 bp, Actinidia deliciosa
cgacgagcgaagatgcagatcttcgtgaaaaccctaacggggaagactattaccctagaggtcgaatcctccgacaccatcgacaatgtcaaggcaaagattcaagacaaggaaggcattcctccagaccagcagcggctgatcttcgccggaaaacagctggaggacggacgcaccctcgccgactacaacatccagaaggagtcgacgctccacttggtgctccgcctccgtggaggcgccaagaagcgcaagaagaagacctacaccaagcccaagaagatcaagcacaagaagaagaaggtcaagctcgccgtcttgcagttctacaaggtcgatgattcaggaaaggtccagaggctgaggaaggagtgccctaacgccgagtgcggtgcaggtacgttcatggcgaatcacttcgatcgtcactactgtggtaaatgtggcctcacctacgtttaccagaaggccggcggagactgaatgatttggtgatagtatcgtgatcgcagtacttctaagtttattatttgtgttgttttgagttaattgcatggattatcgatgattatgcgcgattttgaaactttatgagattttcggttctatgaactaattttgatgtgctttcaaattttctgttctaattttttgttttttgtggttatgctctataagaatttattgtatcaagtggagtagaattaagtttagtatagtcaatttttaggtgctattttgacttaatgggaatggattgtcgaagattatgatcgattttcaatcttttgaaaattttggttctatgaacaaaattttatttgttttcagaatggaggattaatcggattgctgtcaaattagttttaagttaaaaaaaaaactctactgctgggaaa

SEQ ID NO: 2243 - DNA, 696 bp, Actinidia deliciosa
  misc_feature (232)..(232): n is a, c, g, or t
  misc_feature (247)..(247): n is a, c, g, or t
  misc_feature (262)..(262): n is a, c, g, or t
  misc_feature (265)..(265): n is a, c, g, or t
  misc_feature (271)..(271): n is a, c, g, or t
  misc_feature (274)..(274): n is a, c, g, or t
  misc_feature (280)..(280): n is a, c, g, or t
  misc_feature (313)..(313): n is a, c, g, or t
  misc_feature (439)..(439): n is a, c, g, or t
  misc_feature (448)..(448): n is a, c, g, or t
  misc_feature (496)..(496): n is a, c, g, or t
  misc_feature (499)..(499): n is a, c, g, or t
  misc_feature (529)..(529): n is a, c, g, or t
  misc_feature (541)..(541): n is a, c, g, or t
  misc_feature (545)..(545): n is a, c, g, or t
  misc_feature (549)..(549): n is a, c, g, or t
  misc_feature (557)..(557): n is a, c, g, or t
  misc_feature (569)..(569): n is a, c, g, or t
  misc_feature (582)..(582): n is a, c, g, or t
  misc_feature (590)..(590): n is a, c, g, or t
  misc_feature (596)..(596): n is a, c, g, or t
  misc_feature (600)..(600): n is a, c, g, or t
  misc_feature (620)..(620): n is a, c, g, or t
  misc_feature (623)..(623): n is a, c, g, or t
  misc_feature (639)..(640): n is a, c, g, or t
  misc_feature (646)..(646): n is a, c, g, or t
  misc_feature (651)..(651): n is a, c, g, or t
  misc_feature (659)..(659): n is a, c, g, or t
cccagccgcaccctctacaacagagattctctctcctgaaatcgcgaagatgcagatcttcgtgaaaaccctaaccgggaagacgataaccctagaggtggagtcctcagacaccatcgacaatgtcaaggccaagattcaggacaaagagggaatacctccggaccaacaacgcctgatcttcgccggaaaacaacttgaagacggccgaacactggccgactacaacatncagaaggaatcgacnctccacctggtgctncgncttcgnggnggcgcnaagaagcgcaagaagaagacgtacacaaagccnaagaagatcaagcacaagaagaagaaggtgaagctcgccgtcttgcaattctacaaggtcgacgactccggcaaggtccagaggctcaggaaggagtgtcccaatgccgagtgcggtgctggaacnttcatggcnaatcactttgatcgccactactgtggtaagtgtggtctcacttacgtntancagaaggcgggtggcgactgagtcttaaantttatttgcttngcanatcnatataggngtttaaactttnaataatcagacanattctagntcttgntttntggaaacttggtttatgatnatnctgtgctacttggttnnttgttnctggncatgaatnttggagatgaaagaccattttgcataaaaaaaaaaaa

SEQ ID NO: 2244 - DNA, 727 bp, Cucumis melo
cctaaagagggagtggccactataaaagggagcactcatctcacccaacccttgttattcccaattggccgtgcggcaaagaagcctctcaaccatgcagatcttcgtgaaaaccctaacgggtaagaccatcactctcgaagttgagagctccgataccatcgacaatgtcaaggcaaagatccaggacaaggaaggaatccccccggaccagcagcgtttgattttcgccggaaagcagctcgaggacggccgaactctagccgactacaacattcagaaggaatcgaccctccaccttgtgcttcgtctcagaggaggcgccaagaagcgtaagaagaagacctacaccaagcccaagaagatcaagcacaagcacaagaaggtgaagctcgccgtcctccagttctacaaggtcgatgactctggaaaggtgcagaggcttaggaaggagtgccctaacgccgagtgcggcgctggaacttttatggctaatcactttgaccgccactactgcggtaaatgtggtttgacctacgtttacaacaaagctggtggtgattaggtttaatctgttgtttcttttttccatcatgtttacgttttatctaaatgtttgatgtcgttgaatttatctagaatttcttctccagtttgtggagtttagttcttgacatggattttgttttcttaatgtcgatttattatcgtttttaattaaaaaaaa

SEQ ID NO: 2245 - DNA, 704 bp, Nicotiana benthamiana
ggggatcttctctttgtgcagcggctctcctcaccttgcaattcttggtgcacatagttggcaaggatgcagatattcgtgaagaccctgacagggaagactattaccttagaggtagagtcatccgacaccattgacaatgttaaggctaagattcaggacaaggaaggcattccaccagaccagcagcggttgattttcgcaggtaagcagcttgaggatggccgaacactagccgactacaacatccagaaggagtccaccctccaccttgtccttcgcctccgtggtggtgccaagaagcgtaagaagaagacttacactaagccaaagaagattaagcacaagaagaagaaggttaagctcgccgtcctccagttttacaaggttgatgattctggtaaggttcagaggctccgcaaggagtgtcccaacgccgagtgtggtgccgggactttcatggctaaccactttgacaggcactattgtggtaaatgtgggcttacctatgtttaccagaaggctggtggtgattagatgagtgttactttgcttattacttttccccacatttcttgccttaaactctcctaatgtcttgtttgtgacaagatgtaatgaatttgaattatggtattgtgttagcagcttatgaaattaaggatttttgtcagttaaaatatgttttcagttttgtttttgca

SEQ ID NO: 2246 - DNA, 675 bp, Quercus alba
agcaaccatgcagatcttcgtgaaaaccctaacggggaagaccataaccctagaggttgagtcctcagacaccatcgacaatgtcaaggccaagatccaagacaaggagggaatcccaccggaccaacagcgtttgattttcgcagggaaacagctcgaagatggccgaaccttagccgactacaacatccagaaggagtccactcttcaccttgtgcttcgtctccgcggtggcgctaagaagagaaagaagaagacctacaccaagcccaagaagatcaagcacaagcacaagaaggtcaagctcgctatcctccagttctacaaggtcgacgactctgggaaagttcagaggctcaggaaagagtgcccaaatgctgagtgtggtgctggaaccttcatggctaaccatttcgataggcattactgtggcaagtgtgggcttacctatgtgtaccagaaggctggtggtgattagagattcgatgaaatgaaacgaaagttgagtttttttgggtacccttttggctattttgttggattttagtgaattttgatagttttatttcggtttaagtttatgggtatttcgatgacattatgcaattgaaataatttgtttaagactttttgtttatttattagattttgaatgaaatgacgagttttttgggt

SEQ ID NO: 2247 - DNA, 1234 bp, Capsicum annuum
agtaatagtatgattataaattaaacataaaatagatacaattcagcgtacagagcatcctgcattagtaggtccggagacagactgcatcctaaagagtgtgatgagactacatgtcctaatacaagcattaatttttactttactgcctcgaaccgatatcatatgggtctcgacgataattttattcccttaaaacacagtgtatatagtgcaattcatataaaaaaaagagctactattttttttttttttttaatacacctccctttgcttctatggtttcattttatgacaattggtaagactcctgcagggtttttcaagatgtggtggttttttggtggctatacatttgccaattatatttttattgcatattggttctttatgtaatggatcatagggtatccttctttgagggacatttccatcttctcctgacaatctcctggaatttgctgaggataaacagaatattaagacaaaaaaggctatgaaaaataaagagaatgctttgtgattcatggcttcaaaaacttatgatggaaaaataattctctacaagagccgcggccgtagcagacagacgaagatgcagatcttcgtgaaaaccctaaccgggaaaacaatcaccctcgaagttgaatcctccgacaccatcgacaatgtgaaggccaagatccaagacaaggaaggaattcccccagaccaacaacgtctaattttcgccggaaagcaactcgaagatggccgtacactcgccgactacaacatccagaaggagtcaacactgcatctggtgctccgtctccgtggtggtgctaagaagaggaagaagaagacgtacactaagccgaagaagattaagcacaagcacaagaaggttaagcttgctgtgttgcagttctacaaggtggatgattctggaaaagtgcagaggcttcgtaaggagtgtcctaatgctgagtgtggtgctggaacttttatggcgaatcattttgatcgtcattactgtggtaagtgtgggctcacctacgtttacaacaaggctggaggcgattgataattatgtttagttcttgtttatgctgtcgttgattttatcgtttgagagatttttgctatatggattttggtttttgatgtatgtgacaacccttgggattgttgagttatttcagaactaattttttgcttattattttcactatccatcttagttttatgttcc

SEQ ID NO: 2248 - DNA, 809 bp, Petunia hybrida
cgcggggattcattcacatcaacaacaacagcagcagctcaaccctaacagacgcaaccgaagatgcagatcttcgtgaaaaccctaacgggtaaaacaatcaccctcgaagtcgaatcctccgacactatcgacaatgtcaaagccaagattcaagacaaggaaggaatccccccagatcaacaacgccttatcttcgccggaaaacagctggaggacggcagaaccctagcagactacaacattcaaaaggaatcaactctgcacctggtgctccgtctccgtggtggtgcaaaaaagaggaagaagaagacttacactaagccaaagaagattaagcataagcataagaaggttaagctagctgtgttgcagttttacaaagtggatgattctggaaaagttcagaggctgagaaaggagtgtcctaatgctgagtgtggtgctggtacttttatggcgaatcattttgatcgtcattattgtggtaagtgtggccttacctatgtttacaacaaggctggtggtgattgattttaattcgtttaggtatgcgtttttggtgtcgttgatttgtcgaacgatgatttagagtttttttttgctatatggatttgagttttttgatgtaatgtggaaacctttggattgttgagttattcaacagtttttatttaatcgttcgcagttttgatgttcatgataattgtgtgtgttggaaatgtatgctgtttaagatttcacagctttagttatagcctttatattcagttataaataaagttgcagtctttagcattggctaaaaa

SEQ ID NO: 2249 - DNA, 689 bp, Populus trichocarpa
acccagccaaaacccgctgttccgctctgctctgcatctctccaagtgaaaaccctaagaaagaagcgaagatgcagatcttcgtgaaaaccttgacgggcaagacaataaccctcgaggtagaatcctcagatacaatcgacaatgtcaaagccaagattcaagacaaggaaggtatcccaccagaccaacagcgtctcattttcgctggaaaacagctcgaggacggccgcacactcgctgactacaacatccagaaggagtccactctccacttggtgcttcgcttgaggggtggagccaagaagagaaagaagaagacctacactaagcccaagaagatcaagcacaagaagaagaaggtcaagctcgctgttctccagttctataaggttgatgatagcggcaaagtccagaggttgaggaaggagtgtcctaatgctgagtgcggtgctggaactttcatggctaatcattttgataggcactactgtggtaagtgcggccttacctacgtttaccagaaagccggtggcgattaagcttttttttctcttttaagtattgaacaaggatttttgtcccttttctcttgttacaacatgattgatggtgaacttacatttatatttcctggtattaatcagtacttcggagtttaattaatggttaatcagctgttcgtgtta

SEQ ID NO: 2250 - DNA, 712 bp, Populus trichocarpa
ggagaaactcgtacactgccaataaacaaaaccctaatataaaacctacccgctgctcctctgcaccagctacgtcgcaaaaaagagaggaaagcaagaaaccagaagacatgcagatcttcgtgaagaccttgacggggaagaccataaccctcgaggtcgaatcttcagatacaatcgacaatgtcaaagccaaaatccaagacaaggaaggcatcccaccagaccagcaacgtcttattttcgccggaaaacaactagaagatggacgtacacttgcagactacaacattcagaaggaatccacactccacttggtgcttcgcttgaggggtggagccaagaagagaaagaagaagacttacaccaagcccaagaagatcaagcacaagaagaagaaggtcaagcttgctgttcttcagttctataaagttgacgacagtggcaaagtccagaggctgagaaaagagtgcccaaatgccgaatgtggggctggtacttttatggctaatcattttgataggcattattgtggtaagtgcggcctcacctatgtttatcagaaggctggtggtgactaactgaatcacctttagacaggaccctgttgtttttcaaagaattattgttaggtttttgagttttgaccgcttatggattgttggttggattctttatggttattaacaataagctttttgttggttaatta

SEQ ID NO: 2251 - DNA, 750 bp, Populus trichocarpa
tcaaacccaaaaaaccctagtatcggtaccatcctcctcaaatacccctccctcatacacgccaccggccgaaacaatctcttcccattctgctttgcatctacaagcgaagatgcagatcttcgtgaaaaccttgacgggtaagacaataaccctcgaggttgagtcctcagacacgatcgacaatgtcaaagccaagattcaagacaaggagggcatcccaccagaccaacagcgtctcattttcgctggaaaacagctcgaggatggccgcacgctcgctgactacaacatccagaaggagtccactctccacttggttcttcggttgaggggtggtgccaagaagagaaagaagaagacctacaccaagcccaagaagatcaagcacaagaagaagaaggtcaagcttgctgtccttcagttctacaaggttgatgatagcggcaaagtccagagattgaggaaggagtgccctaatgctgagtgcggtgctggaactttcatggctaatcattttgataggcactactgtggtaagtgtgggcttacctatgtttaccagaaggctggtggtgattaagcttactcgaatggttctttagcttcttttttcgttttaaagtatcgaagaaggattttggccaatttctctatttagaacatgtttgatgttggacataatagttatgttttcttggtattggtaacttggagtttaattaatggttaactatctgtttgtgtttt

SEQ ID NO: 2252 - DNA, 761 bp, Populus trichocarpa
agccgaaccctaacccagtcttaaatcttccgcgtctgctctgcatctctgaaagtaaagaagcgaagatgcagatcttcgtgaaaaccttgacgggcaagacaataaccctcgaggttgagtcctcagacactattgacaatgtcaaagccaagattcaagacaaggaaggtatcccaccggaccaacagcgtctcattttcgctggaaaacagctcgaggacggccgtacacttgctgactacaacatccagaaggagtccactctccacttggtgcttcgcttgaggggtggagccaagaagagaaagaagaagacctacacgaagcccaagaagatcaagcacaagaagaagaaggtcaagctcgctgtactccagttctataaggttgatgatagcggcaaggtccagaggttgaggaaggagtgtcctaatgctgagtgtggtgctggtactttcatggctaatcattttgataggcactactgtggtaagtgtggccttacctatgtttaccagaaggctggtggtgattaagcttttttttaatccttaaaagaaagtattgaacaaggatttttgccaatttattattttcttgcttagaacatggttgatggtgcccttatagttatattttgttggtattaactgttaatttggagtttaattattggttaattagttcttagtgtttttttttttatctgtgcttgatgtgggttttgctataatattcatggggatgaacccttcttg

SEQ ID NO: 2253 - DNA, 815 bp, Prunus persica
tgagagagagctgagagttgaaaccctagccgaatctccctctctctgtctgcggagaaaagatgcagatcttcgtcaaaaccctaacggggaagactataaccctagaggttgagtcttccgacaccatcgacaatgtgaaagccaagatccaagacaaggagggcatccccccagaccagcaacgtctcatcttcgcagggaagcagctcgaggacggccgaaccctagctgactacaacatccagaaggaatcgactctgcacctggtgcttcgtctccgtggtggagccaagaagcgtaagaagaagacctacaccaagcccaagaagatcaagcacaagaagaagaaggtcaagctcgccgtcctccagttctataaggtcgacgattctggaaaggtccagaggctcaggaaggagtgccccaatgctgagtgcggcgccgggactttcatggccaaccatttcgacaggcactactgtggtaagtgcggcctcacctatgtctatcagaaggctggcggcgactgagttaaacgcaccgttttgggttcgtttttaatatcactatgttagggtgctgaacagttggttaattttaaataattctgctttaggatttggaaccgtgttcttatggtttatgctttatgtattttgatatggtacttagaattttaatttcaattttggagttaaatggttagctattattatttataattttgttatatttattttcctgtgattttatatgctatttgatgtatggatgaactcgatcgttcttatctagttggtggaatgggtttc

SEQ ID NO: 2254 - DNA, 719 bp, Prunus persica
gtcccattcatatcccccgcgcctccctctccttctctgcgattctgaggccgcaaacatgcagatcttcgtgaaaaccctaacgggtaagaccattaccctagaggtcgagtcctctgataccatcgacaatgtgaaggccaagatccaagacaaggagggcattcccccagaccagcagcgcctcatcttcgccggcaagcagctcgaggacggccgaaccctagccgattacaacatccagaaggaatcgaccctccaccttgtgcttcgcctccgtggtggcgccaagaagcgtaagaagaagacctacaccaagccaaagaagatcaagcacaagaagaagaaggtcaagctcgcggtgcttcagttctacaaggttgatgattctgggaaggtccagaggctgaggaaagagtgccctaatgctgagtgcggagccgggactttcatggcgaaccacttcgacaggcactactgcggcaagtgtgggttgacctatgtttaccagaaggctggcggtgattagagatttagaactttaaatttcaaatatatcattttggatttaaattttgctgctttttttttaatgatggtattttcggtttcaatttcatgcttgaaaaacctctgaaattttaggtattgtcgttgtttcaattgcatatgccagatggaatgattatcctaattttgttatgattcgtgttctgctg

SEQ ID NO: 2255 - DNA, 744 bp, Solanum phureja
cttccttcaactctcagtgtagcggcactttttcaccttcaaatttctggtgcaccaagtggtgaaaaatgcagatctttgtaaagaccctgacgggcaagactattaccttagaggtagagtcatcggacaccattgacaatgttaaggctaagattcaagacaaggaaggcattccaccagaccagcagcgattgattttcgccggtaagcagctcgaggatggacgaacactagctgactacaacatccagaaggagtctaccctccaccttgtccttcgtctccgtggtggtgccaagaagcgtaagaagaagacttacactaagcctaagaagatcaagcacaagaagaagaaggttaagctcgctgtcctccagttttacaaggttgatgattctggcaaggttcagaggctccgtaaggagtgccccaacgctgagtgtggcgctggaaccttcatggctaaccattttgataggcactattgtggtaaatgtgggcttacctatgtttaccagaaggctggtggtgattagagaattgttagtttggttattgctttatcttagattttgctcacatttgtgtccctatactctccttttaatgtcttgtttgtgacaagatgtaatgaatttagattatgggattatgtttgcagcttataagaagctatggatcttgtcagctaaagtattttgcaccttttgtttttgtgcttctattcactcggatttcttc

SEQ ID NO: 2256 - DNA, 751 bp, Solanum phureja
atcttcttcttccttcaattctctgtgcagcggaactcttcagcttcaaattctgggtgcaccaagtggtgaaaaatgcagatctttgtgaagaccctaacgggcaagactattaccttagaggtagagtcatcggacaccattgacaatgttaaggctaagattcaggacaaggaaggcattccaccagaccagcagaggttgattttcgcaggaaagcagctcgaggatggccgaacgctagctgactacaacatccagaaggagtccaccctccaccttgtccttcgtctccgtggtggtgccaagaagcgtaagaagaagacttacactaagcctaagaagatcaagcacaagaagaagaaggttaagctcgctgtcctccagttttacaaggttgatgattctggcaaggttcagagacttcgtaaggagtgcccaaacgctgagtgtggcgctggaaccttcatggctaaccattttgataggcactattgtggtaaatgtgggcttacctatgtttaccagaaggctggtggtgattagagaaatgttagtttggttattgctttatcttttagattttgcccacatttgtgtccctatactctccttttaatgtcttgtttgtgaacaagatgtaatgaaatttggattatgagattatgtttgcagctcataagaagctatggattttgtcagctaaaatattttgcacttattgtttttgtgcttctattcactcggattt

SEQ ID NO: 2257 - DNA, 786 bp, Fragaria vesca
  misc_feature (78)..(78): n is a, c, g, or t
  misc_feature (82)..(82): n is a, c, g, or t
  misc_feature (85)..(85): n is a, c, g, or t
  misc_feature (90)..(91): n is a, c, g, or t
  misc_feature (93)..(94): n is a, c, g, or t
  misc_feature (96)..(97): n is a, c, g, or t
  misc_feature (99)..(100): n is a, c, g, or t
aattcggcacgaggcctcgtgccgaattcggcacgaggcgcctcatctccttcagagctgagtgagccgccgcaaccntgcnganttcgnnannanncnnctcatctccttcagagctgagtgagccgcaaccatgcagatcttcgtgaaaaccctaacggggaagaccatcaccctcgaggtggagtcctccgacaccatcgacaacgtcaaggccaagatccaggacaaggagggcatcccgccggaccagcagcgcctcatcttcgccggcaagcagctcgaggacggccgcaccctcgccgactacaacatccagaaggagtcgactctccacctcgtgctccgcctccgcggtggcgctaagaagaggaagaagaagacctacaccaagcctaagaagatcaagcacaagcataagaaggtcaagctcgctgtgctccagttttacaaggtggatgactctggaaaggtccagaagctcaggaaggagtgccctaatgcggagtgcggcgccgggactttcatggccaaccactttgacaggcactactgcggcaagtgtgggctgacctatgtttaccagaaggccggcggcgattaggttgttagtgctttattatgttatcgtattcgatttaagtttggtactccgtactctgttatgttttgttttaatttcgtgcttttataagctctggatatttaggtattttgtttttggatgatatattttgatgctgggattatgacaattttatctatttaaagttctgttttgtctaa

SEQ ID NO: 2258 - DNA, 863 bp, Fragaria vesca
atgttcgccagtcgccagggtttcaataaaacgcttgtgttgaacgaagagaaattctatacaaggactatatggtcatttcagcgcggatcctaacctgtacttaaagcccctctcatacagaatttgagagttgaaagaaaaccctaaggcggcgtcaagatgcagatcttcgtgaaaaccctaacggggaagacgatcacgttggaggtggagtcctccgacaccatcgataatgtgaaggccaagatccaagacaaggagggcatcccgccggaccagcagcgcctcatcttcgccggaaaacagctcgaggacggccggactctcgccgactacaacatccagaaggagtcgactctccacctggtgctccgcctccgcggtggcgccaagaagcgcaagaagaagacgtacaccaagcccaagaagatcaagcacaagcacaagaaggtcaagctcgccgtgctccagttctacaaggttgatgactccgggaaggtccagaagctcaggaaggagtgccctaacgccgagtgcggcgccgggactttcatggctaaccattttgacaggcactattgcggtaagtgtggtctcacctatgtttaccagaaggctggtggcgattgagagtctaaacgatgtcgctttggtcgtttttactagtatcagtgttatcagtgttgttatggatttgaacagatggtttaatttcaaggtttagaacttttaatcctcttttgctgaggtttatattgaggattttgaatctggagtttaattgttagtttttgttaaatttaaattacctcagaattctatgtgcctgcatataatgttggatgggtgttagattgtcg

SEQ ID NO: 2259 - DNA, 724 bp, Fragaria vesca
gaaaaccctaaggcggcgtcaagatgcagatcttcgtgaaaaccctaacggggaagacgatcacgttggaggtggagtcctccgacaccatcgataatgtgaaggccaagatccaagacaaggagggcatcccgccggaccagcagcgcctcatcttcgccggaaaacagctcgaggacggccggactctcgccgactacaacatccagaaggagtcgactctccacctggtgctccgcctccgcggtggcgccaagaagcgcaagaagaagacgtacaccaagcccaagaagatcaagcacaagcacaagaaggtcaagctcgccgtgctccagttctacaaggttgatgactccgggaaggtccagaagctcaggaaggagtgccctaacgccgagtgcggcgccgggactttcatggctaaccattttgacaggcactattgcggtaagtgtggtctcacctatgtttaccagaaggctggtggcgattgagagtctaaacgatgtcgctttggtcgtttttactagtatcagtgttatcagtgttgttatggatttgaacagatggtttaatttcaaggtttagaacttttaatcctcttttgctgaggtttatattgaggattttgaatctggagtttaattgttagtttttgttaaatttaaattacctcagaattctatgtgcctgcatataatgttggatgggtgttagattgtcg

SEQ ID NO: 2260 - DNA, 845 bp, Camellia sinensis
ggagctctgaaaccctaaccctagttcgtgcctccatcgatctgtaaagatgcagatcttcgtgaaaaccctaactggcaagaccataaccctagaggtggaatcatcggacaccatcgacaatgtgaaggcaaagatccaggataaggaaggcatacctccggaccagcaacgtctcatcttcgccggaaagcagctcgaagacggcagaaccctagccgactacaacatccagaaggagtccaccctccatctggtcctccgcctccgcggcggcgctaagaagcgcaagaagaagacctacaccaagcccaagaagatcaagcacaagaagaagaaggtcaagctcgccgtcttgcagttctacaaggtcgatgactccggcaaggtccagaggctgaggaaggagtgccctaacgccgagtgcggtgctggaacgttcatggccaatcacttcgaccgtcactactgtggcaagtgtggtctcacctacgtttaccagaaggctggtggtgattgaaagctggtgatgatgatatcgcgatcgcggtagtttttaagattctcatcgtcaatttaggttttattttgactttaatggaatggattttatatggtttgatcgattttgcgtcttgtctaaatgtttgaattctgctttgcttcaaggttaggttatgagcttaatcacaatcttataattttatctgtttttggaacaaattatttctcggttcatttttgcagttatatacatgttctctgcctctatctgtgtgatttattatatatatgcatgtgcatatgcaggggtatagagatatatacggcagctgtgtgagcaa

SEQ ID NO: 2261 - DNA, 690 bp, Nicotiana tabacum
  misc_feature (53)..(53): n is a, c, g, or t
ctctttgtgcagcggcactcctcaccttgcaattcttggtgcacatagttggnaaagatgcagatattcgtgaagaccctgacggggaagactattaccttagaggtagagtcatcggacaccattgacaatgttaaggctaagattcaggacaaggaaggcattccaccggaccagcagcggttgattttcgcaggtaagcagcttgaggatggccgaacactagctgactacaacatccagaaggagtccaccctccatcttgtccttcgcctccgtggtggtgcaaagaagcgtaagaagaagacttacactaagccaaagaaaatcaagcacaagaagaagaaggttaagctcgccgtcctccagttttacaaggttgatgattccggtaaggttcagaggctccgcaaggagtgtcccaatgctgagtgtggtgccggtactttcatggctaaccactttgacaggcactattgtggtaaatgtgggcttacctatgtttaccagaaggctggtggtgactagatgagtgttactttgcttattactttagcactagttttttccccacatttcttgccctatactttcctattgtcttgtttgtgacaagatgtaatgaatttgagtggtattgtgtttgcagcttatgaaattaaggatttttgtcagctaaaatatgttttc

SEQ ID NO: 2262 - DNA, 710 bp, Solanum lycopersicum
cttccttcagctttcagtgtagcggcactttttcaccttcaaatttctggtgcaccaagtggtgaaaaatgcagatctttgtgaagaccctgacgggcaagaccattaccttggaggtagagtcatcagacaccattgacaatgttaaggctaagattcaagacaaggaaggcattccaccagaccagcagcgattgattttcgccggtaagcagctcgaggatggccgaacgctagctgactacaacatccagaaggagtccaccctccaccttgtcctccgtctccgtggtggtgccaagaagcgtaagaagaagacttacaccaagcctaagaagatcaagcacaagaagaagaaggttaagctcgctgtcctccagttttacaaggtcgatgattctggcaaggttcagaggctccgcaaggagtgccccaacgctgagtgtggcgctggaaccttcatggctaaccattttgacaggcactattgtggtaaatgtgggcttacctatgtttaccagaaggctggtggtgattagacaagtgttagtttggctattactttatcttagattttgcccacatttgtgtccctatactctcctttcaatgttttgtttgtgacaagatgggattattttgcagcttataaaaagctatggattttgtcagctaaaatattttccacctcttgtttttgtgcttctatt

SEQ ID NO: 2263 - DNA, 671 bp, Solanum lycopersicum
cttcagctttcagtgtagcggcactttttcaccttcaaatttctggtgcaccaagtggtgaaaaatgcagatctttgtgaagaccctgacgggcaagaccattaccttggaggtagagtcatcagacaccattgacaatgttaaggctaagattcaagacaaggaaggcattccaccagaccagcagcgattgattttcgccggtaagcagctcgaggatggccgaacgctagctgactacaacatccagaaggagtccaccctccaccttgtcctccgtctccgtggtggtgccaagaagcgtaagaagaagacttacaccaagcctaagaagatcaagcacaagaagaagaaggttaagctcgctgtcctccagttttacaaggtcgatgattctggcaaggttcagaggctccgcaaggagtgccccaacgctgagtgtggcgctggaaccttcatggctaaccattttgacaggcactattgtggtaaatgtgggcttacctatgtttaccagaaggctggtggtgattagacaagtgttagtttggctattactttatcttagattttgcccacatttgtgtccctatactctcctttcaatgttttgtttgtgacaagatgggattattttgcagcttataaaaagctatggattttgtcagcta

SEQ ID NO: 2264 - DNA, 854 bp, Solanum lycopersicum
atcttcttcttccttcaattctctgtgcagcggaactcttcagcttcaaattctgggcgcaccaagtggtgaaaaatgcagatctttgtgaagaccctaacgggcaagactattaccttagaggtagagtcatcggataccattgacaatgttaaggctaagattcaggacaaggaaggcattccaccagaccagcagaggttgattttcgcgggaaagcagcttgaggatggccgaacgctagctgactacaacatccagaaggaatccaccctccaccttgtccttcgtctccgtggtggtgccaagaagcgtaagaagaagacttacactaagcctaagaagatcaagcacaagaagaagaaggttaagctcgctgtgctccagttttacaaggttgatgattctggcaaggttcagaggctccgtaaggagtgccccaacgctgagtgtggcgctggaaccttcatggctaaccattttgataggcactattgtggtaaatgtggccttacctatgtttaccagaaagctggtggtgattagatttgcctattactttgtggttgtgttgctttttcgccaacaatctagttttttccccacattcgtcctataggtcttctttgtgacagagatgtaatgaatttgaattatgggttcatatttgcagccttatcaaattatggattttgtccgttaaaagtattttttttccttttgtttgaattattttagtttaatatttatgaatactggagttattaggtaagagattggtttcgagacgaaccttggttcattcgaatttttttgcgaatatatatgttacacataaatacatactaattgtt

SEQ ID NO: 2265 - DNA, 865 bp, Solanum lycopersicum
gaaaccctagttctacattttatcctcttcttccttcaattctctgtgcagcggaactcttcagcttcaaattctgggcgcaccaagtggtgaaaaatgcagatctttgtgaagaccctaacgggcaagactattaccttagaggtagagtcatcggataccattgacaatgttaaggctaagattcaggacaaggaaggcattccaccagaccagcagaggttgattttcgcgggaaagcagcttgaggatggccgaacgctagctgactacaacatccagaaggaatccaccctccaccttgtccttcgtctccgtggtggtgccaagaagcgtaagaagaagacttacactaagcctaagaagatcaagcacaagaagaagaaggttaagctcgctgtgctccagttttacaaggttgatgattctggcaaggttcagaggctccgtaaggagtgccccaacgctgagtgtggcgctggaaccttcatggctaaccattttgataggcactattgtggtaaatgtggccttacctatgtttaccagaaagctggtggtgattagatttgcctattactttgtggttgtgttgctttttcgccaacaatctagttttttccccacattcgtcctataggtcttctttgtgacagagatgtaatgaatttgaattatgggttcatatttgcagccttatcaaattatggattttgtccgttaaaagtattttttttccttttgtttgaattattttagtttaatatttatgaatactggagttattaggtaagagattggtttcgagacgaaccttggttcattcgaatttttttgcgaatatatatgttacacataaatacat

SEQ ID NO: 2266 - DNA, 1573 bp, Eucalyptus grandis
catcccctcgccccgtgcgccgcgccgtcgccggaaaggagccatgcagatcttcgtgaagaccctgacggggaagacgataaccctcgaggtcgagtcgagcgacaccatcgacaatgtgaaggccaagatccaggacaaggagggcatcccccccgaccagcagcgcctcatcttcgccgggaagcagctcgaggacggccgcaccctggccgactacaacatccagaaggagtccaccctccacctcgtcctccgcctccgcggcggcgccaagaagcgcaagaagaagacctacaccaagcccaagaagatcaagcataagaagaagaaggtcaagctcgccgtcctccagttctacaaggtcgacgactccggcaaggtccagcgcctccgcaaggagtgccccaacgccgagtgcggcgccggcaccttcatggccaaccacttcgaccgccactactgcggcaagtgcggcctcacctacgtctaccagaaggccggcggtgattgaagggcctatgctgctcgttgccctttttcttttagcgtctattcgttccatgtttacagctttcgaggatttacatattcccttctggattttgattggtggtcgctaagtcgagacgttttcttttcgatgaatacatttgctcgttataatcggttcttgtttatgttttctcgagtggtattgcctctgtccgtagtcatttagtgctgctgtgtggatgaagttgttcgattttctttcggcagtcgaagttggtcgatttgttgttgtgaatgagcgatgaactggttcgatgtggctgaacttaatccgatgcttaaggttgcgcttgacattcatcatgaagcaacctgtggcatctcgtctgaagaccaatcaacggccgaccaatgtgtgcagggtggtgtggaatcttcgtaggctgtaatgcatcggctagattagttgcaatgtgcgaaaatgcttgtgaatgtgaacggattgctgacatgaactcgcctgaatgggaggcagatgtgtgggggcttgttggaggtcgatcctgagattaccacacttagagtcgcggatggagagaaaaaccaaactgtctgttgatgctgtagacttcagcttgaggccattattgcatttgccgatcgaatttgattgtttgattgcttaagatgcttagtatgactttgcacgatttagctccttcagatcactactatcattgcattgttgttccgtcatcattttgtggcgagttctattagatatataggtatttttgttctttcaattctgcttctgtttgatatactgtggtttcttggtttgtttgaagcgaaaggatgataatgaaagccctgtggcggtgggaagacttctttctatcatcccctctccccttccggtgttatatacattagtctagttgacatgaagctagagcgaaagatttgttactccattagcttcgcccatcaggccttatgctatcataagacagtaactaaaaatgatgatacagatttccacttcttttatcgtccagaacccctattcctttcc

SEQ ID NO: 2267 - DNA, 1102 bp, Triticum aestivum
gtcaaggcgaagatccaggaccaggaggcatccccccggaccagcagcgcttcattttcgccggcaagcagctgaggacggtcgcacccttgctgactacaacatccagaaggagtccaccctccacctggtgctccgcctcaggggtggtatgcagatcttcgtcaagaccctcaccggcaagaccatcaccttggaggttgagtcatccgacaccattgacaacgtgaaggcgaagatccaggacaaggagggcatccccccggaccagcagcgcctcatctttgccggcaagcagcttgaggacggccgcaccctcgctgactacaacatccagaaggagtccaccctccacctggtgctccgtctcaggggtggtatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttcatggccaaccacttcgaccgccactactgcggcaagtgcggcctcacctacgtctacaaccagaaggcttagaggtggcttgcgtttgctctgctcttttacctacctacctatcgagagtcgaactcatttagatgtgtcccgtttgtcgtttaaactgaatccttgagtatcatgtttcctgaatatttcatcgcctactgctgttatgcgatgcgtgcttaaattttggtgtccgtatgctatcagtctaaatgcttttaatccattccatgtcggctatcttattctatgctttgttgaccttaataaggtggtgcgatcacg

SEQ ID NO: 2268 - DNA, 1106 bp, Triticum aestivum
agaatctccgccagatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgccggcaccttcatggccaaccacttcgaccgccactactgcggcaagtgcggcctcacctacgtctacaaccagaaggcttagaggtggctcgcgtttgctctgctctttttacctacctatcgagaatcgaactcatttagatgtgtcccgtttgtcttttaaactgaaaccttgagtatcatgtttcctgaatatttcatcgcatactgctgtagtgcgatgcgtgcttaaattttggtgtccgtatgctatcagtccaaatgcttttaatctatcccatgtcggctttcttattctatgctttgctgatcttaataaggtggtgggatcacgaaaaatgtatcctgttgatacatgtgttctttggcttataacctttatggcaggtgtttgtagattagtcaatagctatgcagggcttacatgtggatgacgactattt

SEQ ID NO: 2269 - DNA, 671 bp, Hordeum vulgare
cgccgccaccgtcgccgccgcagcgcgcggaggcgacctcgcgccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggaggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgactgcggcgccggcaccttcatggccaaccacttcgaccgccactactgcggcaagtgcggcctcacctacgtctacaaccagaaggcttagaggtggcttgcgtttgctctgctcttttacctatcgcgaatagaactcatttatgtgtccagtttgtctttgaaaactgaaaccttggagtaatatgttgtgtttcctggatatttgatcgcctattgctgagatgtgatgcgagcttt

SEQ ID NO: 2270 - DNA, 800 bp, Pteridium aquilinum
ggcaggaggagatacttgtgatcgagcgacgaaggaaattgtctggagctcggcctttctccaacctgtgaagatgcagatcttcgtaaaaaccttgactggtaagaccattacccttgaggtcgagtcttctgatactattgacaatgtgaagaccaagattcaggacaaggagggaattcctcctgatcagcagcgcctgatttttgctggtaagcagctggaagatggtcggacacttgctgattataacattcagaaggaatccaccctccaccttgtgcttaggctgagaggaggtgctaagaagagaaagaagaagacctacaccaagcccaagaagctcaagcataagaagaagaaggtcaagctcgctgtgctccagttctacaaggttgatgactctggcaaggtgcagcgcttgcgcaaagagtgcccgaatgccgagtgtggagctggaactttcatggcgaaccatcatgatcgccattactgtggcaagtgtggcttgacctatgtttaccagaaggcctgattatgtgcatgagctgggagctttagttttttatttagcattgtcaacagcagctagtttaggttttttcattcgcggtattggtgtgcaagtgtcgtcgaggttttttgcgtaaagctagcagaccttgggttgttagctgatcaacatttatggattaatgtagttttgtcttagtttttgatgttactgtcgtgtttcttgtctttttgcttcttcatacatcaccttcatgaacaatgtacagacttgagaagtctcctta

SEQ ID NO: 2271 - DNA, 744 bp, Pteridium aquilinum
gaggagaggccagagcctgtgcgaaccctaaacgctaaaaggcttggcgaagtccatatttatcattgagagagagaggcagagagtgacgaaggaaagtgtctggagctctctggagctcccatcgcagcaatgcagatcttcgtgaagacattgactggaaagaccatcaccctcgaggtagagtcctctgatacgatcgacaatgtgaagaccaaaattcaagataaggagggtatcccccctgatcagcagcgcctaatttttgccgggaagcagcttgaggatggtcgcaccctggcagattacaacattcagaaggaatccactcttcacttggtgctgaggctgaggggaggggcaaaaaagaggaagaagaagacctacactaagcccaagaagctcaagcacaaaaagaagaaagtgaagcttgctgtacttcagttttataaggttgatgactctggaaaggtacagcgccttcgcaaagagtgccccaatgctgaatgtggagcaggaacgttcatggcaaatcaccacgaccgtcactactgcggcaagtgtgggttgacctacgtctatcagaaggcttgataagatatctggtgttcacttttttttgaagtttaggatcctagacattgtgaacatgtctacatgtttggacatgcaatgtaatgagtttagaagcaatgcaattttcagtctttctttgctgacagctaaaaggtagttggcattgtg

SEQ ID NO: 2272 - DNA, 705 bp, Pteridium aquilinum
gaagcaggaggagatacttgtgatcgagcgacgaaggaaattgtctggagctcggcctttctccaacctgtgaagatgcagatcttcgtaaaaaccttgactggtaagaccattacccttgaggtcgagtcttctgatactattgacaatgtgaagaccaagattcaggacaaggagggaattcctcctgatcagcagcgcctgatttttgctggtaagcagctggaagatggtcggacacttgctgattataacattcagaaggaatccaccctccaccttgtgcttaggctgagaggaggtgctaagaagagaaagaagaagacctacaccaagcccaagaagctcaagcataagaagaagaaggtcaagctcgctgtgctccagttctacaaggttgatgactctggcaaggtgcagcgcttgcgcaaagagtgcccgaatgccgagtgtggagctggaactttcatggcgaaccatcatgatcgccattactgtggcaagtgtggcttgacctatgtttaccagaaggcctgattatgtgcatgagctgggagcttagtttttatttagcattgtcaacagcagctagttaggttttttcattcgcggtattggtgtgcaagtgtcgtcgaggttttttgcgtaaagctagcagaccttgggttgttagctgatcaacatttatggattaatgtagttttg

SEQ ID NO: 2273 - DNA, 764 bp, Triticum aestivum
caggacaaggagggcatccctccggaccagcagcgcctcatcttcgctggcaagcagcttgaggatggtcgcaccctcgctgactacaacatccagaaggagtccaccctccacctggtgctccgcctgcgtggtggcatgcagatcttcgtgaaaaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgtggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgccggcaccttcatggccaaccacttcgaccgccactactgcggcaagtgcggcctcacctacgtctacaaccagaaggcttagaggtggctcgcgtttgctctgctctttttacctacctatcgagagtcgaactcatttagatgtgtcctgtttgtcgtttaaactgaaaccttgagtattatgtttcctgaatatttcatcgcctactgctgtaacgcgatgcgtgcttaaattttggt

SEQ ID NO: 2274 - DNA, 954 bp, Triticum aestivum
atctttgtgaagcaccctcaccggcaagaccatcacccttgaggtcgagtcatcggacaccatcgacaacgtcaaggcgaagatccaggacaaggagggcatccccccggcaccagcagcgcctcatctttgctggcaagcagctcgaggatggccgtacccttgctgactacaacatccagaaggagtccaccctccacctggtgctccgccttcgcggtggtatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtcccgtttgtcgtttaaactgaaaccttgagtcttatgtttcctgaatatttcatcgcctactgctgtaacgcgatgcgtgcttaaattttggtgtccgtatgctatcagtctaaatgcttttaatctattccatgtccgtattctatgctttgtggatcttaatagggtggtgtgatcacggaaagatgtatcctgt

SEQ ID NO: 2275 - DNA, 804 bp, Cryptomeria japonica
  misc_feature (632)..(632): n is a, c, g, or t
  misc_feature (792)..(792): n is a, c, g, or t
gagcggccgcagaaggtgtctggagcagggcgacgtgttcaagatgcagatattcgtgaaaacattgactggtaaaacaataaccctagaggtagaatcctctgatacaatcgacaatgtgaaggcgaagatccaggataaggagggtattcctcctgatcaacagaggctaatctttgctgggaagcagctggaggatggcagaacccttgcggattacaatatccagaaggagtccacccttcatctggtccttcgactcaggggaggtgcgaagaagagaaagaagaaaacctatactaaacccaagaagattaagcacaagaagaagaaggtcaagttggctgttttgcagttctacaaggtggatgactctggtaaggtgcagaggcttagaaaggaatgccctaatcaggaatgcggagctgggactttcatggccaatcactttgacaggcattactgcggcaaatgcggtttgacttatgtctatcagaaagccgaggcttaagttgatttggccctaaattgggttttgggttaaatggggtttagttaagaattggatcaatctagggcgggaaggagttgcttcactttttaacataatttgctggcgtttgaaattgtcngagttggataagaattttgtagcagggattcagtttttatttatgcaattggcattcaccaatctttataactagatttatgaaaatctattagtttatgcgttaaaatcaatagattgatctgttttatggcatatgcgcctgattgggattgtcatanactaaaagagtt

SEQ ID NO: 2276 - DNA, 710 bp, Adiantum capillus-veneris
gaaggaggtgttagggcacgagcgacgaaggaacgtgtctggagctcggcctttctccgttctgcagagatgcagatcttcgtgaagacattaactggcaagaccatcactctcgaggttgagtcctccgatactatcgacaatgtgaagactaaaatccaggacaaggagggaatccctcctgatcagcagcgtctcatttttgccgggaagcagcttgaagatggacgaacactggctgattacaatatccagaaagagtccaccctccaccttgtgctcaggttgagaggtggtgccaagaagagaaagaagaagacttacaccaagcccaaaaagctcaagcataagaagaagaaggtaaagcttgcagtgctccaattctacaaggtggatgactctgggaaggtgcaacgacttcggaaggagtgtccaaatgctgaatgtggagctggaactttcatggccaatcatcatgatcgccactactgcggcaagtgtggcctgacctacgtctatcagaaggcttgatgtatgtgactttcaaagtcatgttttggatgtagaatgagcagctattgctctgctgaatttaactttttgaaccgtaatgatgtcacttacttttgggtttagtctcagcaattgtaatctgccattatcttcatgctaagtcttgagatttactctctttttaataaaaaaaaaaa

SEQ ID NO: 2277 - DNA, 620 bp, Ipomoea nil
cacaaacgcaaaaatgcagatctttgtgaagactctgacggggaagacgatcaccctcgaggttgaatcgtcggacaccatcgacaatgtgaaggcaaagatccaggacaaggaaggcatcccgccggaccagcagcggctcatcttcgccggcaagcagctcgaggacggccgcaccctcgccgactacaacatccagaaggagtccaccctccacctcgtgctccgcctccgcggtggtgcgaagaagcgcaagaagaagacctacaccaagccgaagaagatcaagcacaagcacaagaaggtcaagctcgccgtcttgcagttctacaaggtggatgagtctggaaaggtgcagaggctgaggaaggagtgccccaacgccgagtgcggcgccggtaccttcatggctaaccacttcgacaggcactactgcggcaagtgcggtctcacctatgtctaccagaagggcggtgattaagcgtctcttcctttttaaaacctttacttttgctagtacaattacagttggagtatcgaattttagttttttttaatggatttcaattgtcatgtgatggatctatgattatttaagttttgagttatgttttagaccc

SEQ ID NO: 2278 - DNA, 678 bp, Lotus japonicus
accttcaacacttctggttcgattgtgctgctgctgcaagatgcagatcttcgtgaaaaccctaacggggaagacgatcaccctcgaggtggagtcttccgacacaatcgacaatgtgaaagccaagatccaggacaaggagggaattcccccggaccagcagaggttgatcttcgccggaaagcaactcgaagacggccgcaccctcgccgactacaacatccagaaggagtccactctccacctcgtcctccgtctccgcggtggcgccaagaagaggaagaagaagacctacactaagcccaagaagatcaagcacaagcacaggaaggtgaagctcgctgttctccagttctacaaggtggatgactccgggaaggttcagaggctgaggaaggagtgccccaatgctgagtgcggcgccgggactttcatggcgaaccactttgatcgtcactactgtggcaagtgtgggctcacctatgtctaccagaagcccactgcttagagctgcatttggtttgaacaatgttagatttctctattttgctattcgaagtttgaatttttgttatattcgacttgtggggttgacattttttgtgttgatttagttttggttgagataacaactttataatatttgccgttagtaatttcataatctgttatgctgca

SEQ ID NO: 2279 - DNA, 728 bp, Zea mays
aaaccctagcctccacccctcacccgccgcagccaatccctccccagcagccgtcgtcgccaccgctgcagcgcggaggcgaccccccatcgccgccaagatgcagatcttcgtgaagaccctgacggggaaaacgatcacgttggaggtggagtcctcggacaccatcgacaacgtgaaggccaagatacaggacaaggagggcatcccgccggaccagcagcggctaatcttcgccggcaagcagctcgaggacggccgcaccctcgccgactacaacatccagaaggagtccaccctccacctggtgctccgcctccgaggtggcgccaagaagcgcaagaagaagacgtacaccaagcccaagaagatcaagcacaagcacaagaaggtaaagctcgcagtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattcacctgttggttactcgatttgaatatcatttagatctgtttgaggttggaacataaatgcagcagtagtttctgtcttattatattggtacctctgttactgagttgatgtggtcc

SEQ ID NO: 2280 - DNA, 779 bp, Zea mays
ccatctccgaatcaatccctcgcctccccggcggttgttgcttcggctccgctcgggactcggccggcggaagcggagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctggccgtgctccagttctacaaggttgacgacgccaccggcaaggtcacccgcctccgcaaggagtgccccaacgccgagtgcggcgcgggggtcttcatggccaaccacttcgaccgccactactgcggtaagtgtggcctcacctacgtctacaaccagcaggcgtaggatgcccctcctttctgtcgggaaggaaaatgggaagtcttgctaggtgataatcctttttgctttgttttgttttgttgcaatggtagtagtttcttggaacagaacacctgtatctcttttggcgacgcttagtttgggtttaattatatcatgttgttatgggtcctgtcaagcactgttgaattcgaatggtttttgaattaatcttgtactatgtttttatgatgcca

SEQ ID NO: 2281 - DNA, 730 bp, Avena sativa
cactcctccacccaacccaaaccctaccccgccgccgccaccagcgtcgccgccgcagcgcgcggaggtgaccccccaccgccgccaagatgcagatcttcgtgaagaccctgacgggcaagaccatcacgctggaggtggagtcctcggacaccatcgacaacgtcaaggccaagatccaggacaaggagggcatccccccggaccagcagcgtctcatcttcgccggtaagcagctcgaggacggccgcaccctcgccgactacaacatccagaaggagtccaccctccacctggtgctccgtcttcgcggaggcgccaagaagcgcaagaagaagacgtacaccaagcccaagaagcaaaagcacaagcacaagaaggtgaagctcgccctcctccagttctacaaggtcgacgacgccaccggcaaggtcaccaggctcaggaaggagtgccccaacgccgagtgcggcgccgggacattcatggccaaccacttcgaccgccactactgcggcaagtgcggcctcacctacgtctacaaccagaaggcttagaggtggctcagcgttcgctatgctttactttaccctacctatcgagaactgaagtgagctgttggttacatctcatttagatatgtctcccgtttgtcgttaaaacagaacctgaagtagtatgtttcctggattattgatcgtctattactcagatgatgtgaagcgagttt

SEQ ID NO: 2282 - DNA, 836 bp, Arachis hypogaea
atccacagccacaacctcataagaacaaggcggaaacccaaaccctaacttaataatcttcttcttcttctgtagaagcaaaatgcagattttcgtgaaaaccctaacggggaagaccatcacccttgaggtggaatcttccgacaccatcgacaacgtgaaggccaagatccaagacaaagaaggaatcccgccggaccagcagcgcctcatcttcgccggaaagcagcttgaggacggccgcacactcgccgattacaacatccagaaagaatcgacgctccatctcgtcctccgcctccgcggcggcgccaagaagaggaagaagaagacgtacaccaagccgaagaagatcaagcacaagcataagaaggtgaagctcgcgattctccagttctacaagatcgacgataccggtaaggttcagaggctcaggaaggagtgccctaacgctgagtgtggcgctggaaccttcatggctaaccactttgatcgccattactgtggcaagtgtggcttgacctacgtgtaccagaaggccgctgcttagggtttgaatctcgatttctgagtttaaatttcagttataaatgttatagttttgatttttatttttagtgatgaatgattgcttgtttttttggggctataataacccttgattttcggtttgaacgcggttaagtatctgtcgttttaatctatatgattccgttaagtatatttcattacttgcatgatatagttcagtttaggctagcatcttttccatgttcaatgttctgtgttttgtttggtgtccattagtgcctgatatattaagccaccttgtcatt

SEQ ID NO: 2283 - DNA, 692 bp, Arachis hypogaea
agagcgtagagtcctccttctcccaccggcagccgcaaagatgcagatcttcgtgaaaaccctaacggggaagaccatcaccctggaggtggagtcttccgacaccatcgacaacgtgaaggccaagattcaggacaaggaaggcatccctccggaccagcagcgtctcatcttcgccggcaagcagctggaggacggccgcaccctcgccgactacaacatccagaaggagtccaccctccacctcgtcctccgcctccgcggtggcgccaagaagagaaagaagaagacctacaccaagcctaagaagatcaagcacaagcataagaaggtgaagctcgccatccttcagttctataagatcgatgacagtggtaaggttcagaggcttagaaaggagtgccctaacgccgagtgcggtgctggaactttcatggctaaccactttgatcgccattattgcggcaagtgtggcctcacctatgtttaccagaaggctgctgcctaatttcctttattttaattttgatttctcatgtcgtaatttcggatattaagactgctatgttaaaggtttaattcatgtttcgatgttgaaaaatatcgtttattttattgctttttactgctacttgttactgctctgcatccaaataagcatgattcactgtgctaccttcaaatttattttg

SEQ ID NO: 2284 - DNA, 830 bp, Arachis hypogaea
ctctcaccatatgaactttccgcttccaagttcattgagttccagcgtagcttcccccttctgccgtccgcaaagatgcagatcttcgtgaaaaccctaacggggaagaccatcaccctcgaggtggagtcttccgacaccatcgacaacgtcaaggccaagatccaggacaaggaaggcatcccaccggaccagcagcgtctcatcttcgccggcaagcagctcgaggatggtcgcaccctcgccgactacaacatccagaaggaatccaccctccaccttgtcctccgcctccgcggtggcgccaagaagaggaagaagaagacctacaccaagcctaagaagatcaagcacaagcataagaaggtgaagctcgccatccttcagttctataagatcgatgacagtggtaaggttcagaggcttaggaaggagtgccctaacgctgagtgcggtgctggaactttcatggccaaccactttgatcgccattactgcggaaagtgtggcctcacctatgtttaccagaaggctgctgcgtaatttcgtttaattttctgtcatttagggttttactctttaaattttaatttctcatctgttaatttcggtgtttcggttttggaacgagactgctatgttagaggtttaaattttgaggatttttatgtgactatatatcttttgcgattgtgttttgttctgccctacgaattaatggtttgttgaggttagcttattagattctcagtattttgtttgcttaatattatttttgggtgctatggaattatcaattatcgaatagaatggaacatgacagattgagc

SEQ ID NO: 2285 - DNA, 742 bp, Pseudoroegneria spicata
ctccgccccccaacccaaaccctaccccgccgccaccgtcgccgccgcagcgcgcggaggcgacctcgcaccgccgccaagatgcagatcttcgtgaagaccctgacgggcaagaccatcacgctggaggtggagtcctcggacaccatcgacaacgtgaaggccaagatccaggacaaggagggcatccccccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacgtacaccaagcccaagaagcaaaagcacaagcacaagaaggtgaagcttgccgtcctccagttctacaaggtcgacgacgccaccggcaaggtcaccaggctcaggaaggagtgccccaacgccgactgcggcgccggcaccttcatggccaaccacttcgaccgccactactgcggcaagtgcggcctcacctacgtctacaaccagaaggcttagaggtggcttgcgtttgctctgctcttctacctacctatcgagaatcgaactcatttagatgtgtcccgtttgtcttttaaactaaaaccttgggagtattatgtttcctgaatatttcatcgcctactgctgtaatgcgatgcgtgcttaaattttggtgtccgtatgctatcagtctaaatgcttttaatca

SEQ ID NO: 2286 - DNA, 895 bp, Oryza sativa
taaaccctagccgtccacaccccaccaccaccgccgtcgcctccaccccgccgccgcgggagaaaccacaggtaagggcaagcgcgccgccgctgcggccgccggcgaagatgcagatcttcgtgaagaccctgacggggaagacgatcacgctggaggtggagtcctcggacaccatcgacaacgtgaaggcgaagatccaggacaaggaggggatcccgcccgaccagcagcggctcatcttcgccggcaagcagctggaggacgggcgcaccctcgccgactacaacatccagaaggagtcgaccctccacctggtgctccgcctccgcggcggcgccaagaagcgcaagaagaagacgtacaccaagcccaagaagcagaagcacaagcacaagaaggtgaagctcgccgtgctccagttctacaaggtggacgacgccaccggcaaggtcacccgcctccgcaaggagtgccccaacgccgagtgcggcgccggcaccttcatggccaaccacttcgaccgccactactgcggtaagtgcggcctcacctacgtctacaaccagcaggcttaggcgtaggctcctgttctttgggggcggaagtaaggaaggaggaggaaatcgaactggttattagatgataattaatccttttttgtcatgtcgtattaaactagtctccttggaactgaacaccttagcatcacctctgtgaagattgtgatgccctacttttggttttgaaatcatgttatgtactactgtcgaattatgtttgggttaatcatctttttatccgttggcgtggtcttggttatcggctatggtatttgattaaattgcttgttgcagggaagcgaagtaattgtgattgggaattttgtttgaaa

SEQ ID NO: 2287 - DNA, 859 bp, Oryza sativa
aaaaccctagccaccttccccccacccctctcgccgccgcagccgcggaggcgacccctcccccgccgccgccaagatgcagatcttcgtgaagaccctgacggggaagaccatcacgctggaggtggagtcctcggacaccatcgacaacgtgaaggccaagatccaggacaaggaagggatccccccggaccagcagcgcctcatcttcgccggcaagcagctcgaggatggccgcaccctcgccgactacaacatccagaaggagtccaccctccacctcgtgctccgcctccgcggcggcgccaagaagcgcaagaagaagacgtacaccaagcccaagaagatcaagcacaagcacaagaaggtgaagctcgccgtgctccagttctacaaggtggacgacgccaccggcaaggtcaccaggctcaggaaggagtgccccaacaacgactgcggcgcgggcaccttcatggccaaccacttcgatcgccactactgcggcaagtgcggcctcacctacgtctacaaccagaaggcctaggttgatgcttgctgctgctcgctttgctctgatctgatgcttttcattcccttttatctgttattatcatgagctgagatgagctgctgctggttacatgttattcagattatatgcgttttgttctccgtttacaattggaaaactttgagtagtagcctcttggaatattattatctgttactgaattgatgatgcgatgtgagttcacttgtgttttctgattcctgttggatgattagtttgcgccagtttcgttgctctgatgtgtttttgagatctcactgattgcaattagataattgtttttctgca

SEQ ID NO: 2288 - DNA, 1029 bp, Sorghum bicolor
ctagtcgccgcccacacacacatcccccaccatccccgccgccgcaggcgagaaacctcaggtaagggcgggcggcagccgccggagccgggcgcgcctgccaagatgcagatcttcgtgaagaccctgacggggaagaccatcacgctggaggtggagtcctcggacaccatcgacaacgtgaaggccaagatccaggacaaggagggcatcccgccggaccagcagcggctcatcttcgcggggaagcagctggaggatgggcgcaccctggccgactacaacatccagaaggagtcgacgctgcacctggtgctccgcctgaggggaggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacgccgagtgcggcgccggggtcttcatggccaaccacttcgaccgccactactgcggtaagtgcggcctcacctacgtctacaaccagcaggcgtagaggagaaagaagggaaatggaaagtcttgctaggtgatgataatcttctttttttcgttttgttttgtcgcgtgttagtagttttgttggaattggaacagaacacctgctgcatctctctcttatggcgaggatgccaacttttgttttgatcatatcatgtcgttatgggtcctgtcaagcactcactgttgaattcgagttatgtttgggttaatcttatactatgttttcatttcatgttgcgattctcggctcctgagttggtaatttgcgaattactgcgagtaatcgattggattggatacatgtcactgtatgatgtagtatgttagccgtgctgatatgtgatcgaaacacattttctacctctatgattagcatgtgtggggctgtgttggataaggtggtgatgactcgtctggttgcagcatggtgtgcttctgctgcttagta

SEQ ID NO: 2289 - DNA, 880 bp, Sorghum bicolor
cctagactccaccccccaccccgccgcacccaaaccctacccagccgccgccgtcgccgccgccgcagcgcggaggcgaccccccaaccgccgccaagatgcagatcttcgtgaagaccctgacggggaagaccatcacgttggaggtggagtcctcggacaccatcgacaacgtgaaggccaagatccaggacaaggagggcatcccgccggaccagcagcgtctcatcttcgccggcaagcagctcgaggacggccgcaccctcgccgactacaacatccagaaggagtccaccctccacctggtcctccgcctccgcggtggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgccggcgtctttatggccaaccacttcgaccgccactactgcggcaagtgcggcctcacctatgtctacaaccagaaggcgtaatcgcttgcgccgatttgctttacccgcctacctatcaagcatccacctgttggttactcgaattgaatctcatttagatctgtctgaggttgaaacttaaatggagcagtagtatctatcatattggtaccccctgttactgagttgatgtgatgctgagttaaattttgttttcatattcttctatcattcttgacgattgcaccttttggccgtttcaccattattcataggtcgattatatttgtattgcattactggattaattgcttagtattgcataattggattaaatgcgttccttagctttcgat

SEQ ID NO: 2290 - DNA, 708 bp, Glycine max
acccccaaaccctgctgcataggaagaaaccctagcctctcaccctccctgcgacacgatgcagatcttcgtgaaaaccctaacgggtaagacgatcacccttgaggtggagtcttctgacaccatcgacaacgtgaaggccaagatccaggacaaggaaggcatccctccggaccagcagcgcctcatcttcgccggaaagcagctggaggacggccgcaccctcgccgactacaacatccagaaggagtccaccctccacctcgtcctccgtctccgcggtggcgccaagaagcgcaagaagaagacctacaccaagcccaagaagatcaaacacaagcacaagaaggtcaagctcggcattctccagttctacaaggtcgacgattctggaaaagtgcagaggctccgcaaggagtgccccaacgccgggtgtggtgccgggactttcatggccaatcacttcgaccgccactattgcggcaagtgtggcttgacctatgtctaccagaaggccgatgcttaaattcgttggaagtgaattctctgtggttctattttaattttagttatttaaaagttttggttaatgtttttgttcaattagtgttatgactgtttgggctttgattaaacctttatgaatactgtttcgctttggattacttattatttttcgctttaaatatattgttagtttggtttata

SEQ ID NO: 2291 - DNA, 665 bp, Glycine max
acccccaaaccctgctgcataggaagaaaccctagcctctcaccctccctgcgacacgatgcagatcttcgtgaaaaccctaacgggtaagacgatcacccttgaggtggagtcttctgacaccatcgacaacgtgaaggccaagatccaggacaaggaaggcatccctccggaccagcagcgcctcatcttcgccggaaagcagctggaggacggccgcaccctcgccgactacaacatccagaaggagtccaccctccacctcgtcctccgtctccgcggtggcgccaagaagcgcaagaagaagacctacaccaagcccaagaagatcaaacacaagcacaagaaggtcaagctcggcattctccagttctacaaggtcgacgattctggaaaagtgcagaggctccgcaaggagtgccccaacgccgggtgtggtgccgggactttcatggccaatcacttcgaccgccactattgcggcaagtgtggcttgacctatgtctaccagaaggccgatgcttaaattcgttggaagtgaattctctgtggttctattttaattttagttatttaaaagttttggttaatgtttttgttcaattagtgttatgactgtttgggctttgattaaacctttatgaatactgtttcgctttggatta

SEQ ID NO: 2292 - DNA, 738 bp, Glycine max
gagtttgagtgaaaccctagctcagcaacgatgcagatattcgtgaaaaccctaacggggaagacgataaccctagaggtagagtcttcggacacgatcgacaatgtgaaggcgaagatccaggacaaggagggcatcccgccggatcagcagcgcctgatcttcgccggaaagcagctggaggacgggcgcacccttgccgactacaacatccagaaggagtccaccctccacctcgtcctccgcctccgcggcggcgccaagaagcgcaagaagaagacctacaccaagcctaagaagatcaagcacaagcacaagaaggtgaagctcgccatcttgcagttctacaaggttgacgactccggcaaggtgcagagactccgcaaggagtgtcccaacgctgagtgtggcgccgggaccttcatggccaaccacttcgaccgccactactgtggcaagtgcggattgacctatgtttaccagaaatctgaagcttaggattgttttccatttgtttctgaattttggaattttattttagtataatactgtttttttttggggtcgcatatttattattatgactgcctaaatgatctgccttttcatattattatgactgcttaaatcttgatgcattattttttgaatttgattttaattttgaaatgaagtgagtgatttatgactgaatttacgaaatttgatggaaatttataggtaaaatcagttttactt

SEQ ID NO: 2293 - DNA, 885 bp, Saccharum officinarum
gcatgaacccaccggactcggattcccgggccgacccacgcgtccgccctaccacgccgcagccaaacactacccagccgccgccgtcgccgccgccgccgccgcagcgcggaggcgaccccccaccgccgccaagatgcagatcttcgtgaagaccctgacggggaagaccatcacgttggaggtggagtcctcggacaccatcgacaacgtgaaggccaagatccaggacaaggagggcatcccgccggaccagcagcggctcatcttcgccggcaagcagctcgaggacggccgcaccctcgccgactacaacatccagaaggagtccaccctccacctggtgctccgcctccgtggtggcgccaagaagcgcaagaagaagacgtacaccaagcccaagaagatcaagcacaagcacaagaaggtgaagctcgccgtgctccagttctacaaggtggacgacgccaccggcaaggtgacccgcctccgcaaggagtgccccaacaccgagtgcggcgcgggcgtcttcatggccaaccacttcgaccgccactactgcggcaagtgcggcctcacctatgtctacaaccagaaggcgtaatcgcttgcgccgatttgctttacccgcctacctatcaagcattcacctgttggcctgttggttactcgaattgaatctcatttagacctgtctgaggttgaaacttaaatcgagcagtagtatctatcatattggtacccctgttactgagttgatgtgatgctgacttaaattttgcgttcccgacagacttttactattgcattatatcattaaataatgtggctgccgttttataagatccaacttcataccgcgtgtagccaagtttaacttttcat

SEQ ID NO: 2294 - DNA, 722 bp, Saccharum officinarum
ccgccgccggagtagggcgcgcctgccaagatgcagatcttcgtgaagaccctgacggggaagaccatcacgctggaggtggagtcctcggacaccatcgacaacgtgaaggccaagatccaggacaaggagggcatcccgccggaccagcagcggctcatcttcgccggcaagcagctggaggatgggcgcaccctggccgactacaacatccagaaggagtcgacgctgcacctggtgctccgcctgaggggaggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacgccgagtgcggcgccggggtcttcatggccaaccacttcgaccgccactactgcggtaagtgcggcctcacctacgtctacaaccagcaggcgtagttccttctgtggaggggaggagaaagaagggaaatggaaagtcttgctaggtggtgataatcttcttttttgttttgttttgtcgcgtgttagtagtttcttggaacagaacacctgcatctctctcttatggcgatgccaacttttgttttgatgatatcatgtcgttatgggtcctgtcaagcactcactgttgaattcgagttatgtttgggttaatctta

SEQ ID NO: 2295 - DNA, 794 bp, Panicum virgatum
accactccaccccgccgccgcaggcgagaagcagctccagctcaggtaagggcggccgccgccggggagggcgcgcctgcgaagatgcagatcttcgtgaagacgctgacggggaagaccatcacgctggaggtggaatcctcggacaccatcgacaacgtgaaggccaagatccaggacaaggagggcatcccgccggaccagcagcggctcatcttcgccggcaagcagctggaggacgggcgcaccctcgccgactacaacatccagaaggagtcgacgctgcacctggtgctccgcctccgcgggggagccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgcggggaccttcatggccaaccacttcgaccgccactactgcggtaagtgcggcctcacctacgtctacaaccagcaggcgtaggatggatgctccgctgttgtggtgggggaaaggaaaaaaaatggaaagtcttgctagatgataaatcttatttctttttttttgtcgcatgttaagttaaagtagtttgttggaacagaacacctgcatctctcatggtgatgtcgttatggatcgcaccaaacactgttgaattcaacctatgtttgtgttaatcttatactatgtgtgcccagtgttaacgtgattttgttcttagagtc

SEQ ID NO: 2296 - DNA, 820 bp, Triticum aestivum
ccccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtcccgtttgtcgtttaaactgaaaccttgagtcttatgtttcctgaatatttcatcgcctactgctgtaacgcgatgcgtgcttaaattttggtgtccgtatgctatcagtctaaatgcttttaatctattccatgtccgtattctatgctttgttgatcttaataaggtggtgtgatcacggagagatgtatcctgttgatatcatgtgttct

SEQ ID NO: 2297 - DNA, 1095 bp, Triticum aestivum
gccccctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgccggcaccttcatggccaaccacttcgaccgccactactgcggcaagtgcggcctcacctacgtctacaaccagaaggcttagaggtggctcgcgtttgctctgctctttttacctacctatcgagaatcgaactcatttagatgtgtcccgtttgtcttttaaactgaaaccttgagtatcatgtttcctgaatatttcatcgcatactgctgtagtgcgatgcgtgcttaaattttggtgtccgtatgctatcagtccaaatgcttttaatctatcccatgtcggctttcttattcaaaaacctgcccgggcggccaatcccgcggccatggcggccgggagcatgcgacgttcgggcccaattcgccctatagtgagtcgtattacaattcactggccgtcgttttacaacgtcgtgactgggaaaaccctgggcgttacccaacttattcgcttgcagcacatccccttttcgcagctggcgttaatagcgaaaaggccgaaccgatcgccctcccaaaagtgtgccacctgaaatggctatggccccccctgtaacgggccataaacccgcgggttttgttgttaccccagggtgatgttaaatttgcaggccctaagccggctcttt

SEQ ID NO: 2298 - DNA, 817 bp, Triticum aestivum
cccaaacccaaccccgccgccgccactgccgtcgccgccgcagcgcgcggaggcgaccaccccgccttcgccaagatgcagatcttcgtgaagaccctgacgggcaagaccatcacgctggaggtggagtcctcggacaccatcgacaacgtcaaggccaagatccaggacaaggaggggatcccgccggaccagcagcgtctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgccgattgcggcgccgggaccttcatggccaaccactttgaccgccactactgcggcaagtgcggcctcacctatgtctacaaccagaaggcttagaggtggcttgcgtttgctctgctcttttacctatcgaggatagaactcatttatatgtgtccctgtttgtatttgaaaactgaaaccttggagtattatgtttcctagatatttgattgcctaatgctgagatgctatgcgagcttaaattttggtcattttgaatgacgttaatctatctcatggcagctatcgtattttatgctttgttgatctgatggtgatgtgatcatggagcatgtatcttttgatacatgtgttcttgagcttaaaa

SEQ ID NO: 2299 - DNA, 894 bp, Triticum aestivum
ccccaacccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttcatggccaaccacttcgaccgccactactgcggcaagtgcggcctcacctacgtctacaaccagaaggcttagaggtggcttgcgtttgctctgctcttttacctacctacctatcgagagtcgaactcatttagatgtgtcccgtttgtcgtttaaactgaatccttgagtatcatgtttcctgaatatttcatcgcctactgctgttatgcgatgcgtgcttaaattttggtgtccgtatgctatcagtctaaatgcttttaatccattccatgtcggctatcttattctatgctttgttgatcttaataaggtggtgcgatcacgagacatgttgatgcatgggttcttcagcttataacccattattgcaggtgtttctagattagccaatagctatgcaggtcttaccatgtggatgaat

SEQ ID NO: 2300 - DNA, 738 bp, Humulus lupulus
aaccctctcggcgccactctgtttctgctatcatgcagatcttcgtgaaaaccctaacgggtaaaccataaccctagaggttgagtcttctgacaccatcgacaatgtcaaggccaagatccaggacaaggagggcatcccaccggaccagcagcgtctcatcttcgccggaaagcagctcgaggacggccgaaccctgcggattacaacatccagaaggagtcgactctccactcggtgctccgtctcaggggaggagccaaaaagaggaagaagaagacctacactaagccaaagaagatcaagcacaagaagaagaaggtgaagctctcgctcctccagttctacaaggtcgatgactcaggcaaggtccagaggctgaggaaggagtgccccaatgctgagtgtggcgccggcactttcatggcgaatcacttcgaccgacactactgcgggaagtgtggtttgacttatgtttatcagaaggccggcggcgattaggtttctttttcgctttattttatttttgtaatttaattaagaaacaatgaaatagatcgaatttggttatttgtttgtagtaggtactgtttaatttaatagcgaatttccgtactttgtttgtatgattacataatttggtttatgcgattatgctaaatagcttgggtttatttgaacaaaaaaaaaacaaaaaactacgcggccggctagagactcgaccgaacggacacacga

SEQ ID NO: 2301 - DNA, 1692 bp, Arabidopsis lyrata
acctcttaataattttcaagaactaaccaactgataatttttttacttagtaaatcatggtattgatcgtttactggtatgacttcatctgctttgccacagtagcggctgcaatcgtcgcgtccctgtggtttctattgcgcagagaaagaggctgcttaggaattgatgatacgggccacgttagcttgctaccactttatagatcgaagagccttgggtcggctcagttatggaccagttgctggacaaggttacatcccggctggctactcttcactcgttccacctcttttctctccatggctgcattattggcttgggatatcttgaagtgggacgcaagcatcttcgtctattacacagaatggaccttcatgcttgtgatcatctactttgcgatgggtattgcagcttcagtatatggttgcttgatacattctaaggagctagcattggaaactggtgaagatgtggttgtagaaaaggtcggagatgagttccggcaaagattagaggtttatggttgtttcatgcagacaatttttcagacaagtgcaggagctgtagtgctgacggacattgtgttttggttagttatagttcctttcctctcgaatactcgcttcgggttaaacaagttgatgatttgcatgcacacggcaaacgcaggcttcctcctgctcgaaacggtcctcaatagccttccgttcccttggtttcgaatgggatatttcgtgctatggagttgtctctatattatcttgcacaaccaacctattctaatcaaatcaaacctatctcaggtggccatatccgttcctcgagctcgataagccatgggctccgatatggtacttaagcatggcaattgttcacatcccttgctatggagcttatgccgcagttgtaaaagccaagaactcatgcttcccatatctattcccaaatgcttttgtaaatccagatttgattatgtgatatatcaatcaatcatgcaatgacattcaaataagagaagcgaattaaagagcataacaatatccataagaaaaacctagatatgaaattcagaaccaaacaagttcaacatcataagatccacaacatccaaaaacaacttccaaaatcaaaaagcagtattcaaattcaaaatgatagagatcgagatgaaattcattcctgagctccttctttctggtaaacgtaggtgagaccacacttaccacagtagtgacgatcgaaatggctagccatgaaagtcccagcaccacaggtagcgttagggcactccttcctcagacgctgaaccttacctgaaccatcaaccttgtagaactggagaacagcgagcttgaccttcttgtgcttgtgcttgatcttcttaggcttggtgtaggtcttcttcttcctcttcttagcaccaccacggagacgaaggacaaggtgaagcgttgattccttctggatgttgtaatcggctaaggtacgtccgtcttcgagctgctttccggcgaaaatcaatcgctgctgatccggtgggataccttccttgtcttggatcttggccttgacattgtcgatggtgtcagaggactcgacctcgagagtgatcgtcttccccgttagggttttcacgaagatctgcatctttttttgcttttcgctaaccaacggcggaagaaaatttct

SEQ ID NO: 2302 - DNA, 1653 bp, Arabidopsis thaliana
accactttatttttttagaactaatcaaatgataaaaaaatttgtagttagtaaatcatggcattgatcgtttattggtatgacttcatctgctttgcgatagttgcggctgcaatcgtcacgtccttgtggtttctatcccgcagagacagaggctgcgtagtaattgatgatacgtcccacgatagcttgttaccactttatagatcgaacaaccgtggttcggctcggttatgggccagttgctggacaagattacatcccggctggctactctttactcgttccacctcttttctctccatggctgctttattggcttgggatgtcatcaagtgggacgcaagcatcttcgtctattacacagaatggaccttcatgcttgtgatcatctactttgcgatgggtattgtagcttcagtatatggttgtttgatacatttaaaggagctaacacttgaaactgatgaagatgtggtagtagaaaaggtcggagatgagttccggcgaagattagaggtttgtggttgtttcatgcagacaatttttcagacaagtgcaggggctgtagtgctgacggacattgtgttttggttagttatagttcctttcctatcgactactcgctttgggttaaacacgttgacgatctgcatgcacacggcaaatgcaggcttcctcctgcttgaaacactcctcaatagccttccattcccttggtttcgaatgggatatttcgtgctatggagttgtctctatgttatattccaatggatcatccacgcatgtggcttcacttggtggccatatccgttcctcgagctagacaagccatgggctccgatatggtacctatgcatggcaattgttcatatcccttgctatggagcttatgccgcaatagtaaaagccaagaactcctgtttcccatatctattcccaaatgctcttgtaacttagattagattgtgtgaactataaatcaatcatgcaataagatttgaaagtaattcaaataaagagcataaaaatatccataagaaaaacctagatatgaaattcaaacaagttcaacataagatccacaacatccaaaaacaacttccaaattccaaaaaaaaagcagtattcaattcaaaatgatagagatcgagatgaaaatcattcctgagctccttctttctggtaaacgtaggtgagaccacacttaccacagtagtgacgatcgaaatgactcgccatgaaagtcccagcaccacaggttgcgttagggcactccttcctcaaacgctgaaccttacctgaaccatcaaccttgtagaactgaagaacagcgagcttgaccttcttgtgcttgtgcttgatcttcttaggcttggtgtaggtcttcttcttcctcttcttagcacctccacggagacgaaggacaaggtgaagcgttgattccttctggatgttgtaatcggctaaggtacgtccgtcttcgagctgctttccggcgaaaatcaatcgctgctggtccggtgggattccttccttgtcttggatcttggccttgacattgtcgatggtgtcagaggactcgacctcgagagtgatcgtcttccccgttagggttttcacgaagatctgcatctttttttgcttttacgg

SEQ ID NO: 2303 - DNA, 806 bp, Amsonia hubrichtii
cattcggcctcaagctgcagtgttccaaatatgcagattttcgtgaaaaccctcacggggaagactatcacccttgaggtcgagtcttctgacaccatcgacaatgtcaaggccaaaatccaggacaaggagggtattccaccggaccagcaacgtctcatcttcgcagggaagcagctcgaagacggcagaactctagccgactacaacatccagaaggaatccacacttcaccttgttctccgcctccgtggtggcgcaaagaagcgtaagaagaagacctacaccaagccaaagaagatcaagcacaagaagaagaaggtcaagcttgctgtccttcagttttacaaggtggatgactccggaaaggttcagaggctcaggaaggagtgcccaaatgctgattgtggtgccggcactttcatggccaatcattttgacaggcactactgcggcaagtgcggccttacctatgtttaccagaaggccggcggtgactaaatgccagtcctttttcccgcaattttcccagtagttttattatgttttttaaatattttgattagggtcatggattttatatagcatgagactattggcttttgtcggatggaattttacgctagaaatgtttattttgtggcttaatatgcatcttattctcgagtttttgtgcttttttattttgttaattctctagtgaggttttgattattgctcttagagttgttttgcttatactttgtgtttagtttgatgggcagatagtatattttgttcttctttggatgggaaataaagttgct

SEQ ID NO: 2304 - DNA, 967 bp, Theobroma cacao
aattattatttctgttagtatattcgaactgcttttagtcattaaaaaataaaattgaaaaaagaaaatatttacattaggcttgggctcccatatatctccggcccaaatggtaatctaaagcccgaagccaagataccatgggcaatttaggtactttcaatccctgcccccactcccacaaaaccctaatcccacccttttttctccatatgaaaaccctcattcatctcccattttgaagccctagccgaaaccccctcctctactttctctgcatcttcagccaacgcaaagatgcagatcttcgtcaaaaccctaacggggaagaccataaccctagaggtcgaatcctctgacaccatcgacaatgtcaaagccaagatccaggacaaggaaggaatcccaccggatcagcaacgtctcatcttcgccggcaagcagctcgaagacggccgcaccttagccgactacaatattcagaaggaatccacccttcacctcgtcctccgtctcaggggtggcgccaagaagaggaagaagaagacctacaccaagcccaagaaaatcaagcacaagaagaagaaggtcaagctcgcggtcctccagttttacaaggtggatgaatccgggaaggttcagaggttgaggaaagagtgccctaatgcggagtgtggggccggaacgttcatggctaaccattttgataggcactattgcggtaagtgtgggctcacttacgtttaccagaaggccggtggggattgagtagggttcgacttctgttcggctcgtgataaaaatggatctatagtttttaagtatgagttttaggatttttattttcaataatcgttggactttttatttttgtgttattgtttattatgttacaatactttcgatatgattttggagttttggatcattaatttagctgtttgaaacaaattatgcggttttctac

SEQ ID NO: 2305 - DNA, 696 bp, Chelidonium majus
cccaatcttgacgaagatgcagatcttcgtcaaaaccctaacgggtaaaacaatcacattagaggtcgaatcctctgatacaatcgacaatgtcaaagccaagatccaagacaaggaaggaatcccaccagaccagcaacgtctcatcttcgccggaaaacaacttgaagacggaagaaccctagctgattacaacatccagaaggaatcaactcttcatcttgttcttcgtcttagaggaggagctaagaagaggaagaagaagacttatactaagccaaagaagattaagcataagcataagaaggttaagctagctgtattgcagttttacaaggttgatgattctgggaaagttcagaagctgaggaaagagtgccctaattctgagtgtggagctggaactttcatggctaatcattttgatcgtcattattgtggtaagtgtgggttgacttatgtttaccagaaggcgggcggcgagtgatttgtcgacggagatatggtggtggtggtggtggacggtgaatggtggtcgtgttatccttttagggttttccttaaaggtagtttatttcttgagatttagcttatctttactttgttttggaaatgactcattactgttatggatattgagttaatagtattttgtcgacattgctatgcgaatttgttggctatgaatttagtttt

SEQ ID NO: 2306 - DNA, 741 bp, Chelidonium majus
taaacaccgcctcttccatcgtgagagcacaaacccaaggagcgtatctggtaagagtaacccaaaccctagcttgttctcctctcagcgaagatgcagatcttcgtgaaaaccctaacgggtaagactatcaccctagaggtggagtcatcggacaccatcgacaacgtcaaggccaagatccaggacaaggagggaatcccaccggatcagcaacgtcttatcttcgccgggaagcagcttgaggatggccgaaccctagctgattacaatatccagaaggagtctacccttcatttggttcttcgactcaggggaggagcaaagaagaggaagaagaagacttacaccaagcccaagaagatcaagcacaagcataagaaggtcaagctcgcggttctgcaattctacaaggtggatgactctggaaaggtgcagaagttgaggaaggagtgccctaattccgagtgcggtgcagggactttcatggcgaatcattttgatcgtcattactgtggtaagtgtggtcttacttacgtttaccagaaggctggaggcgagtaagattgatttagttgttcagagaggtcgtctctttctctctctttttagttgagttctgataaaatggattcagtttttatagggttttaaggatttttgtttcagtaattttgatattatgtttgaatcttatctgaaaaaagaggcggaactttgattagaatattatgattttgt

SEQ ID NO: 2307 - DNA, 628 bp, Cucurbita pepo
agctctgcaggcaagcctcccaaccatgcagatcttcgtgaaaaccctaacgggtaagaccatcaccctagaggtcgagagctccgatgccatcgacaatgtcaaggccaagatccaggacaaggagggaattccgccggaccagcagcgtctgatttttgccggaaagcagcttgaggacggccgaaccctcgctgactacaacatccagaaggaatccacgcttcaccttgttctccgtctcaggggaggcgccaagaagcgtaagaagaagacctacaccaagccgaagaagatcaagcacaagcataagaaggtcaagcttgccgttctccagttctacaaggtcgatgactctggaaaggtacagaggctgaggaaggagtgccctaatgccgagtgcggcgctggaactttcatggctaaccactttgaccgccactactgtggtaaatgtggtttgacctacgtttacaacaaagctggtggtgattaggtttatcgttgtttttcatcatgtttttgttttatctaaacgttttatgttgttgaatttatctagaatttctactccagcttgtggagttcagtttttgtacatggattttgatttcttaaagtctattta

SEQ ID NO: 2308 - DNA, 1542 bp, Eucalyptus grandis
catcgcattctctccccttctctgtttctccccgcgtctgcatcgccggcggccaagatgcagatcttcgtgaaaaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactacaacatccagaaggagtccaccctccacctcgtcctccgcctccggggcggcgccaagaagcgtaagaagaagacctacaccaagcccaagaagatcaagcataagaagaagaaggtcaagctcgccgtcctccagttctacaaggtggacgactccggcaaggtccagcggctccggaaggagtgccccaacggcgagtgcggcgccggcaccttcatggccaaccacttcgaccgccactactgcggtaagtgcggcctcacctatgtctaccagaaggccggcggcgattgaggtagatatagagatagagaattcagttatatggagtgtgtagtcgtaagatcggactggatttagcttatggcgcttccatttttttgcggtacttggtgcttttggcgttaatttgtggctccggaatgtggaattttggttgctgatatttagcttcttgaatgacatctcttatgaatcgtttttgctttagctttgactggctccttttggtccctgcgcttctgatcattgtcgcaaatgctttgtggattatcaatgaacatgctttctgatcattgttgggttgagaagatagagaaattgattcattcaatacccaatcttgcgaggtggtagtaatgacctgatgcgtttggttaataggtgaactagtggctttttgtgttttgggtgcggtttgcagtttgtggtttggtccaggccggagagaggaggacaccttttgtatctccatctgggatatcaatgtgcttggataatttttggttgtctttcttggctcttcggcttgtgagattcgctcaattgtgactgttttccttagaactaccagaattgatataatgagtctgtctggagaagaagctctaaattatgagcaggcgggtgtgtttagtcaagaccatgaatggcgttcctttttgctattatgccagaaggttatagttagcagcaatcagtgatagacctcctctgaacatttctccttgatcatgaagcgattgcgaagtatatttggctgaagttgcttccatccgcagctttctagttatcatagctgctgtcgtcatttgacgataggatcttagcccttctttatcgaaagcatctcgcacctacaaatcagctcctttctaatgaacgtctatcagcagctttccatgacttctctccatttttggagaccactgtcattggaattcatcagctgtagagtatcaatgtggttctccggcttagagcctaagcgttgctcccgtggctgcctttttattgtattagaatggg

SEQ ID NO: 2309 - DNA, 527 bp, Eucalyptus grandis
atcgcattctctccccttctctgtttctccccgcgtctgcatcgccggcggccaagatgcagatcttcgtgaaaaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactacaacatccagaaggagtccaccctccacctcgtcctccgcctccggggcggcgccaagaagcgtaagaagaagacctacaccaagcccaagaagatcaagcataagaagaagaaggtcaagctcgccgtcctccagttctacaaggtggacgactccggcaaggtccagcggctccggaaggagtgccccaacggcgagtgcggcgccggcaccttcatggccaaccacttcgaccgccactactgcggtaagtgcggcctcacctatgtctaccagaaggccggcggcgattga

SEQ ID NO: 2310 - DNA, 526 bp, Eucalyptus grandis
cgcattctctccccttctctgtttctccccgcgtctgcatcgccggcggccaagatgcagatcttcgtgaaaaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactacaacatccagaaggagtccaccctccacctcgtcctccgcctccggggtggcgccaagaagcgtaagaagaagacctacaccaagcccaagaagatcaagcacaaaaagaagaaggtcaagctcgccgtcctccagttctacaaggtggacgactccggcaaggtccagcggctccggaaggagtgccccaacggcgagtgcggcgccgggaccttcatggccaaccacttcgaccgccactactgcggtaagtgcggcctcacctatgtctaccagaaggccggcggcgattgag

SEQ ID NO: 2311 - DNA, 978 bp, Eucalyptus grandis
catctcctccatcgcattctctccccttctctgtttctccccgcgtctgcatcgccggcggccaagatgcagatcttcgtgaaaaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactacaacatccagaaggagtccaccctccacctcgtcctccgcctccggggtggcgccaagaagcgtaagaagaagacctacaccaagcccaagaagatcaagcacaaaaagaagaaggtcaagctcgccgtcctccagttctacaaggtggacgactccggcaaggtccagcggctccggaaggagtgccccaacggcgagtgcggcgccgggaccttcatggccaaccacttcgaccgccactactgcggtaagtgcggcctcacctatgtctaccagaaggccggcggcgattgaggtagatatagagatagataattcagttatatggagtatgtagtcgtaagatcggactggatttagctcatggtgcttccattttttttgcggtacttggtgcttttggcgttaatttgtggctccggaatgtggaattttggttgctgatatttagcttcttgaatgacatctcttatgaatcgtttttgctttagctttgactggctccttttggtctctgcgcttctgatcattgtcgcaaatgctttgtggattatcaatgaacatgctttctgatcattgttgggttgagaagatagataaatagattcattcaaaatccaatcttgcgaggtggtagtaatggcctgatgcgtccggttaataggtgaactagtggctttttgtgttttgggtgcggtttgcagtttgtggtttggtccgggccggagagaggag

SEQ ID NO: 2312 - DNA, 664 bp, Euonymus alatus
ctctctgaggctgcaagccggcgaccatgcagatctttgtgaaaaccttaacgggtaagaccattaccctagaggtagagtcgagcgacaccatcgacaatgtgaaatcgaagatccaggataaggagggaatcccaccggaccagcagcgtctgatcttcgccgggaagcagctggaggacggtcgtacactcgctgactacaacatccagaaggagtccactctccacctggtgctccgtctccgcggtggcgccaagaagcgtaagaagaagacctacaccaagcccaagaaaatcaagcacaagcataagaaggtcaagctcgctgtcctccagttctataaggtcgatgactccggtaaggtccagagactcaggaaggagtgccctaacgctgagtgcggtgctggtacctttatggccaaccacttcgacaggcactactgtggcaagtgcggtttgacctacgtctaccagaatgctggtggcgattaggtttttaatatttttattgtgttatgattatgggtattagtactctcctgctgagttccggtacctttgttttgtttttgatagcacgctattaaatttttgtctggataaggattttctgttgaatggattttgtggtttattttggtaatttgagattgttaccg

SEQ ID NO: 2313 - DNA, 741 bp, Euonymus alatus
cctatcccctgtgtgcctttcctatcccctgttgcgtgtctcagcggccggggaaaacacagtcaggcggaaccccaattctctctgagactgcaaacatgcagatctttgtgaaaaccctaacgggtaagaccattaccctagaggttgagtcgagcgacaccattgataatgtcaaatcgaagatccaggataaggaggggatcccaccggaccagcagcgtctgatcttcgccgggaagcagctggaggacggtcgtacactcgctgactacaacatccagaaggagtcaactctccacctggtgctccgtcttcgcggtggtgccaagaagcgtaagaagaagacctacacaaagcccaagaagatcaagcataagcataagaaggtgaagctagctgtccttcaattctataaggttgatgactccggtaaggtccagaggctcaggaaggagtgccctaatgcagagtgcggtgctggtacctttatggccaaccacttcgataggcactactgcggcaagtgcggtttgacctacgtctaccagaatgctggtggcgattaggtttttaatattttatcttgttatgattatggatattatcatattagtactttccttttgagttgtggtacctttgctctgttttttgtagcacagtgttaaatttctgtctggataagattttctgttaattggattttgtggtttattttgaatatttgaatggttactg

SEQ ID NO: 2314 - DNA, 698 bp, Euonymus alatus
aggcggaacccccaattctctctgaaaccgcaaagatgcagatctttgtgaaaaccctaacgggtaagactattaccctagaggttgagtcgagcgacacaattgataatgtcaaatcgaagatccaggataaggaggggatcccaccggaccagcagcgtctgatcttcgccggaaagcagctggaggacggtcgtacactcgctgactacaacatccagaaggagtccactctccacctggtgctccgtcttcgtggtggtgccaagaagcgtaagaagaagacctacacaaagcccaagaagatcaagcataaacataagaaggtgaagctagctgtccttcaattctataaggtcgatgactccggtaaggtccagaggctcaggaaggagtgccctaatgcagagtgcggtgctggtacttttatggccaaccacttcgataggcactactgtggcaagtgcggtttgacctacgtctaccagaatgctggtggcgattaggtttttaatattttatcttgttatgattatggatattatcatatcagtactttcctttttagttgtggtacttttgttctgttttttgtagcacagtgttaaatttctgtctggataagattttctgttaaatggattttgtggtttattttgaatacttgaatggttactgatagttcatgcggtttcgtt

SEQ ID NO: 2315 - DNA, 656 bp, Euonymus alatus
ggaacccccaattctctctgaaactgcaaagatgcagatctttgtgaaaaccctaacgggtaagactattaccctagaggttgagtcgagcgacacaattgataatgtcaaatcgaagatccaggataaggaggggatcccaccggaccagcagcgtctgatcttcgccgggaagcagctggaggacggtcgtacactcgctgactacaacatccagaaggagtcaactctccacctggtgctccgtcttcgcggtggtgccaagaagcgtaagaagaagacctacacaaagcccaagaagatcaagcataagcataagaaggtgaagctagctgtccttcaattctataaggtcgatgactccggtaaggtccagaggctcaggaaggagtgccctaatgcagagtgcggtgctggtacctttatggccaaccacttcgataggcactactgtggcaagtgcggtttgacctacgtctaccagaatgctggtggcgattaggtttttaatattttatcttgttatgattatggatattatcatattagtattttccttttgagttgtggtacctttgttctgttttttgtagcacagtgataaatttctgtccggataagattgtctgttaaatggattttgtggtttatttttg

SEQ ID NO: 2316 - DNA, 673 bp, Euonymus alatus
aggcggaacccccaattctctctgaaaccgcaaagatgcagatctttgtgaaaaccctaacgggtaagactattaccctagaggttgagtcgagcgacacaattgataatgtcaaatcgaagatccaggataaggaggggatcccaccggaccagcagcgtctgatcttcgccgggaagcagctggaggacggtcgtacactcgctgactacaacatccagaaggagtccactctccacctggtgctccgtctccgcggtggcgccaagaagcgtaagaagaagacctacaccaagcccaagaaaatcaagcacaagcataagaaggtcaagctcgctgtcctccagttctataaggtcgatgactccggtaaggtccagagactaaggaaggagtgccctaacgctgagtgcggtgctggtacctttatggccaaccacttcgacaggcactactgtggcaagtgcggtttgacctacgtctaccagaatgctggtggcgattaggtttttaatatttttattgtgttatgattatgggtattagtactctcctgctgagttccggtacctttgttttgtttttgatagcacgctattaaatttttgtctggataaggattttctgttgaatggattttgtggtttattttggtaatttgagattgttaccg

SEQ ID NO: 2317 - DNA, 670 bp, Euonymus alatus
ggcgaaaacctaattctctctgaggctgcaagccggcgaccatgcagatctttgtgaaaaccttaacgggtaagaccattaccctagaggtagagtcgagcgacaccatcgacaatgtgaaatcgaagatccaggataaggagggaatcccaccggaccagcagcgtctgatcttcgccgggaagcagctggaggacggtcgtacactcgctgactacaacatccagaaggagtccactctccacttggtgctccgtctccgcggtggtgccaagaagcgtaagaagaagacctacaccaagcccaagaaaatcaagcacaagcataagaaggtcaagcttgctgtcctccagttctataaggtcgatgactccggtaaggtccagagactcaggaaggagtgccctaacgctgagtgcggtgctggtacctttatggccaaccacttcgacaggcactactgtggcaagtgcggtttgacctacgtctaccagaatgctggtggcgattaggtttttaatattttatcttgttatgattatggatattatcatattagtattttccttttgagttgtggtacctttgttctgttttttgtagcacagtgataaatttctgtccggataagattgtctgttaaatggattttgtggtttatttttgaaac

SEQ ID NO: 2318 - DNA, 534 bp, Euphorbia peplus
aaaattacaaaccctaatccccaatctctggtgcaacgatgcagatcttcgtgaaaaccctaacgggtaaaaccataaccctggaggttgaatcctccgacaccatcgacaacgtcaaggcgaagatccaggacaaggaaggcatcccgccggaccagcagcgcctcatcttcgccggcaaacagctcgaagacggcagaactctcgccgactacaacatccagaaggagtcgacacttcacttggtgctgcgtctacgtggaggagctaagaagaggaagaagaagacttacacgaagcccaagaagattaagcataagaagaagaaggtgaagcttgctgtgttgcagttttataaggtggatgattctgggaaggttcagaggttgaggaaggagtgccctaatgcggaatgcggtgctgggactttcatggccaaccattttgataggcactactgtgggaagtgtgggttgacttatgtttacaataaggctggcggcgattaggttatgttggttttgggtaattttc

SEQ ID NO: 2319 - DNA, 674 bp, Hevea brasiliensis
accgtccttttgccttgccctctgcatcggtttccaaagatgcagatcttcgtcaaaaccctaacgggtaagaccataacactcgagtttgagtcctcggacactatcgacaatgtgaaggccaagatccaagacaaggagggaatcccaccggaccagcagcgcctaatcttcgctggaaaacaactggaagatggacggacccttgccgattacaacattcagaaggagtcgactctccacctggtgctgcgcttgaggggtggagccaagaagaggaagaagaagacctacaccaagcccaagaagatcaagcacaagaagaagaaggtcaagctctccattcttcagttctacaaggttgatgatagtggtaaagtgcagaggctgaggaaggagtgtcccaacgccgaatgtggcgccggtacttttatggccaatcattttgacaggcactactgcggtaagtgtggcctcacttacgtttaccagaaggccggcggtgactgatcttaagtatcgtcctgaggaagcatagagaaatttcgttttgagtattatcttcttttgacctcgttgttgaacttgctatcatgtctgttattttttatggtctatttggctacgttgaatgataatttttgcagtttaatggtcaatttggattttacttt

SEQ ID NO: 2320 - DNA, 737 bp, Hevea brasiliensis
acgcggggacgcttcaaccattcaaccctaagccgaaaaccctcttctcgccttgctttctgcatcggccatcaaagatgcagatcttcgtcaaaaccctaacgggtaagaccataactctcgaggtagagtcctcggacactatcgacaatgtgaaggccaagatccaagacaaggagggcatcccaccggaccagcagcgcctcatcttcgccggaaagcaactggaagacggaaggacccttgccgactacaatattcagaaggagtcgactctccacctagtgttgcgtttgaggggtggagccaagaagaggaagaagaagacctataccaaacccaagaagatcaagcacaagaagaagaaggtcaagctcgccatccttcagttctacaaggttgatgatagcggcaaagtgcagaggctgaggaaggagtgtcctaacgctgagtgtggggctggtactttcatggccaatcactttgataggcactactgtggtaagtgtggcctcacctatgtttaccagaaggccggtggtgattgattgattgatcgccgccgatgtcgcttataggtttttgagatgtctttttatttaaactaccgttggacctgttaaagttttgtttcgattatggtaatttcggatactactgttggattgtgttattcttaatttagattttttttaatcaattgatgttgttgaccctaagtgatatgattttcgatg

SEQ ID NO: 2321 - DNA, 662 bp, Lippia dulcis
ccttacaacttcattttctgcggtctccacacaaaaaccctagcactgcgacgcctttccgccgcgatgcagatcttcgtcaagaccctcacgggtaagaccattaccctggaggttgaatcctccgacacgattgacaatgtcaaggccaagattcaggacaaggaaggcatccccccggaccagcagcgtctcatcttcgccgggaagcagctcgaggacggccgcaccctcgccgactacaacatccagaaggagtcaacacttcaccttgttctccgcctccgcggtggcgccaagaagcgtaagaagaagacctacaccaagccgaagaagatcaagcacaagaagaagaaggtcaagctccctgtgctccagttctacaaggttgatgattccgggaaggtgcagaggttgaggaaggagtgcccgaatgccgagtgtggtgccggaaccttcatggccaaccacttcgacaggcactactgtggtaagtgtgggctcacctacgtctacaataaggccggcggtgattgagatttcctagctttctcttattacagattttatatgttttgtcgtcgtttgtgaacgattattatcatgactgttatctaggcttttgaaatcgtggattttgatttgagtactgtttttattgg

SEQ ID NO: 2322 - DNA, 1476 bp, Plantago ovata
gactccctcctatatccatcacaggaagatccctagctttcacaacattgacatacaagaaatacattgtctcaactaaatcataagtactggctgtcttatctctaccccaataccccattcttgcagccacaggtggcctagtctccaccacaccatactccggcttctggcccggaaactgcatctgcatcaccgaagaagaagctggcccttgtttcgcgaaatcactccgtgtttccacgaaagccggcttctcaggcggtggcggaggcggtcctccgccaccagttccaacagagtaaaaagtcctcacctccttctccttctttttcttcttactcttgtcatgactctccttgtaaaaatactcatcatcaaacttattggtattaacctccttcaatggaggagaatcactatgatgatgctcatgatgactattatgctcattatgaaagttattctcctgactattacttttaacctcagtttcaaaaacctcctcaacactaggctgaaactgaaacccactaacattcccctgaacagcataacacttaagagcaatttcacctttaacatgagaaaagattcctcttttatcaagagggtacctggtaacagaagcttcttgctctgaaaaggggataatcatcccagaaatccgaaccttccaagaaaattctgtgaccattcttgctatcattgtagacatagacctccacagtctgatcagagatgtggtttggattcttgatgttgaaaaccagtttctcattccaacaagggttgagatcttttggcttggttgaagttctctgcctcttcttcgcgccgccaccggagatgcagatcttcgtcaagaccctaacgggcaaaacaatcaccctcgaggtcgagtcatctgacacgatcgacaatgtgaaggccaagatccaggacaaggaaggcatccctccggaccagcagcgcctcatcttcgccggcaaacagctcgaggacggccgcactctcgctgactacaacatccagaaggagtcgactctccacctggtgctccgtctccgtggtggcgcgaagaagaggaagaagaagacctacaccaagccgaagaagatcaagcacaagaagaagaaggttaagctcgcggtgttgcagttttacaaggtggatgattctggaaaggtccagaggttgaggaaggagtgccctaacgctgagtgtggtgcggggactttcatggcgaatcactttgaccgtcactattgtggtaagtgtgggctcacttacgtttacaacaaggctggcggcgattaaatgaaagtgtcgtattagttttctttttttaatgttgaagttttatatgaaggattgttttggatctgaattttgtttaattcggtttgcgaacatgtttattccgaattagcctttttggttttgctaatgccagatttgttattatggtttacg

SEQ ID NO: 2323 - DNA, 815 bp, Sequoia sempervirens
tcaggagagagctttttagccgcagtaatatttgatccattttaggctttttttagggtttctagagagggtttttttgagagaaggcttgtagccgtggctactgaacgattctggagtagggcgacttcaagatgcagatattcgtcaaaactttgactggtaagacaataaccctagaggtagaatcctctgatacaatcgacaatgtgaaggcgaagatccaggacaaggagggtattcctcctgaccagcagaggctaatctttgctggaaagcagctggaggatgggagaaccctggcggattacaatattcaaaaggagtctactcttcatctggtccttcgcctgaggggaggtgcgaagaagagaaagaagaagacctacactaagcccaagaagattaagcacaagaagaagaaagtaaagttggctgttttacagtactacaaggtggatgactctggcaaggtgcagagactcaggaaggaatgccctaatcaggagtgtggagcaggaactttcatggccaatcatttcgacagacattactgtggcaagtgtggtctgacttatgtctatcagaaagctgaggcttaagatgaattcggttaacatagggttaaaaagggttgcttagcattttcacattaaatgctatggttttaaattgtcgtgatggataagaatttttgtagcgatgatttagattttattaatgccttgggtatttatcaatcattatactggatttatgaaaatctatcattttatcttttaaaacaatactcatatgttttatgccatgcctgc

SEQ ID NO: 2324 - DNA, 672 bp, Sequoia sempervirens
agatgcagatattcgtaaaaacattgactggtaagacaataaccctagaggtagaatcctctgatacgatcgacaatgtcaaggcgaagatccaggataaggagggtattcctcctgatcagcagaggctaatctttgctgggaagcagctggaggatgggagaaccctggcggattacaatattcagaaggagtccacccttcatctggtccttcgcctcaggggaggtgcgaagaagagaaagaagaagacctacaccaagcccaagaagattaagcacaagaagaagaaagtcaagttggctgttttacagtattacaaggtggatgactctggcaaggtgcagaggctcaggaaggaatgccctaatcaggagtgtggagccgggacattcatggccaatcactttgacaggcattactgtggcaagtgtggtttgacctatgtttatcaaaaagctgaggcttaagatgattttgccctaaattagttttagagatgaatctggttcatctagggctaaaaagggctgcttagcgttttcgcgttatattctggggtttgaaattgttgagatggacaagaattttgtagcagtgatttagatttatttatgcagtcgttatttaccaatcattaaactggattaatgaaaatcttacattttatct

SEQ ID NO: 2325 - DNA, 668 bp, Silene vulgaris
cctccacccccaaaatcaatccatccccaaaatcctgcaaaaatgcagatcttcgtgaaaaccctaaccggaaaaacaatcaccctcgaggttgaatcctcagacacaatcgacaatgtcaaaaccaaaatccaagacaaagaaggaatcccaccagaccaacaacgtctaatcttcgccggaaaacagctggaagacggccgtaccctcgccgactacaacatccagaaggaatccaccctccaccttgttctccgtcttcgtggtggcgcaaaaaagaggaagaagaagacttacaccaaacccaagaagattaagcacaagcatcgcaaagttaagcttgctgtgttgcagttctacaaggttgatgacagtggaaaggttcagaggttgaggaaggagtgtccgaatgctgagtgtggtgctggaactttcatggcgaatcattttgataggcattattgtgggaaatgtgggcttacttatgtttatcagaaggctggtggtgattgattcatgggttttgtttcggtatcggtttcgggttttaacatgttttgtgtaaggattatttgtgttttgtttttgtaagacttttaagtagttggatatttatgttatcttgtggatttttgcaggttttcatagcgcttccatattgagtttcg

SEQ ID NO: 2326 - DNA, 654 bp, Silene vulgaris
aatctgcaaaaatgcagatcttcgtaaaaaccctaaccggaaaaacaatcaccctcgaggttgaatcctcagacacaatcgacaatgtcaaaaccaaaatccaagacaaagaaggaatcccaccagaccaacagcgtctaatcttcgccggaaaacaactcgaagacggccgcaccctcgccgactacaacatccagaaggaatccaccctccaccttgtcctccgtctccgcggtggcgcaaagaagcgcaagaagaagacttacaccaaacccaagaagatcaagcacaagcatcgcaaggttaagcttgctgtgcttcagttttacaaggttgatgacagtggcaaggttcagaggttgaggaaggagtgcccgaatgctgagtgcggtgctggaactttcatggcgaatcattttgatcgacattattgtggcaagtgtgggcttacttatgtttaccagaaagccggtggcgattaatcgaatgattgattgattgttcgaggatgaggtctatttaatttacatttccgttttagcagactttgtttttattttggatactcagattttgttgttttgttttactgtatgaattcatctgctttggcgaatatgcggttttagttatcgtagatggtgaacgtattgt

SEQ ID NO: 2327 - DNA, 649 bp, Tabernaemontana elegans
atcaacctgctgcgttgcaaaaatgcagatcttcgtgaagaccctcacggggaagaccatcacccttgaggtcgaatcctccgataccatcgacaatgtcaaggcgaaaatccaggataaggaaggcatcccaccggaccagcaacgtctcatcttcgctgggaagcagctcgaggacggcagaacgctagccgactacaacatccagaaggaatccacccttcaccttgttctccgcctccgtggtggcgcaaagaagcgtaagaagaagacctacactaagccgaagaagatcaagcacaagaagaagaaggtcaagctcgctctgcttcagttctacaaggtggatgattctggaaaggttcagaggctcaggaaggagtgccccaatgctgagtgtggtgccggcactttcatggccaatcattttgacaggcactattgcggcaagtgcggcctcacctatgtttaccagaaggctggcggggactaaatgcctgccatttttacccaattttcccagtagtttgaatttgcgtttcaaaaaaatattctgtttagggttatggattttattatatagcatgagacttgtggtttttgttttatgggatcttaatctagaaatgtttatttcgtgacttcatat

SEQ ID NO: 2328 - DNA, 700 bp, Solanum lycopersicum
aatttatcaacaaaagaaaccctagaagccgcagtgccactgatttctctcctccagacgaagatgcagatcttcgtgaaaaccctaacggggaagacgatcaccctagaggttgagtcttccgacaccatcgacaatgtgaaagccaagatccaggacaaggaagggattcccccagaccagcagcgtttgattttcgccggaaagcagcttgaggatggtcgtactcttgccgactacaacatccagaaggagtccactctccatctcgtgctccgtctccgtggtggtgctaagaagaggaagaagaagacctacaccaagccaaagaagatcaagcacaagaagaagaaggttaagctcgctgtgttgcagttctataaggttgatgacactggaaaggttcagaggcttcgtaaggagtgccctaatgctgagtgcggtgctggaacttttatggctaaccattttgaccgtcactactgtggtaagtgtgggctcacctacgtttacaacaaggctggaggcgattgattttaatgtttagcaatgctctatcagattttctttttgtcgaatgaacggtaatttagagttttttttttgctatatggattttcgattttgatgtatgtgacaacccttgggattgttgatttatttcaaaactaagagtttttgcttaaaaaataaaataaaa

SEQ ID NO: 2329 - DNA, 687 bp, Tripterygium wilfordii
gccctaattctctcagagactgcaaacatgcagatctttgtgaaaaccctaacgggtaagactattaccctagaggtcgagtcgagcgacaccattgacaatgtcaaatcgaagatccaggataaggaggggatcccaccggaccagcagcgcctgattttcgccgggaagcagctggaggacggtcgtacactcgctgactataacatccagaaggagtccaccctccacctggtgctccgtcttcgcggtggtgccaagaagcgtaagaagaagacctacaccaagcccaagaagatcaagcataagcataagaaggtcaagctcgccgtccttcagttctacaaggtcgatgactccggtaaggtccagaggctcaggaaggagtgccctaatgcagaatgcggtgctggtacctttatggccaaccacttcgacaggcactactgtggcaagtgcggtttgacctacgtctaccagactgctggcggcgattaggtttttaatatttttatcgagttatgattatggatattagtactttcctgttgagttgtggtacctttgttctgtttttgctagcacagtatcaaattgttgtctggataaggattatctgtgaaatggattttgtggtttattttggatatttgagatgattactgatagttcatgtggtttcgtatt

SEQ ID NO: 2330 - DNA, 634 bp, Tripterygium wilfordii
aattctctgaggctgcaaccatgcagatctttgtgaaaaccctaacgggtaagaccattaccctagaggtagaatcgagcgacaccatcgacaatgtgaaatcgaagatccaggataaggagggaattccaccggaccagcagcgtctgatctttgccgggaagcagctggaggacggtcgtacacttgctgactacaatatccagaaggagtccaccctccacctggtgctccgtctccgcggtggtgccaagaagcgtaagaagaagacatacaccaagcccaagaaaatcaagcacaagcataagaaggtcaagctagctgtccttcagttctacaaggtcgatgactcaggtaaggtccagaggctcaggaaggagtgccctaacgctgagtgcggtgctggtacctttatggccaaccacttcgacaggcactactgcggcaagtgcggtttgacctacgtctaccagaatgctggtggcgattaggtttttaatattttgtcgttttatgattatggatattagtactctcctgttcggttgcggtacctttgtttgtgtttgatagcacagtattaaattttgtctggataatgattttctgttaaatggattttgtggtttatttt

SEQ ID NO: 2331 - DNA, 501 bp, Triticum aestivum
atgcagatcttcgtgaagaccctgacggggaagacgatcacgctggaggtggagtcgtcggacacgatcgacaacgtcaaggccaagatccaggacaaggaggggatcccgccggaccagcagcgcctcatcttcgccgggaagcagctggaggacgggcgcacgctggccgactacaacatccagaaggagtcgacgctgcacctggtgctccgcctccgcggcggcgccaagaagcgcaagaagaagacctactccacgcccaagaagcaaaagcacaagcacaagaaggtgaagctcgccgtcctccagttctacaaggtcgacgacgccaccggcaaggtcaccaggctcaggaaggagtgccccaacgccgagtgcggtgccgggaccttcatggccaaccacttcgaccgtcactactgcggcaagtgcggcctgacatatgtctacaaccagaaggcttagaggtggcttgcgtttgctctgctcttttaccta

SEQ ID NO: 2332 - DNA, 690 bp, Glycine max
gagtttgagtgaaaccctagctagccacaatgcagatattcgtgaaaaccctaacggggaagacgataaccctagaggtagagtcttcggacacgatcgacaatgtgaaggcgaagatccaggacaaggagggcatcccgccggatcagcagcgcctgatcttcgccggaaagcagctggaggacgggcgcacccttgccgactacaacatccagaaggagtccaccctccacctcgtcctccgcctccgcggcggcgccaagaagcgcaagaagaagacctacaccaagcccaagaagatcaagcacaagcacaagaaggtcaagctcgccctcctccagttctacaaggtcgacgactccggcaagctccagaggctccgcaaggagtgccccaatgccgaatgtggcgccgggaccttcatggccaaccacttcgaccgccactactgtggcaagtgcggattgacctatgtttaccagaaatctgaagcttaggattgttttccatttgtttctgaattttggaattttattttagtataatactgtttttttttggggtcgcatatttattattatgactgcctaaatgatctgccttttcatattattatgactgcttaaatcttgatgcattattttttgaatttgattttaattttgaaatgaagtgagtgatttatgactg

SEQ ID NO: 2333 - DNA, 704 bp, Musa acuminata
gggagcgttttccggccgtcgtaacttaagccagcggcgccacctccgttggccgctaccccccgccggcaagatgcagatcttcgtgaagacgctcacggggaagacgatcaccctcgaggtggaatcgtcggacaccatcgacaacgtgaaggccaagatccaggacaaggagggcatcccgccggaccagcagcgcctcatcttcgccggaaagcagctggaggatgggcgaaccctcgccgactacaacatccagaaggagtccacgctccacctcgtcctccgcctccgcggcggcgccaagaagcgcaagaagaagacctacaccaagcccaagaagatcaagcacaagaagaagaaggtcaagctcgccgtgctccagttctacaaggtcgacgacgcaaccggcaaggtcacccgcctccgcaaggaatgccccaacgccgagtgcggtgccggaaccttcatggccaaccacttcgaccgccactactgcggcaagtgcggcctcacctacgtctaccagaaggcgcaaggtgagtgatcgagtaatctcatgcctggtttaagaatatgtgactactgaacacagttaaatatttgaaattggacttagttttatgcggttggaacagtctgttttcgtcaattttttagttctgccttaatgatggatgatgatgctatatttgatgatttga

SEQ ID NO: 2334 - DNA, 721 bp, Hordeum vulgare
attccacaccgccgccaaaccgccgcccccgccgcctccactgccgtcgccgccacagcgcgcggaggcgaccgccccaccgccgccaagatgcagatcttcgtgaagaccctgacgggcaagaccatcacgctggaggtggagtcctcggacaccatcgacaacgtcaaggccaagatccaggacaaggagggcatcccgccggaccagcaacgcctcatcttcgccggcaagcagctcgaggatggccgtactctcgccgactacaacatccagaaggagtccaccctccacctggtgctccgccttcgtggtggtgccaagaagcgcaagaagaagacgtacaccaagcccaagaagcaaaagcacaagcacaagaaggtgaagctcgccgtcctccagttctacaaggtcgacgattccaccggcaaggtaacccggctcaggaaggagtgccccaacgccgactgcggtgccgggaccttcatggccaaccacttcgaccgtcactactgcggcaagtgcggcctcacctacgtctacaaccagaaggcctagaggtggcttgcgtttgctctgctcttttaccctgtcgtttgtcattgaaaactgaaaccttggagtaatatgttttctggatacttgatcgactattgctgagatgctatgcgagctaaaattttggtcattctgaatgatattctttttcatggtcgctatc

SEQ ID NO: 2335 - DNA, 728 bp, Hordeum vulgare
cgccctagcctccattccacaccgccgccaaaccgccgcccccgccgcctccactgccgtcgccgccacagcgcgcggaggcgaccgccccaccgccgccaagatgcagatcttcgtgaagaccctgacgggcaagaccatcacgctggaggtggagtcctcggacaccatcgacaacgtcaaggccaagatccaggacaaggagggcatcccgccggaccagcaacgcctcatcttcgccggcaagcagctcgaggatggccgtactctcgccgactacaacatccagaaggagtccaccctccacctggtgctccgccttcgtggtggtgccaagaagcgcaagaagaagacgtacaccaagcccaagaagcaaaagcacaagcacaagaaggtgaagctcgccgtcctccagttctacaaggtcgacgattccaccggcaaggtaaccaggctcaggaaggagtgccccaacgccgactgcggtgccgggaccttcatggccaaccacttcgaccgtcactactgcggcaagtgcggcctcacctacgtctacaaccagaaggcctagaggtggcttgcgtttgctctgctcttttaccctgtcgtttgtcattgaaaactgaaaccttggagtaatatgtttcctggatacttgatcgactattgctgagatgctatgcgagctaaaattttggtcattctgaatgatattctttttcatggtc

SEQ ID NO: 2336 - DNA, 787 bp, Bruguiera gymnorhiza
aaatgtgtttttttggtcttcaaatttcaccgcctcgggctgcgcctttgtggctctctctcgctgcaacgatgcagatcttcgtgaaaaccctaacggggaagacgataaccctcgaggtcgagtcatctgacaccatcgacaatgtcaaggccaagatccaggacaaggaaggcataccgccggaccagcagcggctgatcttcgccggaaagcagctggaggacggccgcaccctcgccgactacaacatccagaaggagtcaaccctccacttggtcctccgcctccgcggtggcgccaagaagaggaagaagaagacctacaccaagcctaagaagatcaagcacaagaagaagaaggtgaagctcgccgttctccagttctacaaggtggatgattccggcaaggttcagaggctcaggaaggagtgcccgaacgccgagtgcggtgctggaacctttatggccaaccatttcgatcggcactactgtggcaagtgtggcttgacttatgtttacaataaagccggcggcgattaggcctatttaatcgttacctttatgttttggaaccttgtgtgtgttgttttcggattgggaatagatttgctgggatttctatgtcttgaagtttccggattttgttggttaagctgctttgatcgattaatggatcgttaaatcttgctgtttgaaaataaaaggagaagggaatggaaggtttgggtaaagaaatttttgtaaagaaaagttggggggcaaaagaaactcatttagggggggtt

SEQ ID NO: 2337 - DNA, 733 bp, Manihot esculenta
acgcacacccttcaaacccaagccgaagaccctccgtttgcctcgctctctgcatcggtctccaaagatgcagatcttcgtcaaaaccctaacgggtaagaccataactctcgaggtagaatcctcggacactatcgacaatgttaaggccaagatccaagacaaggagggaatcccaccggatcagcagcgcctcatcttcgcaggaaaacaactggaagatggacggacccttgcagactacaacattcagaaggagtcaactctccacttggtgctgcgtttgaggggtggagccaagaagaggaagaagaagacctacaccaagcccaagaagatcaagcacaagaagaagaaggttaagctctccatccttcagttctacaaggttgatgatagtggtaaagttcagagactgaggaaggagtgtcccaacgccgactgtggagccggtacttttatggctaatcattttgacaggcactactgtggtaagtgtggccttacctacgtttaccagaaggccggcgatgactgatcttcagcttcaagctgaggaggcatagagaaacttcgtttttagtattttttcttttgagctggttgttgaacttgcttttatggctgctattttttatggtctatttggctactttggatggtattttttgcagtttaatggtcacttttgcattttacattaccttttaatctatattgcttgcttagtgtc

SEQ ID NO: 2338 - DNA, 771 bp, Manihot esculenta
gacgcttaccaacaaaaccctaaaatccctcccctctcttctcttccacccacacggccacacccacacttgctgttcaatcctagaccaaaaccctattttttgccttgctctctgcatctgtcgccaaagatgcagatcttcgtcaaaaccctaacgggtaagaccataactctagaggtagagtcttcggacactatcgacaatgtgaaggccaagatccaagacaaggagggcattccaccggaccagcagcgcctcatcttcgctggaaaacaactagaagacggccggacccttgccgactacaacattcagaaggagtcgactcttcatctggtgttgcgcttgaggggcggagccaagaagaggaagaagaagacctataccaaacccaagaagatcaagcacaagaagaagaaggtcaagctctccattcttcagttctacaaggttgatgacagcggtaaggtgcagaggctgaggaaggagtgccccaacgctgattgtggcgctggtacttttatggctaatcattttgataggcactactgtggtaagtgtggtctcacctacgtttaccagaaggcaggcggtgactgatcgtataagattcatccggagagcagagcacaaatttattttcaaatgtttttcttatttttgacctgaatgttgaacttacttttattgctgtatttttatgagatattttgctattctggataatgactattttgcattttaatggtcaatttccgttttgacgtt

SEQ ID NO: 2339 - DNA, 714 bp, Ricinus communis
aatcagccacatatataaatatccttctatagcctaatttcgcatctcttagtctgcataacaaaaggaaggaaaaaatatgcagatctttgtgaaaaccctaacggggaaaacaataaccctagaggtagagtcatcagacacaatcgacaatgtgaaggccaaaatccaagacaaggaaggtatacccccggaccaacaacgtttaatcttcgccggaaagcagcttgaggacggccgcacgctcgccgactacaacatccaaaaggaatcaaccctccaccttgtgctccgcttgcgtggcggcgctaaaaagagaaagaagaagacatacacaaagcctaaaaagattaagcacaagaagaagaaggtgaagctagcagtgcttcagttttacaaagtggatgattcagggaaagtgcagagattgaggaaggagtgtcctaatgctgagtgtggggctggtacttttatggctaatcattttgataggcattattgtggtaagtgtgggttgacatatgtctacaataaggctggtgctgattgattagggtctttttaaagagtttagtgatttaaaaaatttgctactttctttttctttttaatgttgggttttgttcttgatggatcttattattagaatctggattttgctggtttaatataattgtctggatattttattaatatatgtttttctacctgagt

SEQ ID NO: 2340 - DNA, 717 bp, Castanea mollissima
agagaccccttttgaagcggctggttgctgcgaatcgcagaaccaaccaatcaaccaaccatgcagatcttcgtgaagaccctgacgggcaagaccatcaccctggaggtcgagtcctcagacaccatcgacaatgtgaaggccaagatccaagacaaggaaggaatcccgccggaccagcagcggctcatcttcgccggaaagcagctggaggacggccgaaccctagccgactacaacatccagaaggagtcgaccctccacctggtgctccgcctccgcggcggcgcaaagaagcgcaagaagaagacctacaccaagcccaagaagatcaagcacaagcacaagaaggtgaagctcgcgatccttcagttctacaaggtcgacgattccggaaaggtccagaggcttcgtaaggagtgccctaactctgagtgcggcgctggaactttcatggccaaccactttgaccgtcactactgtggcaagtgtggcttgacctatgtgtaccagaaggccggtggtgattaggttttatgttttgttttttttttttgatttataatatgttttaattttgaaatagcggatgatgatatggatctgaactactaggttgttgtgttgttttttttttccctaaattttctggatgattatcgtactattattcgacttaaaagtttagttgggattttgcttgattatcaaaaaaaa

SEQ ID NO: 2341 - DNA, 880 bp, Citrus sinensis
  misc_feature (845)..(845): n is a, c, g, or t
tacggccggggaaccagcctagccgtagaaccttcagcctctctgggtcacacagccaaacaagatgcagatcttcgtgaaaaccctaacgggtaagaccataacgttggaggtggagtcctccgacacaatcgacaacgtcaaggcgaagatccaggacaaggagggtatcccaccggaccagcagcgcctcatcttcgccggcaagcagctcgaagacgggcgaaccttggccgactacaatatccagaaggagtcgactctgcacctggtgcttcggcttcgtggtggggccaagaagagaaagaagaagacatacaccaagcccaagaagatcaagcacaagaagaagaaggtgaagttggctgtgttgcagttttacaaggttgatgattctgggaaagtgcagaggctgaggaaggagtgccctaatgctgagtgtggtgctggcacttttatggccagtcactttgacaggcattattgtggtaagtgcggtctcacctatgtttaccagaaggctggcggagattgattgccctctctgtccatctcgtttttcctgttgagattatgctcctgttctttcctaagttttttttttttttttggatattagcagtttttgttaaattaaatgcttctattaattgatatccccggttttttcgttagaatttgttccatgattatgcttgccatagcaaatttgtgggagttctgtaaggattaactgctatatggtttcatctggtggtggcacgtttggtagcgctgcatatagtgctcaaactatattttagtgcgagtatgataatttaatttcatattttacaacaattgcntggaagtcttgctttcgcatgactttattccctta

SEQ ID NO: 2342 - DNA, 760 bp, Gossypium hirsutum
agccgaaccctccatttctctctgccaccagcggcacccaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggaaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggttcagaggctgaggaaagagtgtcctaatgctgagtgtggtgctggaactttcatggctaaccatttcgataggcactattgcggtaagtgtggactcacttatgtttaccagaaggctggtggagattaagtagggctcgtgcaaaagatggatcttttagggtttttccagtatgggttttaggttttaaattttcagtaatcgtcggattttgtttaatcgaatgaattttgttgtgtttgaatatgttataatacttgggctatgtgatttggagttttgattatcaattcagctgtttgaatcaacataagttaattcttctttatgttgtttgattgatgattatatttatatgccttgtattttttgcta

SEQ ID NO: 2343 - DNA, 885 bp, Gossypium hirsutum
gaaaaccctaattcaccttcatgtatatatataaaaccccaacagacttattccgtgttttcgaaacctagcagaaccctccatttctctctgcaaccagcggcacccaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggcaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggttcagaggctgaggaaagagtgtcctaatgctgagtgtggtgctggaactttcatggctaaccatttcgataggcactattgcggtaagtgtggactcacttatgtttaccagaaggctggtggagattaagtagggctcgtgcaaaagatggatcttttagggtttttccagtatgggttttaggttttaaattttcagtaatcgtcggattttgtttagtcgaatgaattttgttgtgtttgaatatgttataatacttgggctatgtgatttggagttttgattatcaattcagctgtttgaatcaacataagttaattcttctttatgttgtttgattgatgattatatttatatgccttgtattttttgctattttgttctctgggtattgtgtatgcttaatgtttgtaaaatgattttactatttt

SEQ ID NO: 2344 - DNA, 699 bp, Gossypium hirsutum
gcggcgtcaagatgcagatcttcgtcaaaaccctaacggggaaaaccataacccttgaggtcgagtcttctgacaccatcgacaatgtcaaagccaagatccaagacaaggaaggcatccctcccgatcaacaacgccttatcttcgccgggaagcagcttgaagacggccgcaccttagccgactacaatatccagaaggaatccactcttcacctcgtcctccgcctccgaggtggtgccaagaagaggaagaagaagacctacaccaagcccaagaagatcaagcacaagaagaagaaggtcaagctcgccgtgctccagttttacaaggtggacgagtcgggtaaggttcagaggctgagaaaagagtgtcccaatgccgagtgtggtgctggaaccttcatggctaaccattttgataggcattattgcggtaagtgtgggctcacttatgtttaccagaaggctggtggggattgagtgggataagatggatttttagttgttttcaaataatcgtattgtcatgttcttattttggttggttttagtatgttataattttggggtttctattttggaattttggttgctaatttaaatgtttgaatcaaatcttgtgaagttttcttcttctttatgatgatttgctctgatttctaatttgatcatgaaaaaacaacaattcaaacttgtt

SEQ ID NO: 2345 - DNA, 844 bp, Gossypium hirsutum
aacgcagagtacatggggaacatcatttgatatcgatctaaccttacagaaaaaagaaaaaatcaaggggcaaacctccttctcacatatatgaacacccaacactcaaaaaaatctcccattttttgaaacccttgcggcgtcaagatgcagatcttcgtcaaaaccctaacggggaaaaccataacccttgaggtcgagtcttccgacaccatcgacaatgtcaaagccaagatccaagacaaggaaggcatccctcccgatcaacaacgccttatcttcgccgggaagcagcttgaagacggccgcaccttagccgactacaatatccagaaggaatccactcttcacctcgtcctccgcctccgcggtggtgccaagaagaggaagaagaagacctacaccaagcccaagaagatcaagcacaagaagaagaaggtcaagctcgccgtgctccagttttacaaggtggacgagtcgggtaaggttcagaggctgagaaaagagtgtcccaatgccgagtgtggtgctggaaccttcatggctaaccattttgataggcattattgcggtaagtgtgggctcacttatgtttaccagaaggctggtggggattgagtgggataagatagatttttacttgttttcaaataatcgtattgtcatgttctgatttttgtttgttttagtatgttataattttggggtttctattttggaattttggttgctaatttaaatgtttgaatcaaatcttatgaagttttcttcttctttatgatgatttgctctgatttctaatttgatcatgaaaaaacaacaattcaaacttgttgaaaacaaa

SEQ ID NO: 2346 - DNA, 1058 bp, Gossypium hirsutum
gtgtgccttggtctcagacgagcggccagtatcaacgcagagtacatggggctagccgacaccttcaataacccattttccgctgcttcttcagctgaggcaaaccgtagccactaagaatgcagatcttcgtgaaaaccctaacggggaagaccataaccctagaggtcgagtcttccgacacaatcgataatgtcaaagccaagatccaagacaaagaaggcatacccccggaccaacaacgcctcatcttcgccggtaagcaactcgaagacggccgcaccttagccgactacaacatccaaaaggaatccactctccaccttgttctccgtctcaggggtggcgccaagaagaggaagaagaagacctacaccaagcctaagaagatcaagcacaagaagaagaaggtcaagctcgccgtgctccagttctacaaggtcgatgaatccggcaaggttcagaggctgaggaaagagtgccccaatgctgagtgtggggctggcactttcatggctaaccattttgataggcactattgcggtaagtgtggactcacttatgtttaccaaaaggctggtggcgattgagtttccatctttagcttgtcgatcttttgttagtatgagagacgggattttaatttccaattatcgttcgactgtttaattttttattatgttttatcatgttacgatacttgggatatgattatcaattttagcttttctgaatctaagtaagggcattttacagattattgtttggttcatgattgttgatttgttgatcttcctttgctcatgttatgttgttctgtgttcaattccaattcccaatctttagaaaatttaaacccagcattggattagacctgtgtcttcatgttgggtttttaagttgtaggtcaatgaagatgcttctgattgcataatggttggattgataatatggtatgtaaagcatatatgagttttcagggtaaaacccagtcatgacaatttcaacttccagtaaacatgtgcttgttgaatgtcaatggatgggaataatttgat

SEQ ID NO: 2347 - DNA, 1035 bp, Gossypium hirsutum
gccacgtatcaacgcagagtacatggggctagccgacaccttcaataacccattttccgctgcttcttcagctgaggcaaaccgtagccactaagaatgcagatcttcgtgaaaaccctaacggggaagaccataaccctagaggtcgagtcttccgacaccatcgacaatgtcaaagccaagatccaagacaaagaaggcatccccccggaccaacaacgcctcatcttcgccggtaagcaactcgaagatggccgcaccctagccgactacaacatccaaaaggaatccactctccaccttgttctccgtctcaggggtggcgccaagaagaggaagaagaagacctacaccaagcctaagaagatcaagcacaagaagaagaaggtcaagctcgccgtgctccagttctacaaggtcgatgaatccggcaaggttcagaggctgaggaaagagtgccccaatgctgagtgtggggctggcactttcatggctaaccattttgataggcactattgcggtaagtgtggactcacttatgtttaccaaaaggctggtggcgattgagtttccacctttagcttgtcgatcttttgttagtatgagagacgggattttaatttccaattatcgttcgactgtttaattttttattatgttttatcatgttacgatacttgggatatgattatcaattttagcttttctgaatctaagtaagggcattttacagattattgtttggttcatgattgttgatttgttgatctttctttgctcatgttatgttgttctgtgttcatttccaattcccattttttagaaaatttaaacccagcattggattagacctgtgtcttcatgttgggtttttaagttgtatgtcaatgaagatgcttctgattgcataatggttggattgatgatatggtatgtaaagcatatatgagttttcagggtaaaactcagtcatgacaatttcaacttccagtaaacatgtgcttgttgaatgtcaatggatgggaataatttgat

SEQ ID NO: 2348 - DNA, 714 bp, Gossypium hirsutum
gcgcatcttcgcccatcgccaagatgcagatcttcgtcaaaaccctaacggggaagactataaccctagaggtcgagtcttcggacaccattgacaatgtcaaagctaagatccaagacaaggaaggcattccacctgaccaacaacgtcttatcttcgccggcaagcaactcgaagatggccgcaccttagccgactacaacatccagaaggaatccactctacaccttgtcctccgtctcaggggaggtgcgaagaagagaaagaagaagacctacaccaagcccaagaagatcaagcacaagaagaagaaggtcaagctcgccgtcctccagttttacaaggtggatgagtccgggaaggttcagagactgagaaaagagtgccctaatgcggaatgtggcgccgggaccttcatggctaaccattttgataggcactattgcggtaagtgtgggctcacttacgtttaccagaaggctggtggggattgagtagagtccgcttctaccttcggttagtgtcctgcaaaaattgaatctatagctatttttctttacaatatgaacattagggctttgattttccgtaatcgttgaacttttttaaatttatgtatgctttattatgttatgatactttgggtatgattttggagttttgaatgatttatcaaatcagctttttgaatcaaattatgtggtattctactta

SEQ ID NO: 2349 - DNA, 1258 bp, Gossypium hirsutum
cctagccgctgtacttctactcccatttttctttgcgcatcttcgcccatcgccaagatgcagatcttcgtcaaaaccctaacggggaagactataaccctagaggtcgagtcttcggacaccattgacaatgtcaaagctaagatccaagacaaggaaggcattccacctgaccaacaacgtcttatcttcgccggcaagcaactcgaagatggccgcaccttagccgactacaacatccagaaggaatccactctacaccttgtcctccgtctcaggggaggtgcgaagaagagaaagaagaagacctacaccaagcccaagaagatcaagcacaagaagaagaaggtcaagctcgccgtcctccagttttacaaggtggatgagtccgggaaggttcagagactgagaaaagagtgccctaatgcggaatgtggcgccgggaccttcatggctaaccattttgataggcactattgcggtaagtgtgggctcacttacgtttaccagaaggctggtggggattgagtagagtccggttctacctgcggttagtgtcttgcaaaaaattgaatctatagctatttttctttacaatatgaacattaggattttgattttccgtaatcgttgaacttttttaaatttatgtatgctttattatgttatgatactttggatatgattttggagttttgaatgatttatcaaatcagctttttgaatcaaattattgtggtattctacttatttatgttttgtagatgattcgatttgcttttttattttttacttatttattatgttttatttttggctatgttggatttgtgtatgcgtgaaatttgggatttaccagaggcggcataagccatgtatttaagtttctatgaatatttcctaccttcgaggcatagcaagttatgattgattgagaatgatgggtgatggcctactttgcttcatatgccacacatgctatgggatttatagagcagagtggatatcctgcacattgaattatgggcttcagctttgcgttattcctgagtctactatctgtattggtttattagtattctcttatcactctaattgatgtcatcgtatattaagttgataggctggcatattgaagaaatatccaaccaagagcctttctgatccctgcaaatgcaatgatatgcttattgtttagtgtcaattgcattgctggaggttattgtacaaattcgagataatagtgcctgttataaga

SEQ ID NO: 2350 - DNA, 720 bp, Cryptomeria japonica
ttggcgatatcattcttaaggcttcgaagaattttagggttacaggagagggctttcggggaagtaaacgctgctgcgaggagtctggagcaggagcagagatgcagattttcgtaaaaacactgactggtaagacaataaccctagaggtagagtcttctgatacaatcgacaatgtgaaggctaagatccaggataaggagggtattcctcctgatcagcagaggctaatctttgctgggaagcagctggaggatgggagaaccctggcggattacaatattcagaaggaatccacccttcatcttgtccttcgcctcagaggaggtgcgaagaagaggaagaagaagacctacaccaagcccaagaagattaagcacaagaagaagaaagtcaagttggctgttttacagtactacaaggtggatgactctggcaaggtgcagaggcttaggaaggaatgccctaatcaggagtgtggagctgggactttcatggctaatcactttgataggcattactgtggcaaatgtggtttgacctatgtttatcaaaaagctgaggcttaagatgagtttgccctaaattaggtttagagataaatttgctttatctagggctgaggagggctggtttattatatgctggggtttgaaattttcgagatgtataagaatttttgtagagtgatttagattctatttatgcagttttatctgg

SEQ ID NO: 2351 - DNA, 780 bp, Cryptomeria japonica
  misc_feature (2)..(2): n is a, c, g, or t
gnctttaggccgatggaatagggtttcaatagagtttttttaagagaaggcttttagccgtggctactgagcgattctggagcagtgagatttcaagatgcagatattcgtgaaaactctgactggtaagacaataaccctagaggtagagtcctctgatacaatcgacaatgtgaaggcgaagatccaggataaggagggtatacctcctgatcagcagaggctaatctttgctggaaagcagctggaggatggaagaaccctggcggattacaatattcaaaaggagtccactcttcatttggtccttcgcctgaggggaggtgcgaagaagagaaagaagaagacctacaccaaacccaagaagattaagcacaagaagaagaaagttaagttggctgtcttacagtactacaaggtggatgactctggcaaggtgcagagactcaggaaggaatgccctaatcaggagtgtggagcagggactttcatggccaatcacttcgacaggcattactgtggcaagtgtggtctgacttatgtctatcagaaagcggaggcttaagataattttgggtttaattgggactagagacgaattcggttagcatttttacattacatgttgggcttttaaattgtggagatggataagaactttttgtagcgatgatttagattttattattgcctttggtatttatcaattatcatactgaatttattaaaatttgtcattttaccttttaaatcaatagagccaactgttttatgcgatgt

SEQ ID NO: 2352 - DNA, 716 bp, Taraxacum officinale
ccctatccggcgcgatgcgtattttggtgaaaaccctaaccggggaaaccatcaccctagaggtagaatcctccgataccatcgacaatgtgaaagccaagatccaagacaaggaaggcatcccaccggaccaacagcgtctgatcttcgccggaaaacagctcgaggacggccgaactctagccgactacaacatccagaaggaatccaccctccatctcgtcctccgtcttcgtggcggtgccaagaagcgtaagaagaagacttacaccaagcccaagaaaatcaagcacaagcataagaaggtgaagctcagcgtcttgcagttttacaaggtcgacgactctggaaaggtccagaggctcaggaaggaatgccccaatgccgagtgtggtgccgggaccttcatggctaatcactttgatcgtcactattgtggaaagtgcggtctcacttatgtttatcagaaggccggtggagattaatttaccaggtttttcttttaagttatcatcagacagattgttatttcaggttttttacatgttttaatctcctttcagaccttttcgatattatgtattttgattgatggatgatgctattatcttcgatatgattatctttatgactgttgttataatattaacatttggttgcttgattacaatcaaacaaatttataatgaaaaaacacgacctaagacaatttgtgg

SEQ ID NO: 2353 - DNA, 704 bp, Solanum melongena
acactatcattccattatcaacagaaaccctagaagccgcactctctcctccaggcgaagatgcagatcttcgtgaaaaccctaacggggaagacgatcaccctagaggttgagtcttctgacaccatcgacaatgtcaaagccaagatccaagacaaggaagggattcccccagaccagcagcgattgattttcgccggaaagcagcttgaggatggtcgcactcttgccgactacaacatccagaaggagtcaactctccatctcgtgctccgtctccgtggtggtgctaagaagaggaagaagaagacctacactaagccaaagaagatcaagcacaagaagaagaaggttaagctcgctgttttgcagttctacaaggtggatgattctggaaaagttcagaggcttcgtaaggagtgccctaatgctgagtgcggtgctggaactttcatggctaaccattttgatcgtcactactgtggtaagtgtgggctcacctacgtttacagcaaggctggaggcgattgatttttatgtttagcgatgtcttatcagttttatatttttgttgatcgataatttagagattttgctatatggattttcgttttttgatgtatggcgacaaccattgggattgttgagttattcagaattaagagtttttgctaattgtttctatctattttcgataatcaatc

SEQ ID NO: 2354 - DNA, 565 bp, Festuca arundinacea
  misc_feature (265)..(265): n is a, c, g, or t
  misc_feature (406)..(406): n is a, c, g, or t
  misc_feature (551)..(551): n is a, c, g, or t
ggcacgaggccaccacccaaccgaaacccttcctcaccgccgccaccaccaccctcgccgccgaagcgcgcggaggcgaccccccagcgtcgccaagatgcagatcttcgtgaagaccctgacgggcaagaccatcacgctggaggtggagtcctcggacaccatcgacaacgtcaaggccaagatccaggacaaggagggcatccccccggaccagcagcgcctcatcttcgccggcaagcagctcgaggacggccgcaccctngccgactacaacatccagaaggagtccaccctccacctggtgctccgcctccgcggtggcgccaagaagcgcaagaagaagacgtacaccaagcccaagaagcaaaagcacaagcacaagaaggtgaagctcgccctcctncagttctacaaggtcgacgacggcaccggcaaggtcaccaggctcaggaaggagtgccccaacgccgagtgcggcgccgggaccttcatggccaaccacttcgaccgccactactgcggcaagtgcggcctcacctacgtctacnaccagaaggcttag

SEQ ID NO: 2355 - DNA, 892 bp, Panax ginseng
cagatcttcgtgaaaaccctcacgggtaagaccattaccctagaggtcgaatcgtcggacaccattgacaatgttaaggccaagattcaagacaaggaaggcatccctccagatcagcagcgccttatcttcgccggaaagcagctggaggacggcagaaccctagcggactacaacatccagaaggagtccaccctccacctggtcctccgcctccgcggtggcgcaaagaagcgaaagaagaaaacgtacacgaagccgaagaagatcaagcataagaagaagaaggttaagctcgcggtgttgcagttctacaaggtggatgattctggaaaggtccagaggctgaggaaagagtgtccgaatgcggagtgtggggcgggaaccttcatggccaatcatttcgatcgacactactgtggcaagtgtggcctcacctatgtttatcagaaggctggtggtgattaaagcttctatcccttttgtattttttattgcaattactaatcgtatgtgtttctaaagatcatagaatggatgggttgaatttgaatattaattgctggatttgagtgctttatctactcaatgagactattatttctgcgtaaactatgtttcgtccctctcaaatataaataaaatatttcaaaccactttggtgggccgcttcaggcccaattgaattttaaactggacccaagcttatgcattccggccgcaattcgaacctcatttggcccaatttccccctttaagtggaggcggtttaacaaattcactggggccgggtggtttttacaaacggtctctggacgtgggaaaaaacccctgggcgctttccgccaacctttaatatccccctctggctaatcactattccccccttctt

SEQ ID NO: 2356 - DNA, 791 bp, Vitis vinifera
cgccgaggcccttccagcggcgactgcggggaagagaaaaggagaggagcgaagatgcagattttcgtgaagaccctaacggggaagaccataaccctagaggttgaatcatctgacacgatcgataatgtcaaggccaagatccaagacaaggaaggcatcccgccggaccagcagcgcctcatcttcgctggcaaacagctggaggacggccgaaccctagccgactacaatatccagaaggagtcaaccctccacctggtgcttcgcctccgtggtggcgccaagaagcgcaagaagaagacctacaccaagcccaagaagatcaagcacaaaaagaagaaggtcaagctcgctgttttgcagttctacaaggttgatgattccggaaaggttcagaggttgagaaaggagtgccctaattctgagtgcggtgcgggtaccttcatggccaatcattttgataggcactattgtggcaagtgcggcctcacctatgtttaccagaaggctggcggagattagggtttataacttgaactacttcttctagtttctgttatgcgtttctgttttgtagaatttcagagttcataattttgaatcgaatggattggaatttgactttgaatttgaatgatttgcatgtttaatctccgtataaggggcttatgatgttctaaatcttacagggattctctttttatttttatcttatttgtttattatttttatatcctttggttattcgttgatttgttgaatggctgagggagtgttttattctgtta

SEQ ID NO: 2357 - DNA, 725 bp, Ipomoea nil
attaatcaatcgttgaacaggaacagaagacaaggaggcgtcggcgtctcttccagcaggcaaagatgcagatcttcgtgaaaaccctgacggggaagaccataaccctggaggtggaatcctccgacaccatcgacaatgtgaaggcgaaaattcaagacaaggagggaatcccacctgaccagcagcggctcatcttcgccggaaagcagctggaggacgggcggaccttggcggactacaacatccagaaagagtctactctccacctggtgcttcgcctccgtggtggcgcgaagaagaggaagaagaagacctacaccaagccgaagaagatcaagcacaagcataagaaggtgaagctggcggtgctgcagttctacaaggtagatgagtccgggaaggtgcagaggcttaggaaggagtgccccaatgctgagtgcggcgctggcaccttcatggccaaccacttcgatcgtcactactgtggtaagtgcggcctcacatatgtttacaataaagctggttccgattgatcactgatcactcctccatccatgatcgatcaaagttttgagtattgatactgagtttcgttatatgttgtattttcgcatttgaaatatggagactgaagttttactggataatgtcagttatgtaaggtctaaactctaatgtttgtttggtttattgaactgatatattgctccattatatacgat

SEQ ID NO: 2358 - DNA, 738 bp, Jatropha curcas
attccctgcttcggctactgctcctctcctctgcaaaaatgcagatcttcgtgaaaaccctaaccgggaagacgataaccctagaggttgagtcttctgatactatcgataatgtcaaggccaagatccaggacaaggaaggcatccctccagaccagcagcgactgatcttcgccggaaagcagctagaggatggccgcactcttgccgactacaatatccagaaggaatccactctccacctggtgcttcgtcttcgtggtggtgctaagaagagaaagaagaagacttacaccaagccaaagaagatcaagcacaagaagaagaaggtcaaacttgccgtgcttcagttctacaaggtcgatgactccggaaaggtgcagaggctgaggaaggagtgccccaatgctgagtgtggagctggaactttcatggccaaccattttgataggcactactgcggcaagtgcggcttgacttatgtttacaataaggctggcggtgattaggttattgttaatgcgtttttgtttcgtgatatggatttggtaattctaagtttgctactttttgcataattttgattagttgagtatgatggatattgatactggtttttttttgtttagtttcttaatataattatctggatgtctgagtaatttgctttgctttttatgtttagaattaaatgttgctatttaaccctttttttatctatttgattgcggctgattg

SEQ ID NO: 2359 - DNA, 643 bp, Actinidia deliciosa
  misc_feature (82)..(82): n is a, c, g, or t
  misc_feature (94)..(94): n is a, c, g, or t
  misc_feature (241)..(241): n is a, c, g, or t
  misc_feature (274)..(274): n is a, c, g, or t
  misc_feature (518)..(518): n is a, c, g, or t
  misc_feature (552)..(552): n is a, c, g, or t
  misc_feature (615)..(615): n is a, c, g, or t
  misc_feature (626)..(626): n is a, c, g, or t
taaccctaatttgtgcctccttcgacgagcgaagatgcagatcttcgtgaaaaccctaacggggaagaccataaccctagangttgaatcatcngacaccatcgacaatgtcaaggccaagatccaagacaaagagggcattcctccggaccagcagcgcctgatcttcgccggaaaacagctggaggacggtcgcaccctcgccgactacaacatccagaaggagtcgacgctccacctngtgctccgccttcgcggaggcgccaagaagcgnaagaagaagacctacaccaagcccaagaagatcaagcacaagaagaagaaggtcaagctcgccgtgttgcagttctacaaggtggatgattctggaaaggtccagaggctgaggaaggaatgccccaacgccgagtgcggtgcgggaaccttcatggcgaatcacttcgaccgtcactactgtggtaagtgtggcctcacctacgtttatcagaagtccggcggtgactgaggatctggcgatngcagtagttttatgtttattgttgtcgatttttnatgttttttgagtttatggcctggataatcaaagattatggtcgattttgaatctttctgaantttttggttcnatgaactaatttatgtg

SEQ ID NO: 2360 - DNA, 660 bp, Lolium multiflorum
aagatgcagatcttcgtgaagaccctgacgggcaagaccatcaccctggaggtggagtcctcggacaccatcgacaacgtcaaggccaagatccaggacaaggagggcatccctccggaccagcagcgcctcatcttcgccggcaagcagctcgaggacggccgcaccctcgccgactacaacatccagaaggagtcaaccctccacctggtgctccgcctccgcgggggcgccaagaagcgcaagaagaagacgtacaccaagcccaagaagcaaaagcacaagcacaagaaggtgaagctcgccctcctccagttctacaaggtcgacgacggcacgggcaaggtcaccaggctcaggaaggagtgccccaacgccgagtgcggcgccgggaccttcatggccaaccacttcgaccgccactactgcggcaagtgcggcctcacctacgtctacaaccagaaggcttagaggtggctctgctgcgtctgctatgccttttcttttaccctacctatcgagaactgaattgagctgttggttacatctcgtttagatatgtgttccgtttgtcgtttaaactgatacctggagtagtatgtttcctggatatttgatcgccttttactcagatgatgcgatgtgagttcagttttggtt

SEQ ID NO: 2361 - DNA, 1256 bp, Zea mays
cccgagccgctgcggcggcggcggcggtggcggtccttgcgaggggagagacctctgaggcgcgggcgcggtggaaaccctatcgcgagaccgcggcttccagaggaagcctgcttcgcccggcttttggtttcatgtgacgcgcgcggcttctgtgcgaagcgcggccgtgagaagctgcccagaatctgggcgtttggccgtggcttctgcttctggcggccagaagccgcccagaatcttaaccaaacaggcaccatgtcgtctttctccgctatataggcgcacacacccaaagacacaaaaaccctagcctccaccccatccggcagcagccaaaccctacataggcgccgccgcaggcggcccccccgcatcgtcgccaaagatgcagatctttgtgaagactctgacggggaagaccatcactttggaggtggagtcctcggacaccatcgacaatgtgaaggccaagatccaggacaaggagggcatccccccggaccagcagcggctcatcttcgccggcaagcagctcgaggacggtcgcaccctcgccgactacaacatccagaaggagtccacactccacctggtgctccgcctccgcggcggcgccaagaagcgtaagaagaagacgtacaccaagcccaagaagatcaagcacaagcacaagaaggtgaagctctccgtgctgcagttctataaggtggacgacaccactagcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgcctaccctatcgaacatccagctgttggttactcgaattgtatctcatgtagatctgtctgaggttgaaacttaaatggagcagtagtatctgtcatattggtacccctgttactgaattgatgtgatgctgagtttaattttgttttcatatctatccttacaggccattgcactctttgcccgtttcaccatgattttttgattcataggtcgattatagtagtattgcgtaattggattgatttatgtttgcttgattattttagttgccactaatgtcttgagataggtaaccattatacttggtatgctacgtacttgttgatgtaattttgatgtggatttattaacgagtaactaataaaataataa

SEQ ID NO: 2362 - DNA, 760 bp, Cucumis melo
tcctcgactcggtaaacctgcgactcccacaatatgcagatcttcgtgaaaacgcttaccgggaagaccataactctcgaggtcgagagttctgataccatcgataatgtcaaggtaaagattcaggacaaggagggaataccgcctgaccagcagcgtctcatcttcgccggtaagcagctggaggatggtcgaacacttgccgactacaacatccagaaggagtctacgctccatcttgtcttaaggctccgtggtggtgctaagaagcgcaagaagaagacctacaccaaacccaagaagatcaagcacaagaagaagaaggtcaagctctctgttcttcagttttacaaggtcgacgattcaggaaaggttcagaggctcaggaaggagtgccctaacgctgaatgcggagctggtacatttatggccaatcattttgatcgtcattactgtggcaagtgcggtttgacatacgtgtatcagaagcccggcggtgattaggtcttaatttatatttacattttgatagagatttttttttaatgatgctcatcatttttggggtaatattaattattaggatttcaaattatcaaatgggtccattttcatgaactgttttacatttggaaacgatcaaatcaacgctcaatcttggttaatatttttgaagcatctttcatatactgcctgttcgctacagattttatgcagttttatacttaaatcagtgtgctaattacgtacaaaaaaaaaa

SEQ ID NO: 2363 - DNA, 647 bp, Nicotiana benthamiana
gcacgagggaaagaagaattctagcgccgtagtgctcctcgagttctctcctccaaagcgaagatgcagatcttcgtgaaaaccctaacgggtaaaacaatcacccttgaggttgaatcttccgacacaatcgataatgtgaaagccaagatccaagataaggaagggattcccccagatcagcagcgtctgattttcgccggaaagcagcttgaagacggccgaaccctagccgattacaacatccagaaggagtcgactcttcatctcgtgctccgcctccgtggtggtgctaagaagaggaagaagaagacttacaccaagcctaagaagattaagcacaagaagaagaaggttaagctcgctgtacttcagttctataaggtggatgattctggaaaagtccagaggcttcgtaaggagtgtcctaatgccgagtgtggtgctggaacttttatggctaaccactttgaccgtcactactgtggtaagtgtgggctcacctatgtttacaacaaggccggtgccgattgatccctatgtttagctctgttttaatgctgtcgtcaattttatctttttgtcgaacggttatttagtatggattttccttttaaatgatgtggcaacctgggattgttgagtta

SEQ ID NO: 2364 - DNA, 616 bp, Nicotiana benthamiana
gatgcagatattcgtgaagaccctgacagggaagactattaccttagaggtagagtcatcggacaccattgacaatgttaaggctaagattcaggacaaggaaggcattccaccggaccagcagcggttgattttcgcaggaaagcagctcgaggatggacgaacactagctgactacaacatccagaaggagtccaccctccaccttgtccttcgccttcgcggtggtgcaaagaagcgtaagaagaagacttacactaagccaaagaagattaagcacaagaagaagaaggttaagctcgctgtcctccagttttacaaggttgatgattctggtaaggttcagaggctccgcaaggagtgtcccaatgctgagtgtgatgccgggactttcatggctaaccactttgacaggcactattgtggtaaatgtgggctcacctatgtttaccagaaggctggtggtgattagatgagtgctactttgcttattactttagcactagttttttccccacatttcttgccctatactctcctatgtcttgtttgtgacaagatgtaatgaatttgaattatgggattatgtttgcagcttatgaaattaaggattttt

SEQ ID NO: 2365 - DNA, 709 bp, Nuphar advena
  misc_feature (215)..(215): n is a, c, g, or t
  misc_feature (221)..(221): n is a, c, g, or t
  misc_feature (537)..(537): n is a, c, g, or t
  misc_feature (539)..(539): n is a, c, g, or t
  misc_feature (545)..(545): n is a, c, g, or t
  misc_feature (547)..(547): n is a, c, g, or t
  misc_feature (560)..(560): n is a, c, g, or t
  misc_feature (571)..(571): n is a, c, g, or t
  misc_feature (585)..(585): n is a, c, g, or t
  misc_feature (591)..(591): n is a, c, g, or t
  misc_feature (595)..(595): n is a, c, g, or t
  misc_feature (604)..(604): n is a, c, g, or t
  misc_feature (606)..(606): n is a, c, g, or t
  misc_feature (611)..(611): n is a, c, g, or t
  misc_feature (614)..(614): n is a, c, g, or t
  misc_feature (626)..(628): n is a, c, g, or t
  misc_feature (645)..(645): n is a, c, g, or t
  misc_feature (672)..(672): n is a, c, g, or t
ttccttccccaatcactcctgcgtctgcgaagatgcagatcttcgtgaaaaccctaacggggaagacgatcaccctcgaggtggagtcttcggacaccatcgacaacgtgaaggcaaagatccaggacaaggagggcatcccgccggaccagcagcgcctcatcttcgccggaaagcagctcgaggacggccgcaccctcgccgactacaacatncagaangagtccaccctccacctcgtcctccgcctccgcggtggcgccaagaagcgcaagaagaagacctacaccaagcccaagaagatcaagcacaagaagaagaaggtcaagctcgccgtcctccagttctacaaggtcgacgactccggcaaggtgcagaggctccgcaaggagtgccccaacgccgactgcggcgccggcaccttcatggccaaccacttcgaccggcactactgcggcaagtgcggcctcacctacgtctaccagaaggccgggggggattagggcaggcaaaaggtttcgttttcaaaggctgatntnttttgntntttatcggattcngatggaaaacnaactgcttttaggntttgtnttcngtttattancntacantcntttttagattcnnnaatatggaatgaactgnttctgctttttgattagtttgaatacntttgatttttaatattaaattttgatttgttgttggt

SEQ ID NO: 2366 - DNA, 864 bp, Quercus alba
acaaaccctagcagacccatccaccatatataaacccctcttcatttcccaactcccttctcatcctttatttcagactcttttcacagagatcccatttgaagcggctggttgctgcgaatcgcagaaccaagcaaccatgcagatcttcgtgaagaccctaacgggcaagaccatcaccctcgaggtcgagtcctcagacaccatcgacaatgtgaaggccaagatccaagacaaggaaggaatcccgccggaccagcagcgcctcatcttcgccggaaagcagctcgaggacggccgaaccctagccgactacaacatccagaaggagtcgaccctccacctcgtgctccgcctccgcggcggcgccaagaagcgcaagaagaagacctacaccaagcccaagaagatcaagcacaagcataagaaggtgaagctcgcgatccttcagttctacaaggtggacgattccggaaaggtccagaggcttcgtaaggagtgccctaactctgagtgcggcgctggaactttcatggcgaaccactttgaccgtcactactgtggcaagtgtggcttgacctatgtgtaccagaaggctggtggtgattaggttttatgttttgttttgttttttttttttttgagttataatatgttttaattttgaaatagcggatgatatggatctgaactactaggttgtgttgttttttttcctgaattttctggatgattatcgtactattattcgacttaatagttttgttgggattttgcttgattatctgtttggtttggtgtttttaatttctctgttattttaatttgctattgattttgctatcttaaattgaatttatagga

SEQ ID NO: 2367 - DNA, 828 bp, Avena sativa
cattcactcctccacccaaaccctaccccgccgccgccaccagcgtcgccgccgcagcgcgcggaggcgaccccccaccgccgccaagatgcagatcttcgtgaagaccctgacgggcaagaccatcacgctggaggtggagtcctcggacaccatcgacaacgtcaaggccaagatccaggacaaggagggcatccccccggaccagcagcgcctcatcttcgccggtaagcagctcgaggacggccgcaccctcgccgactacaacatccagaaggagtccaccctccacctggtgctccgtcttcgcggaggcgccaagaagcgcaagaagaagacttacaccaagcccaagaagcaaaagcacaagcacaagaaggtgaagctcgccctcctccagttctacaaggtcgacgacgccaccggcaaggtcaccaggctcaggaaggagtgccccaacgccgagtgcggcgccgggacgttcatggccaaccacttcgaccgccactactgcggcaagtgcggcctcacctacgtctacaacctgaaggcttagaggtggcgccgagtttgctatgctttactttaccctacctatcgagaactcaattgagctgttggttacatctcatttagatatgtctaccgtttgtcgttaaaactgaacctgtagtagtatgtttcctggatatttgttcgtctattactcagatgatgcgatgcgagtttaaattttggtttcagttatatgatatcattctggattacaatattttgttcgggttctcttaccgtagttttatcatgtgttgatctgattgtgacaag

SEQ ID NO: 2368 - DNA, 750 bp, Elaeis guineensis
  misc_feature (714)..(714): n is a, c, g, or t
cattttctcaaacgcaaaccctaaacctagcggcggccgtcctccaccacctgagagacgccgtgctccaccgccggcaagatgcagatcttcgtgaagactctgacgggcaagaccatcaccctcgaggtcgagtcctcggacacgatcgacaacgtcaaggccaagatccaggacaaagagggcatccccccggaccagcagcgcctcatcttcgccggaaaacagctcgaagacggccgcaccctcgccgactataacatccagaaggagtccaccctccatctagtcctccgcctccgcggtggagccaagaagagaaagaagaagacgtacacgaagcccaagaaaatcaagcacaagaagaagaaggtcaagcttgccgtgctgcaattttacaaggtggacgactccggaaaggtgaccagactcaggaaggagtgccctaacgccgagtgtggcgccgggaccttcatggccaaccacttcgatcgccactactgcggcaagtgcggcctcacctacgtctaccagaaggccggaggtgagtaagggattggacaggaagagccgattggagatcgatatatagagctttgctttagtggttgcttagtttcaagtcttaagcctggaagacaaaataatatttgtgacctaatttttgattaatgcttttatgtgatggattaattatggtacatttgaaattgngatcttattattgcgagaattgcttgtttgattgtt

SEQ ID NO: 2369 - DNA, 811 bp, Elaeis guineensis
  misc_feature (59)..(59): n is a, c, g, or t
  misc_feature (106)..(106): n is a, c, g, or t
  misc_feature (136)..(136): n is a, c, g, or t
  misc_feature (157)..(157): n is a, c, g, or t
  misc_feature (229)..(229): n is a, c, g, or t
  misc_feature (232)..(232): n is a, c, g, or t
  misc_feature (575)..(575): n is a, c, g, or t
  misc_feature (707)..(707): n is a, c, g, or t
gtagaccaatcgtcaccggaactcggagacccagaccgtaaccctagcggcggccatcntccaccaccggagcgccgttgccgctgccaagatgcagatctttgtnaagaccctcaccggcaagaccatcaccctngaggtcgagtcctcggacacnatcgacaacgtcaaggccaagatccaggacaaggagggcatcccaccggatcagcagcgccttatcttcgcnggnaagcagctcgaggatggccgcaccctcgccgactacaatatccagaaggagtccaccctccacctcgtcctccgcctccgcggcggcgccaagaagcggaagaagaagacctacaccaagccgaagaagatcaagcataagaagaagaaggtcaagcttgccgtgctccagttctacaaggtggacgactctggcaaggtgaccagactcaggaaggagtgccccaacgccgagtgtggcgccgggactttcatggccaaccacttcgatcgccactactgcggcaagtgcggcctcacctacgtctaccagaaggccggagctgagtaagagatccgttttnggatcgataaataggcagaagttttcgattctagatctatttcttagggtttatttaaatggttggtctttttaaagtctaaagtcttgaaggactgagaaaaaaaatattagagatctattttttttttanatgtttctatgagatggatggattatggttcatttgcaactggaattttgttattgccagaaatgcttgattgatggttacttttttgttgtggatgcttgtgg

SEQ ID NO: 2370 - DNA, 877 bp, Capsicum annuum
ctgaaactctttgtgcggcggcggcgctcttcaccttcaattctgggtgcaccaagtggtgaaaaatgcagatctttgtgaagaccctgacgggcaagactattaccttagaggtagagtcatcggacaccatcgacaatgttaagaccaagattcaggacaaggaaggcattccaccagaccagcagaggttgattttcgcaggtaagcagctcgaggatggtcgaacactagctgactacaacatccagaaggagtccactctccatcttgtccttcgtctccgtggtggtgctaagaagcgtaagaagaagacttacactaagccaaagaagatcaagcacaagaagaagaaggtcaagctcgctgtcctccagttttacaaggttgatgattccggcaaggtccagaggctccgtaaggagtgcccaaatgctgagtgtggtgccgggaccttcatggctaaccatttcgataggcactattgtggtaaatgtggtcttacctatgtttaccagaaggctggtggtgattagatgagtgttagttaactctttcgcttgcagtagaactagttttctccatatctgtgtccctatactctcctaatgtcttgtatgcgacaagatgtaatgaatttgaattatgggattatttttgcagctttataagaagccaaggattttgtcagctaaaaaaaaaaaaaaaaaaaactcgagactagttctctctctctctgaaatttctttttatattgaatagagataatagttttgtgggaatgaataatatcgaacccactacttttagtttctggtgatgtaatcgttgtcatatgtttcttggtttatatggaagttactgctgcttgcgcttt

SEQ ID NO: 2371 - DNA, 749 bp, Populus trichocarpa
gtactttcacgccctcacccaaaacaaaccctaatattcccctcctcgagcacccctctcttatacaaaacaccgtcagccgaaacctactcttccctatccgctctgcatctccaaaaacccccaagaagcgaagatgcagatcttcgtgaagaccttgacgggaaagaccataaccctcgaggttgagtcatcagacacaatcgacaatgtcaaagccaagattcaggacaaggagggcatccctccagaccaacagcgtctcattttcgctgggaaacaactcgaggacggtcgcaccctcgctgactacaacatccagaaggagtccactctccacttggtgcttcgcctgaggggtggagccaagaagagaaagaagaagacctacaccaagcccaagaagatcaagcacaagaagaagaaggtcaagctcgctgtgctccagttctataaggttgatgatagcggcaaagtccagaggttgaggaaggagtgccctaatgctgagtgcggtgctgggactttcatggctaatcattttgataggcactactgtggtaagtgtgggcttacctatgtttaccagacggctggtggtgattaagctcatttgaatggctttttttcctaagtatggaacaaggattatctttatttagaacatggttgctgttgaacttatagttatgttttatttgcatggctaattttgagtttaattatatttttgttttatattgtctgcc

SEQ ID NO: 2372 - DNA, 766 bp, Papaver somniferum
  misc_feature (730)..(730): n is a, c, g, or t
  misc_feature (750)..(750): n is a, c, g, or t
atctttaattgagtcttgggagatatcttaaaaacctcctctcctcctttctcacatctctttgctaattcatcacagcgatcaatagtcagctttcgagaaaccctactttgagtcgcctccgcgaagatgcagatcttcgtgaaaaccctaacagggaaaacaatcaccctcgaggttgaatcctctgatacgatcgacaatgtcaaggctaagatccaggataaggaaggaatcccaccagatcaacaacgtttgattttcgctggaaaacaacttgaagatggaagaactctagctgattacaacattcagaaggaatcgactcttcatctggttcttcgtttgaggggaggagctaaaaagaggaagaagaagacctatactaagccaaagaagatcaagcataagcataagaaggttaagctcgcggttcttcagttctacaaagttgatgattctggaaaggttcagaggttgagaaaggagtgtcctaattctgagtgtggtgctggaactttcatggctaatcattttgaccgtcactactgcggtaagtgtggtttgacttacgtttaccagcaagctggacaagagtaagtcgtggttactctttagtaatatttagttttgttaagagggtttcttatttggttgtttttagggatttaaagaattttcttgttggttaatttcaatttcagcaccttttatgataagatattatgtnctttttttgttaaatggagnttattattatgactca

SEQ ID NO: 2373 - DNA, 689 bp, Rhizophora mangle
gaccgcgctttctaatatctctgcctcgggccgccactcttgggctctctgcaacgatgcagatcttcgtgaaaaccctaacggggaagacgataaccctagaggttgagtcgtccgacaccatcgacaatgtgaaggccaagatccaggacaaggaaggcatcccgccggaccagcagcggctaatcttcgccggaaagcagctggaggacgggcgcaccctcgccgactacaacatccagaaggagtcaacccttcacttagtcctccgcctccgcggcggcgccaagaaaaggaagaagaagacctacaccaagcctaagaagatcaagcacaagaagaagaaggtgaagctcgccgtgctccagttctacaaggtggatgattccggcaaggttcagaggctcaggaaggagtgcccgaacgctgagtgcggtgccggaacctttatggccaaccacttcgatcggcactactgcggcaagtgtggcttgacttacgtttacaataaagccggcggcgattaggcttctttcaatggttatttttaagttttggcaccttgtgtgtgtgtgtgtgttgatttcagattgggattagacttgctggaattttatgtcttgaagtatccaaattttgttggttaagctgcttggattgattaatggattgttaactcttgctattcg

SEQ ID NO: 2374 - DNA, 740 bp, Solanum phureja
acactctcattccatcaacaaagaaaccctaaaagccgcagcgccactgatttctctcctccaggcgaagatgcagatcttcgtgaaaaccctaacggggaagacgatcaccctagaggttgagtcttccgacaccatcgacaatgtcaaagccaagatccaggacaaggaagggattcccccagaccagcagcgtttgattttcgccggaaagcagcttgaggatggtcgtactcttgccgactacaacatccagaaggagtcaactctccatctcgtgctccgtctccgtggtggtgctaagaagaggaagaagaagacctacaccaagccaaagaagatcaagcacaagaagaagaaggttaagctcgctgtgttgcagttctataaggtggatgatactggaaaggttcagaggcttcgtaaggagtgccctaatgctgagtgcggtgctggaacttttatggctaaccatttcgaccgtcactactgtggtaagtgtgggctcacctacgtttacaacaaggctggaggcgattgattttaatgtttagcaaatgtcttatcagttttctctttttatcgaacggtaatttagagtttttttttgctatatggattttcgtttttgatgtatgtgacaaccctcgggattgttgatttatttcaaaactaagagtttttgcttattgttctcgtctattttggatatcaatcttagttttatatcatttctagtt

SEQ ID NO: 2375 - DNA, 941 bp, Nicotiana tabacum
ggccattacggccggggattcacagcaaagaagaaaccctaacgccgcagtgctcatcgagttctttcctccaaagcgaagatgcagatcttcgtcaaaaccctaacgggtaaaacaatcacccttgaggttgaatcttccgacacaatcgacaatgtgaaagccaagatccaagacaaggaaggaattcccccagaccagcagcgtctgattttcgccggaaagcagctcgaggacggccgaaccctagccgattacaacatccagaaggagtcgactcttcatctcgtgctccgtctacgtggtggtgctaagaagaggaagaagaagacttacactaagcctaagaagattaagcacaagaagaagaaggttaagctcgctgtacttcagttttacaaggtggatgattctggaaaagttcagaggcttcgtaaggagtgtcctaatgctgagtgtggtgctggaactttcatggctaaccactttgaccgtcactactgtggtaagtgtgggctcacctatgtttacaacaaggccggcgccgattgatccctatgtttagctctgttttaatgctctcgtcaattttatctttttgtcgaacggtaatttagtatggattttccctttaaaattatgtggcaaccttgggattgttgagttatttaacagtttttgcttattgttaaagttttagattattatctcaatttttatatccttaattatctactttatatgggagtgctccacatattagcgactttggtgcggtgtaatatgctctcaaggccttgtgtgttagaaaatgtatgcatttttaggagtttgatatttcacagttttattcatagccttttatactcggatggggttgtaaatgaacccaatctaaaatagaaaattgggctcacctatgtttacaactaagccggttc

SEQ ID NO: 2376 - DNA, 689 bp, Nicotiana tabacum
gaagctaaaggcgagaggcggctgacaaaccctaatcccattttgctatcgaacagcgaagatgcagatcttcgtgaaaaccctgacgggtaagaccatcacccttgaggtcgaatcctccgacacaatcgacaacgtgaaggcaaagatccaggacaaggaaggcatcccaccggaccagcagcggctcattttcgccggaaaacagctcgaggatggtcgaactctagctgattacaacatccagaaggagtccactctccatttggtgctccgtctccgtggtggtgctaagaagaggaagaagaagacttacaccaagcctaaaaagatcaagcataagaagaagaaggttaagcttgctgtgttgcagttttacaaggtggatgattctggaaaagtccagaggcttcgtaaggagtgtcctaacgctgagtgtggtgctggtactttcatggctaaccactttgaccgtcactactgtggtaagtgtggcctcacttacgtttacaacaaggccggcgccgactgattcttctatttagcccatgtttttgtgatgtcgtggattttctctatattctagaaccgtattttgtagttatttggaaacttcagtaaacagtatttgctggattgttctcagttttggattatcaaagtgaaatttatattcctattttatcctc

SEQ ID NO: 2377 - DNA, 668 bp, Nicotiana tabacum
caaagaagaaaccctagcgccgcagtgttcctcgagttctctcctccaaagcgaagatgcagatcttcgtgaaaaccctaacgggtaaaacaatcacccttgaggttgaatcttccgacacaatcgacaatgtgaaagccaagatccaagataaggaagggattcccccagatcagcagcgtctgattttcgccggaaagcagcttgaagacggccgaaccctagccgattacaacatccagaaggagtcgactcttcatctcgtgctccgtctccgtggtggtgctaagaagaggaagaagaagacttatactaagcctaagaagattaagcacaagaagaagaaggttaagcttgctgtgcttcagttttacaaggtggatgattctggaaaagtccagaggcttcgtaaggagtgtcctaatgctgagtgtggtgctggaactttcatggctaaccactttgaccgtcactactgtggtaagtgtgggctcacctatgtttacaacaaggccggcgccgattgatccctatgtttagctctgtttaaatgctgtcgtcaattttatctttttgtcgaacggttattttgtatggattttccttttaaaatgatgtggcaaccttgggattgttgagttatttaacagtttttgcttgttcttaaa

SEQ ID NO: 2378 - DNA, 779 bp, Triphysaria pusilla
cctaaatcccctgaacacacctccgccgcgaagatgcagatcttcgtcaaaaccctaacgggtaagacgatcactctcgaagtcgaatcctccgacacaatcgacaacgtcaaggccaagatccaggacaaggaaggcatcccaccggaccagcagcgtctcatcttcgccgggaagcagctcgaggacggccgcacccttgctgactacaatatccaaaaggaatcgactctccacctggtcctccgtctccgcggtggcgcgaagaagaggaagaagaagacgtacacgaagccgaagaagattaagcataagaagaagaaggtgaagctcgcggtgctgcagttttataaggttgatgattctggaaaggtgcagaggctgaggaaggagtgcccgaatgcggagtgtggagctgggactttcatggcgaatcactttgacaggcactattgtggtaagtgtgggcttacttatgtttacaataaggctggtggagattaagtgttgggagcttagtttctggctgatggttttttaaatgtttatgaacaatttatatcatgacaatcgtttagttttttgtgttatggatttttgtttaagtactgttatggaagtttgtttttgaatgatcgtttttatttgagattttgtcatttgctttggttttgaaactggtgtatgattgtttggtgtttctgacattttagaactgtttgttattatgcataaacagctttgatgaatgtggattgtgcttagagaccaaaaaaaaa

SEQ ID NO: 2379 - DNA, 956 bp, Brachypodium distachyon
gaagatgcagatcttcgtcaagacgctgacgggcaagacgatcacgctcgaggtcgagagcagggacaccatcgacaacgtcaaggccaagatccaggacaaggaaggtatcaccccggaccagcagcgtctcatcttttcggggaagcagctggaggatggccgcaccatggccaaatacaacatccagaaagagtccacgcttcacctggtgctgcgcctctttggcgggatgcagatcttcgtgaagaccctcacgggtaagaccatcacgctggaggtggagtcctcggacaccatcgacaacgtgaaggccaagatccaggataaggagggcatcccaccggaccagcagcggctcatcttcgccggcaagcagctggaggacggccgcaccctcgccgactacaacatccagaaggagtccacgctgcacctggtgctccgactgaggggaggcgccaagaagcgcaagaagaagacctacaccaagcccaagaagcaaaagcacaagcacaagaaggtgaagctcgccgtcctgcagttctacaaggtcgacgactccaccggcaaggtcacccgcctccgcaaggagtgccccaacgccgactgcggcgccggcaccttcatggccaaccacttcgaccgccactactgcggtaagtgcggcctcacctacgtctacaaccagaaggcgtaggctgatctgctcggatcttctcttctcttggagaagaagaaaaacaaagttttcgctagatggttaattttctgcctgtcgtattaaagtagcattttggaacagaacccctgcatctctgttggttaattttgtgcctgtcgttttaatatcgtgttatgatggataatgtcaagtgctgttgaatccgaatgatgttcgagttattcgtttttgttctatatacttaaatcaatgcgatcgttttcatctgatc

SEQ ID NO: 2380 - DNA, 2506 bp, Zea mays
caagcatacgacgatacgagtcatcacatgctaaacaaaacgaatagcgacatgtatccgatcgattgcacacagtaattcgcaaattaattcaggggccgagaatggcatcataaaaacatagtacaagattaattcaaaaaccattcgaattcaacagtgcttgacaggacccataacaacatgatataattaaacccaaactacgcgtcgccaaaagagatacaggtgttctgttccaagaaactactaccattgcaacaaaacaaaacaaagcaaaaaggattatcacctagcaagacttcccattttccttcccgacagaaaggaggggcatcctacgcctgctggttgtagacgtaggtgaggccacacttaccgcagtagtggcggtcgaagtggttggccatgaagacccccgcgccgcactcggcgttggggcactccttgcggaggcgggtgaccttgccggtggcgtcgtcaaccttgtagaactggagcacggcgagcttcaccttcttgtgcttgtgcttgatcttcttgggcttggtgtacgtcttcttcttgcgcttcttggcgcctcccctgaggcggagcaccaggtgcagcgtcgactccttctggatgttgtagtcggcgagggtgcggccatcctcgagctgcttgccggcgaagatgaggcgctgctggtccggcgggatgccctccttgtcctggatcttggccttcacgttgtcgatggtgtccgaggactccacctccagcgtgatggtcttccccgtcagggtcttcacgaagatctgcatcttggcaaccgcgcacttctccggcggcggccgccctaacctaaggtggcgctggttctcgcctgcggcggcgggatggggctgtgtgtgtatgggcggaggctagggttcaagaggggagagatgattcttttatagctcgggtcgggtgctctctcccactggatccaaaaggatttggatcggacggcacatatgggcctcctgtgatgagagttgggccgcatgcgcttcattttctaatcccttttgtgttcccccggaggttggtttgggcctcgtaacttttgtgccccagttcgtttatcctctcctctctctttctctgtcttgctgcggcgacacctccgcttccgccggccgagtccggagcggagccgaagcaacaaccgccggggaggcgagggattgattcggagatggcgtcaactagctctataggcgacgtgggagcctcagggtcaaaaggggttgcatgtaaaacatttcctgcttctgcaaataccagtagctcacaccaagagtctcataatgttgatgcaaaatcacgtgtggaggatgtttggaagaagatgaatggtggctttcctaataagatgcccaaacctgcaatgacgaagctcagttcaacagcaacagaaaagaaaaataagccaacaaataattggatgactgttctaggcctctcaccaagtaaggcatgtaattccagtcaaggatcaaaaaatggtctaaaatggacacaacatgaaacgagagaggatgccaaaaaacttgcagcaaaggcccttgcagctgccaaaaatgccgctgctgtggcatctggacgagggaaagtggagatcactgaggtaagggactttgctgtcaaggacatcgaaatcaagaaattggttgatcctaattcgaaggaggcaatagagaaggccaaggcagctggtgccgccccatcagctgtcgatagcattctagagcaaatacggaagaagcagaagctgagcgtcctggacaagacgaagaaagactggggagagtacaaggaagaaaaccgaggcttggaggaagagctggacgcctacaagaagagctcgaaccagtacctcgacaagcaatcattcctgcagcgaactgattaccgcgagtttgagcgcgagcgggatgcccggctgtccatgatggccaaacggaggaccgatatgcgggaggacgatgtgaagggtccattgaccggaactgccttcgacccgcttcatttgccaactggtgttccagtgcctatgtgtttttgtggtaatccttgcaaggttgacaagtctgaggatcatgacacgtatcgacaaaagtattggatgtgtgctaactatgcatttgagccaatgattgttcagcgccggatgaatttaatgactcctccaccactctgtgattttgagcagtggattgacacagaaatctcacagaaagacaaaaagtggttggagaatcttaagaagtgggacgcggaggacaaagaaaggatagagaaaagacgagaggagcttgctgccgagcaacaatgggtagacgagcaggaaatgaggcgtgttgttgaatacagggagaaggagaagaagcttgagcgtgcacgtcgtgcaaaggacgcagtggaggagaaccctgatgcttttcgcaagggcaaatggcctcattgcatgcagtag

SEQ ID NO: 2381 - DNA, 2459 bp, Ceratodon purpureus
ggcacaagtatattccagagtagacaagcaactcaatgtaaaagtgaagtaatagagtcgccatgcacatgaataacgccttctaccaagccaaaaaaaaggacgaagaaagttcttattgcaattcaatcaatgaactcaaaactttactcacatgatctccgaaattacaaaatcatttgaagtaaatactgcctcgactagcacctgcactcggaacatatctcacccaccctcaaaagcgacttccacaaccccccaaaaaggcgccggcactctctaagcctcagccttctggtacacgtacgtcaacccacacttcccgcagtagtggcggtcgaagtggttggccatgaaggttcccgccccacagtcggggttggggcactccttcctcagccgctgcacctttccgctgtcgtccaccttgtaaaactgcagcacggcgagcttcactttcttcttcttgtgtttcagcttcttcggcttggtgtaggtttttttcttcctcttcttcgcaccaccacgcagcctcagcaccaggtgcagcgtcgactccttctggatgttgtaatccgcaagagtccgcccatcctcgagctgcttgcccgcgaagatcagcctctgctggtccggggggatcccctccttgtcctgaatcttggtcttcacattgtcgatcgtatcagaagactccacctcaagggtgatcgtcttgcccgtcagggtcttgacgaagatctgcatggctgcgaggcccttcctccggagggctcagcagcagtgggggtggtgcgtcgtcgccgggagagtttttccgtgactgcgatttgggattgaagctcggtgaaggaagtggaaattttctgcgatctgagataagcttggggtttggcgtggacaaccatggcgggccttacccattcgctgcgtttgagcgccttggatcaagcagtgacagcgtccggggagcttttcaaacaatcgcggcaacatgatcaaaggtgccgcctgccccggagccagcgagtaatggtgcgagctgcatcggagggtccagatttgagtgtcgttgtaaatggtctgaagttgccgaacccatttgttataggatcagggccaccgggcacgaactacactgttatgaagcgtgcatttgatgaaggatggggtggtgttattgctaaaacagtgtcactggattcgtctaaggtggtgaatgtgaccccgcgctacgctcgtttaaaggcatctgcagttgctgggaccaaagctgaggtcattggttggcaaaatattgagctcattagtgaccgcccatttgagaccatgcttgctgaaatgaaacaacttaaggaggagtaccctgaccgtatccttattgcatccattatggaggaatataaccgtgacgcttgggaggagatcattgagcgtgttgaagaaaccggtgtggatgcctttgagataaacttctcatgtccgcatgggatgccagagaggaagatgggtatggctatgggacaagattgttctgttttgggagaggtttgtggctggatcaacgccaaggctactatacctgtctgggctaagatgacgcccaatatcacggacattacccagccagcacgcacagccttgcatgcaggttgtgagggagtagcagcaattaacacaatcacgagtgtcatgggcattaacctcgatacgttacgacctgagccttgtgtagaagggtactcaacacctggtggctactcatccaaagctgtgcgtccaattgcgttggccaaggttatgtccatcgcgcaaatgatgaaggccgagtttccgggtcaagataaatctttgtctggtatcggaggagtggagacaggcaaccatgctgcggaattcatacttcttggggccagcactgtgcaagtatgtactggcgtgatgctgcacggttatggtcatgttaagcatctgtgtacagaattacaagcttttatggacaaacatgggttcacttctattgaagattttcgaggggtatccttggagtacttcacaacgcacgcggatttagtacaacgacagaaagaggcaaccgagaataaaaagaaggtgcgaaagggtctggcatcggacaaggactggaccggggagggctttgtaaaggagactgaaaccatggtatcgaactgacgttattttacctcagttgccatgtgggcgttgaaccaagtgtcattcataaagcaactgatgaagttttaactgaaagttgccaacagtgatgagtcaaaattgtgaattagtgtaaagatcttatgtctattttttagaaatgagaaggatggtctacagccaagaattaggttcattgtcatacttgtgcactcaagatagtgtacaaacttctgtctgtatatcattattttaatggatcgttgtacatttctttgcatcaa

SEQ ID NO: 2382 - DNA, 619 bp, Senecio madagascariensis
aaagacaagtaggtaatacaaacgcagagtacgcggggacacaaaaaaaagaaaaaaatgcagattttcgtgaaaactctcacagggaagacaatcactctcgaggtcgaatcctcggacaccatcgacaatgtaaagacaaaaattcaagacaaagaaggcatcccacccgaccaacaacgtctcatcttcgccggcaagcagctcgaagacggccggacactcgccgactacaacatccagaaggagtccactctgcacctggtacttaggctcagaggtggggctaaaaaaggaagaagaagacatatactaaacctaagaaaatcaaacataaacataggaaagtgaagctgtcggtgttgcagttttataaggtggatgattccggcaaagtgcagaggttgagaaagcagtggtatcaacgcagagtgtggggccgggacgtttatggcgaatcattttgatagacattattgtggtaagtgtggtttgacatatgtttatcagaaagcttaattgattattgttataagtttggattatttttatatgttttgatacaaatgtttggattatttgaggttgtttatggatttataaagttttgaatcatttg

SEQ ID NO: 2383 - DNA, 536 bp, Thalictrum flavum
cacaaaccctagaaacagagccgaaggagagaggaaggaagaagagcgagtgtttgtggtgtgatctgatctgaagcgaagatgcagatcttcgtgaaaaccctaacagggaagacaataaccctagaggttgaatcatctgacacaatcgacaacgtgaaggctaagatccaagacaaggaaggaattccaccagatcaacaaagattgatttttgctggaaaacaacttgaagatggaagaacacttgctgattacaacattcagaaagaatcaacacttcatttggttcttcgattgagaggtggagctaagaagaggaagagaagacttacactaagccaaagagatcaagcataagaagaagaaggttaagcttgctgtgttgcagttttacaaagttgatgattctggaaaagtgcagaagctgaggaaggaatgtcctaatgctgagtgtggtgctggaactttcatggctaatcattttgatcgtcattactgtggtaagtgtggtcttacttatgtttaccagaagg

SEQ ID NO: 2384 - DNA, 770 bp, Medicago truncatula
gatactcccaaactttatccaggagcccatcaaggttccactccaggtgtgcactgacagggcagtaatgaggaagcttatccaagatctccagttcctcaagtgtaatctgatcaatcttgttcacaacatagatgcatggtgcagcaaccaacgaagcaagatgcagatcttcgtgaaaaccctaacagggaagacgataaccctcgaggttgagtcttccgacacaatcgacaatgtcaaagccaagatccaggataaggaaggaattccacctgaccagcaacgtctcatcttcgccggaaagcagttggaagacggacgcactctcgccgactacaacatccagaaggaatccactcttcaccttgtcctacgtcttcgtggtggcgctaagaagcgtaagaagaagacctacaccaagcctaagaagatcaagcacaagcataggaaggtgaagcttgctgttcttcagtttataagttgatgattctgtaagtgcagaggttgaggaaggagtgtcctaatgctgagtgtggtgctggaacttttatggctaatcattttgatcgtcattattgtggtaagtgtggtcttacctatgtttaccagaaggcggaagcttagattcaatgttcatgatgatgttctagtgtttctgttttgttattgttgttgaacttttatgttcagttcggtttaattagcttcgtttggaaaacaattattatatgttctagttgaatatccaatacaattttgtgcgtttg

SEQ ID NO: 2385 - DNA, 761 bp, Quercus alba
cgaatcgcagaaccaagcaaccatgcagatcttcgtgaagaccctaacggcaagaccatcacctcgaggtcgagtcctcagacaccatcgacaatgtgaaggccaaggtccaagacaaggaaggaatcccgccggaccagcagcgcctcatcttcgccggaaagcagctcgaggacggccgcaccctcgccgactacaacatccagaaggagtcgaccctccacctcgtgctccgcctccgcggcggcgccaagaagcgcaagaagaagacctacaccaagcccaagaagatcaagcacaagcacaagaaggtgaagctcgcgatccttcagttctacaaggtggacgattccggaaaggtccagaggcttcgtaaggagtgccctaactctgagtgcggcgctggaactttcatggcgaaccactttgaccgtcactactgtggcaagtgtggcttgacctatgtgtaccagaaggctggtggtgattaggttttatgttttgtttttttttgagttataatatgttttaattttgaaaatagcggatgatatggatctgaactactaggttgtgttgttttttttcctgaattttctggatgattatcgtactattattcgacttaatagttttgttgggattttgcttgattatctgtttggtttggtgtttttaatttctttgttattttaatttgctattgattttgctatcttaaattgaatttataggattgtgttgttgtagtgtgatattgc

SEQ ID NO: 2386 - DNA, 787 bp, Elaeis guineensis
  misc_feature (40)..(40): n is a, c, g, or t
  misc_feature (49)..(49): n is a, c, g, or t
  misc_feature (135)..(135): n is a, c, g, or t
  misc_feature (562)..(562): n is a, c, g, or t
  misc_feature (578)..(578): n is a, c, g, or t
  misc_feature (583)..(583): n is a, c, g, or t
acacgtcttaccataccccttgccgctgcaggccctgctnggctgctgncaccatgcagatcttcgtgaaaaccctcacggtggaagacaatcacccttgaggtggagtcttccgacacaatcgagaacgtcaangccaagatccaggacaaggagggcatccccccagatcagcagcgcctcatcttcgccggaaagcagctcgaggatggccggaccctcgccgactacaacattcagaaggagtccaccctccacctcgtccttcgtctccgcggcggcgccaagaagcgcaagaagaagacatataccaagccaaagaaaatcaagcacaagaagaagaaggttaagctcgccgttctccagttctacaaagtggatgactctggcaaggtcacccgcctcaggaaggagtgccccaacgccgagtgcggtgccgggaccttcatggccaatcacttcgatcgccactactgcggcaagtgcggcctgacctatgtctatcagaaagccggaggcgagtaagtgagctagacttctctcgatctcatctcaatctgtnttctagcaataggganagganagatgggatcttgtagagagaggcactaaaaggtcgtttctttttttgggtttatatggtattagagattttggttttatgttggtttgttaaaaggttatgacttggaacaccagttggtctggtttctgacctggttcttaatgtttgatgaattttgtcatttacgaaatatggatgattatgaaaagatttggtttttaa

SEQ ID NO: 2387 - DNA, 550 bp, Salvia sclarea
ctactagaccttggctgtcactcagaatcccatttcctcccccctccaaaccctagcgtctccgcctctgcaatcggcctctcctccgccgcgaagatgcagatcttcgtgaagaccctcacgggcaagaccatcaccctcgaggtcgagtcctccgacaccatcgacaacgtcaaggccaagatccaggacaaggaaggcatcccgccggaccagcagcgcctcatcttcgccgggaagcagctcgaggacggccgcaccctcgccgactacaacatccagaaggagtccacgctccacctcgtcctccgcctccgcgcgaagaagcgcaagaagaagacctacaccaagccgaagaagatcaagcacaagaagaagaaggtcaagctcgccgtgctgcagttctacaaggtcgatgattccgggaaagtgcagaggctgaggaaggagtgccccaacgcggagtgcggcgccgggacgttcatggcgaatcattttgacaggcattactgtgggaagtgtggattgacctacgtctacaacaagaccg

SEQ ID NO: 2388 - DNA, 764 bp, Amsonia hubrichtii
gtctgagcaagccgcaaccaagacagacagagggagaagaaagaagaattcgcgaagatgcagatcttcgtgaaaaccctaacgggtaagaccattaccctggaggtcgaatcctccgacaccattgacaatgtcaaggctaagatccaagataaggaaggcatcccacccgatcagcagcggctcatcttcgccggtaagcagctcgaggatggcagaaccctagcggattataacatccagaaggagtccaccctgcacctggtcctccgcttgcgtggtggcgccaagaagaggaagaagaagacctataccaagcccaagaagatcaagcataagaagaagaaggttaagctcgccgtcttgcagttctacaaggtcgatgattctggtaaggttcagaggcttaggaaggagtgtcctaatagtgagtgcggcgccggtacctttatggcaaaccatttcgaccgtcactactgcggcaagtgtggcctcacttacgtttacaacaaggccggcggagattgatctttatctcatcaccagtcgttagttttgccttttcttcgtatgggtttactttcgcttcgttgaagcaaatacatgtttaagaccttttgaacttagttactaaaatagttatttgctggattactttcaattttgcaatcgttatcattttatgttcattttatccccacaaaatctccgttatcctcgatccttaactttatatatgcagtgctttcttaaatatttgtgct

SEQ ID NO: 2389 - DNA, 751 bp, Catharanthus roseus
aaacccattcgtcctcaggcagctgcgttcccaaaaatgcagatcttcgtgaaaaccctcacggggaagactatcacccttgaggtcgaatcctcggataccattgacaatgtcaaggccaaaattcaggacaaggagggcatcccaccggaccagcagcgtctcatcttcgccggtaagcagctcgaagacggcagaactctagctgactacaacatccagaaggaatccacccttcaccttgttcttcgcctccgtggtggcgcaaagaagcgtaagaagaagacctacaccaagccaaagaagatcaagcacaagaagaagaaggtcaagctcgctgttcttcagttttacaaggtagatgacgctgggaatgttcagaggctcaggaaggagtgccccaatggcgactgtggtgcgggtactttcatggccaatcattttgacaggcactattgcggcaagtgtggcctcacctatgtttaccagaaggctggcggcgattaaatgcccgtacttttttgctaaaattcagtagttttaattaagacttttagaacatttggtttactgccatggattttttatagctcgaaacttattggtttttgtcttatggattttactctagaaatgtctattttctgactccatatgcattttatattgatattgcaatattctcttgctataattgtgatgttgcctttcctttagctcttaggcatgtgttttgtacatagtgaattgt

SEQ ID NO: 2390 - DNA, 890 bp, Gossypium hirsutum
ggattgggaaattagtgaggtggtggaagatggatttgagagacaccgggcagcagcctgcttggcacccattttgaaaccctagccgaccccccgccccaattctctgcatcgtcacctccacatcaagatgcagatcttcgtcaaaaccctgacggggaagaccataaccttagaggttgagtcctccgatacaatcgacaacgtcaaggccaagatccaagacaaggagggcatcccacccgaccaacagcgccttatcttcgccgggaagcagctcgaagacggccgcaccttagccgactacaacatccagaaggaatccactctccacctcgtcctccgtctcaggggcggcgccaagaagaggaagaagaagacctacaccaaacccaagaagatgaagcacaagaagaagaaggtcaagctcgcagtgctccagttctacaaggtggatgagtccgggaaggttcagaggctgaggaaagagtgtcctaatgcggagtgtggggccgggactttcatggctaatcattttgataggcactattgtggtaagtgtgggctcacttacgtttaccagaaggctggtggagactgagtagcgtccggctccaccttcagtaaaaaaaaaagaatcaatagttcatttttatcagtatgagtagcattaatattcataatatttggacctttttatttatttctaatgttatgatactttggatatgattttcgacttctgcttaccaatttgaattgaattatgggtttttctacttgtttttgtttgactgatgacctttgtatatgctttatttatgttattttgggctcggtggattggtgaatttggatatttccaagcaccgtgaatcattttatctaat

SEQ ID NO: 2391 - DNA, 999 bp, Distylium racemosum
ataattcttgtttttgatgcaacttcagaggaaacattcttgcgtaaccattcacgtactgctacatgcacttcctgagcttgatcaggagtggcaactttccctgtaccaatggcccagacaggttcatatgcaataaccacatcgtcccagcttggcatggcttcagtgaatgcttttagttgctcatagcagacatcaaaagtctttcctgcttctcgctcttctaatttttctcctatgcatgcaatcaccttgagaccctggctcaatgcataggcagctttttttccaataaactgattattctctccaataacatgcctccgctcagaatgagggataccgatttctggcggcgacgaaggaagagtctggagctgcgcagttgtattccctgcgatctcacaacttcgattacctcgctagctcgcaacaatgcagatattcgtcaaaacactgactggcaagacaattactcttgaggtagagtcctctgatacaatagataatgtgaaggccaagattcaagataaggagggtattcctcctgaccagcaacgattgatttttgccggcaagcagctggaggatggaagaactttggctgattacaatattcaaaaagagtcaactttacaccttgttcttcgcttgaggggaggtgcgaagaagaggaagaagaagacctacacaaaaccaaagaagatcaagcacaagaagaagaaggtaaagttggctgtgttacagttttacaaggttgatgactctggtaaggtgcagaggttgaggaaggaatgtcctaaccaggagtgtggtgctggcacgtttatggcaaaccattttgaccgtcattattgcggaaagtgtggatgtacttatgtctaccaaaaggctggcgctgagtaatttgtgtttagtagttatttgcattgaaattaacttaacgaggacagatagatatatatatatatatatatatatatattttggtttagg

SEQ ID NO: 2392 - DNA, 523 bp, Euphorbia peplus
ggcacgagggaagaaccctaatccctctctgcaattatgcagatcttcgtgaaaaccctaacgggtaagacaataaccctcgaggttgaatcctcagacaccatcgacaatgtgaaggctaagatccaggacaaggaaggaatcccaccggaccagcagcgattgatcttcgccgggaagcagctggaggacggccgcactctcgccgactacaatatccagaaggagtccactcttcacttggtgcttcgtcttcgcggtggagctaagaagaggaagaagaagacatacatcaagccaaagaaaatcaagcacaagaagaagaaggtcaagctagctgtgctccagttttacaaggttgatgattctggaaaggttcagaggttgaggaaggagtgccctaatgctgagtgtggagctggaactttcatggctaaccattttgataggcactactgcggcaagtgtgggttgacctatgtttacaacaaggctggtggagattaggttatttctgatgcga

SEQ ID NO: 2393 - DNA, 625 bp, Euphorbia peplus
taaccctcctctgcatcatgcagatctttgtgaaaaccctaacggggaagacgatcaccctagaggttgaatcctcagacaccatcgacaatgtcaagtccaagatccaggacaaggagggaatccctcctgaccagcagcgcttgatcttcgccgggaagcagctggaggacggccgcactctcgccgactacaacatccagaaggagtccactcttcacttggtgcttcgtcttcgtggtggagctaagaagagaaagaagaagacctacactaagccaaagaagatcaagcataagaagaagaaggtcaagctcgctgtgctccagttttacaaggtcgatgactccgggaaggtgcagagattgcgcaaggagtgcccgaatgcagagtgtggggccggaactttcatggccaaccattttgataggcactactgcggcaagtgtggattgacttatgtttacaataaggctggcggcgattaggtttcttttaattcgcttttgttttgttatattggatttggtaaattttaagcttggtactttttgcctaatcttcaatacctaagtgttggaatgttgtttttttggatggatatttatagctggattttgatgtt

SEQ ID NO: 2394 - DNA, 663 bp, Euphorbia peplus
gatgcagatcttcgtgaaaaccttgacggggaacccgatcactctcgaggttgagtcctcagatacgatcgacaatgtgaaggccaagattcaagacaaggaaggaatcccgccggaccagcagaggctcatcttcgccggaaaacagctggaagacgggaggactctcgccgattacaacatccagaaggaatcgactctgcatctggtgctccgattgagaggaggcgcgaagaagaggaagaagaagacctacaccaagccgaagaagatcaagcacaagaagaagaaggtgaagctcgctgttcttcaattttacaaggtcgatgatagcgggaaggttcagaggctgaggaaggagtgcccgaacgccgagtgcggcgccggaacttttatggcgaatcattttgataggcactattgtggtaagtgtggtctcacctatgtttatcagaaagccggcggcgactgatttttcaggttcaattatggtttgatattttgagaattgtcgttttaatttacagacttgttagttttgtttttgtatcttgtttggatgcaaattatggatgattagctgtttacatttacttattgttcatgaaccatgatgatgtttgattgaagttcatttatattaactattaagcataaaggatc

SEQ ID NO: 2395 - DNA, 669 bp, Plantago ovata
tgaaaccctaacagcagccgcagccactgatctccgaagatgcagatcttcgtcaagaccctcacgggcaaaaccatcaccctcgaggttgaatcctcggacacgatcgacaatgtgaaagctaagatccaggacaaggaaggcatcccaccggaccagcagcgcctcatcttcgctggaaagcagctggaagacggccgtaccctcgctgactacaacatccagaaggagtcgactctccaccttgtgcttcgcctccgtggtggcgcgaagaagaggaagaagaagacctacaccaagccaaagaagatcaagcacaagaagaagaaggtgaagctcgctgtgctccagttttacaaggtggatgactctggaaaggtgcagaggttgaggaaggagtgccctaacggtgagtgcggtgctggaactttcatggccaatcattttgataggcattactgtggtaagtgtggccttacctatgtctacaataaggccggtggagagtaatttgctatgatggattagggtttattatcagcttttatgactcttttaaaatatgctgctggatatttgtcgtcttcgtcttgtatgaacggttttgattatctggttcttattactagtgaatgaattttgtttgagacctctgttttgttaaattct

SEQ ID NO: 2396 - DNA, 770 bp, Platanus occidentalis
gtcggatctgcaagtcctgcagccatgcagatcttcgtgaaaacccttacggggaaaaccataaccctcgaggttgaatcctcagacacaatcgacaatgtaaaggcgaagatccaagacaaagaaggcattccaccggatcaacagcgattgatcttcgccggaaagcaactcgaagacggccgaacccttgctgattacaacatccagaaagagtcgacgcttcatctggttcttcgactcagaggaggggcgaagaagcgaaagaagaagacctacacgaagcccaagaagatcaagcacaagaagaagaaggtgaagctcgctgtgttgcagttctacaaggtggatgattccgggaaggttcagaagctgaggaaggagtgccctaatcaggagtgcggagcggggacgttcatggccaaccattttgatcgacactattgcgggaagtgtgggttgacttacgtttaccagaaggccggaggggattagaattgttcttggtaggactatgaactcttttggtttcttttattagtctttggattcttaaggttggaatttttgctttgtagacgagcatatattgggattttgattggtatggctgttttttttttgctggatttctggagagttaacgaaagaattttaataatatcttctcgatctatcagtttgaaattcgatggtctgaattttttgattcttgactgtattataataaatccataaatcaataggtttgtctctgatattgtgtaacg

SEQ ID NO: 2397 - DNA, 685 bp, Platanus occidentalis
ggacctgcaaccctgcaactatgcagatttttgtgaaaaccctgacggggaaaaccataacccttgaagtagaatcctcagacactatcgacaatgtgaaggcgaagatccaagacaaagaaggcatcccgccggatcaacagcgccttatcttcgccggaaaacagctcgaagacggccgaaccctggccgattacaacatacagaaggagtcgacgcttcaccttgttcttcgactcagaggaggggccaagaagcgcaagaagaagacctacacgaaacccaagaagatcaagcacaagaagaagaaggtgaagctcgctgtgttgcagttctacaaggtcgatgattcggggaaggttcagaagctgaggaaagagtgccctaatcaggagtgcggagcggggactttcatggcgaaccattttgatcgacattattgtggaaagtgtggattaacttacgtttaccagaaggccggaggggaatagagttgttcttggtaggattatgaaccctcttggtttattttctatacgctttcggattcttaagttggaattttggctttgtaggggaccaaatttggggatcttggctgtttttggatatatctgattatggaatttatgttttggctataaaattttacttgtctttttcgtatctcgatttgaatcttgac

SEQ ID NO: 2398 - DNA, 646 bp, Platanus occidentalis
ttcgtcgtgtctgcagctctctgcagtcatgcagatctttgtgaaaaccctaacggggaaaaccataaccctagaggttgaatcctcagacaccatcgacaatgtgaaggcgaagatccaggacaaagaaggcatcccgccggatcagcaacgcctcatcttcgcgggaaaacagctcgaagacggccggacccttgcggattacaacattcagaaggagtcgacgcttcacctggttcttcgtctcagaggaggagcgaagaagcgaaagaagaagacttacacgaagcctaagaagatcaagcacaagaagaagaaggtgaagctcgctgtgcttcagttctacaaggttgatgattccgggaaggttcagaagctgaggaaggagtgccctaaccaggagtgcggagcggggacgttcatggccaaccactttgatcgtcactattgtgggaagtgtgggttgacttacgtttatcagaaggccggaggggattaaagttgtgcttggtatgattatgaatccttttggcatcttttatagatcttttgattcttaagttggaattttgttattttaggagagcatcttttgggattttgatatgaaatggctgtttttgaatgtatctgatacttgaatttt

SEQ ID NO: 2399 - DNA, 663 bp, Silene vulgaris
gcagatcttcgtgaaaaccctaacagggaagacgataaccctagaggtagaatcctcagacacgatcgacaatgtgaagacgaagatccaagacaaggaaggaatcccacctgaccaacaacgcctaatcttcgcaggaaagcagcttgaagatggacgaaccctagcagactacaacatccagaaggagtcaacacttcaccttgtcctccgccttcgtggtggtgctaagaagcgtaagaagaagacttacaccaagcctaagaagattaagcataagcataggaaggttaagcttgctgtgttgcagttttacaaggttgatgacagtgggaaagtgcagaggttgaggaaggaatgccctaatgctgaatgtggtgctggtacttttatggctaatcattttgataggcattattgtggtaagtgtggtcttacttatgtttatcagaaggctggtggtgattaagcttgttttggagtaatgttttgttttgtttcgtttcggtttggattcgtactggtttttgtttgtcagattaattaatgctagtttactagccctgaacttcgttttattcagattaatggatgaattgttatgacttaatttcgaatcttatgttgttttcaaatgtttagtttggtattttctgtattttt

SEQ ID NO: 2400 - DNA, 508 bp, Silene vulgaris
atcttcgtgaaaaccctaaccggaaagaccataaccttagaggtcgagtcctctgacaccatcgacaatgtcaaagccaagattcaagacaaggaaggcattcctccggaccaacagcgtctcatcttcgctgggaagcagctcgaggacggcagaactctagccgactacaacatccagaaggagtcaaccctccaccttgtccttcgccttcgtggtggcgccaagaagagaaagaagaagacctacaccaaacccaagaagatcaagcacaagaagaagaaggtcaaacttgccgtcttgcagttttacaaggttgatgattctggaaaggttcagaggttaaggaaggagtgtccgaatgccgagtgtggagctggaacattcatggctaaccacttcgacaggcactactgtggaaagtgtgggctcacctatgtctaccagaaagccggtggtgattgagattgagattaggttgtcgctgctcttttaattagtattactt

SEQ ID NO: 2401 - DNA, 691 bp, Tabernaemontana elegans
gtttgagcctggagtcagccgcgagcaagagacgcagcgggagaagaagaggaattcgcgaagatgcagatcttcgtgaaaaccctaacgggtaagacgattaccctggaggttgagtcctctgacactattgacaatgtcaaggcgaaaatccaagataaggaaggcatcccacccgatcagcagcggctgatcttcgccggcaagcagctcgaggacggcagaaccctagcggattataacatccagaaggagtccacccttcacctggtcctccgcttgcgtggtggcgccaagaagaggaagaagaagacctacaccaagcccaagaagatcaagcacaagaagaagaaggtcaagctagccctcttgcaattctacaaggttgacgattctggtaaggtgcagaggctccgaaaggagtgtcccaatgccgagtgtggtgccggcacgtttatggccaaccacttcgaccgtcactattgcggcaagtgcggcctcacttacgtttacaacaaggccggcggagactgaccttcatctcatcaccagtcatcagttttgcctttttattcctatggattttacttttcttcgttcaaatataacgttttgagaccttctgaacctagttcctaaaatagttatttgctggattactttcacgtgtgatgtttattttatccccata

SEQ ID NO: 2402 - DNA, 813 bp, Taxus baccata
gagtacgcggggagagaataggaaggagggacgtttgtgttggcggctacgaaggaaaagtctggagctgctgactgcccactgctcattttgattcaatatgcagatattcgtgaaaacactgactggcaagaccattacgcttgaggtagagtcctctgatactatagacaatgtgaagacaaagattcaagataaggagggtattcctcctgaccagcagcgattgatttttgctggcaagcagctggaagatggtaggactttggcggattacaatattcagaaagagtcaacgttgcacctggtccttcgtctgaggggaggtgcaaagaagaggaagaagaaaacctacacaaagccaaagaagattaaacataagaagaagaaggtcaagcttgctgtgctgcagttctacaaggttgatgattctggcaaagtgcagagattgagaaaggaatgccctaaccaggaatgtggcgctggcacatttatggcaaaccattttgaccgacactactgtggaaagtgtgggttgacttatgtctaccagaaggctggtgctgagtgaattatttcttatggttacttcaggagtagaatgtcaggagcataaataagtaacttttgatttctgttttttgggatcagcagtaaaacttttttgttcctcttgatattgacatctttttgggaatactgttttgttcttcgataaaagcagatattatattttaattagaccacttatgtggaacttttaagtttttgctatttacgtcaaatttcttttgtgctaatttcagactaccc

SEQ ID NO: 2403 - DNA, 611 bp, Tripterygium wilfordii
gtttttctccgatctgcatctggaacaaggcaaagatgcagatcttcgtgaaaactttaactgggaagaccatcacgttggaagtggaatcctccgacaccatcgacaacgtgaaggccaaaatccaggacaaggaaggcatccctccggaccagcaacgactcatcttcgctgggaagcagcttgaggacgggcgtactctcgccgactacaacatccagaaggagtcaaccctccacttggtgcttcgcctgcgcggtggtgctaagaagcgcaagaagaagacctacaccaagcctaagaagatcaagcacaaaaagaagaaagttaagcttgctctgcttcagttctacaaggtcgatgattctggtaaggttcagaggctacgcaaggagtgccccaatggtgagtgcggcgccggaaccttcatggccaatcattttgataggcactactgtggtaagtgcggtctcacctatgtttaccagaaggccggtggcgactgattgattgtggtcggtggttttacaattaggattatcttaaatgttttgcttaaataattgttggacctaaatatatcttctggttcttttggaggatttataatt

SEQ ID NO: 2404 - DNA, 698 bp, Acacia harpophylla
gattcaaggattcagtctgaatcggcgacaccatgcaaatcttcgtgaaaaccctaacggggaagactataaccctcgaggttgagtcttctgacaccatcgacaatgtgaaggccaagattcaggacaaggaggggattccaccggaccagcagcgtctcatcttcgccggcaagcagctcgaggatggccgaaccctagccgactacaacatccagaaggagtcgacgcttcaccttgtgctccgtctccgtggtggagccaagaagcgtaagaagaagacctacaccaagcccaagaagatcaagcacaagaagaagaaggtcaagctcgcggttctccaattttacaaggttgatgattcaggtaaggtccagaggctcaggaaggaatgtcccaatactgagtgtggggctggtactttcatggccaaccacttcgatcgccattattgtggcaagtgcgggacgacttatgtctaccagaaggccggtggtgattaaacattgcattttgacttcgttactttctataatgtttctttttttgttgcggcagtttaaatttttgtagaatagttcagtaaacttcgttttaaattgtatttgactactccaaggtttggatcttttggatttacttttagcaattttgtttacataaactgatcattgatgctcccttgattttattagtcg

SEQ ID NO: 2405 - DNA, 606 bp, Antirrhinum majus
aaaccctaaatccccctagcctctgcgcacaaacaatccccctcacaacgaagatgcagatcttcgtcaaaaccctaaccggcaagaccatcaccctcgagatcgagtcctccgacacgatcgacaacgtcaaggccaaaatccaggacaaggaaggcatcccccccgatcagcagcgcttaatcttcgccggaaaacagctcgaggacggccgtacgctcgccgattacaacatccagaaggaatcgactcttcatctggtgctccgattgcgaggcggagcgaagaagaggaagaagaagacctacaccaagccgaagaagatcaagcacaagcacaggaaggtcaagctcgccgtgctgcagttttataaggtcgatgattcggggaaagtgcagaggctgaggaaggagtgccctaacgcggagtgcggtgcggggactttcatggcgaatcattttgatcggcattactgcggtaaatgtggcttgacttatgtctacaataaggctggtggtgattgaggaggatttttctagtgttttttgtgttatgatgtgtttttgatatagttgttatgtagttttattttggggattattggtg

SEQ ID NO: 2406 - DNA, 618 bp, Manihot esculenta
ttctatccctaatttctcacttggctatctatttcctcgtctgcaaccatgcagatcttcgtgaaaaccctaacggggaagacgataaccctagaggttgagtcttcggacactatcgacaatgtcaaggccaagatccaggacaaggagggcatccctcccgatcagcagcggctgatcttcgccgggaagcagctggaggacggccgcactctcgctgattacaacatccagaaggagtccactcttcatctggtgcttcgtctccgaggcggcgccaagaagagaaagaagaagacttacacaaagcccaagaagatcaagcacaagaagaagaaggtgaagctcgcagttctccagttttacaaggttgaagactccgggaaggtgcagagactgaggaaggagtgcccaaatgctgagtgcggagctgggactttcatggccaaccattttgataggcactactgtggcaagtgtggcttgacttatgtttacaataaagctggtggcgattagttttttttatgatgtgcttttgtttcgttataatggacttggcatttaaattttggtactttttgcttaattttcaatagctgaatattgatttttatg

SEQ ID NO: 2407 - DNA, 652 bp, Coffea canephora
cgcagtgccactgatttctctcctccagacgaagatgcagatcttcgtgaaaaccctaacggggaagacgatcaccctagaggttgagtcttccgacaccatcgacaatgtgaaagccaggatccaggacaaggaagggattcccccagaccagcagcgtttgattttcgccggaaagcagcttgaggatggtcgtactcttgccgactacaacatccagaaggagtccactctccatctcgtgctccgtctccgtggtggtgctaagaagaggaagaagaagacctacaccaagccaaagaagatcaagcacaagaagaagaaggttaagctcgctgtgttgcagttctataaggttgatgacactggaaaggttcagaggcttcgtaaggagtgccctaatgctgagtgcggtgctggaacttttatggctaaccattttgaccgtcactactgtggtaagtgtgggctcacctacgtttacaacaaggctggaggcgattgattttaatgtttagcaatgctctatcagattttctttttgtcgaatgaacggtaatttagagttttttttttgctatatggattttcgattttgatgtatgtgacaacccttgggattgttgatttatttcaaaactaagagtttttg

SEQ ID NO: 2408 - DNA, 1687 bp, Gossypium hirsutum
tgatcttgaagaatgttgaaaacaaatatttgaagaattcagcacctttctttaaatgctggagaacgatgatcatgttcatatgtccatccagcatacagctcaaacaaacaagctaaacagggaagcaaaataccaggttcttttttaacttttatgagtgaatggataggcatgacaagcaacatcattcgaaggatggattcatcattcgaataacgagaataattacatctcacaatgagtaccaatgacatgtattacccatctacagattcaggttcagaactcgaagtgagctccttagatttggcatcattgaagccaagagctgccaatatcttgtgaccaggtgattccacttcagaccaaatgccaagaagcaaatgagttgttgtaatttccccatcaccaccagattttagtttctcatcaacagcccaatcaagtgccctttgagcatcttctgtcaaaggaggatgctcaggactgaaaaagaacatgtcaccttttcctaataatttgactgtctcatcacgaaccttggaaagagtgataccatttgcacgcaaaaattttgcagccagattagttccttcaatcaatatgcccatgagcaacgactcagttccagtagttggatacttgagtttcctagcttccaattcagccatagcaaatgactttatcgctctccttgaccttgggaactttcccagctgaagcaaccctatctgttttcgaagtggggagacttaaggagatagttgcagtgatggtgcgatggttgggcaagtagggtctggtttttgatggctgaaaggaaattttgaagccaagccaaggactttgtagactgtggggctttagaaatgaaggaggagaagtgggttttgattggtttctggattgggaaattagtgaggtggtggaagatggatttgagagagaccgggcagcagcctgcttggcacccattttgaaaccctagccgacccccgccccaattctctgcatcgtcacctccacatcaagatgcagatcttcgtcaaaaccctaacggggaagaccataaccttagaggttgaatcctccgatacaatcgacaacgtcaaggccaagatccaagacaaggagggcatcccacccgaccaacagcgccttatcttcgccgggaagcagctcgaagacggccgcaccttagccgactacaacatccagaaggaatccactctccacctcgtcctccgtctcaggggtggcgccaagaagaggaagaagaagacctacaccaagcccaagaagatgaagcacaagaagaagaaggtcaagctcgcagtgctccagttctacaaggtggatgagtccgggaaggttcagaggctgaggaaagagtgtcctaatgcggagtgtggggccgggactttcatggctaatcattttgataggcactattgtggtaagtgtgggctcacttacgtttaccagaaggctggtggagactgagcagcgtccgattccaccttcagtaaaaaaaaaactgaaatcaatagtttatttttatcagtatgagtagcattaatattcgataatatttggatctttttatatatttctaatgttatgatgctttggatatgattttcgacttctgcttaccaatttgaattgaattatgggtttttct

SEQ ID NO: 2409 - DNA, 780 bp, Cycas rumphii
  misc_feature (766)..(766): n is a, c, g, or t
tgggatccaaagcggcgacgaaggaagtgtcttgagctgctgagttaccctgctgagataggttggatttcagagccaccatgcagatattcgtcaaaacactgacaggtaagacaattacccttgaggtagagtcttctgatacaattgataatgtgaaagctaagattcaagacaaggagggtattcctcctgatcagcaacgcttgatttttgctggcaaacaactggaggatggccgaactcttgctgattataacattcagaaagagtcaactctgcatttggttcttcggcttaggggtggtgccaaaaagaggaagaagaagacttacacaaagcctaagaagatcaagcataagaagaagaaggtcaagttggctgtgctgcaatactacaaggtcgatgactcaggtaaagttcagagattacgcaaggaatgccccaatcaggagtgtggggctggaacgtttatggcgaaccattttgaccgtcactactgtgggaagtgtggtctgacttatgtctatcagaaggctggtgctgagtaaacggtgtttgcttttaatattccatgaaaaatcaggagcatgttcttgctccaattttctattttggaggagagaactttctgtgtttcagatttttttaagaaactttgtttaagaaaattttggatgttgtatcaactctattgaagtggcatagtctcttttgataaaaaattgagtggacgtgttatgagtttcaattgaattgcttttancagcttatactctt

SEQ ID NO: 2410 - DNA, 746 bp, Tropaeolum majus
acaaaagccctagcttcatgttcatattcattccgatactctgaaaccccaaaccctaactttagccgacttacgattcccgaacgaagatgcagatcttcgtgaaaacccttacgggtaaaaccataaccctcgaggttgaatcctcggacaccatcgacaatgtcaaggccaagatccaagacaaggagggcatcccaccggaccaacagagactgatcttcgccgggaagcagttggaagacggtcgcacactcgctgactacaatatccagaaggaatcgacgctgcatctggttcttcgattgaggggtggggctaagaagcgtaagaagaagacttacacaaagccaaagaagatcaagcataagaagaagaaggtcaagctcgctgttcttcagttttataagattgaggattctggaaaggttcagaggctgaggaaggagtgtcctaatgctgaatgcggagctgggactttcatggctaaccactttgataggcattactgtggtaagtgtgggttaacttacgtgtaccagaaggccggtggtgattgatcatcttagattatgatttattagaaattttctgtttgtttgaatgaatatttcgtgaacatatctatctactatgccattggttctcattatattatctagtcatgttacattccgtttactatgccattggttctcattatattatctagtcatgttacattcagtttaaatcattgaatgtta

SEQ ID NO: 2411 - DNA, 710 bp, Tropaeolum majus
aagcttagtggtatcaaacgcagagtcggccgggggaatttagcacaatttgctgtgaaaaagctctgcatcaagcaatgcagattttcgtgaaaaccctaacgggtaagaccatcaccctcgaggtagagtcgtctgacacaatcgacaatgtgaaagccaagatccaggataaggaagggatcccaccggaccagcagcgtttgatcttcgccgggaagcagctggaggatggacgtaccctcgcggattacaacatccagaaggagtcgacccttcaccttgtgctccgacttaggggaggtgctaagaagcgtaagaagaagacctacacaaagccaaagaagatcaagcacaagaagaagaaggtcaagctcgctgttcttcagttctataagattgaggattctggtaaggtgcagaggctaaggaaggagtgccccaatgctgagtgtggtgccggaactttcatggctaaccactttgataggcactactgtggcaagtgcggcctgacatatgtttaccagaaggccggtggggattaggtcctttcttagtcttactataatgttcatcaagtgtttttgagttttgtttaattatgtcagtactattgaattggtaattttgagtattttgtttgaattcgagctgatttattgaataggtaatttcctgaattacgaaaaaaaaaaaaaaaaaggccg

SEQ ID NO: 2412 - DNA, 634 bp, Tropaeolum majus
attctactcttcaaattcgacccttcctggccgcaaagcaatgcagattttcgtgaaaacccttacggggaagaccatcacccttgaggtcgaatcctcggatacgatcgacaatgtcaaggcaaagatccaggacaaggaaggaattccaccggaccagcaacgtctgatcttcgccgggaagcagttggaagatggtcgcactctcgctgactacaacatccagaaggagtcgactcttcaccttgttctccgcctaaggggtggtgcaaagaagcgaaagaagaagacctacacaaagccaaagaagattaagcataagaagaagaaggtcaagctcgctgtcctccagttttacaagatcgaagattctggtaaggtgcagaggttgaggaaggagtgccccaacgctgagtgcggagcaggaactttcatggccaatcattttgataggcactactgcggtaagtgcggtttgacatatgtttatcagaaggctggtgccgaataggtctcgtttctttttaatataatgcttttcgagttcaattttagtttcctgtaagctaaagtactttatatttgtactttctaaagattttgtttaaattaagttacattcgcttttagtttc

SEQ ID NO: 2413 - DNA, 757 bp, Tropaeolum majus
cggccgggggtactttagttgcctcataatatccacataaaccctagcgacgtcctccatccacaataccaaacccccactactcgccttacgcttgacggaaaccctaatcgcgtacgaagatgcagatcttcgtgaagaccctcacgggcaaaacaatcacccttgaggttgaatcttctgataccatcgacaatgtcaaggccaagatccaggataaggaaggtatcccaccggaccagcaaagacttatcttcgccggcaagcagcttgaggacggccgtacactcgccgactacaacatccagaaggaatcgaccctccaccttgtgctgcgattgaggggtggggctaagaagcgtaagaagaagacttacaccaagccgaagaagatcaagcacaagaagaagaaggtcaagctcgctgttctccagttttacaagatcgaagactccggtaaggttcagaggttgaggaaggagtgtcccaacgcagagtgtggtgctggaactttcatggccaaccatttcgacaggcactactgtggtaagtgtgggctaacctatgtctaccagaaggctggtggtgattaaattttcaaattacatgcggattcatatcttatcttagcttaatatcgttttgagtatttatagattgttcaaatcaataattgttgaacagtttgttgttttggatatggttgttactttggatacaatttttttttctaatcatgacttctggatcatcgttt

SEQ ID NO: 2414 - DNA, 783 bp, Carica papaya
gatctctcataaataaaacccttgtattatccagagcatcttcaaattcatcactactcaaaccctagccgctcttctctgtttctctgcatctcctaaagatgcagatcttcgtcaagaccttgacgggtaagaccataaccctagaggtagagtcctctgataccatcgacaatgtgaaggccaagatccaggacaaggagggcattcccccggaccagcagcgtctcatcttcgccggtaagcagcttgaggatggtcgtaccctcgccgattataatatccagaaggagtcaacactgcatctcgttcttcggttgagaggtggcgccaagaagcgtaagaagaagacctacaccaagccaaagaagatcaagcacaagaagaagaaggttaagctcgcggtgctccagttctacagggttgaagatggtggcaaggtgcagaggctgaggaaggagtgtcccaacgccgagtgtggcgccggaaccttcatggcaaatcactttgacaggcactattgtggtaagtgtggccttacctatgtgtaccagaaggccggcggtgattgatccgagaaccatgaaacttttttcgtcttctaaagagttatgtttatcttaatagctttttggggttagattttaaattacgaagtacttctggaatttataccttctctgttatggtttattttgttactttggatgttcattgtggattttaagtgattaaatttattagctttttaaactatattattgaatttgtgtggtcttttct

SEQ ID NO: 2415 - DNA, 779 bp, Carica papaya
acgactctctcacaatatcccttggtgagctgaaatcccatctgctgcaaaatgcagatattcgtgaaaaccctaaccgggaagaccataaccctagaggttgagtcatcggatacgatcgacaatgtgaagacgaagatccaggataaggagggaatcccaccagaccagcagcggctgattttcgcagggaaacaactcgaggacggccgcacgctcgcggactataacatccagaaggaatccacactgcacctggttcttcggctcaggggaggtgccaagaagcgcaagaagaagacctacaccaagcccaagaagatcaagcataagaagaagaaggtcaagcttcccgtccttcagttctacaaggtggacgacagcggcaaggtccagaggctcagaaaggagtgcccgaacgctgagtgcggcgccggtacttttatggccaaccactttgaccgccactattgcggaaagtgcggcatgacctatgtttaccagaaggctggtggcgattaggtcattttctttttgtttttatctgttttctgctagtcgttgttttcgttaaggttctgatactgataatctgttaccgatttaagaaaagtgtttttggttgagcctgctgaatttttatggattggatgattaattagaggatggatattgggagataatagtagttatatcagtataatttctaatggtcatccaatggttgattgttttggttgattcttttggtaagcttataccaatatcatattggcaat

SEQ ID NO: 2416 - DNA, 645 bp, Salvia sclarea
ctactagaccttggctgtcactcacatccccaaaaccaaaccctagcggcgtaggctctctcgtcgtctccgatgcagatcttcgtgaaaaccctaacgggtaagaccatcaccttggaggttgaatcctccgacaccatcgacaatgtgaaggccaaaatccaggacaaggaggggattccgccggaccagcagcgcctcatcttcgccgggaagcagctcgaggacggccgcaccttggccgactacaacatccagaaggagtccacgctccacctggtgctccgcctccgcggtggcgcgaagaagcgcaagaagaagacctacaccaagccgaagaagatcaagcacaagaagaagaaggtcaagctcgccgtgctccagttctacaaggtcgatgactccggcaaggttcagcggctgaggaaggagtgccccaacgccgagtgcggcgccggaactttcatggccaaccacttcgacaggcactactgcggtaagtgtgggctcacctatgtctacaataagaccgccggtgattgaggcgttctttatatgttgaattgaactctgttttttatgttaattttgaatctagctttctggtattatggattttggctaagtattgttatgatactacaa

SEQ ID NO: 2417 - DNA, 665 bp, Euphorbia esula
ggcacgagggaagaaccctaatccctctctgcaattatgcagatcttcgtgaaaaccctaacgggtaagacaataaccctcgaggttgaatcctcagacaccatcgacaatgtgaaggctaagatccaggacaaggaaggaatcccaccggaccagcagcgattgatcttcgccgggaagcagctggaggacggccgcactctcgccgactacaatatccagaaggagtccactcttcacttggtgcttcgtcttcgcggtggagctaagaagaggaagaagaagacatacatcaagccaaagaaaatcaagcacaagaagaagaaggtcaagctagctgtgctccagttttacaaggttgatgattctggaaaggttcagaggttgaggaaggagtgccctaatgctgagtgtggagctggaactttcatggctaaccattttgataggcactactgcggcaagtgtgggttgacctatgtttacaacaaggctggtggagattaggttatttctgatgcgattttgtttttgttaaattggatttggtaattttaagtttggtactttatgtttaaattttgatacttgaattgttggaattttatgttgctggttggatattaatagctggattttgatggtttagttgctttcctataatc

SEQ ID NO: 2418 - DNA, 674 bp, Euphorbia esula
  misc_feature (89)..(89): n is a, c, g, or t
  misc_feature (263)..(263): n is a, c, g, or t
  misc_feature (284)..(284): n is a, c, g, or t
  misc_feature (317)..(317): n is a, c, g, or t
caaagacgcagatcttcgtgaaaaccttgacggggaagacgatcactctcgaggttgagtcctcagatacgatcgacaatgtgaaggcnaagattcaagacaaggaaggaatcccgccggaccagcagaggctcatcttcgccggaaaacagctggaagacgggaggactctcgccgattacaacatccagaaggaatcgactctgcatctggtgctccgattgagaggaggcgcgaagaagaggaagaagaagacctacacnaagccgaagaagatcaagcanaagaagaagaaggtgaagctcgctgttcttcanttttacaaggtcgatgatagcgggaaggttcagaggctgaggaaggagtgcccgaacgccgagtgcggcgccggaacttttatggcgaatcattttgataggcactattgtggtaagtgtggtctcacctatgtttatcagaaagccggcggcgactgatttttcaggttcaattatggtttgatattttgagaattgtcgttttaatttacagacttgttagttttgtttttgtatcttgtttggatgcaaattatggatgattagctgtttacatttacttattgttcatgaaccatgatgatgtttgattgaagttcatttatattaactattaagcataaaggatcttttaat

SEQ ID NO: 2419 - DNA, 629 bp, Camellia sinensis
ggcgaccaacaacaacaacaatgcagatcttcgtgaaaaccctaacagggaagaccataaccctagaggtcgagtcctccgacaccatagacaatgtgaaggccaagatccaggacaaggagggcattccaccggaccaacaacgactcatcttcgccggaaaacagctcgaagacggccgaaccctagccgactacaacatccagaaggaatccacgcttcacttggttctccgattgcgtggaggagcgaagaagaggaagaagaagacatacacgaagcccaagaagatcaagcacaagaagaagaaggtgaagctcgctgagcttcagttctacaaggtggatgattctgggaaggttcagaggctgaggaaggagtatccgaatgctgagtgtggtgctgggactttcatggcgaatcattttgatcgtcactattgtggcaagtgtgggttgacttatgtttatcagaaggctggtggggattaagatttgatctctctctctctctctctctctagttatgatgtttacatctttgttttgaatattaaagacagaatttcgattgctttggatgttgaacatgggatgaattttgcttaaatgaacccaattttagaacgt

SEQ ID NO: 2420 - DNA, 604 bp, Tragopogon dubius
ttcgtcaaaaccctaaccgggaaaaccataaccctagaggttgaatcctccgataccatcgacaatgtcaaagcgaagatccaagacaaggaaggcatccctccggatcaacaacgtctcatcttcgccgggaaacagctcgaggacggccgaaccctagccgactacaacatccagaaggaatccactctccaccttgtcctccgtctccgtggtggtgctaagaagcgtaagaagaagacctacacaaagccaaagaagatcaagcataagcataagaaggttaagctcagcatcttgcagttttacaaggttgatgattctggaaaggttcagaggctcaggaaggaatgccctaacgctgagtgtggcgctggaacgttcatggctaatcactttgatcgacattattgtggaaagtgcgggctcacatatgtctaccagaaggctggtggtgattaaatttatcaggtttttgttctaaattatcttatgagatttttatttgaggtttttagatgttttttttaaatctgttttgagacatttttcagctttagcatatcattttcattattgagtgatgatttattttcatagttgc

SEQ ID NO: 2421 - DNA, 804 bp, Catharanthus roseus
acgccgaccacgcctctagtgaaaagacggccgacagaggcagagagagcgagagcgagagagagagaaagagagagtaaaagaatttgcgaagatgcagatcttcgtgaaaaccctgacgggtaagaccattaccctcgaggttgaatcctccgataccattgacaatgtgaaggcgaagatccaagataaggaaggcatcccaccggatcagcagaggctcatctttgccggcaagcagctcgaggaaggcaggaccttagcggattacaacatccagaaggagtcgacactgcacctggtccttcgcttgcgcggtggcgccaagaagaggaagaagaagacctacacaaagccaaaaaagatcaagcacaagaagaagaaggtgaagctcgccgttttgcagttctacaaggtggacgatactggtaaggttcagaggctcaggaaggagtgtcccaatgccgagtgtggtgccggaacctttatggccaaccatttcgaccgtcactactgcggcaagtgcggcctcacttacgtttacaacaaaggaggagattgatctatctcttttatctcatcatcatattacctttcgtcagttttgcagcagcatgctcttcttttttttttttgcttcatttaaatataatgttcttgatattgagacatcttcaacttagttactaaaatagttatttgctgttgattactttcaattttacatttgcaattgttatcatctgattttgctttttattactacaagctatcctctactttatcaatccttaaaaaaaaaaa

SEQ ID NO: 2422 - DNA, 661 bp, Acacia harpophylla
ggcgcgggtgaagctaggagagagcaacaatgcaaatcttcgtcaaaaccctaacggggaagacgataaccctcgaggttgagtcttccgacaccatcgacaatgtcaaggccaagattcaggacaaggaagggatcccgccggaccagcagcgtctcatcttcgccggcaagcagctcgaggatggccgaaccctagcggactacaatatccagaaggaatccaccctccatttggtgctccgactccgtggtggcgctaagaagagaaagaagaagacctacaccaagcccaagaagatcaagcacaagaagaagaaggtcaagctcgcggtcctccagttctacaaggtcgatgattccggtaaggtccagaggctgagaaaggagtgccccaatgccgagtgtggtgcgggaactttcatggccaatcacttcgaccggcactactgtggcaagtgtggaacaacttatgtctacaataagggtggtgattagaaatagtgcattttgaatcatgaatttattactttctgaatatttttactttatttttgttcaagggttaagaatttaagaatagcgcagtactggtctttttgggtatggatttgagtacttctaagctctgttatttgatgctacaaaaaaaaaaaaaaaag

SEQ ID NO: 2423 - DNA, 746 bp, Catharanthus roseus
gaattcggcacgaggcgacagaggcagagagagcgagagcgagagagagagaaagagagagaaaagaatttgcgaagatgcagatcttcgtgaaaaccctgacgggtaagaccattaccctcgaggttgaatcctccgataccattgacaatgtgaaggcgaagatccaagataaggaaggcatcccaccggatcagcagaggctcatctttgccggcaagcagctcgaggaaggcaggaccttagcggattacaacatccagaaggagtcgacactgcacctggtccttcgcttgcgcggtggcgccaagaagaggaagaagaagacctacacaaagccaaaaaagatcaagcacaagaagaagaaggtgaagctcgccgttttgcagttctacaaggtggacgatactggtaaggttcagaggctcaggaaggagtgtcccaatgccgagtgtggtgccggaacctttatggccaaccatttcgaccgtcactactgcggcaagtgcggcctcacttacgtttacaacaaaggaggagattgatctatctcttttatctcatcatcatattacctttcgtcagttttgcagcagcatgctcttcttttttttttttgcttcatttaaatataatgttcttgatattgagacatcttcaacttagttactaaaatagttatttgctgttgattactttcaattttacatttgcaattgttatcatctgattttgctttttattaa

SEQ ID NO: 2424 - DNA, 611 bp, Festuca arundinacea
  misc_feature (154)..(154): n is a, c, g, or t
  misc_feature (300)..(300): n is a, c, g, or t
  misc_feature (342)..(342): n is a, c, g, or t
  misc_feature (381)..(381): n is a, c, g, or t
gccaagatgcagatcttcgtgaagaccctgacggggaagaccatcaccttggaggtggagtcctcggacaccatcgacaacgtgaaggccaagatccaggacaaggagggcattcccccggaccagcagcggctcatcttcgccggtaagcagntggaggacggccgcaccctcgccgactacaacatccagaaggagtcgacgctgcacctggtgctccgtctgcgcggaggcgccaagaagcgcaagaagaagacctacaccaagcccaagaagcaaaagcacaagcacaagaaggtnaagctcgccctgctgcagttctacaaggttgacgactccacnggcaaggtaacccgcctccgcaaggagtgccccaacgcngagtgcggcgccggcaccttcatggccaaccacttcgaccgccactactgcggtaagtgcggcctcacctacgtctacaaccagaaggcgtaggctgcttcgctctactcttgtccggagaagaagaagaagaaaaaagaagaaggttctcgttagctgtcaatttatgtctgtctgtctgtcgtattgaagtagaattttggaacagaacacctgcacctttattggtg

SEQ ID NO: 2425 - DNA, 687 bp, Medicago truncatula
acggccgggggcttttagccgtggctaccgagcgattctggagcagtgagacttcaagatgcagatattcgtgaaaactctgactggtaagacaataaccctagaggtagaatcctctgatacaatcgacaatgtggaggcgaagatccaggataaggagggtattcctcctgatcagcagaggctaatctttgctggaaagcagctggaggatggaagaaccctggcggattacaatattcaaaaggagtccactcttcatttggtccttcgcctgaggggaggtgcaaagaagagaaagaagaagacctacactaaacccaagaagattaagcacaagaagaagaaagtcaagttggctgtcttacagtactacaaggtggatgactctggcaaggtgcaaagactcaggaaggaatgccctaatcaggagtgtggagcagggactttcatggccaatcacttcgacaggcattactgtggcaagtgtggtctgacttatgtctatcagaaagcggaggcttaagataattttgggcttaattgggactagagacgatttcggttagcattttcacattatatgctggggttttaaattgtcgagatcgataagaactttttgtagcgataatttagattttattaacgcctttggtatttatcaatcagtatactggatttact

SEQ ID NO: 2426 - DNA, 602 bp, Ceratodon purpureus
ccgccaccatgcagatattcgtcaagaccctgacggggaagacgatcacccttgaggtggagtcttcggatacgatcgacaatgtgaagaccaagattcaggacaaagagggcattccgcccgaccagcagcgcctcatctttgcggggaagcaattggaggatgggcgcacgctcgccgactacaacatccagaaggagtcgactcttcatctggtgctccgactgcgcggtggagcgaagaagaggaagaaaaaacctacaccaagccgaagaagctgaagcacaagaagaagaaagtgaagctcgcagtgctgcagttctacaaggtggatgactccggcaaggttcagcgcctgcgcaaggagtgccccaaccctgactgtggggcggggacgttcatggccaatcacttcgatcgccattactgcggcaagtgcggtctgacctatgtctatcagaaggctggtgcagagtagagctaggggctagttcgtgggtgcaggtgctagttgaggcagtacacaatttcgtatgtgatgttgtttcaagaccctgtggaaaaaagaacgattcggttcatttgacttcgtctctcaaaaa

SEQ ID NO: 2427 - DNA, 649 bp, Malus domestica
gccgttgctgtcggcagatcttcgtgaaaaccctaacgggtaagaccataaccctagaggtcgagtcctccgacaccatcgacaatgtcaaggccaagatccaagacaaggagggcatccccccggaccagcagcgcctcatcttcgccggcaagcagctcgaggacggccgaaccctcgccgactacaacatccagaaggagtccaccctccacctggtgctccgcctccgcggtggcgccaagaagaggaagaagaagacctacaccaagcccaagaagatcaagcacaagcacaagaaggtgaagctcgcagtgctccagttctacaaggtggatgattccggcaaggtccagaggctgcggaaggagtgccccaatgccgagtgcggcgctggaactttcatggcgaaccacttcgacaggcactactgcggcaagtgcggattgacctatgtttaccagaaggctggcggtgattagagtaatttagaatttttaatttcgaattatatcgccatggattttaaatttcgatgctttatggtgctttgggattttaatttcatgcttgaagaacccatgagactttaggcgttttcgttgtttctattgcatatcccagatggaatgattaccctaattttgtt

SEQ ID NO: 2428 - DNA, 673 bp, Arnica chamissonis
tggccatgtcagcagtacgggcgcgataccgatgttgctgctattgatagtgtgtaatcggtaaaaaaccctaacgggtaagacgatcaccttagaggttgaatcctccgatacaatcgacaatgtcaaagccaagatccaagacaaggaaggcatcccaccggaccagcaacgcctcatcttcgccggaaaacagcttgaagacggcagaaccctagccgactacaatatccaaaaggaatcaactcttcacctggtcctccgcctccgcggtggcgcgaagaagcgcaagaagaagacctacaccaagccgaagaagatcaagcataagcacaagaaggtaaagttgagcgtgttacagttctacaaagtcgatgattctggaaaggtgcagaggttgaggaaagagtgccctaacgccgagtgcggtgcgggaaccttcatggccaatcattttgataggcactactgcggcaaatgcgggcttacatatgtctaccagaaggcttaaggttcattttattaaataaagctttttctgttctatttccatggatgatttttggagctcttgttattgtggtaaacctagatgaagttgtttttcacacacaatgattttgcatggattattgattatctatcagtagattatcataccttggttgtatta

SEQ ID NO: 2429 - DNA, 754 bp, Cephalotaxus harringtonia
gaaattagggtttcaaaggttggcgacagaaaaagttcggaggagggaggggagaagaacagaggagagctgagctgaagcagcgtttgttgatggttcaagatgcagatattcgtaaaaacgttgactggtaagactataactctagaggtagaatcctctgatacgattgacaatgtgaaagctaagatccaggataaggagggtattcctcctgatcagcagaggctaatctttgctgggaagcagctggaggatgggagaaccctagcggattataatattcagaaggagtccacccttcatctggttcttcgcctgaggggaggggccaagaagagaaagaagaagacttacaccaagcccaagaagatcaagcacaagaagaagaagatcaagttggctgttttgcagtactacaaggtcgatgactctggcaaggtgcagaggatcaggaaggagtgccctaatcaggagtgtggagccggtactttcatggccaatcactttgataggcattactgtggcaagtgtggtttgacttatgtttaccagaaggctgaagcttaagctattttggtactatgttgggtttttttaggattaaaatgggatagttagttttttgagactttgtgccggggtaggaagtgttgcgaccgtaaaccctgcttttgtaactgggatttacatcttgtttatgctattggtatttaccaatccttacgttggacttatgaaaatttctattttt

SEQ ID NO: 2430 - DNA, 844 bp, Cephalotaxus harringtonia
cgaaggtttttagggtttcaatagagggcttttattgtaagagggcgtcccggccacagaaaaacttcggagcagggcgacgttcgttgatggttcaagatgcagatattcgtaaaaacattgactggtaagactataaccctagaggtagaatcctctgatacgatcgacaatgtgaaggctaagatccaggataaggagggtattcccactgatcagcagaggctaatctttgctgggaagcagctggaggatgggagaaccctagctgattataatattcagaaggaatccacccttcatctggttcttcgtctgaggggaggcgccaagaagaggaagaagaagacctacaccaagcccaagaagatcaagcacaagaagaagaagatcaagttggctgttttgcagtactacaaggtcgatgactctggcaaggtgcagaggctcaggaaggagtgccctaatcaggagtgtggagccggtactttcatggccaatcactttgataggcattactgtggcaagtgtggtttgacatacgtttatcagaaggctgaagcttaagctagcttctaaattgggtttatttaggattaaactgggatagtgcttttgaggcttcgtgccggggtaggatttgttgagaatgtaaaccctgtttttgttactgggatttagatattgtttatgctattggtatttaccaatcgttacgttagatttatcaaaattaatatttttatatttgaatgatggcattgatctgctttgtgtatttgagaatttcatggaattcatctattatttatgtgatttgaaataaactgaaagttaatttagg

SEQ ID NO: 2431 - DNA, 815 bp, Pseudotsuga menziesii
cgacgaaggaattgtctagagctgctgctgttttctgtctgcaaccgcaacaatgcagatcttcgttaaaacactgactggtaagactattacccttgaggtagagtcttcagatacaattgacaatgtgaaggctaagattcaagataaggagggtattcctcctgaccagcaacgtttaatatttgctggcaaacagttggaagatgggagaactctggctgattacaatattcagaaagagtcaaccctacacctggttcttcgtctgagaggtggtgctaagaagagaaagaagaagacctacaccaagcctaagaaactcaagcacaagaagaagaaggtcaagttggctgttctgcagtattacaaggtcgatgactctggcaaggtgcaaagattgcgcaaggaatgcccgaaccaggaatgtggcgctggtacatttatggcaaaccatttcgaccgccactattgtggaaagtgtggtttgacttatgtgtatcaaaaggctgctgctgagtaatttctatttttgattctgctgccatggaaagcctgttgttcgttggacttttcttctcttagatgagacacatcttaatgttttgcccttggtttaaattagtttattattaggaatttcatatttttgatagtagcataaatactggaaattatattaactcttttgaagttagattgtttctatggaacaattaaaaagcttttgcttgctatctagttttgtttctattttttatttgattgctatctttttatgcttaaagaatcaatgaaatattgcataccttgac

SEQ ID NO: 2432 - DNA, 720 bp, Sciadopitys verticillata
gggagggtctggagctgctgggttactcaacttcagcttatcaaccatgcagatattcgtgaaaacactgactggcaagacaattacacttgaggtagagtcctcggatacaatagacaatgtgaagactaagattcaggataaggagggtattcctcctgaccaacaacgattgatttttgctggcaagcagttggaagatgggagaactttggctgattacaatattcagaaagagtcaaccttacacttggtcctccgtctgaggggaggtgccaagaagaggaagaagaagacgtacacaaaaccaaagaagatcaagcacaagaagaagaaggtcaagcttgctgtgctacagtactacaaggttgatgattctggcaaggtgcagagattgaggaaggaatgccctaaccaagagtgtggtgctggtacatttatggcaaaccattttgatcgtcattattgtggaaagtgtggtttgacttacgtctaccagaaggctggtgctgagtaaaatgttggtttgattcctcatttgaaggaaggttaggagcatacttaagttgcaattttaggtatggcagtatatacatttttatgttatgctgtgtttggtttaacaatagaaattttcaatttactattgtcgtggcaggaattttggaattgtatttgttttgtttaaatcagattctctgttttagtgtcaatcacttg

SEQ ID NO: 2433 - DNA, 700 bp, Zostera marina
ggggctagtagaagcgccgtgcgtgttgttggagaaaagatgcagatctttgtgaagacccttacggggaaaacgattactctcgaggttgagtcctcggacacgatcgacaatgtcaaggcaaagatccaggataaggaaggcatcccaccagaccagcagcgtcttatcttcgccgggaagcaactggaggacggacgcactctcgccgactacaacatccaaaaagaatcgacgctccatctggttctccgtctgaggggaggtgccaagaagaggaagaagaaaacctacaccaagccgaaaaagatcaagcataagcacaagaaggtgaagcttgcagtgttacagttttacaaggtcgatgattcggggaaagtggtgaggttgaggaaggaatgtcccaacggggaatgcggtgctgggacttttatggccaatcacttcgacagacactactgtggcaaatgcggtatgacctatgtgtattccaaggctggagaggagtgatttttaagaattatgatttgatttctgttgtttttttttgatgtttgaatgaatgacttttgcattgtatcttaaaaaaattattaatatttagttttgaattttggaatcgttagttgttgttgttgattatgatgataattattaatctagcttctgttttgaggaatatatatatttcatttgtctc

SEQ ID NO: 2434 - DNA, 711 bp, Amborella trichopoda
  misc_feature (330)..(330): n is a, c, g, or t
cttcctctggaatctggggttttgaagatgcagatcttcgtaaaaaccctaactggcaagaccattactcttgaggtcgagagctccgatacgatcgacaatgtcaaggccaaaatccaggacaaagagggcataccaccagatcaacaacgcctcatcttcgcaggtaagcagctcgaagatggccgaaccctagcggattacaatatccagaaagagtcgactcttcatctggttctgagacttagaggaggagcgaaaaagaggaagaagaagacttacactaaacctaagaagttaaagcacaagaagaagaaggtgaagctcccngttcttcagttttacaaggttgatgactctggtaaggttcagaaacttaggaaggaatgccctaatcaggagtgcggagctggaactttcatggcgaatcactttgataggcactattgtggaaagtgcggcctcacttatgtttaccagaaagcaggagcagagtaaatgaagcacttcctttgttttgagatctagggttttatatggcatcttttgaaattattgggttttctgttaatgtgtcggataattacggtttttggacccgcttttctgattcatttaggagatagagtgaactttggatattgagaattgttttcctttttatgtttgggattttgacatttaagaattaagttaaaattgtgttacttt

SEQ ID NO: 2435 - DNA, 617 bp, Aquilegia formosa
ctagaagcagagcaaaggcgagagaggcgagaaggagaggaagcagaagcaaggttttgttgatcagatctgaagcgaagatgcagatcttcgtgaaaaccctaacagggaaaacaataaccttagaggttgaatcatcagacacaatcgacaatgtgaaagctaagatccaagataaggaaggaataccaccggatcaacaacgattgatttttgctggaaaacaacttgaagatggaagaacacttgctgattacaacattcagaaggaatcaacacttcatttggttcttcgattgagaggtggagctaagaaaaggaagaagaagacttatactaagccaaagaagattaagcataagaagaagaaggttaagcttgctgtgttgcagttttacaaagttgatgattctggaaagcttgctaaactcaggaaggaatgtcctaatgctgaatgtggtgctggaacttttatggctaatcattttgatcgtcattactgtggtaagtgtggtcttacttatgtttaccagaaggctggtggtgaatgagtgatatgtaactcattttaattgtttttttgatggatttctgcggttatgtagtactctaaaatt

SEQ ID NO: 2436 - DNA, 644 bp, Aquilegia formosa
ctagaagcagagcaaaggtgagagaggcgagaagaagaagaagcagaagcaaggttttgttgatcagatctgaagcgaagatgcagatcttcgtgaaaaccctaacagggaaaacaataaccttagaggttgagtcatcagacacaatcgacaatgtgaaagctaagatccaagataaggaaggaatcccaccagatcaacaacgattgatttttgctggaaaacaacttgaagatggaagaacacttgctgattacaacattcagaaggaatcaacacttcatttggttcttcgattgagaggtggagctaagaaaaggaagaagaagacttatactaagccaaagaagattaagcataagaagaagaaggttaagcttgctgtgttgcagttttacaaagttgatgattctggaaagcttgctaaactccggaaggaatgtcctaatgctgaatgtggtgctggaacttttatggctaatcattttgatcgtcattactgtggtaagtgtggtcttacttatgtttaccagaaggctggtggtgaatgagtgatatgtaactcattttaattgtttttttgatggatttctgcggttatgtagtactctaaaatttaagctttgttgggatgttttaagacc

SEQ ID NO: 2437 - DNA, 609 bp, Ocimum basilicum
gcacccgttctcgtgccgaattcggcacgaggcacaaaccctagccactggttctcctccgccgcgaagatgcagatcttcgtcaaaaccctaacggggaagacgatcaccttggaggtcgaatcctccgacaccatcgacaacgtcaaggctaagatccaggacaaggaaggcattccgccggaccagcagcgcctcatcttcgccggaaagcagctcgaggacggccgcaccctcgccgactacaacatccagaaggagtggacgctccacctcgtcctccgcctccgcggtggcgcgaaaaaacgtaagaagaagacctacaccaagccgaagaagatcaagcacaagaagaagaaggtgaagcttccgctgctgcagttctacaaggtggatgactcggggaaggtgcagaggctgaggaaggagtgccctaacgcggagtgcggagctggaactttcatggcgaaccactttgataggcattactgtggtaagtgtgggttgacctatgtctacaataaggctggcggtgattgagatttatgtgtcaggtctgttgagagggttttgatataggtttaatcgtcttttggaacggtttttgtt

SEQ ID NO: 2438 - DNA, 1259 bp, Beta vulgaris
  misc_feature (531)..(531): n is a, c, g, or t
cgtatatttaaaatatcagggggcccggagaaactccagaaaaaaaagaggccctttttttcaaaagttgtcacctctagagtaaataggaaaatcttattctttaacaaaatttgtcaccttttttaaaacaaaaaaattttttgggatacacaaaaaaccttttcccatttccctggggggccctacccattccgggttaccgggccccgttacaatttttttttcccccctttccgggcccccctttttgtttcccccgaacttggttcccccgtacccgggcccaaccctggggttcaatttctttctttcctggggggaaggacgcaattcccgttccttcgttccccagtccattcttcccgaagaggtaaaagctaacccccccacaactgttttgtgagggggaaagttcagtagtcccgaaccggacttcgaaaaataagaaaacctggccaattagaaacccaggagtaaagccttgccttggccggaattggccacaaggctcattttcccgggcaaaantgtgtgtgcgagagagagaggtcagaaaagatgcagatcttcgtgaaaaccctaacgggtaaaaccataaccctagaagtcgaatcctccgacaccatcgacaatgtgaaagcaaagatccaagacaaagaaggcattccaccagaccaacaacgtctgattttcgccggaaaacaacttgaagatggtcgcacacttgctgattacaacatccagaaagagtcgactcttcaccttgttcttcgtctgagaggtggtgctaagaagcgtaagaagaagacttacactaagcctaagaagattaagcacaagaagaagaaggttaagttgcctgttcttcagttttataaggtttctgattctgctaagattcagaggttgaggaaggagtgccctaatgctgagtgtggtgctggtacttttatggctaatcattttgatcgtcattattgtggtaagtgtggtttaacctatgtttaccagaaggctggaggcgattaaagcatggattgatagcagaatcttgaaagtcagtgctttcaatttttatgttatatttagtttttgagatttttagattcttgcaagacttttcgtaatcttagttgttatggttatcgtttgttgaggattatattataactctgttgtttttgctaatgttggatctacaattttgaatccttttttttttaatacgagcgttataattttgttttttcgtctgg

SEQ ID NO: 2439 - DNA, 785 bp, Manihot esculenta
tcccaaattcccccgcacggctccctttctctcctgcaaccatgcagatcttcgtgaaaaccctaacggggaagacgataaccctagaggtcgagtcctcggacaccatcgacaatgtcaaggccaagatccaggataaggaaggaattcctcccgatcagcagcgactaattttcgcagggaagcagctggaggatggccgcactctcgctgattacaacatccagaaggagtctactcttcacctggtgcttcggcttcgtggtggcgccaagaagagaaagaagaagacttacactaagcccaagaagatcaagcacaagaagaagaaggtcaagctcgccgtgctacagttctacaaggtcgaggactctgggaaggtgcagaggctgaggaaggagtgcccgaattctgagtgtggagctgggacattcatggccaaccattttgataggcactactgcggcaagtgtggcttgacttatgtttacaataaagctggtggtgattagatttttataatgcgtttttgttctgtgataatggatttggtaatttaaatttcgtactttttgcttaattttcaatagctgtgtattgatttttgttttggtgggatattaatagccggattttgttaatttagttgcgaatatagttatctggatgtctccatgtccaaggattattagttttgctatcttgttttctgaatctgggtgtatgacttggtctgttgccattgcatttcttggaatttgattgaggcttgattgtttgatgcc

SEQ ID NO: 2440 - DNA, 902 bp, Liriodendron tulipifera
ctcatcgtatttctcccctccaaaccctaacccgttcgcctccgagagagagagagagagagagagagagtctaaccctagctgcagcatctgcatccgaagatgcagatcttcgtgaaaaccctaacggggaagacgatcaccctcgaggtggagtcctccgactcgatcgacaccgttaaatccaagatccaggacaaggagggcatcccacccgaccagcagcgcctcatcttcgccggcaagcagctcgaggacggccgtacgctcgcggactacaacatccagaaggaatcgacgctccatcttgttctccgtctccggggcggggcgaagaagaggaagaagaagacctacaccaaacccaagaagatcaagcacaagaagaagaaggtgaagcttgctgtactccaattctacaaggtcgacgactcgggtaaggtccagaggctccgcaaggagtgccccaatgccgagtgtggtgctggcaccttcatggctaaccacttcgatcgccactactgtggtaagtgcggcctcacctatgtctatcagaaggccggcggtgagtaggccgtcagttggtctaggttttggattctttgaatttcgaattttagggtttcgaagaggatgattctgtccccgaatttgatacatttttcgtttctattatgagattgaacttggttatggttataaaatgaagtaggatgttggatgcttcttttaaagtatttgatttgacgtttttaattttagggtttatgttgttttatttggagctggccccaaaatatctgggtcaaggctatgatatgatactgctgcggatgataatgataatgatgattttgatagatgatatgtggatgcctgtttttagggtttattttgtttta

SEQ ID NO: 2441 - DNA, 826 bp, Mimulus guttatus
ctttctcactctaacatttctcctctctctcactagagaaaaaaaaaaaaaaaaccctagcagagtccctcaccgccgccgcgaagatgcagatcttcgtgaaaaccctaacgggcaagacaataacactggaggtagaatcctccgacacgatcgacaacgtgaaggccaagatccaggacaaggaaggcatcccgccggaccagcagcggctcatcttcgccggaaagcagctggaggacggccgcaccctcgccgactacaacatccagaaggagtcgacgctccacctcgtcctccgcctccgcggcggcgcgaagaagcgcaagaagaagacgtacacgaagccgaagaaactgaagcacaagaagaagaaggtgaagctctcagttctgcagtactacaagatcgacgattctggaaaggtgcagaggctgaggaaggagtgccctaacgcggagtgcggcgcgggtactttcatggccaatcattttgacaggcactactgcggtaagtgtggcctcacctatgtttacgccaaggctggtggcgattgagatttttttttaattatgtttttgctttattattaagacttctctttttttttttttgggattgttataccgttttttgttctatcgtttctctggacggaattctctgttattatttaggttttgtttttttttttattatatgaagttgaactttgtatttgattgcatggtttttcaatcttaaatcagtttgcaattaaatgtcatgtgatgtttttgtttgagtttttgattaattgggtgtttttgatctgaaaaatgctctg

SEQ ID NO: 2442 - DNA, 1020 bp, Physcomitrella patens
ataaggcggcgatcgcctccgagagagtcttctcaattagcaccacggtgacgacgcaaagttttgctgagcccgagtgcagcctccaagatgcagatcttcgtaaagaccttaacggggaagactattacccttgaggtggagtcttcggataccatcgacaatgtaaagacgaaaattcaggataaggaaggaatcccgcccgaccagcagcggctcatctttgcaggcaagcagctggaggatgggcgcacccttgctgactataacatccagaaggagtctactcttcatctggtgctccgcctgcgcggtggtgccaagaagaggaagaaaaaaacctacaccaagcccaagaagctgaaacataagaagaagaaagtcaagctcgcggtgctgcagttctacaaggtggacgactctgggaaggtgcagcgcctccgcaaggagtgccccaacccggaatgcggagccggaaccttcatggccaatcacttcgaccgtcactattgcggcaagtgtggtctgacttatgtttaccagaaggctggtgcagagtagagctctttactatatgtatcaggctggttgtccgtaggtttgagctcgcatgtgctggtgtcattcgaggcagtttatttcaatcgaattttaacgtttcaggcagcgtgatcatctatcatttcgaacaatgaatgattattgtgtgagtggcgtttcaagaccctgtcatatagttgttcattgccatcatgcttcgcattaccgaggatttggcctgctttgttctctcgttcctcacccgcacaattgttttacatcgttcccggacggaaaacaatttcaacatagtcatatttagagccttgacccaccacaatatttctgtactcagcttggtacgaaataactacaatatccggtgttatcagttttaccttcattagttactaattaggtcaagttgaaggtcattgtattggtaattttgttccgagtctgacaagctctttacatcgt

SEQ ID NO: 2443 - DNA, 645 bp, Physcomitrella patens
ggtcctttttcctttggtttccgaactacgttccttgacgccacagcggagcggggcgtgccgatctgcagccatgcagatcttcgtgaagaccctgacgggcaagactatcaccctcgaggtggagtcttctgataccatcgacaatgtgaagacgaaaatccaggacaaggagggaattccccccgaccagcagcggttgatcttcgccggaaagcagctcgaggatggacgtaccctggctgactacaacatccagaaggagtcgaccctgcacctggtgcttcgcctgcgaggtggagcgaagaagaggaagaaaaaaacctacacgaagccgaagaaactgaaacacaagaagaagaaagtgaagctcgctgtgttgcagttttacaaagtggatgactccggtaaggtgcagcggctgcggaaggagtgccctaaccctgattgcggggcgggtacgttcatggcgaaccatttcgaccgacactactgtgggaagtgtggtctgacctacgtgtaccagaaggccgaggcttaagtgggcctggtggatacatcatatgtagatgctaatcagaggcactatttccttaacgtgcgttgtgagtgtttagaccgtttggaatgaagtttgattctgtc

SEQ ID NO: 2444 - DNA, 702 bp, Physcomitrella patens
tctctttgctctcctctgtttcggtgacgacgcactcatcacgctgctgctgagcccactagaggaggggcggttcggcctccagccatgcagatctttgtgaagaccctgacgggcaagactatcacccttgaagtggagtcttctgataccatcgacaatgtgaagtcaaaaattcaggacaaggagggaattccccccgaccagcagcggctgatcttcgccggaaagcagctcgaggatggacgcactctggctgactacaatatccagaaggagtcaaccctgcacctggtactccgcctgcgaggtggagcgaagaagaggaagaaaaaaacctatacgaagccgaagaagctgaaacacaagaagaaaaaagtgaagctcgctgtgttgcagttttacaaggtggatgactccgggaaggtgcagcggctgcgtaaggagtgccctaaccctgactgcggggcgggtacgttcatggcgaaccacttcgaccgacactactgtgggaagtgtggtctgacctacgtgtaccagaaggccgaggcttgattgggctgaactatgttctggatgagaggaagtgggcttgaagggtagtgagatatcatgtgcaggtgctagttagaggcagtgtttacttcagtggccaattacttaatagatcacatatgaagtaaatttttttgagtttcacgc

SEQ ID NO: 2445 - DNA, 1411 bp, Physcomitrella patens
cttctttctctcctctgtttcggtgacgacgcaccaccgcagctgctgctgagcccacagaaggagggggcgtgccggccttcagccatgcagatctttgtgaagacccttacgggcaagactataaccctcgaggttgagtcttcggatactattgacaatgtgaagaccaaaattcaggacaaggaggggatccctcccgaccagcagcgattgatattcgccggaaagcagctcgaggatggtcgcaccctcgctgactacaacatccagaaggagtctacccttcaccttgtgcttcgcctgcggggtggagcgaagaaaaggaagaaaaaaacgtacacgaagccgaagaagctgaaacacaagaagaagaaagtgaagctcgcagtgctgcagttctataaggtggatgactccggcaaggtgcagcggctgcggaaggagtgccctaaccctgactgtggggcgggtactttcatggcgaaccacttcgaccgccattactgcggaaagtgtggtctgacctacgtgtatcagaaagctgaggcttgattgatcaaagccgccatttgaatgcttggtattcagcatagggtgtggagacatcacgtgcaggtgctagtcagaggcagtgtttactttgtagatctcacggggagtaatgcgtcttttttgagttgaatctatgaacttggaagggttgtctgggatacggtcgtctttaaattttttttgttggattgtttttgttgatcccctgttagcatgttaatttctgtacgcctttttgttttcttcccgtatctttgtttctctgttaacatcatgcttgctgatttgtcgtggaggagattgtgttgatcacaagatctgtagtcggggttattgtgcacgctcgctcataatttgtctatccgatgtctaaattttctattcgtgaaccacgctcgactttttattgtagtgtcgtaaatgaacccaagaaccgtatcgttttggagagactctgatcccattaccgtgtgactcgataaatctatcttgggaaatgcctgttgaatcggaagttttggtttatgtcgcaccagctatgttaaacacttctggaaggttttactgttgaattacgactcccgcatcacagctgacacagtgattaggtaacctgcccttttccctgtagtgaaatctccttggcccttcatttctgctccttcgaggctttcactcgtgtgcccccacaatcactttcgatcgctatatcaatctgagaaggcaactgatcttctcccattagttcttcttacgggatctttcttccacagcctgccgaacctgaatagataacacacagagttggaagtgggtaacacctatctgattgtgatgtgctaaccacgtcttccac

SEQ ID NO: 2446 - DNA, 647 bp, Rhizophora mangle
ggagcccaccgctggcaacgatgcagatcttcgtgaaaaccctaacggggaagaccataaccctagaggtcgagtcgtcggacacgatcgacaatgtcaaggccaagatccaggacaaagaaggcattccgcccgaccagcagcggctgatcttcgccggaaagcagctggaggacggccggaccctcgccgattacaacatccagaaggagtccactctccaccttgtcctccgcctccgtggtggcgccaagaagaggaagaagaagacttacaccaagccgaagaagatcaagcacaagaggaagaaggttaagctagccgtgcttcagttctacaaggtggatgattctggcaaggttcataagctcaggaaggagtgccccaacgccgagtgcggggccggcaccttcatggccaatcacttcgataggcactactgcggcaagtgtgggcttacttatgtttacaataaagccggtggcgattagacttttctattttagttattagtatcaatgctctattatactttttgattgaatagttactttgtgttttggatctgtttcggaaaatactttttaatactcggtttgtgttggtttagctgcttgaattaactgaaccttgctgttctgagttgc

SEQ ID NO: 2447 - DNA, 579 bp, Rosa hybrid cultivar
aaacattcagaattgagagttgaaagaaaccctagccgtttgtctctcggtggcaacaagatgcagatcttcgtgaaaaccctaacggggaagacgatcaccctggaggtggagtcgtcggacaccatcgacaacgtgaaggccaagattcaagacaaggagggcatcccgccggaccagcagaggctcatcttcgccggaaagcagctcgaggacggccgaaccctagccgactacaacatccagaaggagtccactctccacctggtgcttcgtctccgcggcggagccaagaagcgtaagaagaagacctacaccaagcccaagaagatcaagcacaagcacaagaaggtcaagctcgccgtcctccagttctacaaggtcgacgactccggcaaggtgcagaagctcaggaaggagtgccccaatgccgagtgtgtcgcctggaccttcatggccaaccattttgacaggcactactgtggtaagtgtggcctcttctatgtttaccagaaggccggtggcgactgagtttcttcttttactagcatctgtgttcttggggatttgaacagatgg

SEQ ID NO: 2448 - DNA, 937 bp, Picea glauca
acacccaaacaaaaaccctaacgaggagtggctgttccattcatcataaatcgaataccctcaagtctgttccactatatgactacaggaggagacccgcgtctagggtttgaagggttttagcggagtagaaggcctgtttgcgccgaagggaagtttgttgatggtccaagatgcagatattcgtaaaaacattgactgggaagacaataacactagaggtagagtcctctgatacgatcgacaatgtgaaggccaagatccaagacaaggagggtattccgcccgaccagcagcgcctgatattcgcgggaaagcagctggaagatggccggactctggccgactacaatatccagaaggaatcgaccctgcatctggtcctgcgactgaggggaggtgctaagaagcgaaagaagaagacctacacgaagcccaagaagctcaagcataagaagaagaaggtgaagctcgctgttctgcagtactacaaggtcgatgactcgggcaaggtccagaggcttaggaaggagtgccctaaccaggagtgcggggcagggaccttcatggccaatcattttgataggcattactgtggcaagtgcgggctcacctatgtctatcagaaaggtgccgagtaatttttagggtgattagggtttatgaggtttttagattgagggcgaaaacatttttttttatgtatttgggatcagtatttttgctggtctgaggaatcttgtttctcgtatcttttttcatctgaagtatcatggaaacgtgtgagcacattaaacgaatgatatttttattcgttttcgtttatagatccttgttgctagtatattgttcttgtcattttatatatttgaatgaaacttgttcaatgtgttaaattgacagtattttaattgaagtagatctgtttaataaaaaa

SEQ ID NO: 2449 - DNA, 675 bp, Tamarix hispida
ggggatccatctctcagcagccggagcaagttaactagtgagggttctctgctgaggtgctccagggagagagagaggatgcagatctttgtgaaaaccctaacggggaagacgataaccctagaggttgagtcttccgacaccatcgacaacgtgaaggccaagattcaagacaaagaaggaattccaccagaccagcagcgtctcatcttcgccgggaagcagctcgaagacggccgtaccctagccgactataacatccagaaggagtcaacactccacctcgtgctccgtctccgtggtggtgctaagaagagaaagaagaagacatacaccaagctaaagaagatcaagcacaagcacaagaaagtaaagcttgctgtactgcagttctacaaggtagatgattctggaaaacttaataggttgaggaaagagtgtccaaattccgagtgtggtgctggaacttttatggcgaaccactttgatcgtcattactgtggtaagtgtggtcttacttatgtttatcagaaggcaggtggagattaagtaagctctattaatcggaatgtagcgtctctcgtcgtgtcggattttcattcagggttacaatcggtttccggttaaattacatttgatggtcatgcttgttgattttgatttcaatatcgagaa

SEQ ID NO: 2450 - DNA, 713 bp, Triphysaria pusilla
ggactttcacatttaattcgctcccaaaccctagagccactgaaacacaccctccgccgcgaagatgcagatcttcgtcaagaccctaacgggtaagacgatcaccctcgaggtcgagccctctgacacaatcgacaatgtgaaggccaagatccaggacaaggaaggcatcccaccggatcagcagcgactcatcttcgccggaaagcagctcgaggacggccgcaccctcggcgactacaacatccagaaggagtcgactcttcacctggtcctccgtctccgtggtggcgcgaagaagcgcaagaagaagacctacaccaagccgaagaagatcaagcataagaagaagaaggtgaagctcgcggtcctccagttctacaaggttgatgattcaggaaaggtgcagaggctgaggaaggagtgcccgaatgctgagtgcggcgctgggactttcatggcgaatcactttgataggcactactgtggtaagtgtggtcttacttatgtctacaataaggctggtggagattaagtgttgagatgtgaatctcaggctagttctttctacatgtcatatttttcttctgaacaatttatatcatgacaatcgtctagttttttttgatgttatggatttttgttttaagtaactctcttgaggttggaaacttaattttgattcatctttttattgaatttgcgttgtttat

SEQ ID NO: 2451 - DNA, 515 bp, Fragaria vesca
ctaaggcggtgccaagatgcagatcttcgtgaaaaccctaacggggaagacgatcacgttggaggtggagtcctccgacaccatcgacaatgtgaaggccaagatccaagacaaggagggcatcccgctggaccagcaacgccttatcttcgtcggaaaatagctcgaggacggccggactctcgccgtctacaacatccagaaggagtcgactctccacctggtgctccgcctccgcggtggcgccaagaagcgtaagaagaagacgtacaccaagcccaagaagatcaagcacaagcacaagaaggtcaagctcgccgtgccccagttctacaaggttgatgactccgggaaggtccagaagctcaggaaggagtgccctaacgccgagtgcggcgctgggactttcatggctaaccattttgatcggcactactgcggtaagtgtggtctcacctatgtttacccgaaggctggtggcgattgagcgattcagagtctaaacggtgtcgttt

SEQ ID NO: 2452 - DNA, 700 bp, Catharanthus roseus
caaagaattcggcacgaggccgcatgccgctcttacaatttcagaaccctaaacccattcgtcctcactagtggatccaaagaattcggcacgagggtgaaaaccctcacggggaagaccatcacccttgaggtcgaatcctcggataccattgacaatgtcaaggccaaaattcaggacaaggagggcatcccaccggaccagcagcgtctcatcttcgccggtaagcagctcgaagacggcagaactctagctgactataacatccagaaggaatccacccttcaccttgttcttcgcctccgtggtggcgcaaagaagcgtaagaagaagacctacaccaagccaaagaagatcaagcacaagaagaagaaggtcaagctcgctgttcttcagttttacaaggtagatgacgctgggaatgttcagaggctcaggaaggagtgccccaatggcgactgtggtgcgggtactttcatggccaatcattttgacaggcactattgcggcaagtgtggcctcacctatgtttaccagaaggctggcggcgattaaatgcccgtacttttttgctaaaattcagtagttttaattaagacttttagaatatttggtttactgccatggattttttatagctcgaaacttattggtttttgtcttatggattttactctagaaatgtctattttctgactcc

SEQ ID NO: 2453 - DNA, 477 bp, Pisum sativum
tctcttccggcgcaaaccctaatcctctccgaagatgcagatcttcgtcaaaaccctgacggggaaaaccatcaccctcgaggtcgagtcttccgacaccatcgacaatgtcaaagcaaagatccaagataaggaaggaatcccaccggaccaacagcgactgatctttgccggcaaacagctagaagacggccgcactcttgctgactacaacatccagaaggaatccaccctccaccttgttctccgtctccgcggtggagccaagaagcgtaagaagaagacctacaccaagccgaagaagattaagcacaagcataggaaggtgaagctagctgttcttcagattttacaaggtcgatgattctgggaaggttcagaggttgaggaaggagtgcccgaatgcggagtgcggtgcggggacttttatggcgaatcactttgatcgtcactactgtggcaagtgtggtttgacct

SEQ ID NO: 2454 - DNA, 675 bp, Adiantum capillus-veneris
gtgctggttgacgaaggaaagcgtccggagctcacagatcacctccatctctgcaaccatgcagatattcgttaaaaccttgaccggtaagactatcaccttagaggttgagtcctctgatacaatcgtcaatgtgaaaactaagatccaagacaaggaaggcatccctcctgaccagcagcgactcattttcgctggaaaacagcttgaggatggccgaactctagccgattacaacattcagaaagaatccacccttcaccttgtgctcaggttgaggggaggtgccaaaaagaggaaaaagaagacttacaccaagcccaagaagctcaagcacaagaagaaaaaggtgaagcttgcggcgcttcagttttacaaggtggatgattctggcaaggtgcagcgcctgcgcaaggagtgcccgaatggggagtgtggtgccgggactttcatggcaaatcatcatgatcgacactactgtggcaagtgtggtcttacatatgtttatcagaaggcttgattttgaaatcaatggcaacaattttgggtggaaatggggacttttacggcaaaccatcaggaccgccatgattatgacgagtgtgggcttgaattttaattgtcattccacaagatttttgtggttaccatgtgtgatttgttagtgtggagttt

SEQ ID NO: 2455 - DNA, 700 bp, Abies balsamea
gcgacgaggaattgtctagagctgctgctgttttctgtctgcaaccgtaaccatgcagatcttcgttaaaacactgactggtaagactattacccttgaggtagagtcctctgatacaattgataatgtgaagactaagattcaagataaggagggtattcctcctgaccagcaacgtttgatttttgctggcaagcagttggaagatgggagaactctggctgattacaatattcagaaagagtccaccctgcacctggttcttcgtctgagaggtggtgccaagaaaagaaagaagaagacctacaccaagcctaagaaactcaagcacaagaagaagaaggtcaagttggctgttttgcagtactacaaggttgatgactccggcaaggtgcaaagattgcgcaaggaatgcccaaaccaggagtgcggggctggtacatttatggcaaaccattttgaccgtcactattgtggaaagtgtggtctgacttatgtctatcagaaggctggtgcggagtagtttcacttttttattggactttcggtttttagatgatagacatcttaaattttggccttagtttaaattagtttaatattaggaacatccaatttcctcgactcggaaattatattgacactattgaagttaaattgtttctttttattatttaactaattatatggaacatatttt

SEQ ID NO: 2456 - DNA, 756 bp, Cedrus atlantica
ggaattgtctagagctgctgctgttttctgtctgcaactgcaatcatgcagatcttcgttaaaacactgactggtaagacgattacccttgaggtagagtcttctgatacaattgataatgtgaagactaagattcaagataaggagggtattcctcctgaccagcaacgtttgatttttgctggcaagcagttggaagatgggagaactctggctgattacaatattcagaaagagtcaaccctacatctggttcttcgtctgagaggtggtgccaagaagagaaagaagaagacctacaccaagcctaagaaacttaagcacaagaagaagaaggtcaagttggctgttctgcagtactacaaggtggatgattctggcaaggtgcaaagattgcgcaaggaatgcccgaatcaggagtgcggggctggtacatttatggcaaaccattttgaccgccactattgtggaaagtgtggtctgacttatgtctatcagaaggctgctgccgagtagtttctctttttgatcctgctgctgagtagtttctctttttgatccttctgccatggaaggcctattgttcgttggactttcctcttttttgatgatagacatcttaatgattttggtgttagtttaatattaggaatatccaatttctttgatatttggaaatatcggaaattatgttgactctatagacgttagattgtttcttatcaaaactacttaataaggaacattttaaaagcc

SEQ ID NO: 2457 - DNA, 721 bp, Ceratodon purpureus
tcatcagcaccccggtgacgacgcaaattttttgctgagcctgagtgcggcctccaagatgcagatctttgtgaagaccctgacggggaagacgatcaccctagaggtggagtcttcggatacgatcgacaatgtgaagaccaagattcaggacaaggagggcatcccgcctgaccagcagcggctcatctttgcgggcaagcagctggaggacgggcgcaccctcgccgactacaacatccagaaggagtctaccttgcacttggtgcttcgtctgaggggaggcgctaagaagaggaagaaaaaaacctacactaagcccaagaagctgaaacacaagaagaagaaagtgaagctagcggtgctgcagttctacaaggtggacgactccggcaaggtgcagcgtctccgcaaggagtgccctaaccctgactgtggggctggtacgttcatggccaaccacttcgaccgccactactgcggcaagtgcggcctgacctacgtctaccagaaggccggcgcagagtagagtgcagggagccttacggctttatgtagtggggttgctttttcctggagtggggttgagctcgtgtgtgcaggtgccagccgaggcagtgtgtgtgtgacaatcctgtcccatccaatgttgtttccagactttgtggattaatgaagcattcattttgcaatcgactccggtttgtgtcgttcatttccg

SEQ ID NO: 2458 - DNA, 627 bp, Ceratodon purpureus
gacgacgcaaacgattgctgagcctgagcgcggccgccaccatgcagatcttcgtcaagaccctgacggggaagacgatcacccttgaggtggagtcttcggatacgatcgacaatgtgaagaccaagattcaggacaaggagggcattccgcccgaccagcagcgcctcatctttgcggggaagcaattggaggatgggcgcacgctcgccgactacaacatccagaaggagtccactcttcacctggtgctccgactgcgcggtggagcgaagaagaggaagaaaaaaacctacaccaagccgaagaagctgaagcacaagaagaagaaagtgaagctcgcagtgctgcaattctacaaggtggacgactccggcaaggttcagcgcctgcgtaaggagtgccccaaccctgactgtggggcggggacgttcatggccaatcacttcgatcgccactactgcggcaagtgcggtctgacctatgtctatcagaaggctggtgcagagtagagctaggggctagttcgtgggtgcaggtgctagttgaggcagtacataattccgtatgtgatgttgtttcaagaccctgtggaaaaaagaacgattcggttcatttgacttcgcc

SEQ ID NO: 2459 - DNA, 600 bp, Primula obconica
tggtgtagaagaaaaaagatgcagatatttgtgaaaacgctgacgggaaagacgataaccttagaagtagaatcatcagacacaatcgacaatgtgaagtctaagatccaagacaaggaaggcatccctcccgaccagcagcgtctcatcttcgctggtaaacagctcgacgacggcaggacactcgccgactacaacatccagaaggagtcgacactccacctcgtcctccgtctccgtggtggtgccaagaagaggaagaagaagacttacaccaagcccaagaagatcaagcacaagaagaagaaggtcaagctttctgttcttcagttttacaaggttgatgattctggcaaggtccagagactgaggaaagagtgtcccaccccagaatgcggagctggtacgtttatggccaaccatttcgataggcattattgtggtaagtgtggcctcacctatgtttaccagaagcctggtggagactgatctcggttgttctttctttatgagggttttgtttttggtttgttatgtttagagatatgctactctgttgttggttaaattttgctggataattttgattctggaggtttg

SEQ ID NO: 2460 - DNA, 867 bp, Sciadopitys verticillata
cgccctaaaaaataaactggaaccctaaataatcgaatggggtaaagtaattgccctaaaagttgctcatatatataaacgaagcatcagtgtttagggttttttaaaatcgagaagagctggtggcggccggaaggctaagaaagtctgtagcagagcgaggttcgttgatggttcaagatgcagatattcgtaaagacattgactggtaagacaataaccctagaggtagagtcctctgatacgatcgacaatgtgaagaccaagattcaggacaaggagggcattccccccgatcagcagcgtctgatctttgctggaaagcagctagaagatggccgaactcttgctgattacaatatccagaaggagtcgacccttcatctggtccttaggctgaggggtggtgctaagaagagaaagaagaagacctacacaaagcccaagaagatcaagcacaagaagaagaagatcaagttggctgttttgcagtactacaaggtggatgactctggcaaggtccagaggctcaggaaggagtgccccaaccaggagtgtggtgctggaacattcatggccaatcactttgataggcattactgtggcaagtgtggcttaacttatgtctatcagaaggctggtggagagtaatctatactaatgaatgtggttagttggggttttatgtattaggtttagactatttatttgcgctagtgagggattttgatgatatgttttggtgggctaacggcttcttagaaggcgaggaaatttgaagctcggatttagacatcgtttatttaattggtatttttcaatggataatatgtaccctttgagagactagtctattgcagttgatat

SEQ ID NO: 2461 - DNA, 687 bp, Arabidopsis lyrata
tgctattaacccacaatacccgggggtttcaagcaaattagcacaccgccgcaaagatgcagatcttcgtgaaaaccctaacggggaagacgatcactctcgaggtcgagtcctctgacaccatcgacaatgtcaaggccaagatccaagacaaggaaggtatcccaccggatcagcagcgattgattttcgccggaaagcagctcgaagacggacgtaccttagccgattacaacatccagaaggaatcaacgcttcaccttgtccttcgtctccgtggtggtgctaagaagaggaagaagaagacctacaccaagcctaagaagatcaagcacaagcacaagaaggtcaagctcgctgttctccagttctacaaggttgatggttcaggtaaggttcagcgtctgaggaaggagtgccctaacgctacctgtggtgctgggactttcatggctagccatttcgatcgtcactactgtggtaagtgtggtctcacctacgtttaccagaaagaaggtggcgaagcatgatctctcgtttatcgtttagctctctctctctctctctctttgaatattgcttttgaagtttttttgatgttatggatcttttgttaaacatcttttaaggatattatgctttggttattcgttaatgcttgctaagttgatgcgaatcatacgttcg

SEQ ID NO: 2462 - DNA, 746 bp, Arabidopsis thaliana
caaccactactcttttatttcttctcaccacttaaagagtttccccagaaattttcttccgccgtaaaagcaaaaaaagatgcagatcttcgtgaaaaccctaacggggaagacgatcactctcgaggtcgagtcctctgacaccatcgacaatgtcaaggccaagatccaagacaaggaaggaatcccaccggaccagcagcgattgattttcgccggaaagcagctcgaagacggacgtaccttagccgattacaacatccagaaggaatcaacgcttcaccttgtccttcgtctccgtggaggtgctaagaagaggaagaagaagacctacaccaagcctaagaagatcaagcacaagcacaagaaggtcaagctcgctgttcttcagttctacaaggttgatggttcaggtaaggttcagcgtttgaggaaggagtgccctaacgcaacctgtggtgctgggactttcatggcgagtcatttcgatcgtcactactgtggtaagtgtggtctcacctacgtttaccagaaagaaggagctcaggaatgattttcatctcgatctctatcattttgaattgaatactgctttttttttggaatttggaagttgtttttggatgttgtggatcttatgttgaacttgtttgaatttcatatctaggtttttcttatggatatttttatgctctttatttgaattactttcaaatcttattgcatgattgatttatagttcacac

SEQ ID NO: 2463 - DNA, 755 bp, Artemisia annua
aaaaataaccctagcagcagcagccgcaaaccaaaatgcagatcttcgtgaaaaccctcacgggtaaaaccatcaccctcgaagtcgagtcctcggacaccatcgacaacgtcaaagccaagatccaggacaaggaaggcatcccaccagaccagcagagattgatttttgccggtaagcagttggaggatggacgtaccctagcagactacaacatccaaaaggagtcgaccctccatctggtcctgcgtctccgtggaggagcaaagaagaggaagaagaagacgtacacaaagcccaagaagatcaagcacaagcacaggaaagtgaagctagcagtgttgcagttttacaaagtgggagatgatggaaaagtgatgaggttgaggaaagagtgtcctaatgctgagtgtggggccgggacttttatggctagtcacaaggataggcattactgtggtaagtgtggtttgacttatgtctaccagaaggctggcggtgattgattcagattgtgatttgagacattttgtctgaagaaggatggttatggttatggtttgttattttgctagatgttgttttttatatttcctatgaaagtactattgtctttattatgttttatgtcagacttgttgagatggtatgatgttaatctactatgaagttttgttatggtttatgttgttttgagttgattagttattattattatctgggctagttttgatgaagatatgtgtcatttctag

SEQ ID NO: 2464 - DNA, 594 bp, Brassica juncea
aaagatgcagatcttcgtgaagaccctaacggggaagacaatcaccctcgaggtcgagtcctccgacaccatcgacaacgtcaaggccaagatccaggacaaggaaggcatccctccggaccagcagcggctgatcttcgccggaaagcagctcgaggacggacgcaccttagccgactacaacatccagaaggagtcgactctccacctcgtcctccgtctccgcggtggcgccaagaagaggaagaagaagacgtacaccaagcccaagaagatcaagcacaagcacaagaaggtgaagctcgccgtgctccagttctacaaggtggatggctccggcaaggtccagcgtctgaggaaggagtgccctaacgcgacgtgtggcgctgggacgttcatggctagccattttgatcgtcactactgtggtaagtgtggtcttacttacgtttaccagaaggaaggtggcgaagcatgatctctcgtttatcgtttagctctctctctctctctctctttgattattgcttttgaagtttctttttggatcttttgttaaacatcttttgaggatattatgctttggttattcgt

SEQ ID NO: 2465 - DNA, 656 bp, Brassica juncea
cgcggggaagctcaattttttttcttttcactccgccgttggctttacacagaagcaaagatgcagatcttcgtgaaaaccctaaccgggaagaccatcaccctcgaggtcgagtcctccgacaccatcgacaatgtcaaggccaagatccaggacaaggaaggcatccctccggaccagcagcgactgatcttcgccgggaagcagctggaggacggacgcaccctcgccgactacaacatccagaaggagtccactctccacctcgtcctccgtctccgcggtggcgccaagaagaggaagaagaagacgtacacgaagccgaagaagatcaagcacaagcacaagaaggtgaagctcgccgtgctccagttctacaaggtggatggctccggcaaggtccagcgtctgaggaaggagtgccctaacgcgacttgtggcgctgggacgttcatggctagccatttcgatcgccactactgtggtaagtgcggtctcacgtacgtttaccagaaggaaggtgccgaagcatgatctcgtttatcgtttagatctctctctctctatctttgaattttgagaacttttgaagttttttttttatggtatggatcttatgttaaacatcttttatggataatatgctatggtttaac

SEQ ID NO: 2466 - DNA, 763 bp, Brassica juncea
cgcagagtacacggggatagcacagaacaagcgcagatcattttttctttgtttcattccgccgttgggtacacaaaagcaaagcagcaaagatgcagatcttcgtgaagaccctaacggggaagacaatcaccctcgaggtcgagtcctccgacaccatcgacaacgtcaaggccaagatccaagacaaggaaggcatcccaccggaccagcagcgactgatcttcgccgggaagcagctcgaagacggacgcaccctcgccgactacaacatccagaaggagtcgacgctccacctcgtcctccgtctccgcggtggcgcgaagaagaggaagaagaagacgtacaccaagccgaagaagatcaagcacaagcacaagaaggtgaagctcgcggtgcttcagttctacaaggtcgatgggtctggtaaggtgcagaggctgaggaaagagtgtcctaacgcgacttgcggtgctgggacgttcatggcgagtcatttcgatcgtcattactgtggtaagtgtgggcttacttacgtttaccagaaagagggagctgaggcatgatgatctttctctcgctgtttctttttttttttctctgtctttaatttcgtttttttggtaatttcataaacttgtaatggattcgatgtttgaacatgttttgttctggatttcttatctagattgatgagctttaattatgttggtcctttgattagtctttaaaaaaagtattcatttattaatatccacaagaa

SEQ ID NO: 2467 - DNA, 697 bp, Brassica juncea
gcaaagatgcagatctttgtgaaaacccttacgggaaaaacaatcaccctcgaggtcgagtcctccgacaccatcgacaatgtcaaggccaagatccaggacaaggaaggcatccctccggaccagcagcgactgatcttcgccgggaagcagctggaagacggccgcacgctcgccgactacaacatccagaaggagtcgacgcttcatctcgtcctccgtctccgcggtggcgccaagaagaggaagaagaagacgtacaccaagcccaagaagatcaagcacaagcacaagaaggtgaagctcgcggtgctccagttctacaaggtggacgggtccggcaaggtgcagaggctgaggaaggagtgtcctaacgcgacttgcggtgcggggactttcatggcgagtcacttcgatcgtcactactgtggtaagtgtgggcttacctatgtttaccagaaggagggagccgaggcgtgatttattgaaccggtagattgatctctctctatttccggtttgataatttcataaggtagtttttgttttatcatgtaatggattcgatgttgaactggttttggtctggatttcggtttttaattatgttggaactttgattagtctgaaatacatttcttgcaatatctgcaattacctcttatcttgctatctcgattatgtttgcgaattagat

SEQ ID NO: 2468 - DNA, 730 bp, Brassica juncea
gcaaagatgcagatcttcgtgaaaaccctcacggggaagaccatcaccctcgaggtcgagtcctccgacaccatcgacaacgtcaaggccaagatccaggacaaggaaggcatccctccggaccagcagcgactgatcttcgccgggaaacagctcgaagacgggcgtaccctcgccgactacaacatccagaaggagtcgacgcttcatctcgtcctccgtctccgtggtggcgcgaagaagaggaagaagaagacgtacaccaagccgaagaagatcaagcacaagcacaagaaggtgaagctcgcggtgcttcagttctacaaggtcgatgggtctggtaaggtgcagaggctgaggaaagagtgtcctaacgcgacttgcggtgctgggacgttcatggcgagtcatttcgatcgtcattactgtggtaagtgtgggcttacttacgtttaccagaaagagggagctgaggcatgatgatctttctctcgctgtttcttttttttttctctgtctttaatttcgtttttttggtaatttcataaacttgtaatggattcgatgtttgaacatgttttgttctggatttcatatctagattgatgagctttaattatgttggtcctttgattagtctttaatacatttcttgcaaaatatttaatcatcttatatccgaattatcaaatgctcatcaatctagataagaaatccagaacaaaacttg

SEQ ID NO: 2469 - DNA, 727 bp, Brassica juncea
gcaaaattagcacaccgccgcaaagatgcagatctttgtgaaaacccttacgggaaaaacaatcaccctcgaggtcgagtcctccgacaccatcgacaatgtcaaagccaagatccaggacaaggaagggatcccacctgaccagcagcgactgattttcgccgggaagcagctcgaagacggacgcacgctcgccgactacaacatccagaaggagtcgacgcttcatctcgtcctccgtctccgcggtggcgcgaagaagaggaagaagaagacctacaccaagcccaagaagatcaagcacaagcacaagaaggtgaagctcgcggtgctccagttctacaaggtcgacggatccggaaaggtgcagaggctgaggaaggagtgtcctaacgccacttgcggcgcggggactttcatggcgagtcatttcgatcgtcattactgtggtaagtgtggactcacctacgtttaccagaaagagggtgccgaggcttagatctctctgtttatctatcgttgagaagtgatttttgataatttcgtaatcttttgtaatggattcgatgttgaacatgttttgttctggatttcttatctagactgatgaaagttattacatttttacttatgttggtcctgtttttacttgcctaagcttatgttttgtctcatttgcgaattagcttgaatttatttactattgttatagaaaaaaaaaaaaaaa

SEQ ID NO: 2470 - DNA, 636 bp, Brassica oleracea
ggtctcttcgtttcatctatttgttcgcacagccgcaaagatgcagatcttcgtgaaaaccctaacggggaagacgatcaccctcgaggtcgaatcctccgacaccatcgacaacgtcaaggccaagatccaagacaaggaaggcatcccgccggaccagcagcggctgatcttcgccgggaagcagctcgaggacggcaggaccctcgccgactacaacatccagaaggagtcgacgcttcacctcgtcctccgcctccgcggtggcgcgaagaagaggaagaagaagacgtacaccaagcccaagaagatcaagcacaagcacaagaaggtgaagctcgcggtgctccagttctacaaggtcgatgggtctggtaaggtgcagaggctgaggaaagagtgtcctaacgccacttgtggggctgggacgttcatggcgagtcatttcgatcgtcattactgtggtaagtgtgggcttacttacgtttaccagaaagagggtgccgaggcttgatctctttgtctatctttaacgaatggtttttggttttggtaatttcgttaaagcttattgtaaggaattcgatgtttggacaagttttgttctggattgattaaagttgttacatttttacg

SEQ ID NO: 2471 - DNA, 627 bp, Brassica oleracea
actccgccgttggcttacagagaagcaaagatgcagatcttcgtgaaaaccctaacggggaagacaatcaccctcgaagtcgaatcctccgacaccatcgacaatgtcaaggccaagatccaggacaaggaaggcatccctccggaccagcagcgactgatcttcgccggaaagcagctggaggacggacgcaccctcgccgactacaacatccagaaggagtcgactctccacctcgtcctccgtctccgcggtggcgccaagaagaggaagaagaagacctacactaagccgaagaagatcaagcacaagcacaagaaggtgaagctcgccgtgctccagttctacaaggtggatggctccggcaaggtccagcgtctgaggaaggagtgccctaacgcgacctgtggtgctgggacgttcatggctagccatttcgatcgtcactactgtggtaagtgtggtctcacttacgtttaccagaaggaaggtggcgaagcatgatctctcgtttatcgtttagctctctctctctctctctctctctttgaatactgctttttgaagtttttttggatgttatggatctttttgttaaacatcatttaaggatattatgctttggtt

SEQ ID NO: 2472 - DNA, 713 bp, Brassica oleracea
ggttttttcaagcaaattagcacaccgccgcaaagatgcagatcttcgtgaaaaccctaacggggaaaacaatcaccctcgaggtcgagtcctccgacaccatcgacaatgtcaaggccaagatccaggacaaggaagggatccctcccgaccagcagcgactgattttcgccgggaagcagctcgaagacggacgcacgctcgccgactacaacatccagaaggagtcgacgcttcatctcgtcctccgtctccgtggtggcgcgaagaagaggaagaagaagacgtacaccaagcccaagaagatcaagcacaagcacaagaaggtgaagctcgctgtgctccagttctacaaggtggacggatccggcaaggtgcagaggctcaggaaggagtgtcctaacgcgacttgcggtgccgggactttcatggcgagtcacttcgatcgtcactactgtggtaagtgtgggcttacctatgtttaccagaaggagggtgccgaggcatgatttattgaaccggtagattgatctctctctctctctctctctcgatttcggtttggtgatttcataaggtagtttttgttttatcatgtaatggattcgatgttgaactgattttggtctggatttcgttttttaattttgttggaactttgattactctgaaatacatttcttgcaatatctggaatcattttttatcttgcc

SEQ ID NO: 2473 - DNA, 821 bp, Brassica oleracea
gagcgttccaaaaccctaagaggtgcccgtctctctcgtacaaatacctcactctccattttcttcttccactcagccgtttgtttgttagcaccgccgcaaagatgcagatcttcgttaaaaccctaacggggaagaccatcaccctcgaggtcgagtcctccgacaccatcgacaacgtcaaggccaagatccaggacaaggaaggcatccctccggaccagcagcgactgatcttcgccgggaaacagctggaagacggccgtaccctcgccgactacaacatccagaaggagtcgacgcttcatctcgtcctccgtctccgtggtggtgccaagaagaggaagaagaagacgtacaccaagccgaagaagatcaagcacaagcacaagaaggtgaagctcgcggtgctccagttctacaaggtcgatggatctggtaaagtgcagaggctgaggaaagagtgtcctaacgcgacttgcggtgctggaactttcatggcgagtcatttcgatcgtcattactgtggtaagtgtgggcttacttacgtttaccagaaagagggagctgaagcatgatctctctctcgctgtctcttttttctctatctttaatttcgttttttggtaatttcataaacttgtaatggattcgatgtttgaacatgttttgctctggattttttttatctagatcgatgagttttataaggtgtttaattatgttggtcctttgattagtcttaattacacttcttgcaacttatataatcatcttgtatccgaattgacaaatgcccccacaagctgtagttagtttct

SEQ ID NO: 2474 - DNA, 644 bp, Brassica rapa
tttgttagcaccgccgcaaagatgcagatcttcgtgaaaaccctcacggggaagaccatcaccctcgaggtcgagtcctccgacaccatcgacaacgtcaaggccaagatccaggacaaggaaggcatccctccggaccagcagcgactcatcttcgccgggaaacagctcgaagacggccgtaccctcgccgactacaacatccagaaggagtcgacgcttcatctcgtcctccgtctccgtggtggcgcgaagaagaggaagaagaagacgtacaccaagccgaagaagatcaagcacaagcacaagaaggtgaagctcgcggtgcttcagttctacaaggtcgatggatctgggaaagtgcagaggctgaggaaagagtgtcctaacgcgacttgcggtgctgggacgttcatggcgagtcatttcgatcgtcattactgtggtaagtgtggacttacttacgtttaccagaaagagggagctgaggcatgatgatctttctctcgctgtctctttttttttctctgtctttaatttcgtttttttggtaatttcataaacttgtaatggattcgatgtttgaacatgttttgttctggatattgatgagttttataagatgtttatcctttgattagtct

SEQ ID NO: 2475 - DNA, 684 bp, Brassica rapa
gagaacaagctcaattttttttttcctttcactccgccgttggcttacacagaatcaaagatgcagatcttcgtgaaaaccctcacggggaagacaatcaccctcgaggtcgagtcctccgacaccatcgacaatgtcaaggccaagatccaggacaaggaaggcatccctccggaccagcagcgactgatcttcgccgggaagcagctcgaggacggacgcaccctcgccgactacaacatccagaaggagtccactctccacctcgtcctccgtctccgcggtggcgccaagaagaggaagaagaagacgtacacgaagccgaagaagatcaagcacaagcacaagaaggtgaagctcgccgtgctccagttctacaaggtggatggctccggcaaggtccagcgtctgaggaaggagtgccctaacgcgacgtgtggcgctgggacgttcatggctagccattttgatcgtcactactgtggtaagtgtggtcttacttacgtttaccagaaggaaggtggcgaagcatgatctctcgtttatcgtttagctctctctctctctctctctttgattattgcttttgaagtttctttttggatcttttgttaaacatcttttgaggatattatgctttggttattcgttaatgcttgctaagttgatgccgaaaaaaaaaaa

SEQ ID NO: 2476 - DNA, 723 bp, Brassica rapa
cacaccgccgcaaagatgcagatctttgtgaaaacccttacgggaaaaacaatcaccctcgaggtcgagtcctccgacaccatcgacaatgtcaaggccaagatccaggacaaggaaggcatccctcccgaccagcagcgactgattttcgccgggaagcagctggaagacggccgcacgctcgccgactacaacatccagaaggagtcgacgcttcatctcgtcctccgtctccgtggtggcgcgaagaagaggaagaagaagacgtacaccaagcccaagaagatcaagcacaagcacaagaaggtgaagctcgccgtgctccagttctacaaggtggacgggtccggcaaggtgcagaggctgaggaaggagtgtcctaacgcgacttgcggtgcggggactttcatggcgagtcacttcgatcgtcactactgtggtaagtgtgggcttacctatgtttaccagaaggagggagccgaggcgtgatttatcgaaccggttgattgatgatctctctcgatttcggtttggtagttttataagcgttttttgtcttattatgtaatggattcgttgttgaactgcttttggtctggatttcgttttttaattatgttggaactttgattagtctaaaatacatttcttgcaatatcttcaatcatctcgattatgtttgcgaattagattgaaaaacagtttcacggcaaaaaaaaaaaa

SEQ ID NO: 2477 - DNA, 645 bp, Brassica rapa
cacttgttgtctcttcgtttcatctctttgttcgcacagccgcaaagatgcagatcttcgtgaaaaccctaacggggaagacgatcaccctcgaggtcgaatcctccgacaccatcgacaacgtcaaggccaagatccaagacaaggaaggcatccctccggaccagcagcggctgatcttcgccgggaagcagctcgaggacgggaggaccctcgccgactacaacatccagaaggagtcgacgcttcacctcgtcctccgcctccgcggtggcgcgaagaagaggaagaagaagacgtacaccaagcccaagaagatcaagcacaagcacaagaaggtgaagctcgcggtgctccagttctacaaggtcgatgggtctgggaaggtgcagaggctgaggaaagagtgtcctaacgccacctgtggggctgggacgttcatggcgagtcatttcgatcgtcattactgtggtaagtgtgggcttacttacgtttaccagaaggagggtgccgaggcttgatctctttgtcttatctttaaggattggtttttggttttggtaatttcgtaagcttattgtaagggattcgatgtttggacatgttttgttctggattgattaaagttattacattatgttactc

SEQ ID NO: 2478 - DNA, 679 bp, Brassica rapa
acaaatacctcactctccattttttttttcctactcagccgtttgttttgttagcccgccgcaaagatgcagatcttcgtgaaaaccctcacggggaagaccatcaccctcgaggtcgagtcctccgacaccatcgacaacgtcaaggccaagatccaggacaaggaaggcatccctccggaccagcagcgactcatcttcgccgggaaacagctcgaagacggccgtaccctcgccgactacaacatccagaaggagtcgacgcttcatctcgtcctccgtctccgtggtggcgcgaagaagaggaagaagaagacgtacaccaagccgaagaagatcaagcacaagcacaagaaggtgaagctcgcggtgcttcagttctacaaggtcgatggatctgggaaagtgcagaggctgaggaaagagtgtcctaacgcgacttgcggtgctgggacgttcatggcgagtcatttcgatcgtcattactgtggtaagtgtgggcttacttacgtttaccagaaagagggagctgaggcatgatgatctttctctcgctgtctcttttttttttctctgtctttaatttcgtttttttttggttatttcataaacttgtaatggattcgatgtttgaacatgttttgttctggatttcttatctagattgatgagctttaac

SEQ ID NO: 2479 - DNA, 650 bp, Brassica rapa
cacaccgccgcaaagatgcagatctttgtgaaaacccttacgggaaaaacaatcaccctcgaggtcgagtcctccgacaccatcgacaatgtcaaggccaagatccaggacaaggaaggcatccctcccgaccagcagcgactgattttcgccgggaagcagctggaagacggccgcacgctcgccgactacaacatccagaaggagtcgacgcttcatctcgtcctccgtctccgtggtggcgcgaagaagaggaagaagaagacgtacaccaagcccaagaagatcaagcacaagcacaagaaggtgaagctcgcggtgctccagttctacaaggtggacgggtccggcaaggtgcagaggctgaggaaggagtgtcctaacgcgacttgcggtgcggggactttcatggcgagtcacttcgatcgtcactactgtggtaagtgtgggcttacctatgtttaccagaaggagggagccgaggcgtgatttattgaaccggtagattgatctctctctatttccggtttgataatttcataaggtagtttttgttttatcatgtaatggattcgatgttgaactggttttggtctggatttcggtttttaattatgttggaactttgattagtctgaaatacatttctt

SEQ ID NO: 2480 - DNA, 719 bp, Brassica napus
atcaacgcagagtacgcggggcaagcaaattagcacaccgccgcaaagatgcagatctttgtgaaaacccttacgggaaaaacaatcaccctcgaggtcgagtcctccgacaccatcgacaatgtcaaggccaagatccaggacaaggaaggcatccctcccgaccagcagcgactgattttcgccgggaagcagctcgaagacggccgcacgctcgccgactacaacatccagaaggagtcgacgcttcatctcgtcctccgtctccgtggtggcgcgaagaagaggaagaagaagacgtacaccaagcccaagaagatcaagcacaagcacaagaaggtgaagctcgccgtactccagttctataaggtcgatgggtccggcaaggtgcagaggctgaggaaggagtgtcctaacgcgacttgcggtgcggggactttcatggcgagtcacttcgatcgtcactactgtggtaagtgtgggcttacctatgtttaccagaaggagggagccgaggcgtgatttatcgaaccggttgattgatgatctctctcgatttcggtttggtagttttataagcgttttttgtcttattatgtaatggattcgttgttgaactgcttttggtctggatttcgttttttaattatgttggaactttgattagtctaaaatacatttcttgcaatatcttcaatcatctcttatcttgctatcac

SEQ ID NO: 2481 - DNA, 736 bp, Brassica napus
gactctccattttcttctccccactcagccgtttgttttgttagcaccgccgcaaagatgcagatcttcgtgaaaaccctcacggggaagaccatcaccctcgaggtcgagtcctccgacaccatcgacaacgtcaaggccaagatccaggacaaggaaggcatccctccggaccagcagcgactgatcttcgccgggaaacagctcgaagacggccgtaccctcgccgactacaacatccagaaggagtcgacgcttcatctcgtcctccgtctccgtggtggcgcgaagaagaggaagaagaagacgtacaccaagccgaagaagatcaagcacaagcacaagaaggtgaagctcgcggtgcttcagttctacaaggtcgatgggtctggtaaggtgcagaggctgaggaaagagtgtcctaacgcgacttgcggtgctgggacgttcatggcgagtcatttcgatcgtcattactgtggtaagtgtgggcttacttacgtttaccagaaagagggagctgaggcatgatgatctttctctcgctgtttctttttttttttctgtctttaatttcgttttttttggttatttcataaacttgtaatggattcgacgtttgaacatgttttgttctggatttcttatctagattggtgagctttaattatgttggtcctttgattagtcttaaatacatttcttgcaacttatttaatcatcttatattcgaatt

SEQ ID NO: 2482 - DNA, 685 bp, Brassica napus
caagcaaattagcacaccgccgcaaagatgcagatcttcgtgaaaaccctaacggggaaaacaatcaccctcgaggtcgagtcctccgacaccatcgacaatgtcaaggccaagatccaggacaaggaagggatccctcccgaccagcagcgactgattttcgccgggaagcagctcgaagacggacgcacgctcgccgactacaacatccagaaggagtcgacgcttcatctcgtcctccgtctccgtggtggcgcgaagaagaggaagaagaagacgtacaccaagcccaagaagatcaagcacaagcacaagaaggtgaagctcgctgtgctccagttctacaaggtggacggatccggcaaggtgcagaggctcaggaaggagtgtcctaacgcgacttgcggtgccgggactttcatggcgagtcacttcgatcgtcactactgtggtaagtgtgggcttacctatgtttaccagaaggagggtgccgaggcatgatctattgaaccggtagattgatctctctctctctcgatttcggtttggtgattttataaggtagtttttgttttatcatgtaatggattcgatgttgcactgattttggtctggatttcgttttttaattatgttggaactttgattactctgaaatacatttcttgctatatcgattatgttt

SEQ ID NO: 2483 - DNA, 696 bp, Brassica napus
gcactcagccgtttgtttgttagcaccgccgcaaagatgcagatcttcgttaaaaccctaacggggaagaccatcaccctcgaggtcgagtcctccgacaccatcgacaacgtcaaggccaagatccaggacaaggaaggcatccctccggaccagcagcgactgatcttcgccgggaaacagctggaagacggccgtaccctcgccgactacaacatccagaaggagtcgacgcttcatctcgtcctccgtctccgtggtggtgccaagaagaggaagaagaagacgtacaccaagccgaagaagatcaagcacaagcacaagaaggtgaagctcgcggtgctccagttctacaaggtcgatggatctggtaaagtgcagaggctgaggaaagagtgtcctaacgcgacttgcggtgctggaactttcatggcgagtcatttcgatcgtcattactgtggtaagtgtgggcttacttacgtttaccagaaagagggagctgaagcatgatctctctctcgctgtctcttttttctctatctttaatttcgttttttggtaatttcataaacttgtaatggattcgatgtttgaacatgttttgctctggattttttttatctagatcgatgagttttataaggtgtttaattatgttggtcctttgattagtcttaattacacttcttgcaactt

SEQ ID NO: 2484 - DNA, 722 bp, Brassica napus
gatcacttgttgtctcttcgtttcatctatttgttcgcacagccgcaaagatgcagatcttcgtgaaaaccctaacggggaagacgatcaccctcgaggtcgaatcctccgacaccatcgacaacgtcaaggccaagatccaagacaaggaaggcatcccgccggaccagcagcggctgatcttcgccgggaagcagctcgaggacgggaggaccctcgccgactacaacatccagaaggagtcgacgcttcacctcgtcctccgcctccgcggtggcgcgaagaagaggaagaagaagacgtacaccaagcccaagaagatcaagcacaagcacaagaaggtgaagctcgcggtgctccagttctacaaggtcgatgggtctgggaaggtgcagaggctgaggaaagagtgtcctaacgccacctgtggggctgggacgttcatggcgagtcatttcgatcgtcattactgtggtaagtgtgggcttacttacgtttaccagaaggagggtgccgaggcttgatctctttgtcttatctttaaggattggtttttggttttggtaatttcgtaagcttattgtaagggattcgatgtttggacatgttttgttctggattgattaaagttattacattatgttacttatgttggtcttttaagtaatctctgtcgtcgattatgtttgaatttgataattgcaaaacaaattagaatctaa

SEQ ID NO: 2485 - DNA, 777 bp, Brassica napus
ctatgatgaagatgagtgtcaaaagagctgcaaacttatttgcgtatatagtccagttagtgagaagctctgaaagcatagcgccaagcaaaccgaataatgcaccagaggcttttttttttccactccgccgttggcttacagagaagcaaagatgcagatcttcgtgaaaaccctaacggggaagacaatcaccctcgaagtcgaatcctccgacaccatcgacaatgtcaaggccaagatccaggacaaggaaggcatccctccggaccagcagcgactgatcttcgccggaaagcagctggaggacggacgcaccctcgccgactacaacatccagaaggagtcgactctccacctcgtcctccgtctccgcggtggcgccaagaagaggaagaagaagacctacactaagccgaagaagatcaagcacaagcacaagaaggtgaagctcgccgtgctccagttctacaaggtggatggctccggcaaggtccagcgtctgaggaaggagtgccctaacgcgacctgtggtgctgggacgttcatggctagccatttcgatcgtcactactgtggtaagtgtggtctcacttacgtttaccagaaggaaggtggcgaagcatgatctctcgtttatcgtttagctctctctctctctctctctctctctctttgaatactgcttttgaagtttttttggatgttatggatcttttgttaaacatcatttaaggatattatgctttggttattcgttaatgcttgctttttaaa

SEQ ID NO: 2486 - DNA, 633 bp, Brassica napus
gaagctcaatttttttttcttcactccgccgttggctttacacagaagtaaagatgcagatcttcgtgaaaaccctcacggggaagacaatcaccctcgaggtcgagtcctccgacaccatcgacaatgtcaaggccaagatccaggacaaggaaggcatccctccggaccagcagcggctgatcttcgccgggaagcagctggaggacggacgcaccctcgccgactacaacatccagaaggagtcgacactccacctcgtcctccgtctccgcggtggcgccaagaagaggaagaagaagacgtacacgaagccgaagaagatcaagcacaagcacaagaaggtgaagctcgccgtgctccagttctacaaggtggatggctccggcaaggtccagcgtctgaggaaggagtgccctaacgcgacgtgtggtgctgggacgttcatggctagccatttcgatcgtcactactgtggtaagtgtggtcttacttacgtttaccagaaggaaggtggcgaagcatgatctctcgtttatcgtttagctctctctctctctctctttgattattgcttttgaagtttctttttggatcttttgttaaacatcttttgaggatattatgctttgg

SEQ ID NO: 2487 - DNA, 706 bp, Curcuma longa
gcacgcgtcgccgctccgttgacggatctcgagccgtagccctcctggcggcgccggcaagatgcagatcttcgtgaagacgctgacggggaagacgatcaccctcgaggtggagtcgtcggacacgatcgacaacgtgaaggcgaaaatccaggacaaggagggcatcccgccggaccagcagaggctcatcttcgccgggaagcagctcgatgacgggcgcacccttgccgactacaacatccagaaggagtccactctgcacctggtgctccgcctccgcggcggcgccaagaagcgcaagaagaagacctacaccaagcccaagaaaatcaagcacaagaagaagaaggtcaagctcgccgtcctccagttctacaaggtcgacgacgcaactggtaaggtcacccgtctccgtaaggagtgccccaacaccgagtgcggcgcaggcaccttcatggccaatcacttcgatcgccactactgtggcaaatgcggcctgacctacgtctacaataaggccggggctgagtgatgaataccaccgtactgttttctagttcgataaaagtctgcgttttgctaagattctgtcgtttttcatgttcatgttttatcgatgcagttttggtttaaaaattgctctttgtttagtatcaaacggtagtcttgtttaatgcttcaagaatgattgaggtaacgctct

SEQ ID NO: 2488 - DNA, 730 bp, Liriodendron tulipifera
ggagagaggaggaggaggaggagaggaaaaccctaaccctagcgtcgccatctgcatccgaagatgcagatcttcgtaaaaaccctaacgggtaagaccatcacgctggaggtcgagtcctcggactcgatcgacaccgtgaaatccaagatccaggacaaggaagggatcccgcccgaccagcaacgcctcatcttcgccggaaagcagctcgaggacggccgcacgctcgcggactacaacatccagaaggagtcgacgctccatctcgtcctccgcctgcgaggcggcgcgaagaagcgcaagaagaagacgtacacaaagcccaagaagatcaagcacaagaagaagaaggtgaagctcgcagtcctccaattctacaaggtcgacgattccggcaaggttcaacggctgaggaaggagtgtcctaacaccgagtgtggtgccggcaccttcatggccaaccatttcgatcgccactactgcggtaaatgcggcctcacctacgtttaccagaaggctggcggcgagtaggccgttgctggatttagcgttttcggatctttaattttgaattctagggcttaaatgaggatgctttggtaatgatagagttttggacctgtttgaatgtcttttctttattttagtagtgatgaaatggagcttgatttgagacttatggttgattatgtggaaatgaagtagaattttttctgccgtttctttt

SEQ ID NO: 2489 - DNA, 773 bp, Mimulus guttatus
atttcagaaaattgcagactcattttttcatcagcacacaaaccctagccaccccttgcagccgcgaagatgcagatcttcgtcaagaccctaacgggcaagacaatcacgctcgaggttgaatcctccgacaccatcgacaatgtcaaggccaagatccaggataaggaaggcatccctccggaccagcagaggctcatcttcgccgggaaacagctcgaggacggccgcacgctcgcagattacaacatccagaaggagtcgactctccaccttgtcctccgtctccgtggtggtgctaagaagcgcaagaagaagacctacaccaagccgaagaagctcaagcacaagaagaagaaggtcaagctttctgttctccagtactacaagattgatgattccggcaaggtccagaggctgaggaaggagtgcccgaatgctgagtgcggcgctggaacttttatggcgaatcactttgacaggcactactgtggtaagtgtggacttacttatgtctacgccaagactgctggagattgagattgagagatattttatgcttttttcatcgttttgcgaactccttttattatgacagttatctaggtttttaaattatgaattttggttttgaagtaatgttccgacattggaatttaaattttaatttatctttcttttaattatgtctctgtttatttatttttttaatgcttgagttctgcatctactgctttgattgctaaattgttatgattgtgtgatattccttt

SEQ ID NO: 2490 - DNA, 640 bp, Raphanus sativus
ggattcagccgcaaagatgcagatcttcgtgaaaaccctaacggggaagacgatcaccctcgaggtcgaatcttccgacaccatcgacaatgtcaaagccaagatccaggacaaggaaggaatcccaccggaccagcagcgactgatcttcgccgggaaacagctggaagacggccgcaccctcgcagactacaacatccagaaggagtcgacgcttcatctcgtcctccgtctccgcggtggtgcgaagaagaggaagaagaagacgtacaccaagcccaagaagatcaagcacaagcacaagaaggtgaagctcgccgtcctccagttctacaaggttgatggatctggtaaagtgcagaggctgaggaaagagtgtcctaacgcgacttgcggtgctgggacgttcatggcgagtcatttcgatcgtcattactgtggtaagtgtggtcttacttacgtttaccagaaagaaggagctgaggcatgatctctctctccctatctcgctgtcacttttctctatctttagtttcgctttggtaatttcgtaaacttgtcttctttcttttttttattgtaatggattcgatgatgaacatgttttgttctggatttcttatctagattgatgagtttt

SEQ ID NO: 2491 - DNA, 647 bp, Raphanus sativus
  misc_feature (161)..(161): n is a, c, g, or t
  misc_feature (176)..(176): n is a, c, g, or t
  misc_feature (398)..(398): n is a, c, g, or t
ggactttacattccgccgttggctacacagagaagaagcagcaaaagatgcagatcttcgtgaaaaccctaacggggaagacaatcaccctcgaggtcgagtcctccgacaccatcgacaatgtcaaggccaagatccaggacaaggaaggcatccctccngaccagcagcgactnatcttcgccgggaagcagctggaggacgggcgcaccctcgccgactacaacatccagaaggagtcgactctccacctcgtcctccgtctccgcggtggcgccaagaagaggaagaagaagacgtacaccaagcccaagaagatcaagcacaagcacaagaaggtgaagctcgccgtgctccagttctacaaggttgatggctccggcaaggtccagcgtctnaggaaggagtgccctaacgcgacgtgtggcgcgggaacgttcatggctagccatttcgatcgtcactactgtggtaagtgtggtctcacttacgtttaccagaaagaaggcgccgaagcatgatctcgttttctcgttttagatctctctcttatctttgaatacttgcttttgaatttttgttgctgttttggatctcatgttaaacatgttttaaggatattatgctttggttattcattaatgctt

SEQ ID NO: 2492 - DNA, 667 bp, Raphanus sativus
gggttttcaaacagtctgttagcacccccgccgcaaagatgcagatcttcgtgaaaaccctaacgggtaagacgataaccctcgaggttgagtcctctgacaccatcgacaacgtcaaggccaagatccaggacaaggaaggaatccctccggaccagcagcgactgatcttcgccgggaagcagctggaagacggccgcaccctcgccgactacaacatccagaaggagtcgacgcttcatctcgtcctccgtctccgtggtggggccaagaagaggaagaagaagacgtacaccaagccgaagaagatcaagcacaagcacaagaaggtgaagctcgccgtgctccagttctacaaggtcgacggatccggcaaggtgcagaggctgaggaaagagtgtcctaacgcgacttgcggcgcgggaactttcatggcgagtcacttcgatcgtcattactgcggtaagtgtgggctcacttacgtttaccagaaagagggagctgaggcatgattgcttaaacgtttataagcgtttttgtcttgttatgtaatggattcggtgttgaacttggtttggttttgtctggattttgtttttttttgttttaattatgttggtactttgattagtctgaaatacatttcttgcaatatcttctatcagca

SEQ ID NO: 2493 - DNA, 632 bp, Raphanus sativus
  misc_feature (415)..(415): n is a, c, g, or t
ccactcagccgcaaagatgcagatcttcgtgaaaaccctaacggggaagacaatcaccctcgaggtcgaatcatccgacaccatcgacaatgtcaaggccaagatccaggacaaggagggaatcccaccggaccagcagcgactgatcttcgccgggaaacagctggaagacggccgcaccctcgccgactacaacatccagaaggagtcgacgcttcatctcgtcctccgtctccgcggtggcgccaagaagaggaagaagaagacgtacaccaagccgaagaagatcaagcacaagcacaagaaggtgaagctcgccgttctccagttctacaaggtcgacggatctggtaaggtgcagaggctgaggaaagagtgtcctaacgcgacgtgcggtgctgggacgttcatggcnagtcatttcgatcgtcattactgtggtaaatgtggtcttacttacgtttaccagaaagagggagctgaggcatgatctctctatctctgtctcgatgtcactttctctatctttaatttcgctttggtaatatcataaacttgtcttttcttttttttttttgtaatggattcgatgatgaacatgttttgttctggatttcttatctagattgatg

SEQ ID NO: 2494 - DNA, 811 bp, Picea glauca
ttaattaaattaatcccccccccccccgggcaaatttgtggcggcgacgaaggaattgtctagagctgctgctgttttttgtctgcaactgcaacaatgcagatcttcgttaaaacattgactggtaagactattaccctcgaggtagagtcatcggacacaatcgataatgtgaaggctaagattcaagataaggagggtattcctcctgatcagcaacggttgatttttgctggcaagcagttggaggatgggagaactctggctgattacaatattcagaaagagtcaaccctacacctggtacttcgtctgagaggtggtgccaagaagagaaagaagaagacttacaccaagcctaagaaactcaagcacaagaagaagaaggttaagttggctgttctgcagtactacaaggtcgatgactctggcaaggtgcaaagattgcgcaaggaatgcccaaaccaggactgcggggctggtacatttatggcaaaccattttgaccgtcactattgtggaaagtgtggtctgacttatgtctatcagaaggctgctgcggagtaatttttcttttggattctgctgctgcaatggaaggcctattgttcattggactttcctttttaggatgagacatgtcttaatgtttttggcattggtttaaattagtttaatattaggaacatccaatttccttgatattatcataaatattggaaattatatcaactctattgaagttagattgtttctgtttattttaattacttatatggaacagttttgcttgttacttaattttgtatct

SEQ ID NO: 2495 - DNA, 673 bp, Triphysaria pusilla
tagaagtaaaactgcaacagctctctgaagatgcaggtcttcgtgaaaaccctaacgggtaagaccatcaccctcgaggtcgagccctccgacacgatcgacaacgtcaagtccaagatccaggacaaggaaggcatcccgccggaccagcagcgcctcatctttgccggaaagcagctcgaggatggccgcactctcgccgactacaacattcaaaaggagtcgacgctccacctcgtccttcgcctccgcggaggcgcgaagaagcgcaagaagaagacgtataccaagccgaagaagatcaagcacaagaagaagaaggtgaagctcgccgtgctgcagttctacaaggtggacgattccggtaaggtgcagaggctgagaaaggaatgcccgaacgccgagtgtggagctggaacattcatggcgaaccactttgatcgacactactgtggtaagtgtggcttaacttatgtctacaataaggctggcgaaagttgagatttgagagatttgatcttaataatgacattttgaatttgactattgagtagtatgtttgctgttttatggattatgttagtttcacttttctgagaattttattattattaatacttattatttctgttaattgtaacttgtgttagttcaatttacagcaatcatatgc

SEQ ID NO: 2496 - DNA, 833 bp, Zamia vazquezii
  misc_feature (786)..(786): n is a, c, g, or t
  misc_feature (797)..(806): n is a, c, g, or t
  misc_feature (808)..(808): n is a, c, g, or t
  misc_feature (810)..(812): n is a, c, g, or t
  misc_feature (815)..(816): n is a, c, g, or t
  misc_feature (818)..(818): n is a, c, g, or t
  misc_feature (820)..(822): n is a, c, g, or t
  misc_feature (825)..(826): n is a, c, g, or t
  misc_feature (828)..(828): n is a, c, g, or t
  misc_feature (832)..(832): n is a, c, g, or t
gctaccgggctaccggagatagctcgcggcgacgaaggaagtgtcttgagctgctgagttatatcctgccgagactggtgggatttcgctgctaccatgcagatattcgttaaaacactgacaggtaagacaatcacccttgaggtggagtcttctgatacgattgacaatgtgaaaactaagattcaggacaaggaagggattcctcctgatcaacaacgcttgatttttgctggcaagcaactggaggatggacgaactttggctgattataatattcagaaagagtcaaccctgcatttggttcttcggcttaggggtggtgccaagaagaggaagaagaagacctatacaaagcctaagaagatcaagcacaagaagaagaagatcaagttggctgtgttgcaatactacaaggttgatgactctggcaaagtgcagagattacgcaaggaatgccccaatcaggagtgtggggctggaacatttatggcaaaccattttgaccgacactactgtgggaagtgtggtctgacttatgtctaccagaaggctggggctgagtaaactgtgcttttcgcaaattttccatgcgaaatcagcacatttgtgttccattattttctttgttttaggagagaaccttttatgttttatttttcaaaactttatacttttcatgttagaaaattttgaatgttatataaactctattcaagagagcatagcctcctcttgtaatgatcaactggatgtgtttgggtttcatttacatgaactattgtntatatgcattnnnnnnnnnntntnnntgnncntnnntannancttnt

SEQ ID NO: 2497 - DNA, 616 bp, Arnica chamissonis
ggtaagacgatcacgttggaggtcgaatcctccgacacaatcgacaacgtgaaggccaagatccaagacaaggaaggcataccaccagatcagcaacgtcttatcttcgccggaaaacagcttgaggacggcaggacgctagcggactacaatatccagaaggaatcaactctccacctggtcctccgtctccgtggtggcgcaaagaagcgaaagaagaagacatacaccaaaccgaagaagatcaagcacaagcacaagaaggtgaagttgagcgtgttgcagttctacaaggttgatgattcggggaaagtgcagcggttgaggaaagagtgccctaacgccgagtgcggtgccggaactttcatggctaatcattttgataggcactactgcggtaaatgtggtcttacctatgtctaccagaaggcttaaggttgattgatttaactaagtgttttctttctgttatatgttatggatgatttttatttcgtttctattgtggcaaacctatttgatcgttttgctttttaatttatagtttgaatgctttatatgattaacttcgtactgtattgtttcattatctatcagttaaatgttcatacactgc

SEQ ID NO: 2498 - DNA, 649 bp, Arnica chamissonis
cgggtaagacgatcacgttggaggtcgaatcctccgacacaatcgacaacgtgaaggccaagatccaagacaaggaaggcataccgccggaccagcaacgtcttatcttcgccggaaaacagcttgaggacggcaggacgctagcggactacaacatccagaaggaatcaactctccacctggtcctccgtctccgtggtggcgcgaagaagcgaaagaagaagacatacaccaaaccgaagaagatcaagcacaagcacaagaaggtgaagttgagcgtgttgcagttctacaaggttgatgattcggggaaagtgcagcggttgaggaaagagtgccctaacgcagagtgcggtgccggaactttcatggctaatcattttgataggcactactgcggtaaatgtggtcttacctatgtctaccagaaggcttaaggttgattgatttaattaagtgttctctttctgttatatgttatggatgatttttgatttcgtttctattgttgcaaacctagatgatcgttttgctttttaatttatagtttgaatgctttatatgattaatttcgtactgattgtttgattatctatcagtagatgttcatacactgcctgaatatgccctgttttagatgctatttctt

SEQ ID NO: 2499 - DNA, 736 bp, Pseudotsuga menziesii
aaaaaccctaattgtgcgatatgataactatatgatgccctcgtacaggatcgaaagctctagcggagtagcaggcttagtagcgtcgaagggagggaagtttgttgatggtccaagatgcagatattcgtaaaaacattgacaggtaagacaataacactagaggtagaggcctctgatacgatcgacaatgtgaaggccaagatccaagacaaggagggtattcctcccgaccagcagcgcctgatattcgcgggaaagcagctggaagatggccggactctggccgactacaacatccagaaggaatcgaccctgcatctggtcctccgactgaggggaggtgccaagaagcgaaagaagaagacctacacgaagcccaagaagctcaagcacaagaagaagaaggtcaagctcgctgttctgcagtactacaaggtcgatgactctggcaaggtccagaggttgaggaaggagtgccctaaccaggagtgcggagcagggaccttcatggccaatcatttcgataggcattactgtggcaaatgcgggctcacctatgtttaccagaaaggtgctgagtaatttagaggggttttagtgttagtagggtttatgggtgttttagacaagggcaaaaacatgttttatttttcttatttgagataagtatttttgttggcctgagaaatcctatttctcagatttttcatcttatttattatggaaagttgag

SEQ ID NO: 2500 - DNA, 733 bp, Selaginella moellendorffii
gtcaaggcgaggagcggcggcgaagaaggacgagtctggagccatgcagatcttcgtcaagacattgaccggcaagaccatcactttggaggtcgagtcctcggatacgatcgacaatgtgaagaccaagatccaggacaaggagggcatccccccggaccagcagcgcctcatcttcgcgggcaagcagctcgaggatgggcgcacgctcgcggactacaacatccagaaggaatccacgctccacttggtgctgcgcctccgcggtggcggcaagaagaggaagaagaagacgtacaccaagcccaagaagatcaagcacaagaagaagaaggtgaagctcgcggtgctccagtactacaaggtggacgattcgggcaaggtgaacaggctgcgcaaggagtgccccaatccagagtgtggcgccgggactttcatggcgaatcactttgatcgtcactactgtggcaagtgtggactcacctatgtctaccagaaggccgaggcgtagagagcctgggatgagagctctcttctcccattttcctggaacgctaagtctctctcttttgatttcctttctaagctcttgctatatggcagtgttgttttgtaggctagcttctcttgttaaaggtggtgctttggtaagcaattgccaaagcttttctattcacgagttgtatctctatttccagggctttcttagaaatagagtctaagcattccactc

SEQ ID NO: 2501 - DNA, 741 bp, Selaginella moellendorffii
gggctcgtcgaggcgaggagcggcggcgaagaaggacgagtctggagccatgcagatcttcgtcaagacattgaccggcaagaccatcactttggaggtcgagtcctcggatacgatcgacaatgtgaagaccaagatccaggacaaggagggcatccccccggaccagcagcgcctcatcttcgcgggcaagcagctcgaggatgggcgcacgctcgcggactacaacatccagaaggaatccacgctccacttggtgctgcgcctccgcggtggcggcaagaagaggaagaagaagacgtacaccaagcccaagaagatcaagcacaagaagaagaaggtgaagctcgcggtgctccagtactacaaggtggacgattcgggcaaggtgaacaggctgcgcaaggagtgccccaatccagagtgtggcgccgggactttcatggcgaatcactttgatcgtcactactgtggcaagtgtggactcacctatgtctaccagaaggccgaggcgtagagatcctgggatgagagctctcttctcccattttcctggaacgctaagtctctctcttttgatttcctttctaagctcttgctatatggctgtgttgttttgtaggctagcttctcttgttaaaggtggtgctttggtaagcaattgccaaagcttttctattcacgagttgtatctctatgttccagggctttcttagaaatagagtcttaagcattccactc

SEQ ID NO: 2502 - DNA, 522 bp, Pisum sativum
gcttctaaccaatgcaacgctattttttttctttctcccaatttccatctcttccggcgcaaaccctaatcctctccgaagatgcagatcttcgtcaaaaccctgacggggaaaaccatcaccctcgaggtcgagtcttccgacaccatcgacaatgtcaaagcaaagatccaagataaggaaggaatcccaccggaccaacagcgactgatcttcgccggcaaacagctagaagacggccgcactcttgctgactacaacatccagaaggaatccaccctccaccttgttctccgtctccgcggtggagccaagaagcgtaagaagaagacctacaccaagccgaagaagattaagcacaagcataggaaggtgaagctagctgttcttcagttttacaaggtcgatgattctgggaaggttcagaggttgaggaaggagtgcccgaatgcggagtgcggtgcgggacttttatggcgaatcactttgatcgtcactactgtggcaagtgtggtttgacct

SEQ ID NO: 2503 - DNA, 1719 bp, Artemisia annua
ttaaaccattcttacaatattctctaaccaaacccacaaaaatggcagcttccacaatggctctatcctcttcttttgtaggccaagcggtgaaagtggctctgatatcactgttggacgtgtttccatgaggaaggcagcaacagccaagaaagttgccccatcaggaagcccatggtacggtcccgaccgtgttaagtacttgggcccattctctggtgaggccccatcttacctcactggagaattcccaggtgactacggttgggacacctttctgctgacccagagacttttgccaagaaccgtgagctagaggtgatccactcaagatgggccatgcttggttcggtgaggctgtttggttcaagccagatctttagctacttgggtaacccaagcttggtccatgcacaaagcattttggccatctgggctactcaagtgatcttgatgggcgcagttgagggttacagaattgctggtggcccattgggtgaggttgttgacccactttaccctggtggtagctttgacccattgggccttgctgatgaccctgaggcaaatggaagactagctatgttttcgatgttcggattctttgttcaagccattgtgaccggaaagggacctttggagaacttggctgaccaccttgctgaccctgttgcaaacaatgcttggtcatatgccacattgatgtcatattgtttgtgaattattattagtaatatatggtttaattttgaagcatcaaattaataactataaagagtaacaccatttgcactcaaatatactctacgacgtgtctctatttccaaaaaggtaaaaagagcttcagcttatgaatttgtttttctcccaaaaatactaaagcaacttcataggccttggtaataccgtcgcaatcaccccaaaaagcaattagcaacaatttgtaaccagcctcctaaataaaatctaacagtaaatgaccatcacgaccattttaatgaaatcactaaatcataactgatttagctggtaacataataaaacaatcaacaataataaaactacaaaagttaacctattcaaattgactaaatataaagcaacatcatccggttatcaacgttttaaccaaaataacataaacatcctgaataataatccaaaacatcacataaccaatatctaaacttttaataagatcaaaatgaattccaacaaaagttgccaaactcagaattcttcaatctcctcacctcagacttattaagccttctggtagagataggtcaaaccacacttgccacaataatgcctattctcatgattagccataaaagtcccggcaccacactcagcattaggacactctttcctcaacctattaaccttcccatcctcacccactttgtaaaactgcaacacagcaagcttcaccttcttatgcttgtgcttaatcttcttgggctttgtgtacgtcttcttcttacgcttcttagcacccccacgtagacgcaggaccaaatgaagggtggactctttctggatgttgtagtctgctaaggtgcggccgtcttctagctgctttcctgcgaagattaaacgttgttggtctggtgggatgccttccttgtcttggatcttggctttcacattgtcgatggtgtccgaggactcgacttcgagggttatggttttcccggttagggttttcacgaagat

SEQ ID NO: 2504 - DNA, 802 bp, Zostera marina
ggggattctccagaagaggggaaaaagagaggcattgtttagagaaaaccctaattccgccgtcgtcacaaccaaacatgcagatctttgtgaaaaccctaacggggaagacgatcaccctcgaggtcgaatcttcggatacgatcgataacgtgaaggccaagattcaggacaaagaaggaatcccaccagaccagcagcgtttgatcttcgccgggaagcagcttgaggatggacgtacacttgctgactataatattcagaaggagtcaactcttcacctggttctccgtctacggggaggagccaagaagaggaagaagaagacctacaccaagccgaagaagatcaagcataagcataagaaggtcaagctcgccgtgctccagttttacaaggtggatgattccggaaaggtcgtcaggctgagaaaggagtgccccaatgcagaatgtggtgctggaactttcatggcgaaccacttcgatcggcattattgcggtaaatgcggtatgaccttcgtttactccaatgccgccggagtcgattgatgatcgggctttgatagtcttcgctggtttattgttatttgtttacttttgttttgatcgcattttgtttttttaaatctttctatcctgttatacgacatgatgagagttcttgtttggattatttttgcgttttaactcgcttttgatcctgaaatcagtagattatttatcgttacttgtttttttttggagtgttcgggatggagaagtctctaatttaaatccagagataaataaataaattttga

SEQ ID NO: 2505 - DNA, 710 bp, Arabidopsis lyrata
aaaatccccattttgatcttttagtccagccgttgcctcaaaagatgcagatcttcgtgaaaaccctaacggggaagaccataaccctagaggttgaatcgtccgacaccatcgacaatgtgaaagcgaagatccaagacaaggaaggaatcccaccggaccagcagcgattgattttcgccgggaaacagctggaagacggccgtaccctcgccgactacaacatccagaaggagtcgacgcttcatctggtcctccgtctccgtggtggtgctaagaagaggaagaagaagacatacaccaagccgaagaagatcaagcataagcataagaaggttaagctcgctgttcttcagttttacaaaatcgatggatctggaaaagttcagcgtctgaggaaagagtgccctaacgcaacttgtggagctgggactttcatggcgagtcattttgatcgccattactgtggtaagtgtggactcacttacgtttaccagaaagaaggaggtgacgaatgatctgttctagcaaccgctagatctatctttctcattctctctatgattctctcttatctttaaaaaactgcatttctatttgggaattttgtaacctttttttttgttatcatggattctatgttgaacatctttcgttatgaattatgaaagttttaggatttttatggattcttattatgttgttccttc

SEQ ID NO: 2506 - DNA, 684 bp, Arabidopsis thaliana
aaaatccccattttgataatcttcagcagccgttgcctcaaaagatgcagatcttcgtgaaaaccctaacggggaagaccataacccttgaggttgaatcatccgacaccatcgacaatgtgaaggcgaagatccaagacaaggaaggaatcccaccggaccagcagcgattgattttcgccgggaaacagcttgaagacggccgtaccctcgccgactacaacatccagaaggaatcgacgcttcatctcgtcctccgtctccgtggtggtgctaagaagaggaagaagaagacttacaccaagccgaagaagatcaagcacaagcataagaaggttaagctcgctgttcttcagttttacaaaatcgatggatctggaaaggttcagcgtttgaggaaggagtgccctaacgcaacctgtggagctgggactttcatggcgagtcattttgatcgccattactgtggtaagtgtggactcacctacgtttaccagaaagaaggagttgaagcttgatctgttgtagcggtagatcgatccttctctttctctcttatcttttaaaaactgcatttctatttgggaattttgtaagctctttaatttgagttatcatggattctatgttgaacatctttcgttctggattataaattatggaaggttttaggattttatggat

SEQ ID NO: 2507 - DNA, 740 bp, Zingiber officinale
  misc_feature (7)..(7): n is a, c, g, or t
  misc_feature (17)..(17): n is a, c, g, or t
  misc_feature (22)..(22): n is a, c, g, or t
  misc_feature (54)..(54): n is a, c, g, or t
  misc_feature (185)..(185): n is a, c, g, or t
  misc_feature (188)..(188): n is a, c, g, or t
  misc_feature (200)..(200): n is a, c, g, or t
  misc_feature (305)..(305): n is a, c, g, or t
cgaaccntagccctctnggcgncgccggcaagatgcagatcttcgtgaagacgntgacggggaagacgatcaccctcgaggtggagtcgtcggacacgatcgacaacgtgaaggcgaaaatccaggacaaggagggcatcccgccggaccagcagaggctcatcttcgccgggaagcagctcgangangggcgcaccctngccgactacaacatccagaaggagtccactctgcacctggtgctccgcctccgcggcggcgccaagaagcgcaagaagaagacctacaccaagcccaagaaaatnaagcacaagaagaagaaggtcaagctcgccgtcctccagtactacaaggtcgacgacggaactggtaaggtcacccgtctccgtaaggagtgccccaacgccgagtgcggcgccggcaccttcatggctaatcacttcgatcgccactactgtggcaaatgcggcctgacgtacgtctacaataaggccggggctgagtgatgaacaccatcgtattgttttctagtttgataaaagtctgcgatttactaagatactgttgtctttaatgatcatgttttatcgatgcagttttggtttaaaaaaattgctctttatttagtatcgaacggtagtcttgtttaagtttcaagaatgattgagataacgctctattcgaactgttaattcaatttggtgattctccatggttgcttatattgtcaaaaaaaaaaa

SEQ ID NO: 2508 - DNA, 714 bp, Thellungiella halophila
ggttggctagccagaagcaaaaatgcagatcttcgtgaaaaccctaacggggaagacaatcaccctcgaggtcgagtcctccgatacgatcgacaatgtcaaggccaagatccaggacaaggaaggaatccctccggaccagcagcgattgatcttcgccgggaagcagctcgaggacggacgcaccctcgccgactacaacatccagaaggaatcgacgcttcacctcgtcctccgtctccgtggtggcgcgaagaagaggaagaagaagacctacaccaagcctaagaagatcaagcacaagcacaggaaggtcaagctcgccgttctccagttctacaaggtcgatggctccggcaaggtccagcgtctgaggaaggagtgccctaacgcgacatgtggtgctggaaccttcatggctagccatttcgatcgtcactactgtggtaagtgcggtctcacttacgtctaccagaaagaaggaggcgaagagtgatctcgctttatcctaacatctccatcttggattactgcttttcttaatttttgggaattttcgaagtgtttttgctgttatggatcttattatgttgaacatctatggttctggatttcgtatctagaacccgaatttctaggtttattttatggatattatgccctcgttgtgttcttcgttaatgcttgttcagtctattatgctaattcattact

SEQ ID NO: 2509 - DNA, 783 bp, Thellungiella halophila
gctgatatttttttttttctgcagccgagatacgcttttgccgcaaagatgcagatctttgtgaaaaccctaacggggaagacaataacccttgaggtcgaatcgtcagacaccatcgacaatgtgaaagcgaagatccaagacaaggaaggaatcccaccggaccagcagcgattgatattcgccggaaaacagctggaagacgggcgcacactcgccgactacaacatacagaaggagtcgacgcttcatctcgtgctccgtcttcgtggtggtgcgaagaagaggaagaagaagacgtacacgaaaccgaagaaaatcaagcataagcataggaaggtgaagctcgctgttctccaattctacaaagtcgatggatctggtaaggttcagcgtctcaggaaagaatgcccaaacgcaacttgcggtgctggaacgttcatggctagtcacttcgatcgccattactgtggcaagtgtggtctcacttacgtctaccaaaaagagggagctgaggaatgataccttaaatcggtagatgtatcactctctctctctctttctctatctcttaagaactggttacgatttggtacttttataagttttgttggttgtaatggattcggtgttaaacatcttttgttctggatttcttatctggagtgatgatatttctagttttaaattctgttagcccgttgattaatcttttatacattactttgaacaccttcaatcatttcttcgtttagcaactttggtttagcatttttttttgag

SEQ ID NO: 2510 - DNA, 926 bp, Abies balsamea
cgaccaaagaaacaagcaaacaaaaaccctaacgaggagtggccgttccattcatcacaaattgaataccctaaaatctgtcccaccatataattactcgataccctcgtatagggttcgaagggttttagcggaggagaatacctggttgcgccgaagggaagtttgttgatggtcgaagatgcagatattcgtgaaaacattgactggtaagacaataactctagaggtagagtcctctgatactatcgacaatgtgaaggccaagatccaagacaaggagggtattccgcccgaccagcagcgcctgatattcgctggaaagcagctggaagatggacggacgctggccgactacaacatccaaaaggaatcgaccctgcatctggtcctccgactgaggggaggtgcaaagaagcgaaagaagaagacctacacgaagcccaagaagctcaagcacaagaagaagaaggtcaagctagctgttctgcagtattacaaggtcgatgactcgggcaaggtccagaagcttaggaaggagtgccctaaccaagactgcggggcagggaccttcatggccaatcattttgacaggcattactgtggcaagtgcgggctcacctatgtctaccagaaaggtgccgagtaattttaggatattttgtgctattagggtttatgtgagttttagaatatgggtgagaacacgtttttttagtttatttgggatcagtatttttgctggtccgagcaatcttgtttcgcggatttttttcaccttaattattacggaaacttgaatcagcactttggacgaatgttatttttcattctcgtgtgcatagattcttgttgctagtaaattgttcttctcatattcttatatcgttgtcagtaaacctgtctaatgtgttaaattgacaata

SEQ ID NO: 2511 - DNA, 618 bp, Centaurea maculosa
gcgggggccccaaagcagatcttcgtgaaaccctaaccggcaagacgatcaccctggaggtggaatcctccgatacaatcgacaatgtcaaatccaagatccaagacaaagaaggcatcccaccggaccagcagcgtctcatcttcgccggaaaacagctcgaggacggcagaaccctagcggactacaacatccagaaggagtccaccctccacctggtcctccgcctccgcggtggtgccaagaagaggaagaagaagacctacaccaagccgaagaagatcaagcacaagcacaagaaggtgaagcttagcgttttgcagttctacaaggtggatgattctggaaaggtgcagaggctgagaaaagagtgtccgaatgcagagtgtggagctggaacgttcatggcgaaccatttcgatcggcattattgtggtaagtgtgggcttacttatgtctaccagaaggcttaatggttaatcgaattagataagtatattttctgtttttctataagagatggatgattttggttttgaatctggagttttgttgttgttttttggtgaaacttggatgatgttgctttgaatttgatgaattcgagctttttagttc

SEQ ID NO: 2512 - DNA, 610 bp, Eucalyptus grandis
  misc_feature (323)..(323): n is a, c, g, or t
tgaagaccctgacggggaagacgataaccctcgaggtcgagtcgagcgacaccatcgacaatgtgaaggccaagatccaggacaaggagggcatcccccccgaccagcagcgcctcatcttcgccgggaagcagctcgaggacggccgcaccctggccgactacaacatccagaaggagtccaccctccacctcgtcctccgcctccgcggcggcgccaagaagcgcaagaagaagacctacaccaagcccaagaagatcaagcataagaagaagaaggtcaagctcgccgtcctccagttctacaaggtcgacgactccggnaaggtccagcgcctccgcaaggagtgccccaacgccgagtgcggcgccggcaccttcatggccaaccacttcgaccgccactactgcggcaagtgcggcctcacctacgtctaccagaaggccggcggtgattgaagggcctatgctgctcgttgccctttttcttttagcgtctattcgttccatgtttacagctttcgaggatttacatattcccttctggattttgattggtggtcgctaagtcgagacgttttcttttcgatgaatacatttgctcgttataa

SEQ ID NO: 2513 - DNA, 748 bp, Linum usitatissimum
ccacgcgtccgaattcgcatcggcgacaacccccaaatcctctctcagtcgagctctgcaacgatgcagatcttcgtgaagaccctcacgggtaagacaatcaccctcgaggtggagtcgtcggacaccatcgacaatgtcaaggccaagatccaggacaaggaaggaatcccaccggaccagcagaggctgatcttcgccgggaagcagctggaggacgggcgcaccctcgctgactacaacatccagaaggaatcgactctccacctggtgctccgcctccgcggtggcgccaagaagaggaagaagaaggtgttcaccaagccaaagaagatcaagcacaagaagaagaaggtgaagctcgcggtgctccagttctacaaggtggaggactccggcaaggtgcagaggctgaggaaggagtgccccaacgcggagtgcggagctggaacgttcatggcgaaccacttcgacaggcactactgtggcaagtgcggcatgacttacgtctacaacaaagccggatccgactaggtttttttgcagctgtttgttatctgtttcagtcggatttataatgtctatgtttaagtttggatatcgttttagttttgatgttttgaatatctggggtggctgaaaggtttcatctttctggctgtggatgatgttaattgttgaattttgatggtttagattctgttatatgcaaaacaacgatttcctgcataaaaaaaaaaaaaaaaaa

SEQ ID NO: 2514 - DNA, 723 bp, Marchantia polymorpha
  misc_feature (545)..(545): n is a, c, g, or t
gtaatgttgggctgcgcacatagcagcgaagaaggaatagtctggagcttctgccgtgccgcttaaaattgccgttctgagagttcgtaaacatgcagatctttgtaaagaccctaacgggcaagactatcacccttgaggtggagtcttcggataccatcgacaatgtgaagaccaagatccaggacaaggaggggattcctccggatcagcagcgattgatcttcgcgggcaagcagctggaagatggtcgcactcttgccgactacaacattcaaaaggagtctaccttgcaccttgtgctcagacttcgtggaggagcgaagaagcgcaaaaaaaaaacctacaccaagcccaagaagatcaaacacaagaagaaaaaagtcaagctagccgtcctccaatattacaaggttgatgacagcggaaaggtacaacgcttgcgtaaggagtgccctactcctgaatgcggtgccggaactttcatggcaaaccacttcgaccgccactactgcgggaagtgtggtttgacctacgtataccanaaggctggtggagagtaggtgtaccataagtttacatcggggcctttgacctcatttaaattttgactttagtaaagtgaccttcggttgaaggatttgggtcaaaaactagcaagattttgacgttgtgcttctcgctatcgatggaattgatttgttgcgttgtacaaaaaaaaaa

SEQ ID NO: 2515 - DNA, 477 bp, Heritiera littoralis
ctctcaccagccgcgccacccaaaacctgcaaccatgcagatcttcgtgaaaaccctaacgggtaagacaataaccttggaggtcgaatcctccgacaccatcgacaatgtcaaggccaagatccaagacaaggaaggcatcccaccggaccagcaacgcctcatcttcgccgggaagcagctggaagacggccgaacactagcggactacaacatccaaaaggagtccactctccacctggtcctccgcctccgaggcggcgccaagaagagaaagaagaagacttacacgaagccgaagaaaatcaagcacaagaagaagaaggtgaagctcgctgtgctccagttttataaggtggatgattctggaaaagttcaaaggttgaggaaagagtgccctaatccggagtgcggagctggtacgtttatggctaatcattttgacaggcattactgtggtaagtgtgggatgaccta

SEQ ID NO: 2516 - DNA, 549 bp, Euphorbia peplus
catcggtctgcaaagatgcgatcttcgtgaaaacattgacaggcaagaccataactctcgaggttgagtcctccgataccatcgacaatgtgaaggccaagatccaagacaaggaaggaattccgccggaccagcagcgactgatcttcgccgggaaacagctggaagatggaaggactctggccgactacaacattcagaaggagtcaactctgcatctggtgctccgattgaggggtggagcgaagaagagaaagaagaagacctatacaaagccaaagaagatcaagcacaaaaagaagaaggtgaagctcgctgttcttcagttttacaaggttgatgatagcggtaaggtgcagcggctgaggaaggagtgccccaacgccgagtgcggagccggtacgtttatggccaatcattttgacaggcactactgtggtaagtgtggcctcacctatgtttatcagaaagccggcggcgactgattaatgagattgattatgcttttgattggtcgagtattattatcattttgtttcacagacttgg

SEQ ID NO: 2517 - DNA, 663 bp, Cleome gynandra
ttccttcatctgctgcaaagatgcagatcttcgtaaaaaccctaacggggaagaccataaccctagaggttgaatcctccgacaccatcgacaatgtcaaggccaagatccaggacaaggaagggatcccaccggaccagcagcgtctgatcttcgctgggaaacagttggaagacggccgcaccctcgctgactacaacatccagaaggagtcgacgctacaccttgtcctccgcctccgtggtggcgcgaaaaagaggaagaagaagacctacaccaagcccaagaagatcaagcacaagaagaagaaggtcaagctcgctgtccttcagttctacaaggtcgatggctccggaaaggtccagcgtctcaggaaggagtgtccgaacactacttgcggtgcaggaacattcatggcaagccactttgaccgtcactactgtggtaagtgtggactcacttacgtttaccagaaagaaggtggtgatgagtgaatcgcgcatcgatagatctttatctttgataaacgctttttgaatttatgtttttgaagtttttcgttgttatggatcctatccaaggctctggatattcgtaatctgatatgatgactttttaggtttttgaatactttttgttgattgtcagttccgtactcgtttg

SEQ ID NO: 2518 - DNA, 538 bp, Cleome spinosa
agtacgcggggaccgccgcagcagagatgcagatcttcgtgaaaaccctaacggggaagaccataaccctagaggtcgaatcctcggataccatcgacaatgtgaaggctaagatccaggacaaggaagggatcccgccggatcagcagcgcctgatcttcgccgggaaacagcttgaagacggccgcaccctcgccgactacaacatccagaaggagtcgacgcttcacctcgtcctccgcctccgtggtggcgccaagaagaggaagaagaagacctacaccaagccgaagaagatcaagcacaagcacaagaaggtcaagctcgctgtcctccagttctacaaggtcgacggatcgaacaaggttcagcgtctcaggaaggagtgtccgaactgcggtgcgggaactttcatggcgagtcacttcgaccgtcactactgcggtaagtgtggcctcacctacgtttaccagaaagacggaggcgacgagtgaatcgcgtctcgatagatctctatcttttgataaacgcttttttt

SEQ ID NO: 2519 - DNA, 645 bp, Cleome spinosa
acctccagacagaagtgcaatagccattgccgctaggcgcaagtgcacctgcaaagatgcagatcttcgtgaaaacactaacggggaagaccataacccttgaagtcgagtcctccgacaccatcgacaatgtcaaggctaagatccaggacaaggaagggatcccgccggaccagcagcggctgattttcgccgggaaacagttggaggacggccgcaccctcgcagactacaacatccagaaggagtcgacgctccacctcgttctccgcctccgtggtggcgccaaaaagaggaagaagaagacctacaccaagcccaagaagatcaagcacaagcacaagaaggtcaagctcgctgtcctccagttctacaaggtcgatggctccaacaaggtccagcgtctcaggaaggagtgtccgaactgcggtgcgggaacattcatggcgagccacttcgaccgtcactactgcggtaagtgcgggctcacttacgtttaccagaaagatggcggtgacgagtaaatcgcgtatcgaatagatctctatcattccgttgacgctttttgatttggtgtttttttaagaatttcatcgtcatggatccaatgttgaacacccttggtactgaatatttctaggtttt

SEQ ID NO: 2520 - DNA, 683 bp, Raphanus sativus
  misc_feature (173)..(173): n is a, c, g, or t
  misc_feature (188)..(188): n is a, c, g, or t
  misc_feature (191)..(191): n is a, c, g, or t
  misc_feature (200)..(200): n is a, c, g, or t
  misc_feature (212)..(212): n is a, c, g, or t
  misc_feature (233)..(233): n is a, c, g, or t
  misc_feature (254)..(254): n is a, c, g, or t
  misc_feature (278)..(278): n is a, c, g, or t
  misc_feature (371)..(371): n is a, c, g, or t
  misc_feature (377)..(377): n is a, c, g, or t
  misc_feature (393)..(393): n is a, c, g, or t
  misc_feature (455)..(455): n is a, c, g, or t
  misc_feature (482)..(482): n is a, c, g, or t
  misc_feature (526)..(526): n is a, c, g, or t
  misc_feature (532)..(532): n is a, c, g, or t
  misc_feature (556)..(556): n is a, c, g, or t
  misc_feature (573)..(573): n is a, c, g, or t
  misc_feature (584)..(584): n is a, c, g, or t
  misc_feature (590)..(590): n is a, c, g, or t
  misc_feature (621)..(621): n is a, c, g, or t
  misc_feature (637)..(637): n is a, c, g, or t
  misc_feature (643)..(643): n is a, c, g, or t
  misc_feature (649)..(649): n is a, c, g, or t
  misc_feature (659)..(659): n is a, c, g, or t
gggtctctcttctgtttcagctgttttgttccccaccgccgcaaaggatgcagatcttcgtgaaaaccctaacggggaagacgataaccctcgaggtcgagtcctccgacaccatcgacaacgtcaaggccaagatccaagacaaggaaggcatccctccggaccagcagcgnctcattttcgccggnaancagctcgangacggacgcacnctcgccgactacaacatccanaaggagtcgacgcttcacctngttctccgtctgagaggaggagcnaagaagaggaagaagaagacgtacacgaagccgaagaagatcaagcacaagcacaagaaggtgaagctcgcggtgctccagttctacaaggtngatggntccggcaaggtgcagnggctgaggaaggagtgtcctaacgcgacttgcggtgctgggactttcatggcgagtcatttngatcgtcattactgtggtaagtgtggncttacttacgtttaccagaaggagggtgccgaggcttgatctcncttttntctcttttctctatctttaagaantggttttagtttcggtntggtaatttcntaaagnttcttgtaatggattcgatgttgaacatgtnttgtttctggatttcntatctngacttnatgaaagttnttacatttttacttatgttggtac

SEQ ID NO: 2521 - DNA, 725 bp, Cedrus atlantica
tttagcggaggggaagacctggttgcgccgaagggaagtttgtggatggtccaagatgcagatattcgtaaaaacattgactggtaagacaataacgctagaggtagaggcctctgatacgatcgacaatgtgaagaccaagatccaagacaaggagggtattccacccgaccagcagcgcctgatattcgcaggaaagcagctggaagatggccggacgctggccgactacaacatccagaaggaatcgaccctgcatctggttctccgactgaggggaggtgccaagaagcgaaagaagaagacctatacgaagcccaagaagctcaagcacaagaagaagaaggtcaagctcgctgttctacagtactataaggtcgatgactcaggcaaggtccagaagcttaggaaggagtgccctaaccaagaatgcggggcggggaccttcatggccaaccattttgacagacattactgtggcaagtgcgggcttacctatgtctaccagaaaggtgctgagtaattttagggttttgagggttgataggctttgattggttttagaacgagggcgaaaacatgtgttttgatgtatttgcgatcagtattatttctggtccgagaaatcttgtttttcggattttttcatcttaatcatcatgcaaacttgaatgagaactttaaacaaatgagtttttctttttataatgctttacatatatgcg

SEQ ID NO: 2522 - DNA, 910 bp, Pinus pinaster
gaagaagtccgaacattgcttaacaaaaccctaaaaagttgaaggcaagaatttcaatatgaccgcgacctaagaaacataaacaaaaaccctaattgcagaacctcaaatctattctactatataaggacgcgatacgctcagttggggttttaagggttagcagagtagaaggccggtttgcgacgaagggaagttggttgatggtccaagatgcagatattcgtaaaaacattgactggtaagacaataacactagaggttgaagcctctgatacgatcgacaatgtgaaggccaagatccaagacaaggagggtattccgcccgaccagcagcgcctgatattcgcgggaaagcagctggaagatggtcggacgctggccgactacaacattcaaaaggaatcgaccctgcatctggtcctccgactgaggggaggtgccaagaagcgaaagaagaagacctacacgaagcccaagaaactcaagcacaagaagaagaagatcaagctcgctgttctgcagtactacaaggtcgacgactcgggaaaggtcaagaggcttaggaaggagtgccctaaccaggagtgtggggcaggaaccttcatggccaatcattttgacaggcattactgtggcaagtgtgggcttacgtatgtctaccagaaaggtgatgagtaattttagggttattagggtttatgggctttttcaatcgagggcgaaaacatttaatttttcaatgtttgagatcagtactcttgctggtctgagaaatcttgtgtctcgaattttttaatcttatttatcatgtaaacgtgagtaagcactttaaatgaatactttcttctaattttttttttacggatagattcttgttgcttgctcattgttctcgtcattttagata

SEQ ID NO: 2523 - DNA, 725 bp, Podocarpus macrophillus
ggagaagaccaccggtgagaagggcaagaagacagttcgaggctcgcttatggtctttgaagatgcagatattcgtaaaaactctgactggtaagactataaccctagaggttgagtcctcggatacgatcgacaatgtgaaggcgaagattcaggacaaggaggggattccaccggatcagcaaaggctgatctttgccggaaagcagctggaggatggccggactttagcggattacaatattcagaaggaatcgaccctgcatctggtgctccgcctcaggggaggggccaagaagagaaagaagaagacctacaccaagccaaagaagcttaagcacaagaagaagaagattaagctcgccgttctgcagtattacaaggtggatgattctggaaaggttcaaaggcttcgcaaggaatgccctaatcaagaatgcggtgccggaactttcatggccaaccactttgataggcattactgcggcaagtgtagccttacttatgtttacagtaaggctggtgccgcttaagcgattttccagttctgaattagggtttcaaaagttttaagaggctttttgtagttgggatctagatcatgatcgttatttggtgattttttcatgggtactttaaaaccttgttttgctagaatgagatttcaattgaggttgttattcttgtaacaacaacttgtggcttatacactgcatttcaaaatt

SEQ ID NO: 2524 - DNA, 780 bp, Podocarpus macrophillus
ggtgaggttaggttagggtttcaagctagggtttcaacgacaggggtttaaatctcaattctagggtttgaataacaaatattgttggcaagcagaggagacagtccagcggatttcgtttatggtcgctaaagatgcagatattcgtaaaaacattgactggtaagactataaccctagaggttgagtcgtcggatacgatcgacaatgtgaaggcgaagattcaggacaaggaggggattccaccggaccagcaacggctcatatttgctggaaaacaattggaagatggccggactttggcggactataacatccagaaggagtcgactttgcatctagtgctccgcctgaggggaggcgcgaaaaagagaaagaagaagacctacaccaagcctaagaagattaagcacaagaagaagaagatcaagctcgctgttctgcagtactacaaggtcgacgattcaggcaaagtccagaggcttcgcaaggagtgtcctaaccaggagtgcggcgccggaacctttatggccaatcatttcgataggcattattgcggcaagtgtagccttacctatgtttacagcaagggtggtgctaattaaactttttccttatgggttagggcttctagggtttcaaattaatggtttctggggtttggaagagggatcaagggttaaggaattttgacaagattcagatcttggtcttaaactatttaatgattccatttaagactttacaaatcatgttcctcgtttgttgaaatttatatag

SEQ ID NO: 2525 - DNA, 682 bp, Marchantia polymorpha
cagcgttggactgcgcactttgcagcgaagaaggaagagtctggagctcgtgccgtgccataccaattttgccattctgagagtccgtcaatatgcagatcttcgtaaagaccctaacgggcaagactatcaccctcgaggtggagtcttctgacaccatcgacaatgtgaagaccaagatccaggacaaggaggggattcccccagaccagcagcgattgatcttcgctggcaagcagcttgaagatggtcgcacccttgccgactacaacatccagaaggagtctaccctgcacctggtgctcagacttcgtggaggagcgaagaagcgcaaaaaaaaaacctacaccaagcccaagaagatcaaacacaagaagaagaaagtcaagctagccgtcctccaatattacaaggttgatgacagcgggaaggttcaccgcttgcgtaaggagtgccctactcctgaatgcggtgccggaactttcatggccaaccaccatgaccgtcattactgcggaaagtgtggtttgacctacgtctaccagaaggctggtgccgagtagacacatcattagtttaacagaggagtaattttttgacctgagtaaagctcccttcaattgaaggaattctatcgattatcttacttgtgtgagatgaatgcttggcccgatgtcaatgt

SEQ ID NO: 2526 - DNA, 625 bp, Mesostigma viride
gctagggtcggcacacacgttcgcgaggagggacacgttcctaagcgaacccgtggcgtgcagccatgcagatcttcgtgaagacccttacgggcaagactatcacccttgaggtggagtcatcggatactatcgacaatgtgaaggctaagattcaggacaaggagggaatcccccctgatcagcagcgtctcatcttcgctggcaagcagctggaggacggccgcacgctggcggactacaacatccagaaggagtccacgctccacctggtgctccgcctgcgtggtggtgccaagaagaggaagaagaagacctacaccaagcccaagaagaacaagcataagaagaagaaggtgaagctcgccgtcctccagtactacaaggtggacgactcgggcaaggtgcagcgcctgcgcaaggagtgccctaacccggactgcggtgcgggctgcttcatggccagccacaaggaccgccactactgcggcaagtgcggcctgacctacgtctaccagaagggcgagtaggcggttgtgcggtgataatgcctcgatctaggctgtgggaggcataactggccattttgtaattaaatttatcaacaaattgggctttttttcaa

SEQ ID NO: 2527 - DNA, 1378 bp, Mesostigma viride
ctagggtcggcacacacgttcgcgaggagggacacgttcctaagcgaacccgtggcgtgcagccatgcagatcttcgtgaagacccttacgggcaagactatcacccttgaggtggagtcttcggatactatcgacaatgtgaaggctaagattcaggacaaggagggaatcccccctgaccagcagcgtctcatctttgcgggcaagcagctggaggacggccgcacgctcgcggactacaacatccagaaggagtccacgctccacctggtgctccgcctgcgtggtggtgccaagaagaggaagaagaagacctacaccaagcccaagaagaacaagcataagaagaagaaggtgaagctcgccgtcctccagtactacaaggtggacgactctggcaaggtgcagcgcctgcgcaaggagtgccccaacccagactgcggtgcgggctgcttcatggccagtcacaaggaccgccactactgcggcaagtgcggcctgacctacgtgtaccagaagggcgagtaggccgttgtgcggtgataatgcctcgacgtagacagtgggaggcatagttggccactttgtaattaattttgtaatcaaaatgggcttcttatcaagctgtaagcgaatcgccatggagtcggttcagtgctacggtcgcaagaagacggccgttgccgtcgcgcactgcaaacgcgggcgcggtctgctgaagatcaatggtaccccattggatcttgtacagcccgacattctgcgctacaaggtgtatgagcccatcctgttgctcggccgccagcggtttgccaacgtcgacatccggatccgtgtgaacgggggtggccacgtctcccagatctatgccatgcgccaggccattgccaaggcgattgtggcattctaccagaagtacgttgatgaggtgacgaagaaggaaatcaaggacatcctgctgcagtacgaccggacgctgctggtcgccgacccacgtcggtgcgaggccaagaagttcggtggtcgcggtgcccgctcgcgcttccagaagtcctaccgttaaaactcatattgtcatgggtggtggcgcctgggcaaagatttttgcgttgctgccatgggagccaataaagttcattgcattgcggattgccggcaggttggaaagaggggttgggcattacatgggaatgtagctgacaatgaccactgtgctcatttacccactctttcctttcattcttccgtctgtggcgtatgtcccgcccagacatggtcagtgtattgccatgtgcactggtccgaaggggatgaaggccattaagacagtgtgtagggttgtgatgtattatacagtaataaatgacgtaatcatgc

SEQ ID NO: 2528 - DNA, 804 bp, Gnetum gnemon
taaaccctagccaatcatccctaaaggatagaatagggttttattccagggaaaggaggcagcgcgacgcagcaggaagacgacgcagggaaagcgttggcgcagcttcgaagatgcagatcttcgtgaaaactttgacgggtaagacgatcacgttagaggtcgagtccttcggacacgatcgacaatgtgaaggcgaagattcaggacaaggagggcattccgccggatcagcagaggctgattttcgccggaaagcagctggaggacggcaggactcttgcggattacaatatccagaaggagtcgactcttcatctggttctcaggctccggggaggtgcgaagaagcgcaagaagaagacctacaccaagcccaagaagatcaagcacaagaagaagaaggttaagctcgctgtgctgcagttctacaaggtggatgattccggaaagatccagaggctccgccgagagtgcccaaatcaggagtgcggagctggaaccttcatggccaatcattttgatcgccactactgcggcaaatgctatgttacgtatttgttcaagaagaaagacgagtagggtagggttttcttgaactagtgctttattcaggttttgtttttgaagtagcttaggatttggatcttagaacacatgaattttcagttccaatttggaggcacattgaatctttgaatattctgggccaagcttggtgtatttgatggctcagcactgaaattttgcatgctggatatttttttaatcaattttgaatgttcgtttccaacgttttcagct

SEQ ID NO: 2529 - DNA, 610 bp, Cichorium intybus
cggggggcacattcggcgaaatgcagatcttcgtgaaaccctaacgggcaagacgattacgttggaggttgaatcctccgacacgatcgacaatgtgaaggcgaagattcaagacaaggaaggcatcccaccggatcaacagcgtcttattttcgctgggaaacaacttgaggacggcagaacccttgccgactacaacattcagaaggagtcaaccctccacctggttctccgtctccgtggtggcgccaagaagcgcaagaagaagacctacaccaagccgaagaagatcaagcataagcacaagaaggtgaagttgagtgtgttgcagttctacaaggttgatgattccgggaaggtgcagaggttgaggaaagagtgtcccaatgctgagtgtggtgccggaaccttcatggctaaccatttcgataggcactattgcggcaagtgtggtctcacttatgtctaccagaaggcttaaggtttgattaatttagataaatgttaaagtatcgtttttgagatttgaattataattctgaatttatcttgtaattttgtggcacacctggaactatagggttgtttttcaattgaggttttgcttatc

SEQ ID NO: 2530 - DNA, 743 bp, Cynara scolymus
  misc_feature (6)..(6): n is a, c, g, or t
catcgncgccagatcagatcttcgtcaaaccctaaccggtaaaaccataaccctagaggtcgaatcctctgacaccatcgacaatgtcaaagccaagatccaagacaaggaaggcatcccaccagatcaacaacgcctcattttcgccggaaaacagctcgaagacggtagaaccctagccgactacaacatccagaaggaatccaccctccaccttgtccttcgtctccgtggtggtgctaagaagcgtaagaagaagacctacaccaagccaaagaaaatcaagcataagcataagaaggtcaagctcagcgtcttgcagttttacaaggtcgatgattctggaaaggtccagaggttgaggaaggagtgccctaatgccgaatgtggcgccggaaccttcatggccaatcacttcgatcgacactattgtggtaaatgtgggctcacttatgtttaccagaaggccggtggtgattaataactatatcaggttttgttttcaatcatcatgagacatattatcatctcttgttcttggatgttcctgaatttgctttgagacagttcatatcaacattcatcatcaattttcatttttgttacaatatctctttaagtttttgtgattgaacaagtcattacatgatcatgtgattccttaattgctaattattgatgtcgtatgatggattggatcaccaatttatgttttagtttcattggggggaaacatgattatg

SEQ ID NO: 2531 - DNA, 768 bp, Distylium racemosum
agggtgttgttagcgaaggagcacggaggaggttgcggccgggaggctgaagagcttgcgcgcagagcagagagagccagaggttcgttgatggtcgttcaagatgcagatattcgtgaaaacattgactggtaagacaataacactagaggttgagtcgtcggatacaatcgacaatgtgaaggcgaaaatccaggataaggaggggattccgccggatcagcagcggctgatctttgctggaaaacagctggaggatggccggactttggcagattacaacatacagaaagagtcgacgctgcatctggtgctccgccttaggggaggcgccaagaagaggaagaagaagacttacaccaaacctaagaagatcaagcacaagaagaagaagatcaagctcgccgtcctccagttctacaaggtcgatgattctggcaagatccagaggctccgcaaggagtgccctaaccaggaatgcagcgctggcactttcatggccaatcactttgacaggcattactgcggcaagtgtggtctcacatatgtcttcaacagtgccgctgccgcttaagatgccgtagatctgaacttggttaaggttttgggggtttcatatttggtttggggataatcaggtatgttagggtttggtaatggttagatgggtagcgaattttgtagccgggattaatactttgggattaatactttgttcacgtctttggttttttaatggatactttaaaccattcgaagtttattttt

SEQ ID NO: 2532 - DNA, 1106 bp, Pinus taeda
acgtgcgaccttggctgtcactcaggagcaaacgtggggcggcgacgaaggaattgtctagagctgctgctgtttcttgtctacaactgcaataatgcagatcttcgttaaaacactgactggtaagactattacccttgaggtagagtcttcagatacaatcgataatgtgaagactaagattcaagataaggagggtattcctcctgaccagcaacgtttgatttttgctggcaagcagttggaggatgggagaactctcgctgattacaatattcagaaagagtcaactctacacctggttcttcgtctgagaggtggtgccaagaagagaaagaagaagacttacactaagcctaagaagctcaagcacaagaagaagaaggtaaagttggctgttctgcagtactacaaggttgatgactctggtaaagtgaaaagattgcgaaaggaatgcccgaaccaggagtgcggagctggtacatttatggcgaaccattttgaccgtcattattgtggaaagtgtggtctgacttacgtctacaagacggctggtgaagagtaatttatcctttggattctgctgccacctatggcgtattggtcgttagattttctttttaagatgagacaggtctaaatgtttttggcgttggtttaaattagttttagattgggaacattcaatttcctttagtggcataagtattggaaattatatcaactctgttgaagctaagtgtttctgtttatttcaaccactgaacattataaagggtttttggttattggttttgtttctactactgttatttgaacgctatcttagtcgtcctttcaaatgagcttatattattgtcactctcctgttgtaatttaaaatcctatgtaacttcaatttttaaatgatgttaaccattctacagttgaatgtattggctttcactagtataggaataacttgtccaatgtgaaagttcacatatttacttggaaatcaaatctaacgaaagtctgagggcctttcctgttgaatctatacatgattttgtgaaggaaaacctcgcttaatacaataatatgctgttactctcctgttgtaattt

SEQ ID NO: 2533 - DNA, 671 bp, Cleome gynandra
aagagaaccggccattgccgcaagcctctcacctgcaaagatgcagatcttcgtgaaaaccctaacggggaagaccataaccctagaggttgagtcctccgacaccatcgacaatgtcaaggccaagatccaggacaaggaagggatcccgccggaccagcagcgtctgatctttgcagggaaacagctggaggacggacgcactcttgccgactacaacatccagaaggaatcgacgattcacctcgtcctccgcctccgtggtggtgccaaaaagaggaagaagaagacctacaccaagccaaagaagatcaagcacaagaagaagaaggtcaagctcgctgtcctccagttctataaggttgacggctctggtaaggttcagcgtctcaggaaggaatgtccaaacagcacatgcggagcgggaaccttcatggcgagccacttcgaccgtcactactgcggtaagtgcgggctcacttacgtttaccagaaagatggtggcgacgagtgaattcgcatatcgttagatctctatttctgataaaacactttttggaatggttttgttcaagtatttcgttgttatggatccgattctaaacatccttggctctgaatattcgtatgaatttctaggtttttattgatattattatactcgttgataa

SEQ ID NO: 2534 - DNA, 784 bp, Jatropha curcas
accctaacgggtaagaccattaccctcgaggttgagtcttccgataccatcgacaatgtgaaagccaagatccaagacaaggaaggaattccaccggaccagcagcgtctaatcttcgctggaaaacagctggaagacggcaggaccctcgcagactacatcattcagaaggagtcgactcttcacctggtgcttcgcttgagaggtggtgccaagaagagaaagaagaagacctacaccaagccaaaaaagatcaagcacaagaagaagaaggtcaagctcgctgttcttcagttctacaaggtcgatgacagtggtaaagtgcagaggttaaggaaggagtgtcccaatgcggagtgtggagctggcacttttatggctaatcattttgataggcactactgtggtaagtgcggcctcacctatgtttaccagaaggctggtggagaatgattttgaaattgtttctcagagggtagaccaagcttttgattttaagtttcttcttgttgagcttacaatttatggtcttaattgttgactagttggaatgataattttggctatttaagtttcatttatacctgtttttgtttttggtgtttctattagcggtgatgttagtattgatataatgatttcagcatgataagactctgttttagtttctacaaaggcatttgcttgctgtagagcttgtggcaggtttagcattagaatgatgtgagttgttaaaaaccaaaatggtttcagaatctataaagatctagaatgtcttgtttgt

SEQ ID NO: 2535 - DNA, 1100 bp, Pinus taeda
tcggccattatggccgggggagcaaacgtggggcggcgacgaaggaattgtctagagctgctgctgtttcttgtctacaactgcaataatgcagatcttcgttaaaacactgactggtaagactattacccttgaggtagagtcttcagatacaatcgataatgtgaagactaagattcaagataaggagggtattcctcctgaccagcaacgtttgatttttgctggcaagcagttggaggatgggagaactctcgctgattacaatattcagaaagagtcaactctacacctggttcttcgtctgagaggtggtgccaagaagagaaagaagaagacttacactaagcctaagaagctcaagcacaagaagaagaaggtaaagttggctgttctgcagtactacaaggttgatgactctggtaaagtgaaaagattgcgaaaggaatgcccgaaccaggagtgcggagctggtacatttatggcgaaccattttgaccgtcattattgtggaaagtgtggtctgacttacgtctacaagacggctggtgaagagtaatttatcctttggattctgctgccacctatggcgtattggtcgttagattttctttttaagatgagacaggtctaaatgtttttggcgttggtttaaattagttttagattgggaacattcaatttcctttagtggcataagtattggaaattatatcaactctgttgaagctaagtgtttctgtttatttcaaccactgaacattataaagggtttttggttattggttttgtttctactactgttatttgaacgctatcttagtcgtcctttcaaatgagcttatattattgtcactctcctgttgtaatttaaaatcctatgtaacttcaatttttaaatgatgttaaccattctacagttgaatgtattggctttcactagtataggaataacttgtccaatgtgaaagttcacatatttacttggaaatcaaatctaacgaaagtctgagggcctttcctgttgaatctatacatgattttgtgaaggaaaacctcgcttaatacaataatatgctgttactctcctgttgtaattt

SEQ ID NO: 2536 - DNA, 961 bp, Pinus taeda
aacattgcttaacaaaaccctaaaaaattgaaggcgagaatttcaatatgaccgtgacctaagaaacataaacaaaaaccctaattgcagagcctcaaatctattccactatataaggacgcgatacgctcagttggggttttaagggttaacagagtagaaggccggtttgcgacgaagggaagttggttgatggtccaagatgcagatattcgtaaaaacattgactggtaagacaataacactagaggttgaagcctctgatacgatcgacaatgtcaaggccaagatccaagacaaggagggtattccgcccgaccagcagcgcctgatattcgcgggaaagcagctggaagatggccggacgttggccgactacaacattcaaaaggaatcgaccctgcatctggtcctccgactgaggggaggtgccaagaagcgaaagaagaagacctacacgaagcccaagaagctcaagcacaagaagaagaagatcaagctcgctgttctgcagtactacaaggtcgacgactcgggcaaggtcaagaggcttaggaaggagtgccctaacctggagtgcggggcaggaaccttcatggccaatcattttgacaggcattactgtggcaagtgtgggcttacgtatctctaccagaaaggtgatgagtaatttttagggctattagggtttatgggctttttagatcgagggcgaaaacatttaatttttcaatgtttgcgatcagtattcttgctggtccgagaaatcttgtctctcgaatttttaatcttatttatcatgtaaacgtgagtaagcactttaaacgaatatttttctttaatttttttacggatagattcttgttgcttgcacattgttctcgtcattttagatatatgaatcaaccatgttcaatttgttaaattgtcagtattgttggtgaagcagatctgcttattg

SEQ ID NO: 2537 - DNA, 916 bp, Pinus taeda
cttaacaaaaccctaaaaagttgaaggcaagaatttcaatatgaccgcgacctaagaaacataaacaaaaaccctaattgcagaacctcaaatctattctactatataaggacgcgatacgctcagttggggttttaagggttaacagagtagaaggccggtttgcgacgaagggaagttggttgatggtccaagatgcagatattcgtaaaaacattgactggtaagacaataacactagaggttgaagcctctgatacgatcgacaatgtcaaggccaagatccaagacaaggagggtattccgcccgaccagcagcgcctgatattcgcgggaaagcagctggaagatggccggacgttggccgactacaacattcaaaaggaatcgaccctgcatctggtcctccgactgaggggaggtgccaagaagcgaaagaagaagacctacacgaagcccaagaagctcaagcacaagaagaagaagatcaagctcgctgttctgcagtactacaaggtcgacgactcgggcaaggtcaagaggcttaggaaggagtgccctaacctggagtgcggggcaggaaccttcatggccaatcattttgacaggcattactgtggcaagtgtgggcttacgtatctctaccagaaaggtgatgagtaatttttagggctattagggtttatgggctttttagatcgagggcgaaaacatttaatttttcaatgtttgcgatcagtattcttgctggtccgagaaatcttgtctctcgaattttttaatcttatttatcatgtaaacgtgagtaagcactttaaacgaatatttttctttattttttttacggatagattcttgttgcttgcacattgttctcgtcattttagatatatgaatcaaccatgttcaatttgtt

SEQ ID NO: 2538 - DNA, 1013 bp, Pinus pinaster
cattcaccagtcctcaaaattacttaattttgaacaagtaagataaagcccacactctccccatattttgatggaggtgttagggttcgatggttttttattaattagactaatttaaatgggatgaaatgcaatttcattacttttttgaccgtcggattagaggacgggtttcacgatcttgaggttgccctaatttccaaggtataaatccggcttaagcccatggtggttggatgagcaaacgtgtggcggcgacgaaggaattgtctagagctgctgctgttttctgtctacaactgcaataatgcagatcttcgttaaaacactgactggtaagactattacccttgaggtagagtcttcagatacaatcgataatgtgaagactaagattcaagataaggagggcattcctcctgaccagcaacgtttgatttttgctggcaagcagttggaggatgggagaactctcgctgattacaatattcagaaagagtcaactctacacttggttcttcgtctgagaggtggtgccaagaagagaaagaagaagacttacactaagcctaagaagctcaagcacaagaagaagaaggtaaagttggctgttctgcagtactacaaggttgatgactctggtaaagtgaaaagattgcgaaaggaatgcccgaaccaggagtgcggagctggtacatttatggcgaaccattttgaccgtcattattgtggaaagtgtggtctgacttacctctacaagacggctggtgaagagtgatttatcctttttgattctgctgccaccgatggcgtattggtcgttagattttctttttaagatgtgacaggtctaaatgtttttggcgttggtttaaattagtttgagagtaggcattcaatttcccttattggcataagtattggaaattatatcaactctgttgaagctaagtgtttctgtttatttcagccactgatacggaacattataaaaggttttggttattagtttt

SEQ ID NO: 2539 - DNA, 587 bp, Lippia dulcis
accctaacgggtaagaccattaccctggaggttgaatcctccgacaccattgacaacgtcaaggctaagatccaggacaaggagggcattccgccggaccagcagcgtctcatcttcgccggaaagcagctcgaggacggccgcaccctcgccgactacaacatccagaaggagtcgactcttcaccttgttctccgtctccgcggtggagccaagaagcgtaagaagaagacctacaccaagccgaagaagatcaagcacaagaagaagaaggtcaagctccccgtgctccagttctacaaggtcgatgattcgggaaaggtgcagaggctgaggaaggagtgccccaatgccgagtgtggcgccggaactttcatggccaatcactttgacaggcactattgcggaaagtgtggcctcacctatgtctacaatacggccggcggtgattgagattttgaagctccaacagtttttttgtcactacagattttatatgttttctaatttagtttacggatactgtttctgctgtttggttttaatttatccctattttgcgattgattgtgattctgaaaaaagaa

SEQ ID NO: 2540 - DNA, 681 bp, Tripterygium wilfordii
cactgaaaccctagcggagaagaatccattttcgtttgtccgatctgcatctggaacaaaggcaaacatgcagatcttcgtgaagactttgactgggaagaccatcacgttggaggtggaatcctccgacaccatcgacaacgtgaaggccaaaatccaggacaaggaaggcattcctccggaccagcagcgactcatcttcgccgggaagcagctcgaggacgggcgcactctcgccgactacaacatccagaaggagtcaaccctccacttggtgcttcgcctccgcggtggtgctaagaagcgcaagaagaagagctacaccaagcctaagaagatcaagcacattaagaagaaggtgaagctcgctgcgcttcagttttacaagatcgatgactctggtaaggttcagaggctacgaaaggagtgccccaatggtgactgcggtgccggaaccttcatggccaatcattttgataggcactactgtggtaagtgcggactcgcctacgtctaccagaagaccggtggcgactgattgattatagtgtctgatttttttacgattagggttttcttaaatgttttgctttgataattgctggacctaatttatcgttatgctattgcatctttatctcaatgtggaattgcaattcctcaatcaacctagcattgttc

SEQ ID NO: 2541 - DNA, 730 bp, Arabidopsis lyrata
aggggtttcaacgcggagtccgcgggggtcgttctccgatcaaaaaaaaaaaaaaaaacagagagcacaagaaaatgcagatcttcgtgaaaaccctaacggggaagacaataaccctagaggttgaatcatcagacacaatcgacaatgtgaaagcgaagattcaagacaaagaaggaatcccaccggatcagcaacggttaatcttcgccggaaaacaattggaagatggaagaacactcgctgattacaacattcagaaagagtcgacgcttcatttggtgcttcgtctgagaggaggtgcgaagaagaggaagaagaagacgtacacgaaacctaagaagattaagcataagcataagaaagtgaagctagcggttttgcagttttacaaggttgatggaagtggaaaagttcagaggttgaggaaagagtgtccttctgttagctgtggtcctggaactttcatggcgagtcattttgatagacattattgtgggaaatgtggaactacttacgtgttcaagaaggctgatgaagagtgatgatgatcactaggtgttatgtttttgtctctcctatttaaaattgaattatcgtttattcagataattttttgagactgttaaggtttaattttattttatggattatttagtttattaaatagttgcagtaagttattataatatctctattgatagtttatatgtctaatgtctagatttcg

SEQ ID NO: 2542 - DNA, 699 bp, Raphanus sativus
ggcgacccaaaaaaaaaaaaaaaaaacagagagagcactcacaagaaaatgcagatcttcgtgaaaaccctaacggggaagacgataaccctagaggtcgaatcatccgacacgatcgacaatgtgaaggccaagatccaggacaaggaagggatcccaccggaccagcagcgactgatcttcgccgggaagcagctggaagacggaaggacgctcgcggattacaacatccagaaggagtcgacgcttcacctggttctccgtctgagaggaggagcgaagaagaggaagaagaagacgtacacgaagccgaagaagatcaagcacaagcacaagaaagtgaagctcgcggttctgcagttttacaaggtcgatggaagcggcaaggttcagaggctgaggaaagagtgtccttcggcgagctgtggtccggggacgttcatggcgagtcatttcgataggcattactgtggcaagtgtggaaccacttatgtcttcaagaagcctgatgaagagtgatcaatgagagagagagattattactaggtgttatgtttttgtctcttatttaaaactgaattatcgtttattcagataacttttagatgttttgttataacgaaggttaatttcttttgtgagattatggtttgtttttaattagttgcattaagtcattataatatctctattgattgt

SEQ ID NO: 2543 - DNA, 868 bp, Setaria italica
atgcagatcttcgtgaagaccctgacggggaagaccatcacgttggaggtggagtccatcgacaacgtgaaggccaagatccaggacaaggagggcatccccccggaccagcagcgtctgatcttcgccggcaagcagctggaggatggccgcaccctcgcggactacaacatccagaaggagtcgacgctgcacctggtgctccgcctcaggggaggggccaagaagcgcaagaagaagacatacaccaagcccaagaagatcaagcacaagcacactcgccgtgctccagttctacaaggtcgacgacgccaccggcaaggttacccgcctccgcaaggaatgccccaacgccgagtgcggcgcgggaaccttcatggccaaccacttcgaccgccactactgcggtaagtgcggcctcacctacgtctacaaccagcaggcgtagggtgctccgctgttatgttggggagaaggaaaatggaaagtcttgctagatgataattttcttttttgtcgcatgttaaagtagttttcttggaacagaactcctgcatctcttatggtgatgcttacttttggttttgatgatatcgtgtcgttatggatcctatcaagcactgttgaattccaattatgtttgtgttaatcctatactatgtgctcgatgttgatgtaatattggtccctgggtcagtagtttgtgtattgccgtgtgtgattgatatgataacatgtcactgtagttttcaatctttttttgtgggtatgctcacttgctgatagcttgcaaaaagctttatgcctagtttagttatgttagcataagaaatgttgcaaggtcggtgatagacatgatagggtgcaa

SEQ ID NO: 2544 - DNA, 811 bp, Taxus baccata
gcggaagaggctatcgcgtttgcaggtaatctctggaggggagcggcgttcgttgatggttcaagatgcagattttcgtgaaacattaactggtaagacaataacattagaggtagaatcctctgatacaatcgacaatgtgaaggccaagatccaggataaggagggtattccacctgatcagcagcggctgatttttgccggaaagcagttggaggatgggagaaccctagcggattataatatccagaaggagtccaccctgcatcttgttcttcgcctgaggggaggcgcaaagaaaagaaagaagaagacttacaccaagcccaagaagattaagcataagaagaagaagataaagttgtctgttttgcagtactacaaggtagatgattctggcaaggtgcagaggctcaggaaggagtgccccaatcaggagtgtggagccggtactttcatggcaaatcactttgacaggcattactgtggcaagtgtggcttaacttatgtctatcagaaggctgaagcttaggaaaatttgttcgtctgggtctaaattgggtttagggtttagtcgggtttaaagtgggttagtgagtgtctctcacttcgcaccgggagttggaaccgatgggaagggcttggtgtctttacaagtgggattttgatcttgttaatgtaattggtattttaccaatttctatattggatttatgaaattggagctctttctattcaattgatgtcattgatccgtttaatgacatcaattgaatagaaaagagcttgcttgattaggattctcatgtta

SEQ ID NO: 2545 - DNA, 494 bp, Aquilegia formosa
tttactcattctgcaacaaaatgcaaatcttcgtgaaaaccctaacagggaaaacaataaccctagaagtagaagcaagtgatacaatcgacaatgtgaaaaccaagattcaagataaagaaggaataccaccatatcaacaacgtttaatatttgcaggaaaacaacttgaagatggaagaacattagcagattacaatatacagaaagaatcaacacttcatttagttttacgtcttcgtggtggagcaaagaagagaaagaagaaaacttatacaaaacccaaaaagattaaacatatgaagaagaaagttaagcttgctgttttacagttttataaagttgatgatttaaatgggaaagttgaaaaattaaggaaagaatgtcctaatggtgattgtggtgctgggacttttatggctaatcattttgataggcattattgtggaaaatgtggattgacttatgtttatcagaaagctggtggtgattga

SEQ ID NO: 2546 - DNA, 553 bp, Brassica juncea
agacgaaaaatgcagatctttgtgaaaaccctaacggggaagacgataaccctagaggtcgaatcatccgacacgatcgacaatgtcaaggccaagattcaggacaaggaaggtatcccgccggaccagcagcgactgatcttcgccgggaagcagctcgaagacgggaggacgctggccgactacaacatccagaaggagtcgacgcttcacctggtgctacgcctgagaggaggagcgaagaagaggaagaagaagacgtacacgaagccgaagaagatcaagcacaagcacaagaaggtgaagctcgcggttctgcagttttacaaggtggatgggacagggaaggttcagaggctgaggaaagagtgtccttcggttagctgtggtccggggactttcatggcgagtcatttcgataggcattactgtggcaagtgcggaaccacttatgtgttcaagaagcctgatgaagagtgattaggtgttatgtttctttgcctgtcttttttgttgtcgtattggaacttataattggcatttttatatattc

SEQ ID NO: 2547 - DNA, 618 bp, Brassica rapa
aaaatgcagatctttgtgaaaaccctaacggggaagacgataaccctagaggtcgaatcatccgacacgatcgacaatgtcaaggccaagattcaggacaaggaaggtatcccgccagaccagcagcgactgatcttcgccgggaagcagctggaagacgggaggacgctcgcggactacaacatccagaaggagtcgacgcttcacttggtgctccgtctgagaggaggagcgaagaagaggaagaagaagacgtacacgaagcccaagaagatcaagcacaagcacaagaaagtgaagctcgcggttctgcagttttacaaggtcgatgggtcaggcaaggttcagaggctcaggaaagagtgtccttcggttagttgtggtccgggcactttcatggcgagccatttcgataggcattactgtggcaagtgtggaaccacttatgtcttcaagaagcctgatgaagagtgattatgtgttctgtttttttttttttgcatgtcttgaattatcgtattggaacttataattggtatcggaatcttggttctgttctattgaggtttaaacttgtggcaaggttttgagtttattcaaatagttgcttgaagttga

SEQ ID NO: 2548 - DNA, 634 bp, Brassica rapa
agccttctccgagcaaaaaaaaataaaacagagagcacaagaaaatgcagatctttgtgaaaaccctaacggggaagacgataaccttagaggtcgaatcatccgacacgatcgacaatgtgaaggccaagattcaggacaaggaaggtatcccgccggaccagcagcgtctgatcttcgccgggaagcagctggaagacggaaggacactcgcggattacaacatccagaaggagtcgactcttcacctggttctccgtctgaggggaggagcgaagaagaggaagaagaagacgtacacgaagcccaagaagatcaagcacaagcacaagaaggtgaagctcgcggttctgcagttttacaaggtcgatgggtcagggaaggttcagaggctgaggaaagagtgtccctcggtgagctgtggtccgggaacgttcatggcgagtcatttcgataggcattactgtgggaagtgtggaactacttatgtctttaagaagcctgatgaagagtgatgagtgatcactaggtgttatgtttttgtctctcctatttaaaattgaattatcgtttattcggataattttttgagactgttaaggtttaattttattttatcggattatttagttta

SEQ ID NO: 2549 - DNA, 636 bp, Brassica rapa
  misc_feature (129)..(129): n is a, c, g, or t
aaaatgcagatctttgtgaaaaccctaacggggaagacgataaccctagaggtcgaatcatccgacacgatcgacaatgtgaaggccaagattcaggacaaggaaggtatccctccggaccagcagcgnctgatcttcgccgggaagcagctggaagacgggaggacgctcgcggactacaacatccagaaggagtcgacgcttcacttggtgctccgcctgagaggaggagcgaagaagaggaagaagaagacgtacacgaagcccaagaagatcaaacacaagcacaagaaagtgaagctcgcggttctgcagttttacaaggtcgatggttcaggcaaggttcagaggctcaggaaagagtgtccttcggttagttgtggtccgggaacgttcatggcgagccatttcgataggcattactgtggcaagtgtggaaccacttatgtcttcaagaagcctgatgaagagtgattagatgttctgttttttttgcctgtctttttaattgaattatcgtattggaacttataattggcatcggaatcttggtggttctgttctattgaggtttaaacttgtggcaaggttttgttttattcaaatagttgcttgaagttgaagtcatttattcta

SEQ ID NO: 2550 - DNA, 687 bp, Brassica napus
aaaaaaaaataaaacagagagcacaagaaaatgcagatctttgtgaaaaccctaacggggaagacgataaccttagaggtcgaatcatccgacacgatcgacaatgtgaaggccaagattcaggacaaggaaggtatcccgccggaccagcagcgtctgatcttcgccgggaagcagctggaagacggaaggacactcgcggattacaacatccagaaggagtcgacgcttcacctggttctccgtctgaggggaggagcgaagaagaggaagaagaagacgtacacgaagcccaagaagatcaagcacaagcacaagaaggtgaagctcgcggttctgcagttttacaaggtcgatggaagtgggaaggttcagaggctgaggaaagagtgtccctcggtgagctgtggtccgggaacgttcatggcgagtcatttcgataggcattactgtgggaagtgtggaactacttatgtctttaagaagcctgatgaagagtgatgagtgatcactaggtgttatgtttttgtctctcctatttaaaattgaattatcgtttattcggataattttttgagactgttaaggtttaattttattttatcggattatttagtttataaatagttgcagtaagttattgtattatctctactgatagtttatatgtctaatgtctagatttcg

SEQ ID NO: 2551 - DNA, 820 bp, Brassica napus
atcaacgcagagtacgcgggggttctcagacgaaaaatgcagatctttgtgaaaaccctaacggggaagacgataacactagaggttgaatcatccgacacgatcgacaatgtgaaggccaagattcaggacaaggaagggatcccaccggaccagcagcgtctgatctttgccgggaagcagctggaagacgggaggacgctcgcggactacaacatccagaaggagtcgacgcttcacttggtgctccggctgagaggaggagcgaagaagaggaagaagaagacgtacacgaagcccaagaagatcaagcacaagcacaagaaagtgaagctcgcggttctgcagttttacaaggtcgatgggtcaggcaaggttcagaggctgaggaaagagtgtccttcggtcagttgtggtccgggaactttcatggcgagtcatttcgataggcattactgtggcaagtgtggaaccacttatgtcttcaagaagcctggtgaagagtgattaggtgttctgtttttttctttcttgcctgtcgtttttaattgaattatcgtattggcatcggaatattagttctgttctattgaggtttaaacttgttgcaaggttttgtgtttattcagtagttgcttgaagttgaagtcattttgctagtaacttggaatattagttacttgtgaacgtaacaataggttgtttagctgaataaatattatgctttagttttgtagcctaaatggattctttttctgggttgaattttgttgttggtatgtaaacatttagactccaataatatcatatttccaccacc

SEQ ID NO: 2552 - DNA, 765 bp, Brassica napus
cgggggttctcagacgaaaaatgcagatctttgtgaaaaccctaacggggaagacgataaccctagaggtcgaatcatccgacactatcgacaatgtgaaggccaagattcaggacaaggaaggcatccctccggaccagcagcgtctgatattcgccggtaagcagctggaagacgggaggacgctagcggactacaacatccagaaggagtcgacgcttcacttggtgctccgcctgagaggaggagcgaagaagaggaagaagaagacgtacacgaagcccaagaagatcaagcacaagcacaagaaagtgaagctcgcggttctgcagttttacaaggtcgatgggtcaggcaaggttcagaggctcaggaaagagtgtccttcggttagttgtggtccgggaactttcatggcgagccatttcgataggcattactgtggaaagtgtggaaccacttatgtcttcaagaagcctgatgaagagtgattaggtgttctgttttttttttttttgcctgtcttgaattatcgtattggaacttataattggcatcggaatcttggttctgttctattgaggtttaaacttgtcgcaaggttttgagtttattcaaatagttgcttgaagttaataacttggaatattagttacttgtgaacttaataatatgatgtttagctgaataaatcttttgcctttgatcatcttgtttggctataatagcttttatttttagtctaaatggatttgtttttctgtg

SEQ ID NO: 2553 - DNA, 602 bp, Raphanus sativus
cacaccaaaaatgcagatctttgtgaaaaccctgacggggaagacgataaccctagaggtcgaatcatccgacacgatcgacaatgtcaaggccaagattcaggacaaggaagggatcccaccggaccagcagcgtctgatcttcgccgggaagcagctcgaagacgggaggacgctcgcggactacaacatccagaaggagtcgacgcttcacttggtgctccgcctgagaggaggagcgaagaagaggaagaagaagacgtacacgaagccgaagaagatcaagcacaagcacaagaaggtgaagctcgcggttctgcagttttacaaggttgatgggacagggaaggttcagaggctgaggaaagagtgtccttcggttagttgtggtccgggaactttcatggcgagtcatttcgataggcattactgtggcaagtgtggaaccacttatgtcttcaagaagcctgatgaagagtgattagttgttatgtgttttttttttgcctgcctttttattattgaattatcgtattggaacttataattggcttaattcggattggtttcgttttattgaggtttgcaactttttttaaata

SEQ ID NO: 2554 - DNA, 659 bp, Thellungiella halophila
atggagcaaaaacagagagaagaaaaatgcagattttcgtgaaaaccctaacggggaagacgataacactagaggttgaatcatcggatacgatcgacaatgtgaaggcgaagatccaggacaaggaaggaatcccgccggatcagcagcgactgatcttcgccggaaagcaattggaagacgggaggacactggcggattacaacatccagaaggaatcgacgcttcacttggttctccgtctgagaggaggagcgaagaagaggaagaagaagacgtacacgaagccgaagaagatcaagcacaagcacaagaaagtgaagctcgcggttctgcagttttacaaggtggatgggaccggtaaggttcagaggctgaggaaagagtgtccttcggttagctgtggaccggggactttcatggcgagtcatttcgataggcattactgtggaaagtgtggaaccacttatgtcttcaagaagcctgatgaagagtgatgatgatgatgattcttaagtcgtcatttttctcctctttttttatacttgctgttttgaactatcagtgattttattatggaactacattggtatgttggattctaaatttttgagtttgttttattgaggcttaattattagctgttttttttgttgttc

SEQ ID NO: 2555 - DNA, 635 bp, Ipomoea batatas
ggaacacaagacaaggaggcgtcggcgtctcttccagcaaggcaaagatgcagatcttcgtgaaaaccctcacggggaagacgataaccctggaggtggagtcctccgacaccatcgacaatgtgaaggcgaaaattcaagagaaggagggaatcccacccgaccagcagcggctcatcttcgccggaaagcagctggaggacgggcggaccttggcggactacaacatccagaaagagtctactctccacctggtgcttcgcctccgcggtggcgctaagaagaggaagaagaagacctacaccaaaccgaagaagatcaagcacaagcataagaaggtgaagctggcggtgctgcagttctacaaggtggatgagtccgggaaggtgcagaggctcaggaaggagtgccctaatgctgagtgcggcgctggcaccttcatggccaaccacttcgatcgtcactactgtggtaagtgcggtctcacatatgtttacataaagctggttccgattgatcgctcatccatccatctatgatcgatcaaagttttgagtattgaatctcgttatatgttgtattttagcatttggaatatggagactgaagttttactggataatgtcagttatgta

SEQ ID NO: 2556 - DNA, 582 bp, Gnetum gnemon
ctagggtttactcggttatagggagagattagcgttcactcaggaacggcaaaggcgatccaggagggaaagctgcgaaagtaacattgctggaaacgaagatgcagatcttcgtaaaacacttactgggaagacaattactttggaggtagagtcctccgacactattgacaatgtgaaggccaagatacaggacaaggaagggattccgccggatcagcagaggctgatttttgcagggaagcaactggaggatggaagaaccctagcggactataatatccagaaggaatccacactgcacctcgtgctgcggctcaggggaggggccaagaagagaaagaagaagacgtacaccaagcctaaaaaaatcaagcacaagaagaagaaggtgaagctggcggttctccaattctacaaggtggatgacaatggcaaaatccaacgcttaaggagggaatgccccaaccaagattgtggtgcaggcacattcatggccaaccatttcgataggcactgctgtgggaaatgcacgatgacctatttgttcaagaaacctgcagatgagtagggttttggttt

SEQ ID NO: 2557 - DNA, 707 bp, Antirrhinum majus
gatgcagatcttcgtgaaaccctaacgggcaagacgatcaccctggaggtggagtcctccgacacgatcgacaacgtgaaggcgaagatccaggacaaggagggcatcccccccgaccagcagcgcctcatcttcgccggcaagcagctcgaggacggccgcacactcgccgactacaacatccagaaggagtccacactgcacctcgtgctgcgtctccgaggcggcgccaagaagcgcaagaagaagacctacaccaagcccaagaagatcaagcacaagcacaggaaggtcaagctcgccgtgcttcagttctacaaggtcgatgattccggcaaagtgcagaggctcaggaaggagtgtcccaacgccgagtgcggtgcggggactttcatggcgaatcactttgacaggcactactgtggtaagtgtggccttacgtatgtctacaacaaggccggtgctgattaattaccttgcgttgagaggaggtttcaatttgttatatgtcgtttttttatcaaggattttgctagggttgagattttcctagtgttatgttgagacttgtatcgacattttcaatttagtttaattatgctattatactcttagtgttacttttataatgtgttggtaatatgttttttttttggttcaaacgcgatcatgccatctgaattctgaaattgtgtttgtgcgtcaaa

SEQ ID NO: 2558 - DNA, 608 bp, Arabidopsis thaliana
tttctcaaacaagaaaatgcagatcttcgtgaaaaccctaacggggaagacaataaccttagaggtagaatcatcagacacaatcgacaatgtgaaagcgaagatccaagacaaggaaggaatcccaccggatcagcaacggttgatcttcgccggaaaacaattggaagatggaagaacactagctgattacaacatccagaaagagtcgacgcttcatttggttctacgtctgagaggaggtgcgaagaagaggaagaagaagacgtacacgaaacctaagaagattaagcatacgcacaagaaagtgaagctagcagttctgcagttttacaaggttgatggaagtgggaaagttcagaggttgaagaaagagtgtccttctgttagttgtggtcctggaactttcatggcgagtcatttcgataggcattattgtgggaaatgtggaactacttacgtgttcaagaaggctgatgaagagtaggttatgtctttttgcttttggaatttagattgttttttttttaattcagatattttgagatggttttatactattgagggatggtttaattgttgcataatacattatattatctttgatt

SEQ ID NO: 2559 - DNA, 659 bp, Lactuca sativa
atcaccctagaggtagaatcctccgacaccatcgacaatgtcaaagcgaaaatccaagacaaggaaggcatcccaccggatcagcaacgtctcatcttcgccggaaagcagctggaggacggcagaaccctagccgactacaacatccagaaggaatccaccctccaccttgttctccgtctccgcggtggtgctaagaagcgtaagaagaagacctacaccaagccaaagaaaatcaagcacaagcataagaaggtaaagcttagcgtgttgcagttttacaaggtcgatgattcgggaaaggttcagaggctgaggaaggagtgccctaacgctgagtgtggcgccggaactttcatggctaatcactttgatcgacactattgtggaaagtgtgggcttacttatgtctatcagaaggctggaggagattaatttatcaggtttttgcttaaattttatcatatgagacagattattatttgagctttttagagttttttaaatctgcgttaagactgtttttgattttattatatcattatgaattttgggtgatgatttattttcatatatgatgctgttatcttcgatatgagttatcatgacataactttcaatgattcaattgttcatgaatgttgcagccagtttttatt

SEQ ID NO: 2560 - DNA, 658 bp, Lactuca sativa
atcaccctagaggtggaatcctccgacaccatcgacaatgtcaaagcgaaaatccaagacaaggaaggcatcccaccggatcagcaacgtctcatctttgccggaaaacagctcgaggacggcagaacactagccgactacaacatccaaaaggaatccaccctccaccttgtcctccgtctccgcggtggtgctaagaagcgtaagaagaagacctacaccaaaccaaagaaaatcaagcacaagcataagaaggtgaagcttagcgtgttgcagttttacaaggtcgatgattcgggaaaggtccagaggctgaggaaggagtgccctaacgctgagtgtggcgccggaactttcatggctaatcactttgatcgacactattgtggaaagtgtggtcttacttatgtctatcagaaggctggtggagattaatttatcaggttttcgctttaaatttatcatgagacagattattatttgagtttttttagatgtttttaaatctgcgttgagactgtttttgattttatcatatcattatgaattttgggtgatgatttattttcatagatgatgctattatcttcgatatgagatatcatgacatacctttgtatgattcaattgttcatgaatattgcagcccgtttttatt

SEQ ID NO: 2561 - DNA, 713 bp, Orobanche aegyptiaca
taacgggtaaaaccattaccctggaggttgaatcctccgacacgatcgacaatgtgaagacgaagatccaggataaggaaggcattcccccggatcagcagcgtctcatcttcgccgggaagcagctcgaggacggccgtaccctcgccgactacaacatccagaaggagtcgactctccacctcgtcctccgtctccgcggcggcgcgaagaagcgcaagaagaagacctacacaaagccgaagaagatcaagcataagaagaagaaggtcaagctcgctgttctccagttctacaaggtggatgactccggcaaggtgcagaggctgaggaaggagtgcccgaatgctgagtgcggtgcggggacgttcatggcgaatcatttcgataggcactactgtggtaagtgtgggttgacttatgtctacaataaggccggtggcgattgaaatttgggagctgtttcttatgtctgtttgtttccatgaacaatttttagtatgactgttatctagttttttttggatttatggatctctgttttcagtactgcttgtttcgaatctaaaatttcaatttgatttacctttaggtgctgtgtctgttttgcattccttatgctttagcaagttttaatcatggtgtttggttttggaattcagattatatctcaatatatgttttgatgggtgactactacagtttgaagccaa

SEQ ID NO: 2562 - DNA, 649 bp, Pteridium aquilinum
cagatactcgtaaaaccttgactggtaagaccataccctgaggtcgagtcttctgatacattgacaatgtgaagaccaagattcaggacaaggaggaattcctcctgatcagcagcgcctgatttttgctggtaagcagctggaagatggtcggacactttgctgattataacattcagaaggaatccaccctccaccttgtgcctttaggctgagaggaggtgctaagaagagaaagaagaagacctacaccaagcccaagaagctcaagcataagaagaagaaggtcaagctcgctgtgctccagttctacaaggttgatgactctggcaaggtgcagcgcttgcgcaaagagtgcccgaatgccgagtgtggagctggaactttcatggcgaaccatcatgatcgccattactgtggcaagtgtggcttgacctatgtttaccagaaggcctgattatgtgcatgagctgggagctttagttttttatttagcattgtcaacagcagctagtttaggttttttcattcgcggtattggtgtgcaagtgtcgtcgaggttttttgcgtaaagctagcagaccttgggttgttagctgatcaacatttatggattaatgtagttttgtcttagtttttgaaaaaagaa

SEQ ID NO: 2563 - DNA, 571 bp, Citrus clementina
aacacagcctagccgtagaaccttcagcctctctgggtcacacagccaaacaagatgcagatcttcgtgaaaaccctaacgggtaagaccataacgttggaggtggagtcctccgacacaatcgacaacgtcaaggcgaagatccaggacaaggagggtatcccaccggaccagcagcgcctcatcttcgccggcaagcagctcgaagacgggcgaaccttggccgactacaatatccagaaggagtcgactctgcacctggtgcttcggcttcgtggtggggccaagaagagaaagaagaagacatacaccaagcccaagaagatcaagcacaagaagaagaaggtgaagttggctgtgttgcagttttacaaggttgatgattctgggaaagtgcagaggctgaggaaggagtgccctaatgctgagtgtggtgctggcacttttatggccagtcactttgacaggcattattgtgaatttgttccatgattatgtttgccatagcaaatttgggagttttgtaaggattaaccaccgtatggtttcatctgctggtggcgcgtttggc

SEQ ID NO: 2564 - DNA, 690 bp, Citrus sinensis
aacacagcctagccgtagaaccctcagcctctctgggtcacacagccaaacaagatgcagatcttcgtgaaaaccctaacgggtaagaccataacgttggaggtggagtcctccgacacaatcgacaacgtcaaggcgaagatccaggacaaggagggcatcccaccggaccagcagcgcctcatcttcgccggcaagcagctcgaagacgggcgaaccttggccgactacaatatccagaaggagtcgactctgcacctggtgcttcggcttcgtggtggggccaagaagagaaagaagaagacatacaccaagcccaagaagatcaagcacaagaagaagaaggtgaagttggctgtgttgcagttttacaaggttgatgattctgggaaagtgcagaggctgaggaaggagtgccctaatgctgagtgtggtgctggcacttttatggccagtcactttgacaggcattattgtgaatttgttccatgattatgcttgccatagcaaatttgggagttctgtaaggattaactgctatatggtttcatctggtggtggcacgtttggctgcgctgcatgtagtgctcaaacttctcctcagaagaacaaaagagtaccagaatttgctgagcgttgactatttacattatttccacaagaagaaaagaattgatgttacccattttg

SEQ ID NO: 2565 - DNA, 844 bp, Elaeis guineensis
ctgtctcagcttctctacccctctttcccttcgctgcgacggcctcagccgccgccgccaacatgcagatcttcgtgaagaccctcacggggaagactattaccctcgaggtagagtcctccgacaccatcgacaacgtcaagtccaagatccaggacaaggagggcatcccaccagaccagcagcgcctcatcttcgccggaaagcagctcgaggacggccgcaccctcgccgattacaacatccagaaggagtccactctccacctcgtcctccgcctccggggtggcgcaaagaagcgcaagaagaagacgtacaccaagcctaaaaagatcaatcacaagaagaagaaggtcaagctacccgttctccagttttacaagattgatgactccggcaaggtcacccggctcaggaaggagtgccccaacgccgagtgtggcgccgggaccttcatggccaactacttcgatcgccattactgtggcaagtgcggtctcaatgtctaccagaaggctggagggtttttggatgtatgctgatttcgttgaacgttaggagtgcacactggtgagacaacgttctgtggccttgctttaaatttttctgtgaatcttgtcatttttgggacgtggattttagtgagaagctttggtttgatttgacgagactgcttgtaatatattgtttaaagggtttgctttgccatttgatagtgctaagtgacgaaggtctttttcaaagacggtgaatggagaccggtgaattacgtccttgaatttttagtgaatcattttcataactcatgcgtcttatataattttgactagttttggtttgtgct

SEQ ID NO: 2566 - DNA, 697 bp, Cichorium intybus
tgatctatttgaatcggcgaacatgcagatcttcgtgaaaccctaacgagcaagacgatgacgttggaggtagagtcctcctacacgatcgacaatgtgaagtctaagatccaggacaaggagggcatcccaccggaccaacaacgtctcatcttccccggaaaacagctcgaggacggcagaaccctagccgactataacatccagaaggagtcaactcttcaccttgtcctccgcctccgtggtggtgcaaagaagcgcaagaagaagacctacaccaagccaaagaagatcaagcacaagcataagaaggtgaagttgagcgtgttgcagttctacaaggttgatgattccgggaaggtgcagcggttgaggaaagagtgccctaacgccgagtgcggagctggaaccttcatggccaaccatttcgacagacactactgtggtaagtgtgggctcacctatgtttaccagaaggcttgatatttgttgcatcatacaattgtcgaactttctttacatgttatggattaagattatggatttcgttagttatttgtagcaaaccttgattattgaggttgtttttgaattgaacactttgaatgctttacttggtcattggctacatgttttagaatagaattagattctaataagggcagacaaagtatcttttgtctcatgttttcaaaaa

SEQ ID NO: 2567 - DNA, 773 bp, Zamia vazquezii
  misc_feature (116)..(116): n is a, c, g, or t
  misc_feature (599)..(599): n is a, c, g, or t
  misc_feature (671)..(671): n is a, c, g, or t
  misc_feature (682)..(682): n is a, c, g, or t
tgactgggaagaccataacccttgaggttgagtcttctgataccatcgacaatgtgaaagccaaaatccaagacaaggagggaataccgcctgatcaacagcgactgatatttgcnggcaaacaactagaggatgggcgcactctcgccgattataacatccagaaggaatcgaccctgcaccttgtccttcgtctgaggggaggtgccaagaaaaggaagaagaagacctacacaaaacccaagaagatcaagcacaagaagaagaagatcaagttggctgtgctgcaatattacaaggttgatgactctgggaaagtgaatagattgcgcaaggagtgccccaatcaagagtgtggtgccggcaccttcatggccaatcatttcgaccgccattattgtgggaaatgcggtctcacttatgtctaccagaaggctggtggcgaataaatccccccccccccctcctttagtttggcttcgaggagaagttgaggagcttgtttctgttgcaatgacagctactttaacagataaggaatttttatttcccacgttggggatttgcaatagcttagtattacgcaggtgaagaatttntagggccttagggacctgtacgtttcctccttatgatttcatgtgccaatttataaccgtttggaaaatagntgaagtatctnttgaggtgcatttggtttatactttttaaacttcagcatatgagagcactaagccctaaatttgttaggggagctttgatcagaggccctt

SEQ ID NO: 2568 - DNA, 696 bp, Artemisia annua
aaaaccataaccctcgaagtcgagtcctcggacaccatcgacaatgtcaaagccaagatccaagacaaggaaggcatcccaccagaccaacaacgtttaatcttcgcaggaaagcagctagaagacggccgcaccttagcagactacaacatccagaaggagtccacccttcatttggtcctgcgtctacgtgggggtgctaagaagcgtaagaagaagacgtacacaaagcccaagaagattaagcacaagcataagaaggtgaagcttgctgtgttgcagttttacaaagtgggtgaggatgggaaggttaataggttgaggaaggagtgtcctaatgctgaatgtggggctgggacttttatggctaatcatgagaataggcattattgcggcaagtgtggtttgacctatctctaccagaaggcttaataagtcttataaagcaaaagctgtgaggtgaggagattgaagaattctgctgagtttggcaacttttgttggaattcattttgatcttattaaaagtttagatattggttatgtgatgttttggattattattcaggatgtttatgttattttggttaaaacgttgataaccggatgatgttgctttatatttagtcaatttgaatagtttggccgttaaatttgtagtttgattattgttgattgttttattatgttaccagc

SEQ ID NO: 2569 - DNA, 604 bp, Cleome spinosa
agagctgcagattttcagaggaaagatgcagatttttgtgaaaacccttacggggaagactataaccctagaggtcgagtcctccgacacgatcgacaatgtgaaggccaagattcaggacaaggaaggaatcccgccggaccagcagcgattgatcttcgccgggaagcaactggaggacggtcggacactcgccgactacaacatccagaaggaatcgacgctccacttggttctccgtctcagaggaggcgcgaagaagagaaagaagaagacgtacacgaagccgaagaagatcaagcacacgaagaagaaggtgaagctcgcggttctgcagttctacaaggtcgatggttcgtgcaaagtgcagaggctgaggaaggaatgcccgtctgtcggttgcggcccggggacgttcatggcgagtcacttcgacaggcattattgcggaaagtgcggtaccacctatgccttcaaggctcccgctgacgagtaggtcatgtttcgcggtttttgattgaacagtttcgaatttggttctcttttgttgactcaattggcattatttttgtttggattccattagctccattacccaaatttt

SEQ ID NO: 2570 - DNA, 578 bp, Hordeum vulgare
ggcccgagcgaatcaagtctgaggattgtcacctccacattaagatgcagatcttcgtcaaaaccctaacggggaagaccataaccttagaggttgaatccttcgatacaatcgacaacgtcaaggccaagatccaagacatggagggcatcccacccgaccaacagcgccttatcttcgccgggaagcagctcgaacacggccgcaccttagccgactacaacatccagaaggaatccactctccacctcgtcctccgtctcacgggtggcgccaagaacatgaagaagaatacctacaccaagcccaagaagatgaagcacaagacgaagaatgtcaagctcgcagtgctccagttctacaacgtggatgagtcctggaaggttcagaggctgaggaaagagtgtcctaatgcggagtgtggggccgggactttcatggctaatcattttgatgggcactattgcggtgagtgtgggctcacttacctctaccagaaggctggtggagactgagcaacgtccaatatcaccttcagtaaaaagaagaaactgaaatcaatagtgtatttttatcgg

SEQ ID NO: 2571 - DNA, 597 bp, Avena sativa
cctggaggttgagtcttccgacaccatcgacaacgtcaaggccaagatccaggacaaggagggcatccccccggacccagcagcgtctcatcttcgccggtaagcagctcgaggacggccgcaccctcgccgactacaacatccagaaggagtccaccctccacctggtgctccgtcttcgcggaggcgccaagaagcgcaagaagaagacgtacaccaagcccaagaagcaaaagcacaagcacaagaaggtgaagctcgccctcctcaagttctacaaggtcgacgacgccaccggcaaggtcaccaggctcaggaaggagtgccccaacgccgagtgcggcgccgggacattcatggccaaccacttcgaccgccactactgcggcaagtgcggcctcacctacgtctacaaccagaaggcttagaggtggctccgagtttgctatgcgttactttaccctacctatcgagaactgaattgagttgttggttacatctcatttagatatgtctcccgtttgtcgttaaaacagaacctgaagtagtatgtttcctggattattgatcgtctattactcagataatgtgaagcga

SEQ ID NO: 2572 - DNA, 564 bp, Silene vulgaris
ggaaggctcatttagccgagaagacatgcaaatctttgtcaagaccctcacgggtaagaccatcacccttgaggtggagccctctgacaccatcgacaacgtcaaggccaagatccaggacaaggagggaattccccccgatcagcagcgcctcatcttcgctggaaagcagctcgaggatggccgcactctttctgactacaacatccagaaggagtccaccctccacttggtgctccgccttcgtggtggtgccaagaagaggaagaagaaggcttacaccacccccaagaagatcaagcacaagagaaagaaggtcaagctcgctgtcctcaagtactacaaggtcgacgagaacggaaagatcactcgtctcaggcgtgagtgccccaacgagctttgcggagctggtgtcttcatggccaaccacaaggaccgccagtactgcggaaagtgcggactgacctacgtcttcaagaaggattaaacacaccacaaaaacttcctgaattcgaattgtgttcttccccctcgttcttgtcgaagaaatcgatgatgtccacc

SEQ ID NO: 2573 - DNA, 717 bp, Pteridium aquilinum
atacttgtgatcgagcgacgaaggaaattgtctggagctcggcctttctccaacctgtgaagatgcagatcttcgtaaaaaccttgactggtaagaccattacccttgaggtcgagtcttctgatactattgacaatgtgaagaccaagattcaggacaaggagggaattcctcctgatcagcagcgcctgatttttgctggtaagcagctggaagatggtcggacacttgctgattataacattcagaaggaatccaccctccaccttgtgcttaggctgagaggaggtgctaagaagagaaagaagaagacctacaccaagcccaagaagctcaagcataagaagaagaaggtcaagctcgctgtgctccagttctacaaggttgatgactctggcaaggtgcagcgcttgcgcaaagagtgcccgaatgccgagtgtggagctggaactttcatggcgaaccatcatgatcgccattactgtggcaagtgtggcttgacctatagtttaccagaaggcctgattatgtgcatgagctggagcttagtttttatttagcattgtcaacagcagctagttaggttttttcattcgcggtattggtgtgcaagtgtcgtcgaggttttttgcgtaaagctagcagaccttgggttgttagctgatcaacatttatggattaatgtagttttgtcttagtttttgatgttactgtcgt

SEQ ID NO: 2574 - DNA, 528 bp, Arachis hypogaea
tgaggggaggattgaagttagaccaggatgcaaatctttgtcaagactctcactggaaagaccatcacccttgaggtggaaagctctgataccatcgaaaatgtcaagcaaaagatccaggataaggaaggaatccctcctgatcaacaaagacttatcttcgctggtaagcaattagaggacggcagaactttagccgactacaacatccaaaaggaatctactttacacttggtcctcagacttagaggaggaggtaaaagagaaagaagaaggtctacaccaagccaaagaagaacaagcacaagaagaagaaggtcaagctcgctgttctcaaatactacaaggtcgacgaaaacggcaagatcactagattgagaagagaatgccctaacaaggaatgcggagctggtgtctttatggcctctcacttcgacagacaatactgcggaaaatgcggtttgacttacgtcttcaacaagcctggagaaacctccgacgagtaaagtcgtttccctgtcctctaat

SEQ ID NO: 2575 - DNA, 538 bp, Mesembryanthemum crystallinum
gtcgacgggacccggaatccgagaaaacccgtttcgaaaatgcagatcttcgtgaagaccctcacggggaagaccatcaccctggatgtggaaccatccgacagcattgacaacgtcaagcagaagatccaggacaaggaaggcatcccgccagaccagcagcgcctgatcttcgctggcaagcagctcgaggatggccgcaccctctcagactacaacatccagaaggagtcgaccctgcacctcgtgctccgcctgcgtggtggtggcaagaagcgcaagaagaagacgtacaccaagccaaagaagattaagcacaagcacaagaaggtcaagctcgccgtcctcaagttctacaaggtggacgacaatggcaagatctcgcgcctgcgtaaggagtgcccacagtgtggtgctggtgtcttcatggccacgcacttcgaccgccactactgcggcaagtgccacgtgacctaccagttccagaactaagtgtctcgtcggcagacgaacggatggattcttaattctaaattga

SEQ ID NO: 2576 - DNA, 719 bp, Cichorium intybus
atttcgggctcgaggcccttcgtgccggaatttcggccacgggcacggatcgggcggaaaatgcagatcttcggtgaaaaccctaacgggtaaaacgatcaccttggaagtcgaatcctccgatacgatcgacaatgtgaaggccaagatccaagacaaggagggcatcccaccggaccaacaacgactcatcttcgccggaaaacagcttgaagacggtagaacacttgctgactacaacatccagaaggaatcgactctccacttggtcctccgtctccgtggtggcgcaaagaagcgtaagaagaagacatacactaaacctaagaagatcaagcacaagcacaagaaggtgaagctgagcgtgttgcagttctacaaggttgatgattccggtaaggttcagaggctgaggaaagagtgccctaatgccgagtgcggcgctgggactttcatggctaatcatttcgataggcactactgcggcaaatgtggacttacctatgtctaccagaaggcttgaggttgatttaattagataagtacttttcatgtcatggttgataattctggattttgtggttattttggttaaacctggataatgatgttgtttttgttttacgtaatttgaatgcttttgttcaaaaaaaccaaaaaagaaacaacaacaatcgagggggggcccggattcccatttgcccatatggaacagctag

SEQ ID NO: 2577 - DNA, 629 bp, Castanea mollissima
gagtcctcagacaccatcgacaatgtcaaggccaagatccaagacaaggaggggatcccaccggaccaacagcgcttgatcttcgccggaaagcagctcgaggatggccgaaccttggccgactacaacatccagaaggagtccacgcttcaccttgtgcttcgtctccgcggtggcgctaagaagagaaagaagaagacctacaccaagcccaagaagatcaagcacaagcacaagaaggtcaagctcgctatcctccagttctacaaggtcgacgactctgggaaagttcagaggctcaggaaagagtgcccaaatgccgagtgtggtgctggaaccttcatggctaaccatttcgataggcattactgtggcaagtgtgggcttacctatgtgtaccagaaggctggtggtgattagaggttcgatgaaatgagacacaagttgagtttttttgggtacccttttggctattttgttggtttttagtgaattttgatagttttatttcggtttaagtttatgggtatttcgatgacattatgcaattgaataatttgtttaagactttttgtttatttattagattttgaatgaaacgtcgagttttttgggtacccttttggact

SEQ ID NO: 2578 - DNA, 577 bp, Vigna unguiculata
cttctgcgttcagaacaagtcgttcgacatgcagatctttgtcaagaccctgacagggaaaactattaccctcgaggtagaaagctccgataccattgacaatgtaaaacaaaaaattcaggacaaagaaggaatccctcctgaccaacaaagattgatcttcgccggcaagcaactcgaagatggacgcactttggccgattataacattcaaaaggagtccactcttcatcttgtcttaagacttcgtggtggcgccaaaaagaagaagaagaaggtttacactaaacccaaaaagatcccccacaagaaaaagaaggtcaagcttcatgtcttgaaattttacaaagtcgatgatgatggcaagatcggcagacttaggagagaatgcccctcaccctcttgcggaggaggaactttcatggcctctcacttcgacagacaatactgtggcaaatgcggcctcacttatgtctacaacaacaaaggatctgaataagtcttggggcacaaactttttcaatgaaatcaaaaaactaaaaaaattgggtctgaattaatttaggacacaacaaaa

SEQ ID NO: 2579 - DNA, 552 bp, Olea europaea
tcggttatcccaaaacctagcctgtgaatttgcctctgtttagaagatgcagatcttcgtaaaaacccttacggggaaaaccataaccctggaggtggagtcctctgataccatcgacaacgtcaaagccaagatccaggacaaggagggcatcccgccggaccagcaacgccttatcttcgccggaaagcagctagaggacggacgtaccctcgccgactacaacatccagaaggagtccaccctacatctcgtactacgtctccgtggtggcgccaagaagcgcaagaagaagacgtacaccaagccaaagaagatcaagcacaagcataagaaaggtcaagctcgctgtcctccagttcttacaaggtcgacgactccggaaaggtccagaggctgcggaaggagtgtcccaatgccgagtgcggggcgtggaacttctcgcgacacatttagtttacgtacggacgacctaaccttacgttgggttacggttacgtagaacgaaccgaccgaaccgaacggggaagggtaagggtacgaacggacgac

SEQ ID NO: 2580 - DNA, 799 bp, Helianthus annuus
gtgttggtcccgggaattcggccattacggccggggattgacaacgtgaaggccaagattcaagacaaggaaggcatcccaccggaccaacagcgtctcatcttcgccggaaaacagctcgaagacggcagaaccctagccgactacaacatacagaaagagtcgactctccaccttgtgctgcggctccgtggtggcgcgaagaagagaaagaagaagacctacacaaagccgaagaagatcaagcacaagcacaagaaggtgaagctaagcgtcttgcaattttacaaggtggacgatgctggaaaggtgcagaggttgaggaaggagtgcccgaatgcggagtgtggagcgggaactttcatggcgaaccatttcgaccgtcactattgtgggaagtgtgggttgacttacgtctaccagaaggcgtgagggttagtggtttgagttaatggtttttgttattgttatggttatggattgtttcggataatgtttttgtttttttgttttggtgaacctggatgcacctgcttttgaatttataaagttgacttgcttctttatatatttaatttcttatgtgtttttggttatttatcagtaggttttatatggtttgcttgattgcagttctagtttgatatatttgggcatgttttataatttaccgctcaagccttttgaatttgaagatagtttttgagtagttgttttttttgtctaaattatatgtattttgggatcatgatgtatttatttggttgcattttttgttatattgatctattatggtgtt

SEQ ID NO: 2581 - DNA, 584 bp, Avena sativa
ggaatccgcgagaacaaccccgtttcgaaaaatgcagattttcgtcaagaccctcacggggaagacgatcacgctcgacgtggagccgtcggactccattgacaatgtcaagcagaagatccaggacaaggaaggcatcccgcctgaccagcagcgcctgatctttgccggcaagcagctcgaggacggccgcacgctttcggactacaacatccagaaggagtcgaccttgcacctcgtgctccgccttcgtggtggtggcaagaagcgtaagaagaaggtgtacaccaagccgaagaagatctcgcacaagcacaagaaggtcaagcttgctgtgctcaagttttacaaggtcgacgacaatggcaagatctcgcgcctccggaaggagtgcccgcagtgcggcgccggcatcttcatggccacgcactttgaccgccactactgtggcaagtgccacgtgacctaccagttccagaagtaaacgctctggacgggtcagtctatccagcggtctaaacgcgccatttcccaaacacggaaatggccgtgatgtaatgcagattacaccgggttctatcgac

SEQ ID NO: 2582 - DNA, 542 bp, Pinus taeda
ctcgtgccgagttcggcacgaggcagatcttcgtcaagaccctcacggggaagacaatcaccctcgaggtggagtcttcggacaccatcgagaatgtgaagcaaaagatccaagacaaggaaggaattcccccggatcaacaacgattgatcttcgccggcaagcagctcgaggacggcagaactcttgctgactacaacatccagaaggaatccaccctccatcttgtgcttcgccttcgaggtggtgccaagaagagaaagaagaaggtttacaccaagccaaagaaggcccaccacaagaagaagaaggtcaagttggccgtgttgaagtactacaaggtcgacgacaacggcaagatcactcgtcttagacgagagtgcccttctgctcagtgcggcgctggtgtcttcatggccatccacttcgaccgccagtactgcggcaagtgcggtttgacctatgtcttcaagaacgagaagggtgaggctgccgacgaggaataaatccgaatcctctgtcagaaaaaaaaaaaaaaaaaa

SEQ ID NO: 2583 - DNA, 511 bp, Silene vulgaris
cgcaatgcagatcttcgttaagaccctcacgggtaaaaccattaccctagaggtagagagctccgacaccatcgacaatgtaaagcaaaagatccaagacaaggagggtatcccaccagatcaacaacgcctcattttcgctggaaagcaactcgaggacggcagaaccttggccgactacaacatccagaaggaatcaacactccaccttgtgttgagacttctcggcgctggtaagaagaggaagaagaagacatacaccaagccaaagaagataaagcacaagaagaagaagagcaagttggccgtcctcaagtactacaaggttgatgacagccttaagatcactcgcttgagaagggagtgccccaacgctgagtgcggtcctggaaccttcatggctgcccactttgacaggcaatactgcggcaaatgtggtctcacgtatgtgttcaacaagccagcagccaaggcttaagcaagctgcattgcagaaaataaacgctaattt

SEQ ID NO: 2584 - DNA, 569 bp, Brassica juncea
ccctcgaggttgaatcctccgacaccatcgacaacgtcaaggccaagatccaggacaaggaaggcatccctccggaccagcagcgactcatcttcgccggaaagcagctcgaggacggacgcaccctagccgactacaacatccagaaggagtcgactctccacctcgtcctccgtctccgcggtggcgccaagaagaggaagaagaagacgtacaccaagcccaagaagatcaagcacaagcacaagaaggtcaagctcgccgtgctccagttctacaaggtggatggctccggcaaggtccagaggctgaggaaggagtgccctaacgccacgtgtggcgctgggacgttcatggctagccatttcgaccgtcactactgtggtaagtgtggtcttacctacgtgtaccagaaggaaggtgccgaagcatgatctcgttttagatctctcttgtctttgaatactgcttttgatgttttatttttgatgttatggatcttatgttgaacatgttttaaggattattgttctttggttattcgtcaatgcttgcttagttgttgctaa

SEQ ID NO: 2585 - DNA, 606 bp, Silene vulgaris
gcgcacaatcgcgtgcgcaccaagctgagggcggcagcagccatgcagatctttgtgaagaccctgacgggcaagacgatcacgctcgaggtcgagtcgtcggacacgatcgacaatgtcaaggccaagatccaggacaaggagggcatcccgccggaccaacagcgcctgatctttgctggcaagcagctcgaggacggccgcacgctctccgactacaacatccagaaggagtcgacgctgcacctggtcctccgcctgcgcggcggtgccaagaagaagaagaagaagacgtacaccaccccgaagaagatcccgcacaagcgcaagaaggtcaagctcgccgtgctcaagtactacaaggtcgacggcggcaaggtcacccgccttcgccgcgagtgcccgaacgagagctgcggcgccggcgtcttcctggccaaccacaaggaccgccagtactgcggccgctgccgcctgacgtacgtcaacaagcaggccgccgagtaaccgcgcgagctgcgtgaacgcgctcgccgtgctccgtctgcaacttccaggtctggcccgccatgtccttgtccttgtacatcgtggccacctcacaaa

SEQ ID NO: 2586 - DNA, 595 bp, Theobroma cacao
  misc_feature (146)..(146): n is a, c, g, or t
  misc_feature (207)..(207): n is a, c, g, or t
  misc_feature (307)..(308): n is a, c, g, or t
  misc_feature (329)..(329): n is a, c, g, or t
  misc_feature (338)..(338): n is a, c, g, or t
  misc_feature (354)..(354): n is a, c, g, or t
  misc_feature (357)..(357): n is a, c, g, or t
  misc_feature (411)..(412): n is a, c, g, or t
  misc_feature (418)..(418): n is a, c, g, or t
  misc_feature (462)..(462): n is a, c, g, or t
  misc_feature (481)..(481): n is a, c, g, or t
  misc_feature (530)..(530): n is a, c, g, or t
  misc_feature (554)..(554): n is a, c, g, or t
  misc_feature (564)..(564): n is a, c, g, or t
  misc_feature (594)..(594): n is a, c, g, or t
ggcacgagccctcctctactttctctgcatcttcagccaacgcaaagatgcatgatcttcgtcaaaaccctaacggggaagaccataaccctagaggtcgaatcctctgacaccatcgacaatgtcaaagccaagatccaggacanggaaggaatcccaccggatcagcaacgtctcatcttcgccggcaagcagctcgaagacggncgcaccttagccgactacaatattcagaaggaatccacccttcacctcgtcctccgtctcaggggtggcgccaagaagaggaagaagaagacctacaccnngcccaagaaaatcaagcacangaagaaganggtcaagctcgcggtnctncagttttacaaggtggatgaaatccgggaaggttcaaaggttgaggaaaagagnnccctantgcggagtgtggggcccgggaacgttcattggctaaccattttnaataggccctttttgcggngaagtggggggcttactttaccgtttaccaaaaaaggccggtggggganttgaagtaagggttcgacttctgnttcggctcgnggttaaaaaatgggatctatagtttttaang

SEQ ID NO: 2587 - DNA, 462 bp, Tamarix hispida
  misc_feature (28)..(28): n is a, c, g, or t
  misc_feature (38)..(38): n is a, c, g, or t
  misc_feature (53)..(53): n is a, c, g, or t
  misc_feature (59)..(59): n is a, c, g, or t
  misc_feature (132)..(132): n is a, c, g, or t
  misc_feature (150)..(150): n is a, c, g, or t
  misc_feature (189)..(189): n is a, c, g, or t
  misc_feature (204)..(204): n is a, c, g, or t
  misc_feature (272)..(272): n is a, c, g, or t
  misc_feature (339)..(339): n is a, c, g, or t
  misc_feature (382)..(382): n is a, c, g, or t
  misc_feature (388)..(388): n is a, c, g, or t
  misc_feature (394)..(394): n is a, c, g, or t
ggaaacaggtgaggttggagaagctcangagagataanatgcagatctttgtnaaaacncttacgggtaagacgataaccctagaggttgagtcttcggacaccatcgaaaatgtcaaggccaagatccaanataaagaaggaatcccancagaccaacagcgtcttatcttcgccggaaaacagctanaggacggccgtacantcgctgattacaacatccaaaaggaatcaacccttcatcttgtgctccgtctccgtggtggtgctaanaagagaaagaagaagacatacacgaagcctaagaagatcaagcataagcataagaaggtgaagcttnctgtattgcagttttacaaagtggatgattctggtaaacttcnaagatngagganagagtgccctaatagtgagtgcggtgctggaacttttatggcgaatcattttgatcgtcattactgtg

SEQ ID NO: 2588 - DNA, 728 bp, Pinus taeda
ggggatcgttgctgaggaagacaatcacttgtctaggccgccatcatgcagattttcgtaaagaccctcacgggcaagacgatcaccctcgaggttgaatcgtccgacaccatcgacaacgtaaagtcgaagatccaggacaaggagggcattcccccggaccaacagcgtctcatcttcgccggcaagcagctcgaggacgggcgcaccctctccgactacaacatccagaaggagtcgacgcttcatctcgtgttgcgtctacgtggtggcggtaagaagcgcaagaagaaggtgtacactacgcccaagaagatcaagcacaagaggaagaagacgaagctagcggtcctcaagtactacaaggtcgatggcgatggaaaagtcgagcgtctgcgccgcgagtgccccaccccggagtgcggtgcttcgaccttcatggcttcccacaccgaccgccagtactgcggcaagtgccacctgacctacgtcttcgaccagtccaagtagaggagtgttggatggggatggggaggtgcccgatggggatgcgatgtagcacaggacaagcggaatctacattgtgtgctcggttgacttgctaaagggccaagaggtgaaatgtgccatgttgcgagagcgtcaaattccgaaccgtctgactgcttgatgatatatcgccatgtcgtctctccacacagcacacagagaccaagtcatacacccat

SEQ ID NO: 2589 - DNA, 633 bp, Triticum aestivum
ggtgaggaaagcatctcgaagagaggctcagcgttcaagatgcagatcttcgtcaagaccctcacgggcaagaccatcactctcgaggtcgagagctctgataccattgacaatgtcaagtccaagatccaggacaaggagggcattcccccggaccagcagcgtctgatcttcgccggaaagcagctcgaggatggccgcactctttcggactacaacatccagaaggagtccaccctccacttggtcctccgcctccgtggtggagccaagaagcgcaagaagaaggtgtacaccactcccaagaagatcaagcacaagcgcaagaagaccaagctagcggtcctcaagtactacaaggtcgacggtgacggcaagatcgagcgcctccgccgcgagtgcccccaggccgagtgcggtgccggtgtcttcatggccgccatgcacaaccgccagtactgcggaaagtgccacctcacctacgtcttcgacgaggccaaataagcgcgtcgccaccggggaacgcgatacgatcgacaacgagttacggcatcatggcatatatcggaggagctggataggttccaccacaatgtcggacatctagaatcaatcaaactcgtcgtggacatc

SEQ ID NO: 2590 - DNA, 634 bp, Triticum aestivum
ggtgaggaaagcatctcgaagagaggctcagcgttcaagatgcagatcttcgtcaagaccctcacgggcaagaccatcactctcgaggtcgagagctctgataccattgacaatgtcaagtccaagatccaggacaaggagggcattcccccggaccagcagcgtctgatcttcgccggaaagcagctcgaggatggccgcactctttcggactacaacatccagaaggagtccaccctccacttggtcctccgcctccgtggtggagccaagaagcgcaagaagaaggtgtacaccactcccaagaagatcaagcacaagcgcaagaagaccaagctagcggtcctcaagtactacaaggtcgacggtgacggcaagatcgagcgcctccgccgcgagtgcccccaggccgagtgcggtgccggtgtcttcatggccgccatgcacaaccgccagtactgcggaaagtgccacctcacctacgtcttcgacgaggccaaataagcgcgtcgccaccggggaacgcgatacgatcgacaacgagttacggcatcatggcatatatcggaggagctggataggttccaccacaatgtcggacatctagaatcaatcaaactcgtcgtggacatca

SEQ ID NO: 2591 - DNA, 540 bp, Hordeum vulgare
cacgaggaacgccggcatgcagtattttcgtcaaaacccttacggggaagaccattaccctcgaggttgagccttctgacaccatcgaaaatgtcaaggctaagattcaggacaaagaaggaattcctcctgaccagcagaggttgatctttgctggaaagcagctggaggacggccgcacgctgtctgactacaacatccagaaggagtcaactctgcacttggtgctgagactgcgaggcggtgccaagaaaaggaagaagaagtcctacaccactcccaaaaagaacaagcacaagaggaagaaggtcaagctcgcagtgctcaaatactacaaggtggatgagaacgggaaaatccaccggctgagacgcgagtgtcccgctgatgagtgcggcgccggcgtgttcatggcgagccacttcgaccggcattactgtgggaaatgcaccctgacgtactgcttcaacaaacccgaggacaagtagacagggagggggcggagccaataaagatgaaaactttgacttaaaaaaaaaa

SEQ ID NO: 2592 - DNA, 502 bp, Cedrus atlantica
atcgaagatgcaaatcttcgttaagaccctcacgggtaagactatcaccctcgaggtggagtcgtcggacactattgacaatgtcaaggctaagattcaggacaaggagggaatcccgccggatcagcaacgattgatcttcgctggcaagcagctggaagacggccgctcgctgtcggactacaacatccagaaggagagcaccctgcacttggtgctgcgcctgcgtggtggtggcaagaagcgaaagaagaaggtctacaccaagccgaagaagatcgcgcacaagaagaagaaggtcaagctggctgtcctcaagtactacaaggtcgacgagaaccagaagatcacccgccttcgccgagagtgccctgagtgcggcgccggcacgttcatggccaaccacttcgaccgcctgtactgcggcaagtgtggcctgcgatacgtctacaagaaggacggcgaggctgccaaggagtaagcgacagcgatggtagcgacg

SEQ ID NO: 2593 - DNA, 482 bp, Sesamum indicum
atttaaccagctgtttcccatagcgatcaatctcattcctcttctcacaaaccctagtctttgcagcccctccgccgcgaagatgcagattttcgtgaagacccttacgggcaagagcataaccttggaggtagaatcctccgataccatcgacaacgttaaggccaagatccaggataaggaaggcatccccccggaccagcaacgtctcatcttcgccgggaaacagctcgaggatggccgcacgcttgcggactacaacatccagaaggagtccaccctccacctagtcctccgactccgtggaggcgcgaagaagcgcaagaagaagacctacaccaagccgaagaagatcaagcacaagaagaagaaggtgaagctcgctgttctccagttctacaaggtggatgattccggaaaggtgcacaggctgaggaaggagtgcccgaacgccgagtgcggtgctggtactctcatggcga

SEQ ID NO: 2594 - DNA, 531 bp, Phaseolus coccineus
gattgaattagactaggatgcaaatctttgtcaagactctcactggaaagaccatcaccctcgaggtggaaagctctgataccatcgaaaatgtcaagcaaaagatccaggataaggaaggaatccctcctgatcaacaaagacttatcttcgctggaaagcaattagaagacggaagaacccttgccgactacaacattcaaaaggaatctactttacacttggtcctcagacttagaggaggaggtaagaagagaaagaagaaggtctacaccaagccaaagaagaacgcccacaagaagaagaaggtcaagctcgctgttctcaaatactacaaggtcgacgaaaacggaaagatcactagattgagaagagaatgccctaacaaggaatgtggagctggtgttttcatggcctctcacttcgacagacaatactgcggaaagtgcggtttgacttacgtcttcaacaagcctggagaaacctccgacgagtaaagtcgttttccctgtctctaaataaaaaaaaatg

SEQ ID NO: 2595 - DNA, 513 bp, Mesostigma viride
gcacacacgttcttgaggagggacacgttcctaagcgaacccgtggcgtgcagtcatgcccatcttcgtgaatacccttacgggcaagactatcacccttgaggtggagtcatcggatactatcgacaatgtgaaggctaagattcaggacaaggagggaatcccccctgatcagcagcgtctcatcttcgctggcaagcagctggaggacggccgcacgcttgcggactacaacatccagaaggagtccacgctccacctggtgctctgcctgcgtggtggtgccaagaagaggaagaagaagacctacaccaaggccgagaagaacaagcataagaagaagaaggcgaagctcgccgtcctccagtactacaaggtggacgactccggcaaggtgcagcgcctgcgcaaggagtgccctaacccggactgcggtgcgggctgcttcatggccagccacaaggaccgccactactgcggcagcgccgcctgacctacctccaccaaaacggc

SEQ ID NO: 2596 - DNA, 637 bp, Picea glauca
gcacgaggaggattgctccttcttataaaaagtagcatagagcacccaaaacagcagtagaagggaggatgcagatattcgtcaaaaccctcacgggcaagaccattaccttagaggtagagtcttctgacaccattgacaatgtcaagtcgaagattcaagataaggaaggtattccccctgatcaacaacgtctgatctttgctggaaagcaactcgaagacggccgcacgctcagcgactataacatccaaaaagagagcacgctccatttggtcctgcgtcttcgtggcggtgccaaaaagagaaagaagaagacttacactacccccaagaagatcaagcacaagcgcaagccagttaaattggccattctcaaatactacagagtcgactctgatggcaaaatcaagagactgagaagagagtgccctaacgagacatgcggtgctggcgtcttcatggctgctcaccacaatcgtcaatactgtggcaaatgtggattgacctacatgctcagctaagcgggtccgcacaacgtgcagtcttctgtttcagcgagggttgtcgcaagctagtgttccgaaccgctccatatcggataccttgttttgcaattatacgatcacagacaggc

SEQ ID NO: 2597 - DNA, 698 bp, Triticum aestivum
cccgggattcggccattacggccgggggaagccaggtaaactatccactggaattcctaggacctctcttacgacagagtaggaaccagaaacgtcaagatgcagatcttcgtcaaaaccctcaccggtaagaccatcaccctcgaggtcgaatccgccgacacgatcgacaatgtcaagacaaagattcaagagaaggaaggcatccccccagaccaacagcgattgattttcgctggtaagcaactcgaagacggccgaaccttggccgactacaacatccaaaaggagtccacccttcacttggtcttgcgtcttcgtggtggtgccaagaagaggaaaaaaaaaacttacaccacccccaagaagatcaaacacaaacgtaagaaagtcaagatggcggtcttgaaatactacaaggtcgaaagcaacggtaccatcaagcgattacgacgagagtgcccagcccagacctgtggtgccggtgtcttcatggcgtggcactttgaccgacagtactgtggaaagtgcggacttacctacttgttcggtgacaagaacttggccaagcccacttaaacaaccatccatagtacaggctagtgtgacctacagcagtccctacgtttaagctttatgcacctcatgcttggtaatctagatcaactatgcccaactaccccgacattagacttgcg

SEQ ID NO: 2598 - DNA, 485 bp, Nicotiana tabacum
  misc_feature (50)..(50): n is a, c, g, or t
  misc_feature (52)..(52): n is a, c, g, or t
  misc_feature (88)..(88): n is a, c, g, or t
ccggggacaacctattccatttcgccatctaacagcgaagatgcagaatntntcgtgaaaaccctaacgggtaagacatcacccttgnaggtcgaatctccgacacaatcgacaacgtgaaggcaaagatccaggacaaggaaggcattccaccggaccagcagcggctcattttcgccggaaaacagctggaggatggccgaaccctagctgattacaacatccagaaggaatccactctccatttggtgctccgtctccgtggtggtgctaagaagaggaagaagaagacttacaccaagcccacaaagatcacgcatatgaagaaagaaggttaagcttgctgttttgcagttttaaaaggctggatgattctggaaaagtccagagggcttcgtaaggaatgccctaacgctgagtgtggtgctggtacttttcatggctaacccacttagaccgtcacaactgtggtcagtgtgacctca

SEQ ID NO: 2599 - DNA, 670 bp, Setaria italica
atgcagatctttgtgaagacattgactggcaagaccatcacccttgaggtggagtcgtctgacacaggacaaggagggcatcccgccggaccagcagcgcctcatcgcagctcgaggacggccgcacgctcgccgactacaacatccagaaggagtccacgctccacctggtgctaggggaggggccaagaagcgcaagaagaagacgtacaccaagcccaagaagatcaagcacaagcacactcgccgtgctgcagttttacaaggtggacgacgccaccggcaaggtcacccgcctccgcaaggaatgccccaacgccgactgcggcgcgggcaccttcatggccaaccacttcgaccgccactactgcggcaagtgcggcctcacctacgtctacaaccagaaggcgtaatcgcttcgcttgcatcgctttgcttagctttacccgcctacctatcatgaattgagctgttggttacctgaattgaatatcatttagatctgtctgaggttgaaacttaaatggagtagcagtatctatcttcttggaacgcctgttactgagctgatgtgatgcgagtttaattttggttccattttctatcttgcttgatgattatattacttggtcattttgctaccattcatgggtcgcttacagtatttttg

SEQ ID NO: 2600 - DNA, 569 bp, Humulus lupulus
gaggctcagcgttcaagatgcagatcttcgtcaagaccctcacgggcaagaccatcactctcgaggtcgagagctccgataccattgacaatgtcaagtccaagatccaggacaaggagggcattcccccggaccagcagcgtctgatcttcgccggaaagcagctcgaggatggccgcactctttcggactacaacatccagaaggagtccaccctccacttggtcctccgccttcgtggtggtatggccaagaagcgcaagaagaaggtgtacaccacccccaagaagatcaagcacaagcgcaagaagaccaagctagctgtcctcaagtactacaaggttgacggcgatggcaagatcgagcgtcttcgccgcgagtgcccccagcccgagtgcggtgctggtgtcttcatggccgccatgcacaaccgccagtactgcggaaagtgccacctgacctacgtcttcgacgaggccaaataagcgcatcgccactggggcacgcgacacgatcgataacgagttacggcatcaaggcatatatgggaggagctgaataggtttcac

SEQ ID NO: 2601 - DNA, 621 bp, Avena sativa
caccgctcaggaagacaaccatttgtctaggctgtaatgcagatttttgtaaagactcttaccgggaagactatcacccttgaggtggagtcttccgacacaatcgataatgtcaagaccaaaatccaggacaaagaaggaatccctcctgatcaacagcgcttgattttcgcaggaaagcaactagaagatggacggacactcgctgattacaacattcaaaaagaatctaccttacatcttgttctacgtctccgaggtggggcaaagaagcgtaagaagaaggtttacacaacccccaagaaaatcaagcacaagcgaaagaagacaaagttagctgtgcttaaatactacaaagtggacggcgatggaaagattgaacgtcttcgcagggagtgcccatcagcagattgtggtgccggtgttttcatggctgctatgcaggaccgtcaatattgcggacgatgccatctaacttacatatttgacgatgccgctaaataggtaaatttcagattacaaaccttaaaaacaatagagttgttggtgaatggctattacagatataaaaagtatttgcagatttacagatagttgactaccaatttaaactacctagcc

SEQ ID NO: 2602 - DNA, 582 bp, Saccharum officinarum
cgttcgacggtagtattcgagccaacatgcagattttcgtcaagaccctcacgggcaagactatcacccttgaggtggagtcgtccgacaccatcgacaacgtcaaggccaagatccaggacaaggagggtattcccccggaccagcagcgcctgatcttcgccggcaagcagctcgaggatggccgaaccctctcggactacaacatccagaaggagtccaccctccacctcgttctccgtctgcgaggtggtatggccaagaagcgcaaaaagaagaactacaccacgcccaagaagatcaagcacaagaggaaaaaggtcaagatggccatcctcaagtactacaaggtcggatccgacggcaagatccagcgtctgcgccgagagtgccccgcgcccacctgcggcgccggcgtcttcatggcctggcacaaggacaggcagtcgtgcggcaagtgcggtctcacctacaccttcgagcccggaaccaagcccaccgcggcctaagctcttcggccaccccctctctgagctaggatgcatgtagatcgcgcggatcgaacgatcttcgtgtaatata

SEQ ID NO: 2603 - DNA, 677 bp, Hordeum vulgare
cgacccacgcgtccgcacatctgtcgaggccttccatcaagatgcagatattcgtcaagacccttacgggtaagactatcacccttgaggtggagtcctccgataccattgacaatgtcaagtccaagatccaggacaaggagggtatcccccctgaccagcagcgcctgatcttcgccggcaagcagctcgaggatggccgcactctctcggattacaacatccagaaggagtcgacccttcacctcgtcctccgcctgcgtggtggtggtaagaagcgcaagaagaaggtctacaccacccccaagaagatcaagcacaagcacaagaagaccaagctcgccatcctcaagtactacaaggttgacggtgatggaaagattgagcgtcttcgccgcgagtgccccgctcccgagtgtggtgccggtgtcttcatggccgctatgcacaaccgccagtactgcggtaagtgccacctcacctacgtcttcgacgaggccaaataaatggtctaagtcgagccgtggtgggctgtcaccgagcttcggcatggtttctgctaggccaaggcaagtgatggagtgtcacggttgacattggttgatgatggtttcttggtatacccatgtgctacagtcaatacaaagaataaaaactaggcatccgccgaaaaaaaa

SEQ ID NO: 2604 - DNA, 639 bp, Gossypium hirsutum
ccacgcgtccgtctgaggattgcttatgaaggcaatagtttttattgtcgaggcaagatgcagattttcgtcaagaccctcacggggaagacgatcacccttgaggtggagtcttccgacaccatcgacaacgtcaagtccaagatccaggacaaggagggcatcccccctgaccagcagcgactcatctttgctggcaagcagctcgaggatggacgcaccctgagcgactacaacatccagaaggagtccaccctccacctggtcctccgcctccgtggtggtatggccaagaagcgcaagaagaaggtctacaccacccccaagaagatcaagcacaagcgcaagaagaccaagctggctgtcctcaagtactacaaggtcgactccgatggtaagatcgagcgacttcgacgcgagtgccccagcgacacctgcggcgctggtgtcttcatggctgccatgcaggaccgccagtactgtggtcgctgccacctcacctacgtcttcgacaagcaataaatgcatgaccaagggacttgaattgggattgatgacggatcggattgggtgccaaaaatgggcgttgacgggcttttgtagcataaagcacatccggttttgagataatgcatgctt

SEQ ID NO: 2605 - DNA, 647 bp, Artemisia annua
cttttgtcgacgactccatcgtttagttcgttggagagacagaggcatccgtcagcaagatgcagattttcgttaagaccctcacgggcaagaccatcacccttgaggtggagtcttcggacaccatcgacaatgtgaaggccaaaattcaagacaaggagggtatccccccggaccagcagcgcctgatcttcgctggaaagcagctcgaggatggccgcaccctcagtgattacaacatccagaaggagtcgaccctccacttggtgctccgcctgcgtggtggtgccaagaagcgcaagaaaaagacctacaacacccccaagaagattaagcacaagcgcaagaaggtcaagatgtccatcttgaagtactacaaggtggagtccgacggcaagatcaagcgtctccgtcgcgagtgcccgtccgctgagtgcggtgctggtatcttcatggccttccaccaggatcgtcagtactgcggcaagtgcggcttgacctacacgttccagcccggttcgaagccccctgtggtctaagttgtgtgtcttgtcggtgctccggcgctatgttgcgctcgtgtactttgctgttgtccattacatgagtaatgtatgtaaactgcgtataacacaaaaaaaaaaaaa

SEQ ID NO: 2606 - DNA, 1114 bp, Hordeum vulgare
cgggaattcggccattacggccggggaaccattcgcaccatctgaggattgcttaggaaggcaataagctttattgtcgaggcatcatgcagattttcgtcaagaccctcacggggaagacgatcacccttgaggtggagtcttccgacaccattgacaacgtcaagtccaagatccaggacaaggagggtatccccccggaccagcagcgacttatctttgctggtaagcagctcgaggatggccgcaccctgagcgactacaacatccagaaggagtccacccttcacttggtcctccgccttcgtggtggtatggccaagaagcgcaagaagaaggtctacaccacccccaagaagatcaagcacaagcgcaagaagaccaagctggctgtcctcaagtactacaaggtcgactctgatggcaagatcgagcgacttcgacgcgagtgccccagcgacacttgcggcgctggtgtcttcatggctgccatgcaggaccgccagtactgcggtcgctgccacctgacctacgtcttcgacaagcaataaatgcattcaacacgggattgggaatgatgacggaacggatagggtgccaaaaattggcgcttaaaaggctgtaaccccaaaaccattcgggttctaaaaaatggcgttcagcctaagaagacaaaaaggtggttcccaaaaaaaaaaaaaaaaaaaaaccccagggggggcccgggtcccaaattccgcctatagagaagcggattaaaatttaatgggccatgttttcaaaatgaatgacttgcaaaacatctgggggccccaaactgatgccgcaacgaaacattgtgcttgtcaacaagtgggggagaaaacaatgaaggcggcccatatcccgttaccaacgtcacgttcgcgagaaacaatcttatagcggtataaaactatgtcgcgcatgaatgccctggtatgggagaatctagtgataagctggtattataagactggaatggattgtagaagggggagcgacaatactagtgggcagacataagatcaatgtgggtcagaaaactagatgtggcgcgggaaaattataagtgcggagcggaaacattacgtcg

SEQ ID NO: 2607 - DNA, 1084 bp, Hordeum vulgare
attcgcaccatctgaggattgcttaggaaggcaataagctttattgtcgaggcatcatgcagattttcgtcaagaccctcacggggaagacgatcacccttgaggtggagtcttccgacaccattgacaacgtcaagtccaagatccaggacaaggagggtatccccccggaccagcagcgacttatctttgctggtaagcagctcgaggatggccgcaccctgagcgactacaacatccagaaggagtccacccttcacttggtcctccgccttcgtggtggtatggccaagaagcgcaagaagaaggtctacaccacccccaagaagatcaagcacaagcgcaagaagaccaagctggctgtcctcaagtactacaaggtcgactctgatggcaagatcgagcgacttcgacgcgagtgccccagcgacacttgcggcgctggtgtcttcatggctgccatgcaggaccgccagtactgcggtcgctgccacctgacctacgtcttcgacaagcaataaatgcattcaacacgggattgggaatgatgacggaacggatagggtgccaaaaattggcgcttaaaaggctgtaaccccaaaaccattcgggttctaaaaaatggcgttcagcctaagaagacaaaaaggtggttcccaaaaaaaaaaaaaaaaaaaaaccccagggggggcccgggtcccaaattccgcctatagagaagcggattaaaatttaatgggccatgttttcaaaatgaatgacttgcaaaacatctgggggccccaaactgatgccgcaacgaaacattgtgcttgtcaacaagtgggggagaaaacaatgaaggcggcccatatcccgttaccaacgtcacgttcgcgagaaacaatcttatagcggtataaaactatgtcgcgcatgaatgccctggtatgggagaatctagtgataagctggtattataagactggaatggattgtagaagggggagcgacaatactagtgggcagacataagatcaatgtgggtcagaaaactagatgtggcgcgggaaaattataagtgcggagcggaaacattacgtcg

SEQ ID NO: 2608 - DNA, 642 bp, Medicago truncatula
gcaccaggcaagatgcagattttcgtcaagaccctcacagggaagacgatcacccttgaggtggagtcttccgacaccattgacaacgtcaagtccaagatccaggacaaggagggcatcccccctgaccagcagcgcctgatctttgctggcaagcagctcgaggatggccgcaccctgagcgactacaacatccagaaggagtccaccctccacctggtcctccgcctccgtggtggtatggccaagaagcgcaagaagaaggtctacaccacccccaagaagatcaagcacaagcgcaagaagaccaagctggctgtcctcaagtactacaaggtcgactctgacggcaagatcgagcgacttcgacgcgagtgccccgccgacacctgcggcgctggtgtcttcatggctgccatgcaggaccgccagtactgtggtcgctgccacctcacctacgtcttcgacaagcaataaatgcatgaccaagggacttgaattgggaattgatgacggatcggattgggtgccaaaaatgggcgttgacgggcttttgtagcataaagcacatccggtttctgagataatgcatgcttgattgagacgacaaacttgttaaatcacacaacctgttctccccaa

SEQ ID NO: 2609 - DNA, 620 bp, Picea glauca
gattgaggaagacagtcttgtctagattgcacaatgcagatcttcgtcaagaccctcacgggcaagactatcacccttgaggtggagtcgtcggataccatcgacaatgtcaagtccaagatccaggacaaggaaggcatccctcccgaccaacagcgcctgatcttcgccggcaagcagctcgaggacggccgcaccctctccgactacaacatccagaaggagtcgactctgcacctggtgctgcgtctgcgtggtggtggcaagaagcgcaagaagaaggtctacaccacccccaagaagatcaagcataagcgcaagaagaccaagttggccgtcctcaagtactacaaggtggacggtgacggcaagattgagcgtctccgccgcgagtgccccaccgcggagtgcggtgccggtgtcttcatggccgccatgcacaaccgccagtactgcggaaagtgccatctcacctatgtctttgacgagtccaagtagacgagtcgtggatgggtcgatgaaggaatgctggagtgatgtggcaatgatgggactttaaatgtgacgggaccgattctcgaaagtgcctcgcacagacaataagacccataccggcaaca

SEQ ID NO: 2610 - DNA, 659 bp, Saccharum officinarum
atctgaggattgcttaggaaggcaatagttcttattgtcgaggcaagatgcagattttcgtcaagaccctcacagggaagacgatcacccttgaggtggagtcttccgacaccatcgacaacgtcaagtccaagatccaggacaaggagggcatcccccctgaccagcagcgactcatctttgctggcaagcagctcgaggatggccgcaccctgagcgactacaacatccagaaggagtccaccctccacctggtcctccgcctccgtggtggtatggccaagaagcgcaagaagaaggtctacaccacccccaagaagatcaagcacaagcgcaagaagaccaagctggctgtcctcaagtactacaaggtcgactctgacggcaagatcgagcgacttcgacgcgagtgccctgccgacacctgcggcgctggtgtcttcatggctgccatgcaggaccgccagtactgtggtcgctgccaccttacctacgtcttcgacaagcaataaatgcatgaccaagggacttgaattgggaattgatgacggatcggattgggtgccaaaaatgggcgttgacgggcttttgtagcatatagcacatccggtttctgagataatgcatgcttgattgaaacgacaaacttgttaaatcac

SEQ ID NO: 2611 - DNA, 502 bp, Abies balsamea
ccatcgacaatgtgaaagccaagatccaggacaaagaaggcatcccaccagaccaacaacgtttgatcttcgcaggaaagcagctagaagacggccgtaccttagcagactacaacatccaaaaagagtccactctttcattttggtgttgcgtctacgtggaggtgctaagaagcgtaagaagaagacgtacacaaagcccaagaagattaagcataagcataagaaagtgaagcttgctgtgttgcagttttacaaagtgggtgatgatgggaaggtgaataggttgagaaaagagtgtcctaatgctgaatgtggggctgggactttcatggctaatcatgaggataggcattattgtggcaagtgtggtttgacttatctctaccagaaggcttaagctctataaagcttaaatctgagaggaagagagtgaagagttttgctgagtttgattacttttcattggaatctattttgatcgcattaaatatttagatat

SEQ ID NO: 2612 - DNA, 652 bp, Parthenium argentatum
cgaatcttcgttagagagacttatagccatgcagatcttcgtaaagaccctaacgggcaagaccatcaccctcgaggttgagtcgtccgacaccatcgacaatgtcaagtccaagatccaggacaaggaaggaatcccccccgaccagcagcgattgatctttgccggaaagcagctcgaggacggaaggacactctcggactacaacatccagaaggagtctaccctccacctggtgctcaggctgcgaggaggtgcaaagaagagaaagaagaagacgtacaccacccccaagaagatcaagcacgtccgcaagaagaacaagatggcaatcttgaagtactacaaggtcgacagcgacggaaagatcaagaggttgcgccgagagtgccctcaggagacctgcggagccggtgtcttcatggcgtggcacagcgacaggcagtactgcggaaagtgcggtctcacctacaagtttgaggccggcactcagcccccgaaggcctagacggtgcctcttctccctcttggggcaagagatggaaggaatgggttgtagacgctggaccgttgtagctcgatctggacgatccgggtgggcagacctgcatgggcgcagaacaacgaacggcaatgcaatgcagtctcctct

SEQ ID NO: 2613 - DNA, 492 bp, Silene vulgaris
agacgcgaggcatccggcgttgcgctgcactcctaagatgcaaatcttcgtcaagacattgacggggaagaccatcacccttgacgttgagtcaggtgataccatcgagaatgtcaaggctaagatccaagacaaggagggaattcccccggaccagcagcgcttgatcttcgcaggcaagcagctggaggacggccgcaccctctccgattacaacatccagaaggagagcacccttcacttggtgcttcgacttcgcggtggtggcaagaagcgcaagaagaaggtctacaccaagcctaagaagatcgcacacaagcacaagaaggtcaagctggccgtgcttaagttctacaaggttgagggcgacaagatcactcgcctgcgcactgagtgcccccacccgacttgcggtgccggcgttttcatggccaaccacaaggaccgccagtactgcggcaagtgccatttgacctacttcttgggtcaggc

SEQ ID NO: 2614 - DNA, 647 bp, Phaseolus coccineus
  misc_feature (138)..(138): n is a, c, g, or t
  misc_feature (421)..(421): n is a, c, g, or t
aaccggtattcctaggacctctctcctttccaagacagagcaggaaaccagatcgcacaggaaggatgcaaattttcgtaaagaccctcacgggcaagactatcacccttgacgtcgaatccgctgacacaatcgatnatgttaaggcaaaaattcaagataaagaaggcatccctccagaccaacaacgattgattttcgccggaaaacagcttgaggacggtcgtactttggctgattacaacattcaaaaggagtctactcttcacttggtgttacgtcttcgcggtggagctaagaagcgtaagaaaaaaacttacaccacacccaagaagatcaagcataaacggaagaaagtcaaaatggcagtcttgaagtactataaggttgaaagtaacggctccatcaaacgtttgcgacnagagtgtccggcaccatcgtgcggggctggtgtcttcatggcatggcacgaggatcgacagtactgtggaaagtgtgggcttacttacctattcggcgataagaaattacctaaacccacctagacccttagggttaaaacatgtattgcacgtctagaaattgatccccatcttccaaatatgttttaatgcaacaaatatggattcctgccatttttctctcct

SEQ ID NO: 2615 - DNA, 744 bp, Theobroma cacao
  misc_feature (72)..(72): n is a, c, g, or t
  misc_feature (513)..(513): n is a, c, g, or t
cggggatttcttttcgaaatttatccaaaccacatctgaagatttgctgaggaaggcaattccaattgtctnggtcaagatgcagattttcgtcaagacccttacgggtaagacgattaccctcgaggttgagtcctcggacactatcgacaatgtcaagtccaagattcaggacaaggagggcattcccccggaccagcagcgcctgatcttcgctggcaagcagctggaggatggccgcaccctgtctgactacaacattcagaaggagtctactctccacctggtgctgcgtctccgtggtggtggtaagaagcgcaagaagaaggtttacaccacccccaagaagatcaagcacaagcgcaagaagaccaagctggctgtgctcaagtactacaaggttgattccgatggcaagattgagcgccttcgccgcgagtgcccctccgacagctgcggtgccggtgttttcatggctgccatgcaggatcgccagtactgcggccgttgccncctgacttacgtcttcgagaagaactaagtatcttccaagaataaaaagtaaaaatttcacagaatttgggaaaggatgacttcatgggaatgactgccttggttcggcgtttagtgtttgaatttaaataatgacgacacttcgtcagagcctttaatgacctggcttatgtgtgtgtgtgaacatgtactataatttccctaatgtagctgctgacagctggggatatc

SEQ ID NO: 2616 - DNA, 607 bp, Arachis hypogaea
ggggaacttgtcgaggccttcgtcaagatgcagatcttcgtcaagacccttacgggcaagactatcacccttgaggtggagtcgtccgacaccattgacaatgtcaagtccaagatccaggacaaggagggtatcccccccgaccagcagcgtttgatcttcgccggaaagcagctcgaagacggccgcaccctctccgactacaacatccagaaggagtccactcttcacttggtcctccgcctccgtggtggtggtaagaagcgcaagaagaaggtctacacacccccaagaagatcaagcacaagcgcaagaagaccaagctcgctgtgctcaagtactacaaggttgatggcgatggcaagatcgagcgtctccgccgtgaatgcccttccgccgagtgtggtgccggtgtcttcatggccgccatgcacaaccgtcagtactgcggaaagtgccaccttacctacatcttcgatgaatccaaataagcgtctcgttacgatttcgatgtgaaggagtgatgaaaatgaaaatttggactatgtcatttgcccttgtggcttagataagattatgtagaaaaaaggaccggttcattctggcg

SEQ ID NO: 2617 - DNA, 743 bp, Hordeum vulgare
cgccgccgccgcaacaggtcgtaaatctcgggggattgcggcgaccggcgaactgcggcacgatgcagatcttcgtgaagacgctgacggggaagacgatcacgctggaggtggagtcgtcggacacgatcgacaacgtcaaggccaagatccaggacaaggaggggatcccgccggaccagcagcggctcatcttcgccgggaagcagctggaggacgggcgcacgctggccgactacaacatccagaaggagtcgacgctgcacctggtgctccgcctccgcggcggcgccaagaagcgcaagaagaagacctactccacgcccaagaaggtcaagcacgagcgcgagaagaccccgctcgccgtgctgggatactacagggtggacgacgccacgggcaaggtggagaggctgcgcaaggagtgccccaaccccgactgcggcgccgggaccttcatggcggcgcacgccgaccgccacgcatgcggcaagtgcggcctcacctacgcctacgccgaggcgcagggcccagagatcgacagtgattgattgggtgtgtgattcagtgacggagttggattagcgccatggattccgtgtagtacgtctggtaatgaatttttcagtggatatttgtggttagaacaattattttggtctgatgaaattgaaatgtgctttggtatgcatcgtgatagcaaccctataataatagggtgttcggaattaacacacaaatac

SEQ ID NO: 2618 - DNA, 713 bp, Triticum aestivum
ctcgaatcccaatccacgccgccgcgccgccgacgcaacaggtcataaatctcggcgaccggcgaacgagggcgagatgcagatctttgtgaagacgctgacggggaagacgatcacgctggaggtggagtcgtcggacacgatcgacaacgtcaaggccaagatccaggacaaggaggggatcccgccggaccagcagcggctcatcttcgccgggaagcagctggaggacgggcgcacgctggccgactacaacatccagaaggagtcgacgctgcacctggtcctccgcctccgcggcggcgccaagaagcgcaagaagaagacctactcgacgcccaagaaggtcaagcacgagcgcgagaagaccccgctcgccgtgctcggctactacagggtggacgacgcgacgggcaaggtggagaggctgcgcaaggagtgccccaacccggactgcggcgccgggaccttcatggcggcgcacgccgaccgccacgcctgcggcaagtgcggcctcacctacgcctacgccgaggcccagagcccagagatcgacagtgattgatcaggtggtgtgattcgatgacggagttggattagcgccatgaattcagtgtacgtctggtaatgattttttcaatggatatttgtggttagaacaattattctggatatttttctcaattagtcatcagtaagcatgttttggtctg

SEQ ID NO: 2619 - DNA, 526 bp, Pinus taeda
  misc_feature (520)..(520): n is a, c, g, or t
ggcggccttttccgtgagggcatggtgtggctgtaggacaactagagcaacaccatcatgcagatattcgtgaagactttaaccgggaagaccatcacccttgaggtcgaggcttccgacacaatcgaaaatgtcaaggctaagatccaggacaaagaaggaattccccctgaccagcagcgtttgatcttcgctggtaaacagctcgaggatggacgcactctgtctgactacaacatccagaaggagtcgacccttcacctggtgctccgtctccgtggtggagccaagaaacgcaagaagaagaattactccacccccaagaagatcaagcacaagaagaagaaggtcaagctcgctgtcctcaagttctacaaggtggacgagaacggcaagattcaccgtctgaggcgagagtgcccatccgaacagtgcggtgctggtgtcttcatggcagccatggaggacaggcactactgcggaaagtgcggctttacgctggtattcaacaagcccgaanacaagt

SEQ ID NO: 2620 - DNA, 529 bp, Quercus alba
ataatctgaccgtatagacacattgaatagttgtcaatcatgcagatcttcgttaagaccctcacgggcaagactatcactcttgaagtcgaaccttctgatactattgaaaatgtaaaagcgaagattcaagataaggagggaattccaccagaccaacagcgtttgatctttgctggtaagcaattggaagatggacgtacattgtccgattacaacatccaaaaggaatcgacccttcacttggtgctccgtcttcgtggtggtgccaagaaacgtaagaagaagaattactcaacaccaaaaaagatcaagcacaagagaaagaaggtcaagctcgctgtcttgaaatactacaaggtcgatgaaaacggcaaaatccaccgcttgcgtcgtgaatgcccaggagaaaactgcggtgctggagttttcatggctgcacatgaagaccgtcactactgcggaaaatgctcgctcacattcgtattctcaaagaacgaagagaaataaattacaatggataaattgt

SEQ ID NO: 2621 - DNA, 521 bp, Quercus alba
cgccatgcagatctttgtgaaaactctaaccggaaagaccatcacactcgaggtcgagtcttcggacacgatcgagaatgttaaggctaaaatccaagataaagaaggaatcccacccgatcagcaacgattgatctttgccggtaaacagctcgaagatggcaggacactgtccgactaccacattcagaaagagtccaccctgcatctggtgctccgtctcaggggaggagccaagaaacgcaagaagaagaattactcgaccccaaagaaaatcaaacacaagaagaagaaggtcaaactcgcagttcttaaattctacaaggtggacgagaatggaaaaatccatcgattgaggcgggagtgtccgtcggaacagtgtggcgctggagtcttcatggcagccatggaagatcgccattactgtggaaagtgcgggtacactcttgtattcaataagccggaggaaaagtaaatttatatcaccgtttttttgtatttcgctactttttctgaataaa

SEQ ID NO: 2622 - DNA, 972 bp, Hordeum vulgare
ctgtcatgcagatttttgtaaagactctcaccgggaagactatcacccttgaggtggagtcttccgataccattgataacgtcaagaccaaaatccaagacaaagaaggaataccccctgaccaacaacgtttgatcttcgcaggaaagcagcttgaagatggacgaacactcgcagactacaatattcaaaaagagtctaccttacatcttgttctacgtcttcgaggtggagcaaagaagcgcaagaagaaggtttacacaactcctaagaaaatcaagcacaagcgaaagaagacaaagttagctgtgctcaagtattacaaagtggatggcgacggaaaaattgagcgtcttcgcagagagtgtccatcaacagactgcggtgccggtgttttcatggctgctatgcaggaccgtcaatactgtggacgatgccatctaacttacatatttgacgatgctgccaaataagtaaacttcagatcaaggcaagaaactgaacatccgggaacttcagaattgtctggaaatcgtaaagatgggtgtaaaaagtatttgcagattatcagatagttggctaccgatgtaatcttttgggtgtttttagcttctcccctaaatttccacaaccatttcgcacgcatgtacgaacatactttgacgcactataacttcgcggtaaattctctcacagttatgccacaattaaatggttaaattttttagtggggtttaggatggagaaataatggccaattctaactgcagcgcaattctcagaacctcccggccttcacatgtgacttgacagtaccctagtattggggaactatctcagcacctgacagctttgttccttgctaaccactagttctgaccgtcgactttgcggtgttaagattgattatgtcaatcaaataggctcagtcaggatgtagaaaagataagcttttgtgttgttccctcgggc

SEQ ID NO: 2623 - DNA, 789 bp, Triticum aestivum
aggaagacaaccatttgtctaggctgtcatgcagatttttgtaaagactctcaccgggaagactatcacccttgaggtggagtcttccgataccattgataacgtcaagaccaaaatccaagacaaagaaggaataccccctgaccaacaacgtttgatcttcgcaggaaagcagcttgaagatggacgaacactcgcagactacaatattcaaaaagagtctaccttacatcttgttctacgtcttcgaggtggagcaaagaagcgcaagaagaaggtttacacaactcctaagaaaatcaagcacaagcgaaagaagacaaagttagctgtgctcaagtattacaaagtggatggcgacggaaaaattgagcgtcttcgcagagagtgtccatcaacagactgcggtgccggtgttttcatggctgctatgcaggaccgtcaatactgtggacgatgccatctaacttacatatttgacgatgctgccaaataagtaaacttcagatcaaggcaagaaactgaacatccgggaacttcagaattgtctggaaatcgtaaagatgggtgtaaaaagtatttgcagattatcagatagttggctaccgatgtaatcttttgggtgtttttagcttctcccctaaatttccacaaccatttcgcacgcatgtacgaacatactttgacgcactataacttccggtaaattctccacagttatgccacaattaaatggttaaattttttagtggggtttaggatggagaaataatggccaattctaactgc

SEQ ID NO: 2624 - DNA, 811 bp, Triticum aestivum
ctcgtgccgaattcggcacgagggaagacaaccatttgtctaggctgtcatgcagatttttgtaaagactctcaccgggaagactatcacccttgaggtggagtcttccgataccattgataacgtcaagaccaaaatccaagacaaagaaggaataccccctgaccaacaacgtttgatcttcgcaggaaagcagcttgaagatggacgaacactcgcagactacaatattcaaaaagagtctaccttacatcttgttctacgtcttcgaggtggagcaaagaagcgcaagaagaaggtttacacaactcctaagaaaatcaagcacaagcgaaagaagacaaagttagctgtgctcaagtattacaaagtggatggcgacggaaaaattgagcgtcttcgcagagagtgtccatcaacagactgcggtgccggtgttttcatggctgctatgcaggaccgtcaatactgtggacgatgccatctaacttacatatttgacgatgctgccaaataagtaaacttcagatcaaggcaagaaactgaacatccgggaacttcagaattgtctggaaatcgtaaagatgggtgtaaaaagtatttgcagattatcagatagttggctaccgatgtaatcttttgggtgtttttagcttctcccctaaatttccacaaccatttcgcacgcatgtacgaacatactttgacgcactataacttccggtaaattctccacagttatgccacaattaaatggttaaattttttagtggggtttaggatggagaaataatggccaattctaactgca

SEQ ID NO: 2625 - DNA, 614 bp, Malus domestica
agacaacccgtttgtctaggccgccatgcagattttcgtaaagaccctcacgggcaagacgatcacccttgaggtggagtcttcggacaccatcgacaatgtgaagtccaagatccaggataaggagggcattcccccggaccagcagcgtctcatcttcgccggcaagcagctcgaggatggccgcaccctctccgactacaacatccagaaggagtccactctccacctggtgctccgtctccgtggtggtggcaagaagaggaagaagaaggtctacaccacccccaagaagatcaagcacaagcgcaagaagaccaagctcgctgtgctcaagtactacaaggttgacggcgatggcaagatcgagcgtcttcgccgcgagtgcccccagcccgagtgcggtgctggtgtcttcatggctgccatgcacaaccgccagtactgcggtcgctgccacttgacctacgtcttcgacgaggccaaataagcgcgtcgcccccacgatcgatacgagttacgacatcaaggcaatcatggaggactgaaaagacaccaccatatgtcgggcatatagaatcaatcaagatcaaagactcacaaaccaaaaaaaa

SEQ ID NO: 2626 - DNA, 526 bp, Malus domestica
caaggacgccaaagttggccagctacgatcttcaagaaccacaacagcactcaactcacgtacccacccccgttgatcggcaaccatgcagatcttcgtaaagaccctcacgggcaaaaccatcaccctcgaggttgagaatggtgacaccatcgacaatgtcaaggcaaagatccaggacaaggagggtatcccacccgaccaacagcgtctcatcttcgccggcaagcagctcgaggacggccgcactctttcggactacaacatccagaaggagtcgactctccacctcgtacttcgcctgcgtggtggtgccaagaagcgcaagaagaagacgtacactacgcccaagaagatcaagcacaagcgcaagaaggtcaagatgagcgttctgaagttctacaaggtagacgcttcaacgggtgccgtcaagcgtttgcgcaaggagtgccccgcccctacgtgcggtgcctccgttttcatgtcgtggcacaaggaccgcagctactgcggcaagtgccacctc

SEQ ID NO: 2627 - DNA, 576 bp, Artemisia annua
ttactccgacggggatctgcaactgaaagcccaaggacggcaggttgcctaggaacatgcagatcttcgtcaagaccctcacgggtaagactatcacccttgaggtggagtcttccgacaccatcgacaatgtcaagtccaagatccaggacaaggagggaattcccccagaccaacagcgtctgatcttcgccggcaagcagctcgaggacggccgcactctttcggactacaacatccagaaggagtcgacccttcacctcgtgctccgcctgcgtggtggtggcaagaagcgcaaaaagaaggtctacaccacccccaagaagatcaagcacaagcgcaaaaagaccaaactcgccgtcctcaagtactacaaggttgacggtgacggcaagatcgagcgtcttcgccgtgagtgccctcagcccgagtgcggtgctggtgtcttcatggccgccatgcacaaccgccagtactgcggccgctgccacctgacctatgtctttgacgaggccaaataagcatctcgcctgctgaaaagattgttacgacatagaggcaattatgacacgcgag

SEQ ID NO: 2628 - DNA, 571 bp, Brassica rapa
aagacaacttgtcgaggccttcatcaagatgcagatcttcgtcaagaccctcacgggtaagactatcacccttgaggtggagtcatccgacactatcgacaatgtcaagtccaagatccaggacaaggagggtattcccccagaccagcagcgtctgatcttcgctggcaagcagctcgaggacggccgtactctttcggactacaacatccagaaggagtctaccctgcacctcgtgctccgcctgcgtggtggtggtaagaagcgcaagaagaaggtctacaccacccccaagaagatcaagcacaagcacaagaagaccaagctcgccatcctcaagtactacaaggtcgacggtgatggcaagatcgagcgtctgcgccgcgagtgccccgcccccgagtgcggtgccggtgtcttcatggctgccatgcacaaccgtcagtactgcggcaagtgccacctcacctacgtcttcgacgagtccaagtaaatggactctgtctaatcaagaggtttctttggtctgatttgggggcatatgggttcacttgtctttgatatgagttac

SEQ ID NO: 2629 - DNA, 590 bp, Picea glauca
gtctaggccgccatgcagattttcgtcaagaccctcacgggtaagaccatcacccttgaggtggagtcttcggacaccatcgacaatgtgaagtccaagatccaggacaaggagggtattcccccggaccagcagcgtctcatcttcgccggcaagcagctcgaggatggccgcaccctctccgactacaacatccagaaggagtcgaccctccacctggtgctccgcctgcgtggtggtggcaagaagaggaagaagaaggtctacaccacccccaagaagatcaagcacaagcgcaagaagaccaagctcgctgtgctcaagtactacaaggttgacggcgacggcaagatcgagcgtcttcgccgcgagtgcccccagcccgagtgcggtgctggtgtcttcatggccgccatgcacaaccgccagtactgcggtcgctgccacctgacctacgtcttcgacgaggccaaataagcgcgtcgcacccacgatcgatacgagttacgacatcagggcaatcatggagggctgaaaagacaccaccatatgtcgggcatatagaatcaatcaaggatcaagacttcaca

SEQ ID NO: 2630 - DNA, 593 bp, Picea glauca
ggctttgtctaggctgccatcatgcagattttcgtaaaaaccctcacgggcaagaccatcacccttgaggtggagtcttccgacaccattgataatgtcaagtccaagatccaggacaaggagggcatcccacctgaccagcagcgtctgatcttcgccggcaagcagctcgaggacggccgcaccctttcggactacaacatccagaaggagtcgacccttcacttggtgctgcgcctgcgtggtggcgccaagaagcgcaagaagaaggtgtacaccacccccaagaagatcaagcacaagaggaagaagaccaagttggctgtcctcaagtactacaaggtcgacggtgatggcaagattgagcgcctgcggagagagtgccccaacgacacttgcggcgccggtatcttcatggctgccatgcacaaccgccagtactgcggtcgctgccacctgacctacgtcttcgacgacccaaagtagagtgatggaggactcactggaaggaatcatcagcatttgtcaagatagccgcttgttgcggacctgagatacacctcgccatttgaacaactacttcacttgcctta

SEQ ID NO: 2631 - DNA, 578 bp, Picea glauca
gcacgaggcttcgtgaagaccctcacgggcaagactatcaccctcgaggtcgagtccagcgacacaatcgacaatgtcaaaagcaaaatacaagacaaagaaggcataccgcccgaccagcaaagattgatttttgcgggaaaacagcttgaagatggccgcacgctgagcgactacaacatccagaaagagtcgaccctgcacttggtgctgagactccgtggtggaatggccaagaagcgcaagaagaaggtgtacaccacgcccaagaagatcaagcacaagcgcaagaagaccaagttggcggtgctcaagtactacaaggtggacggtgatggcaagatcgagcgcctgagacgcgagtgcccgcagcctgagtgcggtgccggtgtcttcatggccgctatgcacgaccgccagtactgcggcaagtgccatctcacctatgtcttcgacaaatgagcgatcccagcaatcacatcgtgatggatgatcatggatcacgccatgtgtgaagcagagccaatcgaagaaggggatcgtgtagactcaagtcaatgaatcatgtctacaccttc

SEQ ID NO: 2632 - DNA, 625 bp, Pinus taeda
gcttaggaaggcaatagttcttattgtcgaggcaagatgcagattttcgtcaagaccctcacggggaagacgatcacccttgaggtggagtcttccgacaccatcgacaacgtcaagtccaagatccaggacaaggaggtatcccccccgaccagcagcgcctcatctttgctggcaagcagctcgaggatggccgcaccctgagcgactacaacatccagaaggagtccaccctccacctggtcctccgcctccgcggtggtatggccaagaagcgcaagaagaaggtctacaccacccccaagaagatcaagcacaagcgcaagaagaccaagctggctgtcctcaagtactacaaggtcgactctgacggcaagatcgagcgacttcgacgcgagtgccccgccgacacctgcggcgctggtgtcttcatggctgccatgcaggaccgccagtactgtggacgctgccacctcacctacgtcttcgacaagcaataaatgcatgaccaagggatttgaattgggattgatgacgtatcggattgggtgccaaaaacgggcgttgacgggcttttgtagcataaagcacatccggtttctgagataatgcacgcttgattgag

SEQ ID NO: 2633 - DNA, 720 bp, Brachypodium distachyon
ctcgaatcccaatccacgccgccgcgccgccgacgcaacaggtcataaatctcggcgaccagcggaacggattagccacgatgcagatcttcgtgaagacgctgacggggaagacgatcacgctggaggtggagtcatcggacacgatcgagaacgtgaaggccaaggtgcaggacaaggagggggtcccgccggagcagcagcggctcatcttcgccgggaagcagctggaggacgggcgcacgctggccgactacaacgtccagaaggagtccaccctccacctcgtcctccggctccgcggcggcgccaagaagcgcaagaagaagacgcacaccacgcccaagaaggccaagcacgagcgcacgaagaccgagctcgccgtgctggggctataccgggtggacgaggcgacgggggcggtggagcggctgcggaaggagtgccccaacccggagtgcggcgccgggaccttcatggcggcgcacgccgaccgcctcgcctgcggcaagtgcggcctcacctacgcctacgccgaggcccagagcccagagatcgacagtgattgattaggtggtgtgattcaatgacggagttggattagcgccatgaattccgagtagtacgtctggtaatgaatttttcaatggatatttgtggttataacaattattctggatatttttctcaattagtcatcagtaagcatgttttggtctg

SEQ ID NO: 2634 - DNA, 637 bp, Triticum aestivum
agcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaactctccgtgctgcattctataaggtggacgacgccactggcaaggtgacccgcctccgcaaggagtgcccaacacagatggcgcgccggcgtcttcatggcaacacttcgacgcaatactgcggaaatcggctcactatgctacaacagaagggtaatgctgcccgattgcttatcgcaactataacattaaatgttggtaccaaattgacccattaattgcccaggtgaactaatgccatcctacaacaatggaccccgtacggtaaatttctcaaaaaaaaaaaa

SEQ ID NO: 2635 - DNA, 385 bp, Quercus alba
agaccataaccctagaggttgagtcctcagacaccatcgacaatgtcaaggccaagatccaagacaaggaacagcgtttgattttcgcagggaaacagctcgaagatggccgaaccttagccgactacaacatccagaaggagtccactcttcaccttccgcggtggcaagaagaagacctacaccaaacccaagaagatcaagcacaagcacaagaaggtcaagctcgctatcctccagttctacaaggtcgacgactctgggaaagttcagaggctcaggaaagagtgccctaacgctgagtgtggtgctggaactttcatggctaaccatttcgataggcattactgtggcaagtgtgggcttacctatgtgtaccagaagg

SEQ ID NO: 2636 - DNA, 471 bp, Podocarpus macrophillus
cgagagaaagtcaccacgatgcagatcttcgtgaagaccctcacgggcaagactatcaccctcgaggtggagtcttccgacaccatcgacaacgtcaagtccaagatccaggacaaggagggtattccgccggaccagcagcgattgatcttcgccggcaagcagctcgaggatggccgcaccttgagcgactacaacatccagaaggagtccacgctccacctggtgttgcgtctgcgtggtggcgccaagaagaggaaaaagaaggtgtacaccaccccgaagaagatcaagcacaagcgcaagaagaccaaattggccgtgctcaagtactacaaggtcgacggcgatggcaagatcgagcgtctgcggagggagtgcccagccgagacctgcggtgccggtatcttcatggccgctatgcacaaccgccaatactgcggtcgctgccacctgacgtacgtctttgac

SEQ ID NO: 2637 - DNA, 758 bp, Theobroma cacao
atgaaaaccctcattcatctcccattttgaagccctagccgaaaccccctcctctactttctctgcatcttcagccaacgcaaagatgcagatcttcgtcaaaaccctaacggggaagaccataaccctagaggtcgaatcctctgacaccatcgacaatgtcaaagccaagatccaggacaaggaaggaatcccaccggatcagcaacgtctcatcttcgccggcaagcagctcgaagacggccgcaccttagccgactacaatattcagaaggaatccacccttcacctcgtcctccgtctcaggggtggcgccaagaagaggaagaagaagacctacaccaagcccaagaaaatcaagcacaagaagaagaaggtcaagctcgcggtcctccagttttacaaggtggatgaatccgggaaggttcagaggttgaggaaagagtgccctaatgcggagtgtggggcccggaacgttcatggctaaccattttgataggcactattgcggtaagtgtgggctcacttacgtttaccagaaggccggtggggattgagtagggttcgacttctgttcggctcgtgataaaaatggatctatagtttttaagtatgagttttaggatttttattttcaataatcgttggactttttatttttgtgttattttttattatgttacaatactttcgatatgattttggagttttggatcattaatttagctgtttgaaacaaattatgcggttttctacct

SEQ ID NO: 2638 - DNA, 689 bp, Citrus sinensis
gaagactttctccttcctgtcagttgagcgaaggtttctaactaacaatcatgcaaatcttcgtgaagacgctcacgggaaagactatcacccttgaggtggagccatctgattccattgataatgttaagcaaaagatccaagacaaggaaggaattcctccagatcagcaacgtttaatctttgctggtaaacagcttgaagacggcagaaccctttcagattacaacatccaaaaggagtctactcttcacttagtcttacgtctacgtggtggtgctaagaagagaaagaagaagacctacaccaagccaaagaaggcccatcacaagagaaagaaggtaaagttagctgtcttaaaattctaccaggtcgacaaggatggcaaggtaatccgtgccagaaaagattgcccacacgagacctgcggtgctggtgttcgcatggccttacacaagaacagacatcactgcggtaaatgctctttgacctacttcatcgagaagtaaacgagtccatcctgctaaagcaagacgaagataagcagctacagaaaagaaggaatgaaaggctttccagacaaagcaataaatcacttgtccctttaaagcggtcaagtagtaaatagcgaaaataatcgagccaatctcttattttacccccacactaagctaaccaaacaaaactac

SEQ ID NO: 2639 - DNA, 505 bp, Quercus alba
ctcgcgtgtcgaattcccgggattgagatcaagatgcagattttcgtcaagaccctcacgggcaagactatcaccctcgaggtggagtcttccgacaccattgacaatgtcaaaacaaagatccaagacaaggagggcattccgccagaccagcagcgcttgatcttcgccggcaagcagctcgaggacggccgtaccctctccgactacaatatccagaaggagtcgactctacatctcgtgcttcgtctccgcggtggtggtaagaaacgcaagaagaaggtctacaccacacccaaaaagatcaagcacaagaggaagaagaccaaactcgccgtgcttaagtactacaaagttgatggcgatggcaagatcgaacgcctgaggcgcgagtgcccacaggacacttgtggcgctggtgttttcatggccgccatgcacaatcgccagtactgcggcaagtgccatctcacctacgtcttcgaagagaaatagatgactttag

SEQ ID NO: 2640 - DNA, 707 bp, Picea glauca
acacgaaatccctcctgcgacaacttctagagatccccaagcacgcattctcgacaattcaaccaacatcaaagaagcatcttttgctgagctgtggttgatcgccgaagatgcagattttcgttaagaccctcacgggcaagaccatcacccttgaggtcgagtcctccgacaccattgacaatgtcaagtccaagattcaggacaaagagggaatccctccggaccagcagcgtctaatcttcgctggaaagcagcttgaggacggccgcaccctttcggattacaacatccagaaagagtctaccctgcacttggtgctccgcctccgtggtggtgccaagaagcgcaagaagaaggtctacactacccccaagaagatcaagcacaagcgcaagaagaccaagctcgctgtcctcaaatactacaaggttgatggtgatggcaaaattgagcgtctccgccgcgagtgtccccaggagggttgtggtgccggtgtattcatggctgccatgcacaaccgccagtactgcggaagatgccacctcacctacgtctttgaggagtcatagatgcgtcgatctgcttgagcgagacgattaaacgaatatatatctacagctcaacgaaggacggcggatatataggcacaataaagtcttgttgaaagggggaaaatcaataccaattatgtgattactaaaaaa

SEQ ID NO: 2641 - DNA, 655 bp, Triticum aestivum
ctttctcccttcctgtcagttgagcgaaggtttctaactaacaatcatgcaaatcttcgtgaagacgctcacgggaaagactatcacccttgaggtggagccatctgattccattgataatgttaagcaaaagatccaagacaaggaaggaattcctccagatcagcaacgtttaatctttgctggtaaacagcttgaagacggcagaaccctttcggattacaacatccaaaaggagtctactcttcacttagtcttacgtttacgcggtggtgctaagaagagaaagaagaagacctataccaagccaaagaaggcccatcacaagagaaagaaggtaaagttagctgtcttaaaattctaccaggtcgacaaggatggcaaggttatccgtgccagaaaagattgcccacacgagacctgcggtgctggtgttcgcatggccttacacaagaacagacatcactgcggtaaatgctccttgacctacttcatcgagaagtaaactagtccatccctgctaaagcaagacgaagataagcagctacagaagagaaggaaatgaaaggctttccagacaaagcaaccaatcacttgtccctttaaagtggtcaagtcgtaaatagcgaaaataatcgagccaaactcttattac

SEQ ID NO: 2642 - DNA, 699 bp, Triticum aestivum
  misc_feature (2)..(2): n is a, c, g, or t
  misc_feature (6)..(6): n is a, c, g, or t
tntgtntctctctctctctctctctctctctctctctctctctcctttctcccttcctgtcagttgagcgaaggtttctaactaacaatcatgcaaatcttcgtgaagacgctcacgggaaagactatcacccttgaggtggagccatctgattccattgataatgttaagcaaaagatccaagacaaggaaggaattcctccagatcagcaacgtttaatctttgctggtaaacagcttgaagacggcagaaccctttcggattacaacatccaaaaggagtctactcttcacttagtcttacgtttacgcggtggtgctaagaagagaaagaagaagacctataccaagccaaagaaggcccatcacaagagaaagaaggtaaagttagctgtcttaaaattctaccaggtcgacaaggatggcaaggttatccgtgccagaaaagattgcccacacgagacctgcggtgctggtgttcgcatggccttacacaagaacagacatcactgcggtaaatgctccttgacctacttcatcgagaagtaaactagtccatccctgctaaagcaagacgaagataagcagctacagaagagaaggaaatgaaaggctttccagacaaagcaaccaatcacttgtccctttaaagtggtcaagtcgtaaatagcgaaaataatcgagccaaactcttattac

SEQ ID NO: 2643 - DNA, 588 bp, Zingiber officinale
tacgatcgacaacgtgaaggccaagatccaggacaaggaaggcatcccgccggaccagcagcgccttattttcgccgggaagcagctcgaggacgggcgcaccctcgcggactacaacatacagaaggagtccaccctccacctagtcctccgcctccgtggcggcgccaagaagcgcaagaagaagacctacaccaagccgaagaagatcaagcacaagaagaagaaggtcaagctcgcggtgctccagtactacaaggtcgacgacgccaccggcaaagtcacccgcctgcgaaaggagtgccccaacgccgagtgcggcgccggcacctttatggccaaccacttcgaccgtcactactgcggcaaatgcggcctcacctatgtctaccagaaatcgtcaagcgagtaagtttctcatgaaattaggtctttgaattccatttagctttatgtgtttaccaaatttgtgctacaaaacctgatactcgaagtttttcgttagttctgatttgttcctgtcgaagatattttggattttgagttatttggtgattagaacttgttctaatgtccaaaacctcgtgc

SEQ ID NO: 2644 - DNA, 529 bp, Cucurbita pepo
tcgacaatgtcaaggcaaagattcaggacaaggagggaataccgccggaccagcagcgtcttatatttgccggtaagcagctggaggatggtcgaactcttgccgactacaacatccagaaggagtccacgctccatcttgtgttaaggctccgtggtggtgctaagaagcgtaagaagaagacctacaccaagcctaagaagatcaagcacaagaagaagaaggtcaagctcgccgttcttcagttttacaaggtcgacgattctggaaaggttcagaggcttaggaaggagtgccctaacgctgaatgcggagctggtacctttatggccaatcattttgatcgtcattactgtggcaagtgtggtttgacttacgtgtatcagaagcccggcggcgattaggtctattttatgtctacattttgatagatattgcttgttatgataatcattttttgggacaatactaggatttcaaatgatcaaattgatctattttcatgaactgtgttacatttggagatgct

SEQ ID NO: 2645 - DNA, 584 bp, Ocimum basilicum
gtgcagcggtgctcgttttttcgtcgtcgttgtgatgttttaattaaaattgctcggttgaccagaaaacatgcagatcttcgtcaagacgttgacgggtaagaccatcaccctcgaggtcgaacctagtgacactatcgaaaatgtaaaagccaagatccaagacaaagaaggaattcctcccgatcagcaacgtttgattttcgccggtaaacaactcgaagatggacgtactctttccgattacaatatccaaaaagaatcgacgttacatttagtattaagattgagaggaggtgccaaaaaaaggaagaagaagaattactctacgcctaagaaaatcaaacataagaagaagaagattaagctcgccgttttgaaattctacaaagttgacgaaaacggaaagattttccgtcttcgtcgggaatgccccatggaacgttgcggagctggagtttttatggctgcgatgtccgataggcattattgtggtaaatgcggttacacgttagtttacgatggcaacgaaggcaaataatttttataattaatggttggaaataaacattaaatctacgttt

SEQ ID NO: 2646 - DNA, 475 bp, Eucalyptus grandis
  misc_feature (427)..(427): n is a, c, g, or t
  misc_feature (457)..(457): n is a, c, g, or t
  misc_feature (461)..(461): n is a, c, g, or t
agatgcagatcttcgtgaaaaccctgacggggaagaccatcaccctggaggtggagtcctccgacaccatcgacaacgtcaaggccaagatccaggacaaggagggcatcccgcccgaccagcagcgcctcatcttcgccggcaagcagctcgaggacggccgcaccctcgccgactacaacatccaagaaggagtccaccctccacctcgtcctccgcctccggggcggcgccaagaagcgtaagaagaagacctacaccaagcccaagaagatcaagcataagaagaagaaaggtcaagctcgccgtcctccagttctacaaggtgggacgactccggcaagggtccagcggctcccggaaaggagttgccccgaaacgccggagtggcggcgccgggcaccttcatgggccaaaccaacttccnaccgcccacttaactggcggggtaagttgngggncttcaacctatttt

SEQ ID NO: 2647 - DNA, 625 bp, Avena sativa
gaggaagacaaccagattgtctaggccgccatgcagatcttcgtcaagaccctcacgggtaagactatcacccttgaggtggagtcttcggacaccatcgacaatgtgaagtccaagattcaggacaaggagggaattcccccggaccagcagcgtctcatcttcgccggaaagcagctcgaggatggccgcaccctctccgactacaacatccaaaaggagtcgaccctccacttggtcctccgcctgcgtggtggtatggccaagaagaggaagaagaaggtgtacaccacccccaagaagatcaagcacaagcgcaagaagaccaaactcgccgtcctcaagtactacaaggtcgacggcgacggcaagatcgagcgtctccgccgcgagtgcccgcagcccgagtgcggtgctggtgtcttcatggccgccatgcacaaccgccagtactgcggccgttgccacctcacctatgttttcgacgagtcaaagtaaacgaattcagggtgcgatacgggatatgaactgatggggcgaccactacgatcgacaagttggaccgcacaggtccttcgagaccccgggcatgaaatcaccaatcaaatctgtcttgaaacttcac

SEQ ID NO: 2648 - DNA, 557 bp, Triticum aestivum
ccacgcgtccggcaccacgcacacgtcggttgtgtaggccaagctaaccatgcagatcttcgtcaagaccctcacgggcaagacgatcaccctcgaggtcgagtcgtccgacacgatcgacaacgtcaaggccaagatccaggacaaggagggcatcccccccgaccagcagcgtctcatctttgccggcaagcagctcgaggacggccgcactctctcggactacaacatccagaaggagtcgaccctccacctcgtcctccgcttgcgcggtggtatggccaagaagcgcaagaagaagacctacaccaccccgaagaagatcaagcacaagcgcaagcccgtcaagatggcagtcctcaagtactaccgcgtcgactcggacggaaaggtcaagcgcctccgtcgcgagtgccccgccgagacctgcggcgccggtgtcttcatggccgcccacaaggaacgccagacctgcggtcgctgcggcctgactacgtccacgaggcctaaacttggtgttgcgtttgcattgaccatcaccttgtttgtctcccacc

SEQ ID NO: 2649 - DNA, 530 bp, Triticum aestivum
  misc_feature (450)..(451): n is a, c, g, or t
  misc_feature (492)..(492): n is a, c, g, or t
  misc_feature (494)..(494): n is a, c, g, or t
caccacgcacacgtcggttgtgtaggccaagctaaccatgcagatcttcgtcaagaccctcacgggcaagacgatcaccctcgaggtcgagtcgtccgacacgatcgacaacgtcaaggccaagatccaggacaaggagggcatcccccccgaccagcagcgtctcatctttgccggcaagcagctcgaggacggccgcactctctcggactacaacatccagaaggagtcgaccctccacctcgtcctccgcttgcgcggtggtatggccaagaagcgcaagaagaagacctacaccaccccgaagaagatcaagcacaagcgcaagcccgtcaagatggcagtcctcaagtactaccgcgtcgactcggacggaaaggtcaagcgcctccgtcgcgagtgccccgccgagacctgcggcgccggtgtcttcatggccgcccacaaggnncgccagacctgcggtcgctgcggcctgactacgtccacgangnctaaacttggtgttgcgtttgcattgaccatcacct

SEQ ID NO: 2650 - DNA, 629 bp, Humulus lupulus
ttacggccggggcctgcgactgaggaggacaagcatcacttgtctaggtcgtgaaccatgcagatcttcgtcaagaccctcacgggtaagactatcacccttgaggtggagtcatccgataccatcgacaatgtcaagtccaagatccaagacaaggagggaattcccccagaccagcagcgcttgatcttcgccggcaagcagctcgaggatggccgtactctttccgactacaacatccagaaggagtctactctccacctggtgctccgcctccgtggtggtggcaagaagaggaagaagaaggtctaccccaccccaaagaagatcaagcacaagaggaagaagaccaagttggccgtcctcaagtactacaaggtcgatggcgatggaaagattgagcgtctcaggcgcgagtgccccaacgacacttgcggtgccggtatcttcatggctgccatgcacaaccgtcaatactgcggtcgctgccatcttacctacgtctttgacgaggccaagtaaattggtgtggtagtgcaaggacgaggttaggttcggatagatgtatacaggaacacagggacgagcccttgcttcgatgctagagccgaataatcaaaaccaaagtc

SEQ ID NO: 2651 - DNA, 634 bp, Humulus lupulus
  misc_feature (3)..(3): n is a, c, g, or t
  misc_feature (16)..(16): n is a, c, g, or t
  misc_feature (30)..(30): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (318)..(318): n is a, c, g, or t
  misc_feature (502)..(502): n is a, c, g, or t
ttncggccgggggcancgactgaggaaganaaccagcttgtctaggccgccatgcagattttcgtaaagaccctcacgggcaagaccatcacccttgaggtggagtcttcggacaccatcgacaatgtgaagtccaagatccaggataaggagggcattcccccggaccagcagcgtctcatcttcgccggcaagcagcttgaggatggccgcactctctccgactacaacatccagaaggagtcgactctccacctggtgctccgcctgcgtggtggaggtaanaanaggaanaagaaggtctacaccacccccaanaagatcaagcacaagcgcaagaagaccaagctcgctgtgctcaagtactacaaggttgatggcgatggcaagatcgagcgtctccgccgcgagtgcccccagcccgagtgcggtgccggtgtcttcatggctgccatgcacaaccgccagtactgcggtcgctgccacttgacctacgtcttcnacgaggccaaataagcgcgtcgctgcccacgatcgataacacgtttcgacatccagcaaatcatggcaggactgaaaagcaaccaccatatgtcgggaaaatagaatcaatcaaggatcaagactcacaacc

SEQ ID NO: 2652 - DNA, 648 bp, Pinus taeda
ggggatcgtgtctgaggacgacagcaactgtctaggccgccatcatgcaaatcttcgtcaaaaccctcacgggtaagacaatcacgctcgaggttgagtcctccgataccatcgacaatgtcaagtccaagatccaggacaaggaaggcatcccgccagaccagcagcgcttgatcttcgccggcaagcagctcgaggatggccgcaccctttccgactacaacatccagaaggagtcgaccctccacttggtcctgcgtcttcgtggtggcgccaagaagcgcaagaagaaggtgtacactacgcccaagaagatcaagcacaagaggaagaagaccaagctcgctgtgctcaagtactacaaggttgatgccgacggcaaggtcgagcgcctacgccgcgagtgccccactcctgagtgcggtgcttcctgcttcatgtccgctatgcacaaccgccagtactgcggccgttgccaccttacctacgtctttgacgagacgaaatagatggagagctggccttgacaagacctcgaacaacccatgtcgagatcagcatatgagatttggtagagggcagtttgcctgcaagtttagaacatcaaaatcgaatcatatgttgggttacaaaaaaaaaaaaaaaaaa

SEQ ID NO: 2653 - DNA, 584 bp, Pinus taeda
gatagcgactgaggaaggcatttctgtctaggccgccatcatgcagattttcgtcaagaccctcacgggtaagacgatcaccctcgaggttgagtcctcggacaccatcgacaatgtcaagtccaagatccaggacaaggagggaattcccccagaccaacagcgcttgatcttcgccggcaagcagctcgaggatggccgtaccctttcggactacaacatccagaaggagtccacccttcaccttgtcctccgcctccgtggtggtggcaagaagcgcaagaagaaggtctacaccacccccaagaagatcaagcacaagcgcaagaagaccaagttggctgtcctcaagtactacaaggttgacggcgacggaaagatcgagcgtcttcgccgcgagtgccccaacgagacctgcggtgccggtattttcatggctgctatgcacaaccgccagtactgcggtcgctgccaccttacctacgtcttcgatgaggtgaaatagatttgtctaagcgttacatgaagcatctatgcatttctgcacgtcgctcgaagtacatagcaagtctaagaccatcgct

SEQ ID NO: 2654 - DNA, 463 bp, Cephalotaxus harringtonia
ctagatcttcaatatgcagatcttcgtcaagaccctcacgggcaagaccatcaccctcgaggtcgaatcctcagacactatcgacaatgtcaagtccaagattcaggacaaggagggtatcccacccgaccagcaacgtctaatcttcgccggcaagcaactcgaagacggtcgcacactttccgactacaacatccagaaggagtccactcttcatctagtcctccgcctccgaggtggtgccaagaagcgcaagaagaaggtctacaccacccccagaagatcaagcacaagcgcaagaagaccaagttggccgtcctcaagtactacaaggtcgacggtgatggcaagatcgagcgactgagacgtgagtgcccacagccagactgcggtgccggtgtcttcatggctgccatgcacaaccgacaatactgtggtcgttgccacttgacctacgtcttcg

SEQ ID NO: 2655 - DNA, 551 bp, Humulus lupulus
gacggcaagttgcccaggaaccatgcagatcttcgtcaagaccctcacgggtaagactatcacccttgaggtggagtcgtccgacaccatcgacaatgtcaagtccaagatccaggacaaggagggaattcccccagaccaacagcgtctgatcttcgccggcaagcagctcgaggacggccgcactctttcggactacaacatccagaaggagtcgacccttcacctcgtgctccgcctgcgtggtggtggcaagaagcgcaaaaagaaggtctacaccacccccaagaagatcaagcacaagcgcaaaaagaccaaactcgccgtcctcaagtactacaaggttgacggtgacggcaagattgagcgtctgcgccgcgagtgccccgccgagacctgcggtgccggtatcttcatggctgccatgcacaaccgccagtactgcggtcgctgccacctcacctacgtcttcgacgagtccaagtagatcattgacaatacaaaacatgcgcggcgactttgattagataaccgcgtatgtcatcacttga

SEQ ID NO: 2656 - DNA, 516 bp, Humulus lupulus
agcatctgcaactgtcagcccaaggacggcaagttgcccaggaactatgcagatcttcgttaagacccttacgggcaagactatcacccttgaggtggagtcgtccgacaccatcgacaatgtcaagtccaagatccaggacaaggagggaattcccccagaccagcagcgtctgatcttcgctggcaagcagctcgaggacggccgtaccctttcggactacaacatccagaaggagtccacccttcacctcgtgctccgccttcgtggtggtggcaagaagcgcaaaaagaaggtctacaccacccctaagaagatcaagcacaagcgcaaaaagaccaaactcgccgtccttaagtactacaaggtcgacggtgatggcaagatcgagcgtctgcgccgcgagtgccccgccgagacctgcggtgccggtatcttcatggctgccatgcacaaccgccagtactgcggtcgctgccacctcacctacgtcttcgacgagtccaagtagatcat

SEQ ID NO: 2657 - DNA, 765 bp, Lippia dulcis
caattcagaaacaaaaaccctagcaccgccgctatctccgccgcgaagatgcagatcttccttagaagcgttgcgtgcaacaccagattactggaggtagaaccctccgacaccgtcgaacacctcaaggccaagatccaggacaccgaattcatctcgccggacgagcagcgcctcatctacggcggaaaacagctcgaggatggcagcacattggccgactacggcatccagaaagaatccacgatccacgtcctcctccgcctactcggtggcgctaagaagcgcaagaagaagacgtacaccaagccgaagaagatcaagcacaagaagaagaaggtgaagctccccgtcctgcagttctacaaggtggatgattcgggaaaagttcagcggctgaggaaggagtgccccaatgctgagtgcggcgctggtactttcatggcgaaccatttcgacaggcactactgtggtaagtgcgggcttacgtatgtctacaacaaagctggtggagattgagaacaacaattttgtctgatggatttctctttttgtttattcaatatatcgttgacaaacaacactactgtcatgtctgggtatcttgtttagaacttgaattttgtttctgtgtaatttgttgagagttgagacatacatttctttaaatgagttttctgttaaaaataatttatgcttctgctgctgttgtgttctgggtttgcagtggcgggattatttctgctttcaaattgatgcactttc

SEQ ID NO: 2658 - DNA, 508 bp, Podocarpus macrophillus
catgcagattttcgtcaagacccttacgggcaagactatcaccctcgaggtggagtcgtccgacaccatcgacaatgtcaagtccaagatccaggacaaggagggtatccccccggaccaacagcgcctgatcttcgctggcaagcagctcgaggatggccgtaccctctccgactacaacatccagaaggagagcactcttcacctcgtcctccgcctccgtggtggtggtaagaagcgcaagaagaaggtctacaccaccccaagaagatcaagcacaagcgcaagaagaacaagcttgccgtcctcaagtactacaaggttgacggtgacggcaagattgagcgtctgcgccgcgagtgcccctccgacacctgcggtgccggtatcttcatggccgccatgcacaaccgccagtactgcggtcgctgccacctcacctacgtctttgacgaccctaagtaaatgtgtcgccaagacaggtgttgatgacttttgtcttctctgc

SEQ ID NO: 2659 - DNA, 587 bp, Picea glauca
  misc_feature (93)..(93): n is a, c, g, or t
  misc_feature (306)..(306): n is a, c, g, or t
  misc_feature (408)..(408): n is a, c, g, or t
gcacgaggcgaccccgctgtctaggtcgccatcatgcagattttcgtgaagaccctcacgggcaagactatcaccctcgaggtggagtcatcngacaccattgacaatgtcaagtccaagatccaggacaaggagggtatccccccggaccaacagcgcctgatcttcgctggcaagcagctcgaggatggccgtaccctctccgactacaacatccagaaggagagcactcttcacctcgtcctccgcctccgtggtggtggtaagaagcgcaagaagaaggtctacaccacccccaagaagatnaagcacaagcgcaagaagaacaagcttgccgtcctcaagtactacaaggtcgacggtgatggcaagattgagcgtctgcgtcgcgagtgcccctctgacacntgcggtgccggtatcttcatggctgccatgcacaaccgccagtactgcggtcgctgccacctcacctacgtcttcgacgaccccaagtaaacgggtcgctcggagagaggtgccgatgaacttgtttctactttgctagctatctagcgtttttacaatcaagtcgttgtccgatcacc

SEQ ID NO: 2660 - DNA, 616 bp, Picea glauca
ttaattaattaatcccccccccccccgagtttccggttgccattagttctttctttgtggtatggtgtcggcataaggtacaccaagatgcagatcttcgtgaaaaccctcacgggtaaaaccattaccctcgaggtggagccctcggacaccatcgaaaatgtcaaagctaagatccaggacaaggagggcatccctccagaccagcagaggttgatcttcgcgggcaagcagctggaggatggtcgtaccctctcagactacaacatccagaaggagtcgacgctgcatttggtgctgcgtctgcgcggcggcgccaagaagcgcaagaagaagaattactccacgcccaagaagatcaagcataagaagaagaaggtcaagctcgctgtgctcagatactacaaggtcgacgagaacggcaagatccaccgtcttcgtcgcgagtgcacgggcgagcagtgcggcgccggcgtcttcatggcggtgatggaggatcgccattactgcggcaagtgccacagcaccatggtcttcaaggacgacgacaaataggctaagtctagtgttactcgactgctgtgaatgatggattaaaagtcttgacacagtgtca

SEQ ID NO: 2661 - DNA, 601 bp, Picea glauca
gcacgaggtctaggttgccatcatgcagattttcgtcaagaccctcacgggtaagacgattacccttgaggtggagtcttcggacaccatcgacaacgtcaagtccaagatccaagacaaggagggaattcccccagaccaacagcgtcttatcttcgccggcaagcagctcgaggatggccgcaccctctccgactacaacatccagaaggagagcaccctccacttggtcctccgcctccgtggtggtggcaagaagaggaagaagaaggtctacaccacccccaagaagatcaagcacaagaggaagaagaccaagttggccgtcctcaagtactacaaggtcgacggtgacggaaagatcgagcgcctgaggagagagtgccccgccgacacctgcggtgccggtatcttcatggctgccatgcacaaccgccagtactgcggtcgctgccacctgacctacgtcttcgacgacccaaagtagatgtcgagacggacatggacgatagggagattcgtttgatgagcattgtcaactgccacggtggatgatttgcttcttagtcaatatagtcaatcaatcaacccctttcttcac

SEQ ID NO: 2662 - DNA, 526 bp, Triticum aestivum
ttttcccgtcgtcttgactttctgccgccatgcagatcttcgtcaagaccctcacgggtaagacgatcaccctcgaggtggagccgtctgacaccatcgagaatgtcaaggccaagatccaggacaaggagggcatccccccggatcagcagcgcctgatcttcgccggcaagcagctggaggacggccgcaccctgtcggactacaacatccagaaggagtcgaccctccacctggtgctgcgcctgcgcggcggcggcaagaagcgcaaaaagaaggtctacaccacgcccaagaagaaggcgcacaagaagaagaaggtcaagctggccgtgctgcgctactaccgcgtggatggcagcggcaacgtgacccgcctccgccgtgagtgcaactcggagcagtgcggcgccggcatcttcatggcctcgcactacgaccgccagtactgcggcaagtgcggcctgacctacatgctgcccaagagcgagatcaagcccaagccggtgcccggccagtcggccgc

SEQ ID NO: 2663 - DNA, 686 bp, Triticum aestivum
ggggacaaccaaacctgcatcaagcgctgaggatatcaacgagaactcgttgactaggcagcaaacatgcagatcttcgtcaagaccctcacggggaagacgattacgttggaagttgaggcttctgacacaatcgacaacgtcaagagcaagatccaggacaaggaggcattcccccggaccagcagcgtctcattttcgccggcaagcagctcgaggatggccgcactctttcggactacaacatccagaaggagtccaccctccatctagtgctccgcctgcgtggtggtgccaagaagcgcaagaagaaggtgtacaccacccccaagaagatcaagcacaagcgcaagaagaccaagtcgcggtcctcaagtactacaaggttgacggcgacggcaagatcgagcgtctcaggcgtgagtgcccccagcccgagtgcggtgctggtgtcttcatggctgctatgcacaaccgccagtactgcggacgctgccaccttacctacgttttcgacgaggccaaataagcgcatcgactgcgtgccggaaactaggagggagatcggaacacgacatgaatgattacgagttatggagacgcggcggatcggctggactgaataggttgggccatgtgtcggacatctaggctatgaatgaaacatgtcaacaacgtcgcacaat

SEQ ID NO: 2664 - DNA, 520 bp, Eschscholzia californica
tgtgaaagcaaagatccaagacaaggaggggattccaccagatcaacaacgtctcatcttcgcagggaaacagctagaggatggaagaaccctagcagattacaacatccagaaagaatcaactcttcatcttgttcttcgactcaggggaggagctaaaaagaggaagaagaagacctacaccaagccaaagaagatcaagcacaagcataagaaggtcaagcttgctgttcttcagttttacaaggtggatgactcagggaaggttcagaggcttaggaaggagtgccctaactccgagtgcggcgctgggacgttcatggcgaaccacttcgatcgtcactactgtggtaaatgtggtcttacttacgtttaccagaaggctggaggcgaatgactgaattaatttggtggtggtggtggatgatgatggtggtcgatgatgcctgtttaaggtattttagtttatgttgtttctgttgtgatatcaatttctgtgtttgagtaattctattatcaa

SEQ ID NO: 2665 - DNA, 737 bp, Pisum sativum
tgtgtggcatgacaaacatggacatcctcgtcgtgaagccttgaaaactactctttctctgtgcaacatcctcataaaactagccttgaattgtgtagttcttgttgcctagaaaaaaattcagacttctagttctttatctcattcagtttggcattccccttttgacttgttatatcctaatgtaggggaggggcctcggcttttatgctttccacttcaagctataaatacttactcacttgtgtggaaaaaaagatccaagataaggaaggaatcccaccggaccaacagcgactgatctttgccggcaaacagctagaagacggccgcactctcgccgactacaacatccagaaggaatcaactctccatctggtcctccgtcttcgcggtggcgcaaagaagcgtaagaagaagacctacaccaagcctaagaagatcaagcataagcacaggaaggtgaagcttgcggttctccagttctacaaggtggatgattctggaaaggtgcagaggctgaggaaggagtgccctaatgcggagtgtggtgcagggactttcatggcgaatcattttgatcgccattactgtggtaagtgtgggcttacctatgtttaccagaaggctgaagcttgagtttgaatttctagtgttttgatttgtttttgtcgaacttttgaatgttgcggatttaatttaatagtgttactttcagacttttattatgttgctta

SEQ ID NO: 2666 - DNA, 1199 bp, Solanum tuberosum
caaacgaaaaaatggcaaaatcatttgaaaatgaacatccaattaaggcatttggatgggcaactagagacacttctggagttctttctcctttcaatttttcaagaagggtgacaggtgaaaaagatgtgcaatttaaagttatgtattgtggaatttgtcattctgatcttcatcaactcaagaatgaatggggaaatagcaagtacccgatggtgcctgggcatgaggttgttggtgttgtaattgaggttggaagcaaggtggagaaatttaaggttggagacaaagtaggtgttggatgtatggtaggatcatgtcgaaaatgtgagaattgtagcgtggatctcgagaattactgccctcgtcagattcctacttacaacggctatagcttagacggaaccttcacgtttggaggttactctgacatgatggtatccgatgagcattttgtagtacattggcctgaaaacttgtcgatggacgctgctcccctgttatgtgctggaattactacttatagtcctttgaaatattttggactcgataagcctggaatgcacattggtgttgttggtcttggagggctcggacatatggctgttaagtttgctaaggcattcggaaccaaagtgactgtcattagtacatctgcaaataagaagcaagaagcaattgagcgtttaggcgcagactctttcttgatcagtcgcgatcctgagcagatgaaggctgcaatgaacacattggatgggattatcgacactgtttcggcggtgcaccctattcttccattgcttatgttgatgaaatctcatggtaagctagttatggttggtgcaccagaaaaaccggtggagttgcccgtgtttcctctacttatgggaaggaagctagtggctggaagttgcataggagggatgaaagagactcaagaaatgttggacttcgcagcaaagcataacataacaccagatattgaagttgtgcctatggactatgtgaacacagcgttggaacgtcttctgaaatcggacgtgaagtatcgtttcgtgctcgacattggcaatacattaaacaagaaatgagaatattaatagggggatttacgtccaatggtctagcagtgtttctttgcttagattgcattaatttcagagatgattaatcaataaaatgtgtttcttgcacttact

SEQ ID NO: 2667 - DNA, 1275 bp, Solanum phureja
gtatcatccatattttcctacattcttctctattataatttatactatatatacactacataaatatttttatttttcaaacgaaaaaatggcaaaatcatttgaaaatgaacatccaattaaggcatttggatgggcaactagagacacttctggagttctttctcctttcaatttttcaagaagggtgacaggtgaaaaagatgtgcaatttaaagttatgtattgtggaatttgtcattctgatcttcatcaactcaagaatgaatggggaaatagcaagtacccgatggtgcctgggcatgaggttgttggtgttgtaattgaggttggaagcaaggtggagaaatttaaggttggagacaaagtaggtgttggatgtatggtaggatcatgtcgaaaatgtgagaattgtagcgtggatctcgagaattactgccctcgtcagattcctacttacaacggctatagcttagacggaaccttcacgtttggaggttactctgacatgatggtatccgatgagcattttgtagtacattggcctgaaaacttgtcgatggacgctgctcccctgttatgtgctggaattactacttatagtcctttgaaatattttggactcgataagcctggaatgcacattggtgttgttggtcttggagggctcggacatatggctgttaagtttgctaaggcattcggaaccaaagtgactgtcattagtacatctgctaataagaagcaagaagcaattgagcgtttaggcgcagactctttcttgatcagtcgcgatcctgagcagatgaaggctgcaatgaacacattggatgggattatcgacactgtttctgcggtgcaccctattcttccattgcttatgttgatgaaatctcatggtaagctagttatggttggtgcaccagaaaaaccggtggagttgcccgtgtttcctctacttatgggaaggaagctagtggctggaagttgcataggagggatgaaagagactcaagaaatgttggacttcgcagcaaagcataacataacaccagatattgaagttgtgcctatggactatgtgaacacagcgttggaacgtcttctgaaatcggacgtgaagtatcgtttcgtgctcgacattggcaatacattaaacaagaaatgagaatattaatagggggatttacgtccaatggtctagcagtgtttctttgcttagattgcattaatttcagagatgattaatcaataaaatgtgtttcttgcacttat

SEQ ID NO: 2668 - DNA, 1101 bp, Solanum phureja
tttattttcaaaccaaaaaaatggcaaaatcatatgaaaatgaacatccaattaaggcatttggatgggcaactagagacacttctggagttctttctgctttcaacttttcaagaagagtgacaggtgaaaaagatgtgcaatttaaagttatgtattgtggaatttgtcattctgatcttcatcaactcaagaatgaatggggaaatagcaagtacccgatggtgcctgactgcctgggtaaattaatctgttgaaagcaaggtggagaaatttaaggttggagacaaagtaggtgttggatgtatggtaggatcatgtcgaaaatatgagaattgtagcgttgatctcgaaaattactgtcctcgtcagattcctacatacagcggctatagcttagacggaaccctcacgtttggacgttactccgacatgatggtatccgatgagcattttgtagtatggtggcgtgaaaacttgtcgatggacgctgctcccctgttatgtgctggaattactacttatagtcctttgaaatattttggactcgataagcctggaatgcacattggtgttgttggtcttggagggctcggacatatggctgttatgttcgctaagacattcagaatcaaagtgactgtcattagtacatctgctaataagaagcaagaagcaattgagcgtttgggcacagaatctttcttgatcagtcgcgatcctgagcagatgaaggatgcaatgaacacattggatgggattatcgacattgtttcggcagtgcaccctattcttccattacttatgttgatgaaatctcatggtaagcttgttatggttggttcaccagaaaaaccggtggagttacccgtgtttccactacgtatgggaaggaagctagtggctggaagttgcataggagggatgaaagagactcaagaaatgttggattttgcggcaaagcataacataacaccagatattgaagtcgtgccaatggactatgtgaacacagcgttggaacgtcttctgaaatcggatgtgaaatatcgtttcgtgctcgacattggcaatacattgaacaagaaatgaggataggga

SEQ ID NO: 2669 - DNA, 1281 bp, Capsicum annuum
gcacgaggagtatatatatttttattttcaaacaaaaatatcaactgcaaaatggcaaaatcatatgaaaatgaacatccaattaaggcatttggttgggcagctagagacacttctggtgctctttctcctttcaacttctcaagaagggtgactggtgaaaaagatgtgcaatttaaagttatgtattgtggaatttgtcactctgatcttcatcagctcaagaatgaatggggtaatagcaagtatcccgttgtgcctgggcatgagatcgttggtgttgtaactgaggttggtagcaaggtggagaaatttaaggttggtgacaaagtaggtgttggatgtctggttggatcatgtcgcgaatgtgagaattgtagcgttgatcttgagaattactgtcgtcgtcccacttggacatacaacagctataactcagatggaaccctgacattcggaggttactccgacatcatggtatgtgatgagcattttgtagtacattggcctgagaacttgtcgatggatgctgctcccctgttatgtgctggaattactacttatagtcctttgaaatattttggactcgataagcctggaatgcacattggtgttgttggtcttggaggactcggacatatggctgttaagtttgctaaggcattcggaaccaaagtgaccgtcattagtacatctgctagcaagaaacaagaagcaattgagcgtttgggcgcagactctttcttgatcagccgtgattctgagcaaatgcaggatgcagtgaacacattggacgggatcatcgacactgtatcggcagtgcaccctattcttccattgcttatgttattgaaatctaatggtaagcttgttatggttggtgcaccagaaaaaccagtggagttgcccgtgtttcctctacttatgggaaggaaactagtggctggaagtggcataggagggatgaaagagactcaagagatggtagatttcgcggcaaagcataacataacaccagatgtagaaatcgtgccaatggactatgtgaatatagcgttggagcgccttttgaaatcggatgtgaagtaccgttttgtgctagacattggcaacacattgaacaagaattgagatggagatttcttgtttctggcatatctgttttatgaaattttttgtcaagaaaatgagaattggggtcacctgaggtgtgtcttttttcttatgttttgtgtatcaaaggaagaagtcagagaataaatatgattttgtgttttctag

SEQ ID NO: 2670 - DNA, 1056 bp, Solanum phureja
tttatttttcaaacgaaaaaatggcaaaatcatttgaaaatgaacatccaattaaggcatttggatgggaaactagagacacttctggagttctttctcctttcaatttttcaagaagagtgacaggtgaaaaagatgtgcaatttaaagttatttgtggaatttgtcattctgatcttcatcaactcaagaatgaatggggaaatagcaagtaccccatggtgcctagaaaggttggaaacaaagtaggtgctggatgtatggtaggatcatgtcgaaaatgtgagaattgtagcgttgatctcaagaattactgccctcgtcagattcctacatacaacggctttagcttagatggaaccctcacgtttggaggttactccgacatgatggtatccgatgagcattttgtagtacggtggcctgaaaacttgtcgatggacgctacgcccctgttatgtgctggaattactacttatagtcctttgaaatattttggacttgataagcctgtaatgcacattggtattgttggtcttggagggctcggacataaggctgttaagtttgctaaggcattcggaaccaaagtgacttgtcattagtacatctgctaataagaagcaaaaagaaattgagcgtttgggcgcagattctttcttgatcagtcgcaatcctgagcagatgaaggctgcaatgaacacattggatgggattatcgacactgtttttgcggtgcaccctattcttccattgcttatgttgatgaattctcatggtaagcttgttatggttggtgcaccagaaaaaccggtggagttgcctgtgtttcctctacttatgggaaggaagctagtggctggaagttgcataggagagatgaaagagactcaagaaatgctggatttcgcggcaaagcataacataacaccagatattgaagttgtgccaatggactatgtgaacacagcgttggaacgtcttctgaaatcggatgtgaaatatctttttgtgctcgacattggcaatacattgaacaagaaatgaggataggga

SEQ ID NO: 2671 - DNA, 1024 bp, Solanum phureja
tattttgttttaatgggtacagggtgacaggtgaaaaagatgtgcaatttaaagttacgtattgtggaatttgccattctgatcttcatcaactcaagaatgaatggggaaatagcaagtaccctatgtgtaactaattgtaaatataattgcggttgttggtgttgtaactgaggttgaaagcaaggtggagaaatttaaggttggagacaaagtaggtgttggatgtatggtaggatcatgtcgaaaatgtgagaattgtagcgttgatctcgagaattactgccctcgtcagattcctacatacaacggctatagcttagacggaaccctcacgtttggaggttactccgacatgatggtatccgatgagcattttgtagtacgttggcctgaaaacttgtcgatggacgctgctcccctgttatgtgctggaattactacttatagtcctttgaaatattttggactcgataagcctggaatgcacattggtgttgttggtcttggagggctcggacatatggctgttaagttcgctaaggcattcggaacgaaagtgactgtcattagtacatctgctaataagaagcaagaagcaattgagtgtttgggcgcagactctttcttgatcagtcgcgatcctgagcagatgaaggctgcaatgaacacattggatgggattatcgacactgtttctgcggtgcaccctattcttccattgcttatgttgatgaaatctcatggtaagctagttatggttggtgcaccagaaaaaccggtggagttgcccgtgtttcctctacttatgggaaggaagctagtggctggaagttgcataggtgggatgagagacactcaagaaatgttggatttcacggcaaagcataacataacaccagatattgaagtcgtgccaatggattatgttaacacagcgttggaacgtcttctgaaatcagacgtgaaatatcgtttcgtgctcgacgttggcaatacattgaacaagaaatgagaataggaa

SEQ ID NO: 2672 - DNA, 1235 bp, Solanum tuberosum
gaataatatctcaaaaaatacacaaaaatcaagaaaatggaaaaatcacatgaaaatgttaaggcatttggatgggcagctagagatacttctggggtactttctcctttcaacttctcaagaagggtgactggtgaaaaagatgtgcaattcaaagttatgtattgtggaatttgtcattctgatcttcatcaactcaagaatgaatggagcaatagtatatatccaatggtaccagggcatgaagttgttggtgtagtaactgaagttggtagcaaagttgagaaattcaaaactggagacaaagttggagttggatgtttagtaggatcatgtagaaaatgtgaaaactgtgacaacgatcttgaaaattattgtcgcgatcagatcatgacatacaatggtgtttacaccgatggaatccccacgtatggtggttactcggatataatggtaacgaatgaacactacgtggttcattggcccgaaaatttaccaatggaagcagctcccctgttatgtgcagggatcacaacttatagtcctttgagatattacggactagataaacctggaatgcacattggtgttgttggtcttggtggtcttggacatatggctgtgaaatttgctaaggcgttcggaaccaaagttactgtgataagtacatctgtcagtaagaaagatgaggcaattgatcgtttaggggcagactcgtttttggtcagtcgtgaccctgaccaaatgcagggtgcagcggggtcactagatggcatcatcgatactgtatccgtgattcaccctcttcttccattgattaatttgttgaaaacaaatgggaagcttgtgatggttggtgcccctgaaaaaccattagagttgcctgtatttcccctgcttttaggaaggaagctagtggcggggagcgcgataggaggggtgaaggagacacaagagatggttgattttgcggcaaagcataacataacaccagatgttgaagttgtgccaatggactacgtgaatacagcgttggaacgccttttgaaatcggacgtgaagtatcgttttgtgcttgacattggcaacacattgaacaaaaattgagatgaaggggacatcttggtcaagaaaatgagtgtgttgtagggttatgattttgtattaagcctgtacgtttttgttgtttagtttatttcttatgttttgtgtatcaaaaggaataaggagttaag

SEQ ID NO: 2673 - DNA, 1461 bp, Petunia hybrida
cagtacgcggggagcactcaaattgttgttatattcaaaagccaaaatcaagaaaatggaaaaatcacatgagaatgagcacccaacaaaggcctttggatgggcagctagggatacttcaggggttctttctcctttcaagttttcaagaagagccacgggtgagaaagatgtgcagttcaaagttaagtattgtgggatttgccattctgatcttcatcagctcaagaatgagtggggaaacagcatatatcccattgtgcctgggcacgaggttgttggtgtggtaaccgaggttggcagcaaggtggagaaatttaaggtcggagacaaagtaggagtaggatgtatggtaggatcatgtcgcaaatgtgaaaactgtaacaatgatctcgagaattactgtcgtgatcagacattgacatacaatggtatttactctgatggaacgacaacatatggaggttactcagacatcatggtaactgatgagcatttcgttgttcactggccggagaaccttccaatggaagctgctccgctgttatgtgctggaatcacaacttatagtcctttgaaatattttggacttgacaagcctggaatgcacattggtgttgttggtcttggagggcttggccatatggctgtgaaatttgccaaggcatttggaaccaaagtgactgtcatcagtacttcttctagtaagaaacatgaagcaattgagcgtttgggtgtggactcatttttggtcagtcgtgaccctgaccaaatgcaggctgcaatgggctcacttgatggcatcattgatactgtctctgcagttcaccctcttcttccattgatcaatttgttggaaattctcattggggaaggcttggtggatgggttgggcgcaccagaaaaaccactagagttgcctgtatttccgttgcttatgggaaggaagctagtagcagggagtggtataggtgggatgaaggagacacaagagatggtcgatttcgcagcaaagcataatattacacccgatgttgaagtcgtgccaatggactatgtgaatacagctttggaccgtcttttgaaatcggatgtgaagtatcgttttgtgcttgacattgccaatacattgaacaagacttaagctggacttcatgttctttcaaatctctgtcttttggggcaagcaaatgagaattgggttgaccatctgtgtttgttagttaattgaaaaccggacttcatcatcatgttattcactaaaggcttatgatgtttgttttagtttgcacctattggtgtttactcttaatgttttatgtatcaaaggaagcagaggcgaagctagattttaaagttttggggttcataattctaattcttttaaattatgggttcaaaatcgataattaatgtatattaaatattttttcaagacaaatatacatgatttggtcagcc

SEQ ID NO: 2674 - DNA, 1175 bp, Solanum phureja
taataataataataatagtatctccaaaaaaaacaaaaatcaagaaaatggaaaaatcacatgaaaatgttaaggcatttggatgggcagctagagatacttctggggtactttctcctttcaacttctcaagaagggtgactggtgaaaaagatgtgcaattcaaagttgtgtattgtggaatttgtcatactgatcttcatcagctcaagaatgaatggagcaatagtatatatccaatggtaccagggcatgaagttgttggtgtagtaactgaaattggtagcaaagttgagaaattcaaaattggtgacaaagttggtgttggatgtttagtaggatcatgtagaaaatgtgaaaattgtgacaacaatcttgaaaattactgtcgtgatcagatcatgacatacaatggtgtttacaccgatggaatccccacgtatggtggttactccgatataatggtaaccaacgagcactatgtggtccattggcccgaaaatttaccaatggaagcagctcccctgttatgtgcagggatcacaacttatagtccattgagatattttggacttgacaagcccggaatgcacattggtgttgttggtctgggtggtttgggacatatggctgtgaaatttgctaaggcgtttggaaccaaagttactgtgataagtacatctgttagtaagaaagacgaagcaattgatcgtttaggggcagactcgtttttggtcagtcgtgatcctgaccaaatgcagggtgcagcggggtcactagatggcatcatcgataccgtatccgaaattcatcctcttcttccattgattaatttgttgaaaactcatgggaagcttgtgatggttggtgcccctgaaaaaccactagagttacctgtatttcccctgcttttaggaaggaagctagtggcggggagcgcgataggagggatgaaggagacacaagagatggtagatttcgcggcaaagcatagcataacaccagatgttgaagttgtgccaatggactatgtgaataaagcgttggaacgccttttgaaatcggatgtgaagtatcgttttgtgcttgacattggcaacacattaaacaagaattgagatgaagggggacatcctggtcaagaaaatgagtgtgttatagggttatgattttgt

SEQ ID NO: 2675 - DNA, 1273 bp, Solanum lycopersicum
aaataacagtaataataattatctccaaaaataaacaaaaaccaagaaaatggaaaaatcaaatgaaaatgttgaggcatttggatgggcagctagagatacttctggggtactctctcctttcaatttctcgagaagggtgactggtgaaaaagatgtgcaattcaaagttatgtattgtggaatttgtcattctgatcttcatcaaatcaagaatgaatggagcaatagtatatatccaatggtaccagggcatgaagttgttggtgtagtaactgaagttggcagcaaagttgagaggttcaaaactggtgacaaagttggagttggatgtttagtaggatcatgtagaaaatgtgaaaattgtgacaacgatcttgaaaattattgtcccgatcagatcatgacctacaatggtgtttacaccgatggaacccccacgtatggtggttactccgatataatggtaacgaacgagcactacgtggtccattggcccgaaaatttacgaatggaagcagctcccctgttgtgtgcagggatcacaacttacagtcctttgagacattacggactagataaacctggaatgcacattggtgttgttggtctcggtggtttgggacatatggctgtgaaatttgctaaggcgtttggaacaaaagtaactgtcataagtacatctgctagtaagagagatgaagcaatggatcgtttaggggcagactcgtttttggtcagtcgtgaccctgaccaaatgcagggtgcagcagggtcactagatggcatcatcgatactgtatccgcgattcatcctcttcttccattgattaatttgttgaaaactcatggaaagcttgtgatggttggtgcccctgaaaagccattagagttgcctgtatttcccctgcttttaggagggaagctagtggcggggagcgcgataggagggatgaaggagacacaagagatggttgatttcgcggggaagcataacataacaccagatattgaagtagtgtcaatggactacgtgaatacagcgttggaacgccttttgaaatcggacgtgaagtatcgttttgtgcttgacattggcaacacattgaagaagaattgagatgaaggggacatcttggtaaaaaaaaatgagtgtgttatagggtttatgattttgtcttttaagcttgtaattttgttctttaaatttcttatgttttgtgtatgaaaaggaataaggagttaagagaataaatacgatatggtgttttct

SEQ ID NO: 2676 - DNA, 1357 bp, Nicotiana tabacum
atctatctatttccttatgcaattaattactactcaatttgttgtcatatatctaaaaaaaccaaaagttaagaaaatggcaaaattatatgagaatgaacacccagtaaaggcctttggatgggcagctagagatgcttctggtgttctttctcctttcaactttacaagaagagccactggtgagaaggatgtgcagttcaaagttatgtattgtggaatttgtcattctgatcttcagcagctcaagaatgaatggagcactagcatatatccaatggtacctggatatgaagttgttggtgtggtaactgagattggtagaaaggtggagaaatttaaggttggtgacaaagtaggtgttggatgtttggtaggatcatgtcgcaaatgtgaaaactgtgacaataatctcgagaattactgtcctggtcatataatgacatacaatgatatttacattgatggaatcaccacgtatggaggatattccaatattatggtaacggacgagcactacatggttcattggcctgagaacttgccaatggaagcggctccattgttatgtgctggaattacaacatatagtcctttgaaatattttggactcgataaacctggaatgcacattggtgttgttggtcttggtggtcttggtcatatggctgtgaaatttgctaaggcattcggaacaaaagtgactgttattagtacatctgctagtaagaaacaagaagcaattgggcgtttgggtgcggactcatttttggttagtcgtgaccctgaccaaatgcaggctgcagcaggctcgcttgatggcatcattgacactgtctctgcaattcaccctcttcttccattgattaatttgttgaaaactcatgggaagcttgtaatggttggcgcaccagaaaaaccattagagttgcccgtatttcccttgcttttaggaaggaagctagtagcagggagtgccataggagggataaaggagacacaagagatggtagatttcgcggcaaagcataacattacaccagatgttgaagtcgtgccaatggactatgtgaatacagctttagaccgtcttttgaaatcggatgttaagtaccgttttgtacttgacgttggcaatacattaaacaagaattagcggtgggacttgggcaagaaaattagaattggatctaccgtgtgtgcttcttagcctattgaaaatcggattgcattttgctctaggcttatgatcttgttttagcttgctcctattggtgtttattttttactatgttttatgtattaaaggaaggattcagagaataaatacatattgtttatttctagttttgtcatg

SEQ ID NO: 2677 - DNA, 1149 bp, Solanum melongena
tcttatgagaatgaacacccaattaaggcatttggatgggcagctagagacacttctggggttctttctccttacaatttttcaagaagggtgactggcgaaaaagatgtgcagttcaaagttttgtattgtggaatttgtcatactgatcttcatcagatcaagaatgactggggcatcactaaatatcctattataccagggcatgaaatagttggtgtggtaactgagtttggtaacaaggtagacaagttcaaagttggagacgcaataggcgttggatatctagtaggatcatgtcgcgaatgtgaaaattgtgtcaacgatcttgagaactactgtcctggtctgaccatgaccgcaaatggtacttactctgatggaactatcactcatggaggctactctgatctcatggttgtcgatgaacattttgttgttcgttggcccgagaatttgcccatggaagctgctcccctgttatgtgcagggctcacaacttatagccctttgaaatattttggacttgacaagcctggaatgcacattggtgttgttggccttggcggacttggacatatggctgtgaagtttgctaaggcgtttggtactaaagttactgtcattagtacatctcgtagtaagagagatgaggcaattgagaggttaggggcggattcatttttggtcagtcgtgaccctgaccaaatggaggctgcaaggggctcacttgatggcatcatcgacactgtctctgcagttcaccctatttttcctctgcttaatttgatgaaaactaatgggaagcttgtgatggttggcgcaccagaaaaaccactagagttgcctgtatttcccttgatttcaggacggaggctagtggcagggagttcgacaggaggggtgaacgagatgcaaaacatgttagatttcgcggcaaagcatagcataacaccagatgttgaagtcgtgccaatggagtatgtgaatacagcattggaacgtctcgtgaaatcggatgtaaagtatcgttttgtgcttgacattggcaatactttgaacaagagttaatatggagacatcttgttttttttgtgtgtttgtattttatgcaagaaaaaaatgcttgtgtacatgtgttcaaaaggg

SEQ ID NO: 2678 - DNA, 1091 bp, Solanum phureja
acaatggaaaaaacacatgaaaatgtaaaggcatttggatgggcagctagagacacttttggggtactttctcctttcaatttttcaagaagggtgactggtgaaaaagatgtgcaattcaaagttgtgtattgtggaatttgtcatactgatcttcatcagctcaagaatgaatggagcaatagtatatatccaatggtacctgggcatgaagttgttggtgtagtaactgaaattggtaccaaagtggagaaattcaaaattggagataaagttggagttgggggtttagtagaatcatgtcgaaaatgtgaaaactgtgacaacgatctggaaaattactgtcgcgatcagatcatgacatacaacggtgtttacaccgatggaaccaccacgtatggtggttactccgatataatggtaacgaacgagcactacgtggtccactggcccgaaaatttaccaatggaagctgctcccctgttatgtgcagggatcacaatttatagtccattgaaatattttggacttgacaaaccgggaatgcacattggtgttgttggtcttggtggacttggacatatggctgtgaaatttgctaaggtgttcgggaccaaagttactgtcattagtacatctcttagtaagaaagacgaggcaattgagcatttaggggcggactcatttttggtcagtcgtgaccctgaccaaatgcagggtgcagcgggatcacttgatggcatcatcgatactgtatctgtgattcaccctcttcttccattgattaatttattgaaaactcgtgggaagcttgcgatgcttggggcgcctgaaaaaccactagagttgcctgtatttcccctgcttttaggaaggaagctagtggcggggagctttataggagggatgaaggagacacaagagatggtagatttcgcggcgaagcatagcataacaccagatgttgaagtcgtgccaatggactacgtgaatacagcatttgaacgccttttgaaatcaaacgtgaagtatcgttttgtgcttgacattggaaacacgttgaacaagaattgagatggggggacatcttg

SEQ ID NO: 2679 - DNA, 1444 bp, Capsicum annuum
gcacgaggcattcttatttttattattttatagctctagttattttctttgtgttttatatctttttttatttggttgaaatggcaaaatccccagaagaagaacatccaattaaggcatttggatgggcagctagagacacttctggtgttctttctcctttcaacttttcaagaagggctactggggagaaagatgtgcaattcaagattttctattgtggaatttgccacacagatcttcattttctcaagaatgaatggggagtcaccagatatcctatagttccagggcatgaaattgtgggggtagtgacagaagttggtaccaaagttgagaaatttaagattggtgacaaagttggtgttggatgtctagtaggatcatgtaaaaattgtgacaattgttcaaatgatcttgaaaattactgtcctaaacaaataatgacatatggtcacccgtaccacgatggcacgatgacctatggtggttactccgatctcatggttgtcgatgagcactttgcagtccgttggccagagaatttgtcgatggaagctgcgccattgttatgtgcagggatcacaacttatagtccattgaaatattttgggcttgacaagcctggaatgcacattggtgttgttggtcttggtggacttggccatatggctgtcaaatttgctaaggcatttggagctaatgtcacagttattagtacttctactggtaaaaaagatgaagcccttcaacatctcggtgcggataagtttttacttagcaacaatcctgagcagattcagggtgcaatgaacacattggatggaattattgatacagtttctgcagttcatccacttttgccattgattggtatgttaaagcctcatggaaaacttgttatggttggtgcagttgcacaaccacttgaagtgccagtgttccctttactcatcatgggaaggaagttaattgctgggagttgcataggaggaatgaaagagactcaagaaatgttagattttgcagcaaagcataacataacaccagatgttgaagtcgtcgcgatggactacgtgaacacagcgttggatcgccttctgaaatccgatgtcaagtatcgattcgtgctcgacattggcaaaacaatgaactctgtttaatctcaacaccattttcttttggttcttgaaaatcattgttgattttcttgctattgtgtctgtgttttttaaagtcttgttttggtatgtttgtgtctttgcttagttggagtttctagtttgtctttgttcacgaatgaatattatgtgtttctctttattgtcgtgttatttttaccacaacttttagccttcatccattggatgttaaagaggaccattggtggagcttataagttgttcatactagtttacgataattttttaacttatcctcgtgc

SEQ ID NO: 2680 - DNA, 2023 bp, Gossypium hirsutum
ggataaacaggaaggagacggagagggagtatcgacggtgatggagatgcgagacatcgatgacctcccaaagaacgccgccaactacatggctttgacgccgttgtggttcttggaacgagccgccacggttcatcccaccagaaaagcggtgatccatggatctcgaacgtacacgtggctccaaacttaccagcgttgccgtcgcttggcttcagctctttcgaaacgctccatcggcgttggtagctcggtagccataattgcaccaaacgttcctgctttgtatgaagctcattttgggattccgatgtctggtgctgttgtaaacaccatcaatattcgcctaaatgcatcaaccattgctttccttttgggtcattcacaatccaccatcgtcattgtggaccaagagtttttcaatttggcggaggatgctttgagaatcatgaaggagaaaagccaaagcaatttcaggcctccgcttgttattgtcattgctgacggaagctgcaacccggaaacacttgagtatgctttggggcaaggagccattgagtatgagaagttcttagaaagtggtgaccctgactttgcttggaagcctcctcaagatgagtggcaaagcattgctttgggctatacttccggcacgacagccagcccaaaaggggtgttattacatcaccgaggggcatatctaatggctttgagtaatcctattatatgggaaatgaatgaaggagctgtatacttatggactctgcccatgttccattgtaatggttggtgttttccttggacacttgcagctgtttgtggaattaacatatgcctccgacaggtaacagcgaagggcatatactcggccatcgcgaagtacagggtgactcacttctgtgctgcacctgtggttctcaattccatagttaatgcctcgcctgaggataccattctgcccctcccccatgttgttcgtgtaatgacagctggtgcagccccacccccttctgtcctttctggaatgtcccagaaaggtttccgagtcacccacacttatggtctctccgaaacctatggtccttctacagtgtgtgcatggaagcctgaatgggactccctaccacctgaaactcaagctcgtctaaatgcacgtcaaggtgtccgatatgttggtttagagtgcctagatgtcattagtactcaaactggtcagcccgtacctgctgatggaaaaaccattggagaaatagtgtttcgcggtaacattgtgatgaaaggctacttaaagaacccgaaagcaaatgaggaaacattcgcaaatggctggtttcactctggggatctgggtgtgaaaaatccagatggatacattgaaataaaagataggtcgaaggacataatcatatcgggaggcgaaaacatcagcagcgtggaagtggaaaacaatctctatttgcaccctgcagtaatggaggcatcagtggtggcgagggcggacgagcggtggggagagtcaccttgtgctttcgttaccttgaagcctggggtagacaaatccgatgaacagcggttagctgaagacataatgaagttctgcaggtccaagatgcctgcatactgggttccaaaatcagtgatatttggtccgctgccaaagacggccacaggtaagattcagaagcatgtgctaagagccaaggcaaaagagttgggacccgtcaggatgagtaagttataacttggcaagttccaaaactaaatgattaggcatctaaatcttgttgttattaacattaaaaagaagataaaaaatgtaggggattcctactagtagtgttgtattttgtactgtttgtgtaggcttgtagcagtattttatgaataaatatttctggtcaagtaatgtttttgcccaagtgtctgaatgtaataatatatatttgattgaatgtgatagataaagaataattaaagtgataggaatgctgttatgaaataatttagtaagcttgaaatacta

SEQ ID NO: 2681 - DNA, 1889 bp, Gossypium hirsutum
acgagcggccagtatcaacgcagagtacatgggagagaaggaagtgaagaaggttcatcgtcgacggtggcgatggaaatgcgagacatcgacaatctgccgaagaacgccgccaactacacggcgttgacgcctttgtggttcttggaacgagccgccaccgttcatcctgctaggaaagcggtggtccatgggtctcgtacttttacttggctgcaaacttaccagcgctgccgtcgcttggcttctgctctctctaacctctccgtcggcttcggtagcacggtagcagtaatcgcgccaaacgtccctgctgcatacgaagctcacttcggaattccaatgtctggtgctgttataaaccctgtcaatattaggctaaatgcatcaaccgttgcattccttttgggtcactctcaatcagccgtcgtcattgtcgaccaagagtttttcactttggcagaggattctttgaaaatcatgaaggagaaaagccaaggcaatttcaagcccccacttttggttgttgttgccgatgaaagctgtgatccgaaaacactcaggtatgctttgggacaaggagctattgagtacgagaagttcttagaaagcggtgaccctgagttttcttggaagcctccacaggatgagtggcaaagcattgctttgaattacacttctggcacgacagccagccctaaaggggtcgtgttacatcaccgtggtgcatatctcatgtctttgagtaatcctcttatatggggcatgaatgaaggagtcatatacttgtggacactacccatgttccactgtaatggatggtgttttacttgggcacttgcagctctttgcggaacaaacctatgccttagacaggtaacagcaaagggcgtctactcagccatagcgaagtatggcgtgactcacttctgtgctgcacctgtggtgctcaattccatagttaacgccccatccgaggacacaattctgccccttcctcatgtggttcacgtaatgacagccggtgctgccccaccctctgctgttctcttcgcaatgtctcaaaaaggtttccgtgtcacccacacatatggtctctcagaaacctatggtccttcaacggtgtgtgcatggaagcctgaatgggactcgttgccacctgaaacccaagctcgcttaaatgcacgtcaaggtgtccgatacattggcttagagggcctagatgtcatcagtagccaaactggtgagcccgtcgccgctgatggaaaaacgatcggagaaatagtgatgcgcggtaatctcgtgatgaaaggttacttaaagaacccaaaagctaacgaggaaacatttgctaacggatggtttcactccggggatctgggtgtgaagcatccagatggctatatcgaaataaaagataggtcaaaagacataatcatctccggaggcgaaaatatcagcagcgtggaggtagaaaatagcctctacttacaccctgcagttttggaggcatcggtggtggcgagggcagacgagcggtggggagagtctccttgtgctttcgtgacattgaagccgggagtagcggataaatccaaggaacaagagttaagtgaggagataatgcagttttgcaggtcaaagatgcctgcttattgggttccaaaatcagtggtatttggtccattgccaaagacagccacagggaagattcagaaacatatattaagaggcaaggcaaaagagttgggacctgtgaagttgagcaagttataacatataagataaggtctcaactacttcaaagtaatacaacattgattgtctctattcacatccgaaactgtaaactactatattttatgtcaattattttaaatttgctactc

SEQ ID NO: 2682 - DNA, 2019 bp, Gossypium hirsutum
acgagcggccagtatcaacgcagagtacatggggatccaaagaaaaaagaatccaacaaataaggaagatcctaagaaagtttagtgaaaatcgacggcgatggcgattagagatatcgacgatcttccgaagaacgccgccaactacacggcgttgacgccgttgtggttcttggaacgagccgctacggttcatccgtccagaaaagcggtggtccatggatctcggacttacacgtggctccaaacttaccaacgttgccgtcgcttggcctcagctctcgctaaacgctccgtgggagccggtagcacggtggctgtgattgcaccaaatatccctgcaacctatgaagctcattttggaattcccatgtgtggtgctgtaataaaccctgtcaatattcgcctaaatgcatccaccattgctttcctcttgggccattcccagtctgccactgtcattgtggaccaagagttcttcactttggcagaggattcattgaaaatcatgaaggagaaaagccaaggccatttcaaccctccacttcttgttgtcgttgccgatgaagcctgcgatcccgaagcacttcgatatgctttgggacaaggagccattgagtacgaaaagttcttagaaagtggtgaccctgactttgcttggaaacctccccaggatgagtggcaaagtatagctttgggttatacttcgggcacaacagccagccctaaaggagtagttttacatcaccgaggggcgtatttaatgtccttgtgtaatcctcttgtatgggggatgaatgaaggagctatatacttgtggactcttcccatgttccattgcaatggttggtgtttcacttgggcacttgcggctctttgtggaacaaacatatgtcttcgacaggtaacagcaaagggagtctactcggccatcgaaaagcatggggtgactcacttctgtgctgcacctgtggtgctcaataccatagttaatgccgcaccagaggacacaattctggccctcccccatgttgttcacgtaatgacagccggtgctgctccgcctcccgctgttctctttgcaatgtctcgaaaaggcttccgagtcacccacacttatggtctctcagaaacttatggtccttctacaatttgtgcctggaagcctgaatgggactcactaccacccgatacccaagctcgtctaaatgcacgtcaaggtgttcgatacactactctagaatgcctagatgtgatcagtaccaaaaccggtgaacctgtccctgccgatggaaaaagcatgggagaaatagtgatgcgtggcaatgtcgtgatgaagggctacttaaagaacccgaaagcaaacgaggagacatttgcaaacggctggttccactctggggatcttggtgtgaagcatcaagatggatacattgaaataaaagatagatcaaaggacatcatcatatctggaggcgaaaacatcagtagcgttgaggttgaaaatagtctatacttacaccctgcagtgttggaggcatcagtggtagctagggccgatgaacagtggggagaatcgccctgcgctttcgtgacattgaagccggaggtcaacaaatcggatgaacagtggttagcagaggacataatgaagttttgcaagtccaagatgcctgcttactgggttcctaaatcagtggtgtttggtccactgccaaagacagctacagggaagattcagaagcatgtgctaagaggcaaggcacaacagctgggacctgtcaaggtgagtaagttataactctgaaaactatattcatataaattttgataaagttgacgattcatgtaagataataaacagattctaacataaaggtgtatcatgtcctgtttaaattatttttcttatcatatcatgtatggtgtaatgtgttgaaagttgcggtattatttttgttccaattgtgattcatattgacttgaagaaagaaattaagttgattcacgtgtgaaatg

SEQ ID NO: 2683 - DNA, 1976 bp, Gossypium hirsutum
aaaaagaatccaacaaataaggaagatcctaagaaagtttagtgaaaatcgacggcgatggcgattagagatatcgacgatcttccgaagaacgccgccaactacacggcgttgacgccgttgtggttcttggaacgagccgctacggttcatccgtccagaaaagcggtggtccatggatctcggacttacacgtggctccaaacttaccaacgttgccgtcgcttggcctcagctctcgctaaacgctccgtgggagccggtagcacggtggctgtgattgcaccaaatatccctgcaacctatgaagctcattttggaattcccatgtgtggtgctgtaataaaccctgtcaatattcgcctaaatgcatccaccattgctttcctcttgggccattcccagtctgccactgtcattgtggaccaagagttcttcactttggcagaggattcattgaaaatcatgaaggagaaaagccaaggccatttcaaccctccacttcttgttgtcgttgccgatgaagcctgcgatcccgaagcacttcgatatgctttgggacaaggagccattgagtacgaaaagttcttagaaagtggtgaccctgactttgcttggaaacctccccaggatgagtggcaaagtatagctttgggttatacttcgggcacaacagccagccctaaaggagtagttttacatcaccgaggggcgtatttaatgtccttgtgtaatcctcttgtatgggggatgaatgaaggagctatatacttgtggactcttcccatgttccattgcaatggttggtgtttcacttgggcacttgcggctctttgtggaacaaacatatgtcttcgacaggtaacagcaaagggagtctactcggccatcgaaaagcatggggtgactcacttctgtgctgcacctgtggtgctcaataccatagttaatgccgcaccagaggacacaattctggccctcccccatgttgttcacgtaatgacagccggtgctgctccgcctcccgctgttctctttgcaatgtctcgaaaaggcttccgagtcacccacacttatggtctctcagaaacttatggtccttctacaatttgtgcctggaagcctgaatgggactcactaccacccgatacccaagctcgtctaaatgcacgtcaaggtgttcgatacactactctagaatgcctagatgtgatcagtaccaaaaccggtgaacctgtccctgccgatggaaaaagcatgggagaaatagtgatgcgtggcaatgtcgtgatgaagggctacttaaagaacccgaaagcaaacgaggagacatttgcaaacggctggttccactctggggatcttggtgtgaagcatcaagatggatacattgaaataaaagatagatcaaaggacatcatcatatctggaggcgaaaacatcagtagcgttgaggttgaaaatagtctatacttacaccctgcagtgttggaggcatcagtggtagctagggccgatgaacagtggggagaatcgccctgcgctttcgtgacattgaagccggaggtcaacaaatcggatgaacagtggttagcagaggacataatgaagttttgcaagtccaagatgcctgcttactgggttcctaaatcagtggtgtttggtccactgccaaagacagctacagggaagattcagaagcatgtgctaagaggcaaggcacaacagctgggacctgtcaaggtgagtaagttataactctgaaaactatattcatataaattttgataaagttgacgattcatgtaagataataaacagattctaacataaaggtgtatcatgtcctgtttaaattatttttcttatcatatcatgtatggtgtaatgtgttgaaagttgcggtattatttttgttccaattgtgattcatattgacttgaagaaagaaattaagttgattcacgtgtgaaatg

SEQ ID NO: 2684 - DNA, 1856 bp, Gossypium hirsutum
gagagaaggaagtgaagaaggttcatcgtcgacggtggcgatggaaatgcgagacatcgacaatctgccgaagaacgccgccaactacacggcgttgacgcctttgtggttcttggaacgagccgccaccgttcatcctgctaggaaagcggtggtccatgggtctcgtacttttacttggctgcaaacttaccagcgctgccgtcgcttggcttctgctctctctaacctctccgtcggcttcggtagcacggtagcagtaatcgcgccaaacgtccctgctgcatacgaagctcacttcggaattccaatgtctggtgctgttataaaccctgtcaatattaggctaaatgcatcaaccgttgcattccttttgggtcactctcaatcagccgtcgtcattgtcgaccaagagtttttcactttggcagaggattctttgaaaatcatgaaggagaaaagccaaggcaatttcaagcccccacttttggttgttgttgccgatgaaagctgtgatccgaaaacactcaggtatgctttgggacaaggagctattgagtatgagaagttcttagaaagcggtgaccctgagttttcttggaagcctccacaggatgagtggcaaagcattgctttgaattacacttctggcacgacagccagccctaaaggggtcgtgttacatcaccgtggtgcatatctcatgtctttgagtaatcctcttatatggggcatgaatgaaggagccatatacttgtggacactacccatgttccactgtaatggatggtgttttacttgggcacttgcagctctttgcggaacaaacatatgccttagacaggtaacagcaaagggcgtctactcagccatagcgaagtatggcgtgactcacttctgtgctgcacctgtggtgctcaattccatagttaacgccccatccgaggacacaattctgccccttcctcatgtggttcacgtaatgacagccggtgctgccccaccctctgctgttctcttcgcaatgtctcaaaaaggtttccgtgtcacccacacatatggtctctcagaaacctatggtccttcaacggtgtgtgcatggaagcctgaatgggactcgttgccacctgaaacccaagctcgcttaaatgcacgtcaaggtgtccgatacattggcttagagggcctagatgtcatcagtagccaaactggtgagcccgtcgccgctgatggaaaaacgatcggagaaatagtgatgcgcggtaatctcgtgatgaaaggttacttaaagaacccaaaagctaacgaggaaacatttgctaacggatggtttcactccggggatctgggtgtgaagcatccagatggctatatcgaaataaaagataggtcaaaagacataatcatctccggaggcgaaaatatcagcagcgtggaggtagaaaatagcctctacttacaccctgcagttttggaggcatcggtggtggcgagggcagacgagcggtggggagagtctccttgtgctttcgtgacattgaagccgggagtagcggataaatctaaggaacaagagttaagtgaggagataatgcagttttgcaggtcaaagatgcctgcttattgggttccaaaatcagtggtatttggtccattgccaaagacagccacagggaagattcaaaacatatattaagaggcaaggcaaaagagttgggacctgtgaagttgagcaagttataacatataagataaggtctcaactacttcaaagtaatacaacattgattgtctctattcacatccgaaactgtaaactactatattttatgtcaattattttaaatttgctactc

SEQ ID NO: 2685 - DNA, 1899 bp, Citrus sinensis
tagagagagagagagagaagagagagagagagagtagtgggctagtggctggcgctgaagaagatagaagatgtcgatggcaaaagacatagacgatcttcagaagaacgcggcaaattacatggcactaacgccgctgtggttcctagatagagcggctacggtgcatcctaccagaacttccgtggtccatggatccaagcgctacacgtggctccagacatatcaacgctgccgtcgtttggcctccgcactgtctaaacgctccatcggcctcggttgcacggtagcaataattgcaccaaacattcctgcaatctatgaagctcattttggagttccaatggctggagctgtgttaaacgctgtcaatattcgtctaaatgcaccaactattgccttccttctaggtcattcagcttctgctgtaattatggtggaccaggagtactttaagttggcagaagaagctttgaagatcatggaagagaaaagcaatggcagatttaagcctccgcttttgatcgtgataggtgatgaaagctgtgatcctaaggatctgaaatatgctttaggaaggggggccgttgagtatgagaagttccttcaaactggggacccgcaatttgattggaaacccccgcaagatgagtggcaaagcattgccctgggatatacttcaggtacaacagctagtcctaagggtgtggtgttgagccacagaggggcatatctcatgtctctgagtgttgctcttatttggggaatgaatgaaggagctgtatacttgtggactttaccaatgttccattgcaatggatggtgttacacttggtcactggccgctctttgtgggacaaacatatgccttcggcaggtaacggccaaggcagtttactcagccatagccaagtatggtgtgactcacttctgtgctgcacctgtggtgctcaacagcatagtcaatgccccatcagaggacactatccttcccctcccccatgttgtgcatgtaaatacagctggtgcagctccacccccttctgttctccatgcgatgtctcaaaaaggctttcatgtcactcacacttatggtctctcagaaacctatggcccttccactgtttgtgcgtggaagcctgagtgggattcattgccacctgaaacccaagcacgcatgaaagcacgccaaggggtccgctttattggtttggagaaattagatgtcattgacactagaactcagcaacctgttcctgctgacgggaaaacaattggagaaatagtgatgagtggtaatgtggtgatgaagggttacttaaagaacccaaaagccaacgaggaaacttttgcaaatggatggtaccatactggcgatcttggagtaaagcatccggataattatatagaaatcaaagacagatcaaaggacattatcatctccggaggtgaaaacatcagtagcgtggaggtagagaacatgatgtacttgcacccggcagttcttgaggcatctgtggtggcaagggcagatgagcgttggggagagtctccttgtgctttcgtgacgttgaagccagaagtggataaatccaacgagcaacaactggcagaggatataatgaagctttgtcgggcaaaaatgcctgcctactgggttccaaagtcaatagtatttggaccattgccaaaaactgctactgggaagattcagaagcatgtgctaagggctaaggcaaaagagatgggacctgttagaaagagtaagctttaatccaatgatgatcacaaaaaaaaaaaagaaacaaatgcttcttgttttttcaattgccattatagaaggattttaatcttcaatagaataaagctgtaagttaatacacactatttattcaaatt

SEQ ID NO: 2686 - DNA, 1919 bp, Citrus sinensis
ggcaaaactctggatgttatagagagagagagagagagagagagaagagagagagagagagtagtgggctagtggctggcgctgaagaagatagaagatgtcgatggcaaaaggcatagacgatcttccgaagaacgcggcaaattacatggcactaacgccgctgtggttcctagatagagcggctacggtgcatcctaccagaacttccgtggtccatggatccacgcgctacacgtggctccagacttatcaacgctgccgtcgtttggcctccgcactgtgtaaacgctccatcggcctcggttgcacggtagcaataattgcaccaaacattcctgcaatatatgaagctcattttggagttccaatggctggagctgtgttaaacgctgtcaatattcgtctaaatgcaccaactattgccttccttctaggtcattcagcttctgctgtaattatggtggaccaggagtactttaagttggcagaagaagctttgaagatcatggaagagaaaagcaatggcagatttaagcctccgcttttgatcgtgataggtgatgaaagctgtgatcctaaggatctgaaatatgctttaggaaggggggccgttgagtatgagaagttccttcaaactggggacccgcaatttgattggaaacccccgcaagatgagtggcaaagcattgccctgggatatacttcaggtacaacagctagtcctaagggtgtggtgttgagccacagaggggcatatctcatgtctctgagtgttgctcttatttggggaatgaatgaaggagctgtatacttgtggactttaccaatgttccattgcaatggatggtgttacacttggtcactggccgctctttgtgggacaagcatatgccttcggcaggtaacggccaaggcagtttactcagccatagccaagtatggtgtgactcacttctgtgctgcacctgtggtgctcaacagcatagtcaatgccccatcagaggacactatccttcccctcccccatgttgtgcatgtaaatacagctggtgcagctccaccgccttctgttctccatgcgatgtctcaaaaaggctttcatgtcactcacacttatggtctctcagaaacctatggcccctccactgtttgtgcgtggaagcctgagtgggattcattgccacctgaaacccaagcacgcatgaaagcacgccaaggggtccgctttattggtttggagaaattagatgtcattgacactagaactcagcaacctgttcctgctgacgggaaaacaattggagaaatagtgatgagtggtaatgtggtgatgaagggttacttaaagaacccaaaagccaacgaggaaacttttgcaaatggatggtaccatactggcgatcttggagtaaagcatccggataattatatagaaatcaaagacagatcaaaggacattatcatctccggaggtgaaaacatcagtagcgtggaggtagagaacatgatgtacttgcacccggcagttcttgaggcatctgtggtggcaagggcagatgagcgttggggagagtctccttgtgctttcgtgacgttgaagccagaagtggataaatccaacgagcaacaactggcagaggatataatgaagttttgtcgggcaaaaatgcctgcctactgggttccaaagtcaatagtatttggaccattgccaaaaactgctactgggaagattcagaagcatgtgctaagggctaaggcaaaagagatgggacctgttagaaagagtaagctttaatccaatgatgatcacggaaaaaaaaaaacaaatgcctcttgttttttcaattgccattatagaaggattttaatcttcaatagaataaagctgtatgttaatacacactatttattca

SEQ ID NO: 2687 - DNA, 1919 bp, Citrus clementina
ggcaaaactctggatgttatagagagagagagagagagagagagaagagagagagagagagtagtgggctagtggctggcgctgaagaagatagaagatgtcgatggcaaaaggcatagacgatcttccgaagaacgcggcaaattacatggcactaacgccgctgtggttcctagatagagcggctacggtgcatcctaccagaacttccgtggtccatggatccacgcgctacacgtggctccagacttatcaacgctgccgtcgtttggcctccgcactgtgtaaacgctccatcggcctcggttgcacggtagcaataattgcaccaaacattcctgcaatatatgaagctcattttggagttccaatggctggagctgtgttaaacgctgtcaatattcgtctaaatgcaccaactattgccttccttctaggtcattcagcttctgctgtaattatggtggaccaggagtactttaagttggcagaagaagctttgaagatcatggaagagaaaagcaatggcagatttaagcctccgcttttgatcgtgataggtgatgaaagctgtgatcctaaggatctgaaatatgctttaggaaggggggccgttgagtatgagaagttccttcaaactggggacccgcaatttgattggaaacccccgcaagatgagtggcaaagcattgccctgggatatacttcaggtacaacagctagtcctaagggtgtggtgttgagccacagaggggcatatctcatgtctctgagtgttgctcttatttggggaatgaatgaaggagctgtatacttgtggactttaccaatgttccattgcaatggatggtgttacacttggtcactggccgctctttgtgggacaaacatatgccttcggcaggtaacggccaaggcagtttactcagccatagccaagtatggtgtgactcacttctgtgctgcacctgtggtgctcaacagcatagtcaatgccccatcagaggacactatccttcccctcccccatgttgtgcatgtaaatacagctggtgcagctccaccgccttctgttctccatgcgatgtctcaaaaaggctttcatgtcactcacacttatggtctctcagaaacctatggcccctccactgtttgtgcgtggaagcctgagtgggattcattgccacctgaaacccaagcacgcatgaaagcacgccaaggggtccgctttattggtttggagaaattagatgtcattgacactagaactcagcaacctgttcctgctgacgggaaaacaattggagaaatagtgatgagtggtaatgtggtgatgaagggttacttaaagaacccaaaagccaacaaggaaacttttgcaaatggatggtaccatactggtgatcttggagtaaagcatccggataattatatagaaatcagagacagatcaaaggacattatcatctccggaggtgaaaacatcagtagcgtggaggtagagaacatgatgtacttgcacccggcagttcttgaggcatctgtggtggcaagggcagatgagcgttggggagagtctccttgtgctttcgtgacgttgaagccagaagtggataaatccaacgagcaacaactggcagaggatataatgaagttttgtcgggcaaaaatgcctgcctactgggttccaaagtcaatagtatttggaccattgccaaaaactgctactgggaagattcagaagcatgtgctaagggctaaggcaaaagagatgggacctgttagaaagagtaagctttaatccaatgatgatcacggaaaaaaaaaaacaaatgcctcttgttttttcaattgccattatagaaggattttaatcttcaatagaataaagctgtaagttaatacacactatttattca

SEQ ID NO: 2688 - DNA, 2052 bp, Vitis vinifera
atattcacaaccgaggagaggtagatagtgagggtttagagaagatggtggtggagcgcgacatagatgatctaccgaagaacgcagcgaactacacggccttgactccgctgtggtttctggagagagcagctgtggtgcatcccaacaggaagtcagtgatccatggatctttgcagtacacgtggctccagacttatcagcggtgccgccgattggcttccgctctttctaagtattccatcggcgccggcagtacggtagcaataattgcaccaaacatccctgccatgtatgaagctcattttggggttcccatgtctggagcggtggtgaactgtgttaacattcgtctaaatgcaccgacaattgctttccttcttgagcattcatcggcagcagttgtaatggtggatcaagagtttttcccattagcagaggaagctttgaaaatctggtcagggaaaagcaaaaatgattttaagcctccccttctgatcgtcatagctgatgaaagctgcgatcctaaaggactagaatatgctttgaggaaaggggccattgaatatgagcagttcctggaaacaggagaccctgaatttgcatggaaaccaccacaggatgagtggcagagtattgctttagggtatacttctggaactacagccagccctaagggggtagtgttgcatcataggggagcatatgtcatggccctcagtggtgctcttgtatgggggatgaatgaaggagctgtgtacctatggacacttccaatgtttcattgtaatggctggtgtttcacttggacacttgctgctctttgtgggactaacatatgccttcgtcaggttgcaaccaaggcaatttatcaagccatagccaacgatggtgtaacccacctctgtgctgcaccagtggtcctcaacagcatagtcaatgcccccaaaagtgaaaccatccttccccttccacgcgtggtccatgtaatgacagctggggctgctccgcccccttctgttctctttgccatgtcccaacaaggctttcgtgtcacccatacctacggactctcagaaacctacggcccctccacagtatgtgcatggaagcctgaatgggatgaactaccacctgaaactcaagcccgtctcaatgcacgccaaggtgtccgatacatcggcttggagggcctagatgtggtcagcaccacagacatgaagcctgtccctgccgatggaaccaccattggtgagattgtgatgcggggtaatactgtgatgaagggctacttaaagaacccgaaagccaacgaggaaacttttgcaaatggatggttccattcaggtgatcttggcgtgaagcatccagatgggtacatacaacttaaggaccgatcaaaagacatcatcatctctggaggcgaaaacataagcagtgtggagattgaaaatgctgtatacctgcaccctgcagtgctagaggcatcagtggtggcaaggccagatgaccgctggggggaatcgccttgtgctttcgtgacgttgaagccaggggttgataggtccgatgaaagacgcctggcagaagatattatgaagttctgccggtccaagttgccggcttactggattccaaaatctgtggtgtttggaccattgcccaagacagccactgggaagatacagaagcatctgctgagggccagggcgaaggagatgggaaccctaaagaagagcaagctgtagtaatctctcagggtagtccatgaatgaataaaaagagggatcttcttgttgccggttagtctccctcgtactctgttaattcattcagttcgggctataggatttgtggttgggctactaatatggttatgcatttgaagaaaaatacttctctcatattcaccttccccaattgggactatcatgtactgttacttatttaggaactcgtttggacgactgagccaaagaccggatcaaaaagcccaccattaatgatcaacatttcaatattctatttataaagtcaatttcaaaatacata

SEQ ID NO: 2689 - DNA, 2002 bp, Arachis hypogaea
gaaagagcaagagcgaggtgcagtgcataggcgacgatggtggcgcgcgacatagacgaattgcccaagaacgctgccaactacacagcgttgacgccgctgtggttcctggagagagcagctcaggtgcaccccaccagagcctccctcatccatggatcccgtcgctacacgtggcaacagacttaccaccgttgccgtcgattcgcatctgctctcaacaatcgttccatcggtctcggcaacaccgttgctgttattgcacccaacattccagctctgtatgaagctcattttggaattccaatggcaggagcagtattgaaccctgttaacattaggttgaatgcatccaccatagcattccttcttggtcattcctccgcatcagcggtaattgtggatcaagagttctttaccttagcagaggaagctttgaaaatatggtctgataaaaccaaaggcttcaagcctccacttttagttgtgattggtgatgagaactgtgatcctaagcaactaagatatgctaagggaaaaggagcaattgaatatgaggattttcttgagagtggtgaccctggatatgcatggaaacccccggaggatgagtggcaaagtattgcattaggttacacttctggtacaactgctagtcctaagggtgtggtgttacaccatagaggagcatatcttatgtctctaagtggtgctgttatttggggaatgaatgaaggagctgtgtatctttggacactacctatgtttcattgcaatggttggtgctacacttggacccttgctgctttatgtggtactaacatatgccttcgtcaggtagcagctaaggcagtgtatgaagccattgccaagtacaaagtgactcatttttgtgcagcaccagtggttctcaatacaatagtgaatgcaccacccgaagacaccatccttcctctgcctcatgttgttcatgttaatacagctggagctgctcctcctccttctgttctggccgcaatgtcccaaagaggatttcgcgtcactcacacttatggcctctcagaaacctatggcccctccacagtctgtgcctggaagccagagtgggaatcgcttccccctgaaacccaagccaggctcaacgcaaggcaaggggttcggtacattggcttggaaggcctagaagtggttaacacaacaacaatgcaacctgttcctgctgatggcaaaaccattggcgagattgtgatgcgtggcaatgttgtgatgaaaggatacttaaagaatcccaaagccaatgaagagacctttgcaaatggatggtttcactcgggtgatctcgccgtaaagcacccagatggatacatagaaatcaaggacagatcaaaggacataatcatctcgggtgctgagaatatcagcagtgtggagattgagaatgttatgtatacacaccctgcaattcttgaggcatcagtggttgcaagaccagatgagaaatggggtgagtctccttgtgcttttgtgacattgaagccaggagtggatgctagcaacgagcagcgtcttgttgaggatataatgaagttctgtagggccaagatgcctgcttattgggtcccaaaatcagtggttttcggacccttacctaagacagctactgggaagattcagaagcatttgctgagggccaaggctaaagagatgggacctgttaagatcagcaagttgtaagtcacattataacagagatcatgacgaaataaacgttgctattagtccttgctttgtgttttcaagaatgtactaattagttaaggtttctttgtcataataattagtgtacaccttttataaattaaactcgtgtaataataataataataacaataataaatgtaagtttattgaaaatgataagtttaaattaagaagttatgtatttaagtattgaaaataataatttttttgtgatgaactatatataataatggtttagtaa

SEQ ID NO: 2690 - DNA, 1964 bp, Manihot esculenta
gctcgccatttgacagatcgagggagagagagagagtgagagagagagagagagagagagagagaggagtgctgattatggcgagagacatcgatgacctaccaaagctcgaagctaaccatatggccttgacgccgctgtggttcctcgagagagcagctacggtgcaccccaccagaacagccgttgtccatggatcagttcactatacgtggcagcagacctaccaacggtgccgtcgattggcctctgctctttccaagcgcaacatcggcgccggaagcacggtagcaacaattgctccaaatgtcccagccatgtatgaagctcattttggaattccaatggctggcgcagtgttaaatactgtcaatattcgtctaaacgcatcaaccatcgctttcctgctgggccattcaaaatctgcaattgtgatggtggaccaagagttctttcccttagcggagaatgctttgaaaattttagcagagaaagatagccattataaccccccattgttgatcgttatagctgatgaaagttgtgatcccaagtcgctcaaggacgctttgggaaaaggggccattgaatatgacaagttcctggaaagtggtgaccccgactttgcttggaaaccaccagaagatgagtggcagagtattgctttgggttatacttcgggcacaacagccagtcccaagggggtagtgctcagccatcgaggggcatatctaatggctttaagttgtgctatgatatggggtctcaatgaaggagctatttatctgtggactttgcccatgttccattgcaatggttggtgttacccctggtcgcttgcggctctttgcgggacaaatatctgcttgagacaggtcacagccaaggcagtctattcggccattgccaaccaaggtgtgactcacttctgcgctgcacctgtggtgctcaacaccatagtaaatgctccgaacgaagagactatccttcccttacctcgcgttgtccatgtaaacacagctggtgctgccccacccccctctgttctctttgcaatgtcagagaaaggcttccgggttacccatacatatgggctctcagaaacttacggtccatccactgtgtgtgcatggaagcctgagtgggactcactacctcccatcaaacaagcccgcctcaacgcacgccaaggcgtgcgatatataggcttggagggcctagaagtagttgacactaaaactatgaaacctgtacctgcagatggaaagaccatgggagaaatagtgatgcgaggaaatcttgtaatgaagggctacttaaagaatccggaagctaacaaagaagcctttgcaaatgggtggtttcattctggtgatctcgctgtgaagcatccagatgggtatatagaaatcaaggatagaagcaaggacattatcatttcaggaggtgaaaacattagtagcttggaagtagaaaatgtgctatatacgcacccagcagtgtatgaagtatctgtggtagccagagaagatgagcgatggggagagtccccctgtgcttttgtcacattgaaaccaggcatggagaaatctagtgaaggaagtttggcagaagatataataaagttttgtcggtcgaaaatgcctgcttactgggttccaaaatctgttgtatttggaccattgccaaaaactgctactgggaagattcaaaagcatgtgttaagggccaaggcaaaggagatgggacctgtcaaaaagagcaggttatagaaaatagtgtattctgatggcctgaataaggataactccttttgaatagccaatgtggtatgggtttagttcctcacaaggcttctgcagaagtaggattatctattattgttcgcttatttctgttgtaaattaagccattaatatggatttctctattttatgttgaaataaaggtagtttataatacgt

SEQ ID NO: 2691 - DNA, 1938 bp, Tropaeolum majus
acaagagtttcaattcaggctcacgagctgtattacaacggcagcaaaatttcatttccgaaaaaagagagtagggatggcgacgatgtggcgagacatagacgatcttccaaaaaacgcggccaattatacggcgttgacgccactttggttcctggagagagcggctaaggttcaccccaccaggccgtcggtgattcatggatctctgcagtacacgtgggaacagacttaccagcggtgtcgacggttagcctccgctctaagtaaccactccatcggtcccggcaaaacggtagcaataattgcaccaaatattcctgctatgtatgaagctcattttggagtaccaatgtctggagcggtggtaaactgcgtcaacatacgtctaaatgcacaaaccattgctttccttttaggtcattcaggaactgaagtgctaatggttgatcaagagtttttcccttggcagagaatgccttgagaaccattaaagaggaaaaaaagatagcttcaagcctccacttttgattgtcattccggatgaaagctgtgatcctaaggtattccgtgatgctttgggcaaaggagctattgattatgagaagttcctggaaagtggtgatcctgagtttgattggaaaccaccagcagatgagtggcagagcattgcgttaggatatacttctggtacgacagctagtccaaagggggtggtgttgcaccacagaggggcatatctcatggccttaagtgatgcacttgtgtggggaatgacagaaggagctatatacttgtggactcttcccatgttccattgcaacggttggggttatccttggtctcttgcagctctttgtggtactaacatatgccttcgacaggtaacagcgaagggagtttattcagcaattgcaaagtatggtgtgactcacttctcagcagcacctgtggtgctcaacaccatagttaatgcgtcaccagaggaaacaattcttccccttccccatgttgtgcacgtaactacagctggtgctgccccaccaccttctgtcctcttcgcaatgtctcagaaaggcttccgagtcacccacacttacggactgtcggaaacttatggcccttcaaccgtatgcgcatggaagcccgagtggaattcactcccacccgaaactcaagcccgcctcaatgcacgtcaaggtgtccgctttataggcttggagggtctagatgttattgacacccaaactgcaaaacctgtcccagcggacgggaaaacaattggagagatagtaatgcgcggaaacattgtgatgaaagggtacttaaaaaacccaaaagccaatgaagaggcctttgcgaacgggtggtaccattctggtgatctggctgtgaagcatccagataactacattgaaattaaagacaggtctaaggacattatcatctccggaggcgagaacattagtacggtggaaatagaaaatactttatacctacatcccgcagtattggaggctgcagtggtggctagaccacatgagcgttggggtgagtccccttgtgctttcgtgacattgaagccaacatcagatgcatctgataaacaaaacttggcaaaagatataatgagcttttgccgatcaaagttgcctgcttactgggttccgacatcggtagtattcgaaccgttgccgaaaactgctactgggaagattcaaaagcatttgctgagggctcgggccaaagaaatgggacctgtcaaaatgagcaaattatagtttgtgcatagcccaactggttttgtaagtgtctacaatacgctaaaacgttgtgcactcttatatgcatgttttgaaataagtacttctaggagtattcatcatttctatgaaactaagatgtatttttcctatcgatgaaatgattgcattaggt

SEQ ID NO: 2692 - DNA, 2132 bp, Fragaria vesca
ctcatgttgtcagctccttccttcacttcaaaagagaattccagagagagagagagagagagagcgagcagaaatggtggcggagcgagacatagacgatctgccgaagaacgaggcgaactacacggcgttaactccgctgtggtttctggagagagcagctgtggtgcatcccaccaggaaatctgtggtccatggatctcttcactacacatggctccagacttaccagcgctgccgccgtatggcctccgctctcaacagccactccgtcggcctgggttgcacggtatcaataattgcaccaaatgtcccagcgctttatgaagctcattttggagttccaatggcaggagctgtgataaacactgtcaatatccgtctaaatgcatcaacaattgctttccttcttggtcattcagcatctgtagttgtgatggtggatcaagaatttttccccttagtcgaggaggctttgaagatttgggcagagaaaagcaaaggccaattcaagcctccactcttaattgtcattggtgatgaaagcttagatcctaagggactcaaatatgctgtgggaagaggtgccattgaatatgagaagttcttggaaactggtgaccctgagtatgcttggcaaccaccaaaggatgagtggcaaagtatcgctttgggttatacttctggaacaacagcaagccctaaaggggttgttttgcaccaccgtggggcgtatttgatgtctttaagtggtggtcttgtctgggagatgaatgaaggagctgtatatctgtggactctacccatgttccattgcaatggttggtgttacacttgggcacttgcagctctttgtgggacaaacatatgccttcgacaggtttcagccaaggcagtctattcagcgatacacaagtatgctgtgactcacttttgtgctgcgcctgtggtgctcaacaccattgtcaatgctccacaagacgagactatcctccctcttcctcatattgtacgcgtaatgacagctggtgctgcccctccaccttctgttctgtttggaatgtcccaaagggggtttaaagtcacccacacttatggtctgtccgaaacttatggcccctccacagtgtgtgcatggaagcctgagtgggactcccttccccctgaaagccaagcacgattaaatgcgcgtcaaggtgttcggtacattggtttggagggactagatgttctgaaccctcgcactatggaacctgttcctgcagatggaaaaaccgtgggagagataatgatgcggggtaatcttgttatgaagggttacttaaaaaacccgaaggctaatgaggaaacttttgctaatggatggtttcattctggtgatcttgccgtgaaacatccagattcatacatagaaatcaaagacagatcaaaagacattatcatatcaggaggtgagaatatcagtagcgtggaggtagagaatactttgtatcagcacccagccatattggaggtatcagtggttgcaaggccagatgagaagtggggagagtctccttgtgcttttgtgacattgaagtcaggtgtgaataagtccgatgaaaagcgtgtagcagaagatataatgaagttctgccgggaaaagatgccggcttattgggttcccaaatctgtggtgttcggaccattaccaaagacagctactggaaagatacagaagcatttgctgagggcaaaggccgaagagttgggacctgtcaagaagatgagcaagttataaactgtatgatgatgtttgtcatttgtgcaaaagccaataagagcttgcagcatttgtgtcaatgttaatattgggtcacttggactacatgaaatgaaatgggtattttcaggatggatcatgagacttgaaatgtatacagatcacatcgagtggtttgcaaactattcagagagatgatagtgtgcaacaaagcccaatattgtcatgttgatccggactagagtgtaaattaacgatttttcattcctttgtctcttaactttgtgaaaaactcttttaccttgttctgtaaacaatggaaaaatagaaaacgattgaagggaaacgaagataatgcttgtggttgctt

SEQ ID NO: 2693 - DNA, 2233 bp, Eucalyptus grandis
cgtgcgttagtctcttcactcaccaccttgcaccgagagagaaagggagagagagagatggcgagggacatcgacgatctgccgaagaacgccgccaactacacggccctgacgccgctgtggttcctcgaccgggccgccacggtccacccgggccggcggtcgctcgtccacggctccgtcaccttcacctggcgccagacctaccagcggtgccgccgcctggcctccgccctgtccaggcgatccatcggcctcggcaactcggttgcagtgattgcgccgaatgtccctgccttgtttgaagctcattttggggttccgatggctggagctgtcgtaaatgctgtcaatatacgcctgaatgcagcagctgttggttttctcctcggccattcatcttctgaagtcgtaatggtggaccaagagttcttccccttggctgaggaagctctgaaaatagtagcggagaagagtgataaaaattataagcctccacttctgattgttatagcggatgaaagctgtgacccaagaacacttacgcatgctttaggaaaaggggcaattgaatatgagaagtttttggaaaccggagatccggagtttgcttggcaaccaccggaagatgagtggcagagtatcgctcttggttatacttcgggtacgactgccagtccgaagggagttgtattacaccatcgaggagcatatctcatgtctataagtgctcctctagtctgggggatgaatgaaggagccatttacttgtggactttgcctatgtttcattgtaatggttggtgtttcacctggggactggcagccttttgtgcaaccagcatatgccttagacaggtaacagctaaggcagtctattcggctatcgccaaatatggcgtgactcacttctgcgctgcgccggtggttttgaacacaatagtcaatgccgcgcctgaagacaccatactccctctccctcacacagttcatgtaatgaccgctggtgccgccccacccccttctgttctctttggaatgtcccaaaaaggcttccgtgttgcgcacacatatgggctctctgaaacgtatggtccttccaccatctgtgcatggaagcccgagtgggattcgctgcctccagaagagcaagcccgcctcaattcacgccagggcgttcgttacacaggtctggaaggtcttgaagttttaagcactcaagacatgaagcccgttcctgctgacgggaaaaccgtaggagagatagtgatgcggggcaacgttgtgatgaaaggctacctgaagaacccaaaagccaacgaggagtcttttgcagggggatggtaccattctggagatcttggtgtcaaacatcctgacggatacattgaaatcaaggacaggtcaaaggacatcatcatctccggaggcgaaaacataagcagtgtagaggtcgagaatgctctatacacgcatccagcgattttagaggtatctgtggttgccaggcctgatgtccgatggggggagtctccttgtgcctttgtgacactgaagccgggagtggataaatccgatgagcggcgactggcacaggatataatgaagttcagccgggagaaactaccggcttattgggttcctaagtcagtcgtcttcgggccattgccgaaaacggctacgggaaagatacagaagcatgtgctgagggccaaggcaaaggaaatgggacctgtcaagaccagtaaattatgagtgcgccatggtcgagctggttttagtcacttctcttcgtcagtactttgaagaagcctgctttgcatgcaaatctttaataacggaacaccttccttcctacttttcttgagaaaaaactattcattttcctgatgatactgttggatttggaatattgtcggagctaattccaggtcgccaagcctgactttgcaaaagggtaagaattgggccttagagatggccgaccttcaaggaaggtgaactagtgtacaagtccatgtcgttttcgctggaaatggggttgggttttgccttcccatctctctcatcaagtcaatggataagccttagccagaaaatgatacacaggtgaataaacatcgtctagacgaaagaatgcttattagtcttgccggctaccaatcgggtgtcgacactttgatattatgaattcaattggattgtagactttttcataaccatatgtgcacaa

SEQ ID NO: 2694 - DNA, 1929 bp, Eucalyptus grandis
atacgaagcaagagcgcatggactgaaccagtctccgacccgccaccgcacttctagagagagagagagagagagggaggaggaggaggagcgatggcgagggacatcgacgacctgccgaagaacgcggccaactacacggccctgaccccgctgtggttcctcgaccgggccgccacggtccacccggaccggcggtcgctcgtccacggcgccgtcgccttcacctggcgccagacctaccggcggtgccgccgcctggcctccgccctctcccggcgctccgtcggcctcggcagcacggtcgcagtgattgcgccaaatgtccctgccttatttgaagctcattttggagttccaatggctggagctgtagtaaattgtgtcaatatacgtctgaatgcaccaacagttgcttttcttcttggccattcatcttctgcagtcataatggtggaccaagagttcttccctttggctgaggaagctctgaaaatattagcagaaaagagtgataaaaattataagcctccacttctgattgttatagctgatgaaaactgtgacccaagaacactaaagtatgctttaggaaaaggggcaattgaatatgagaagtttttggaaactggagatccagagtttgcttggaaaccaccagaagatgagtggcagagtattactctcggttatacatctggtacgactgccagtcccaagggagttgtattgagccatcgaggagcatatctcatgtctgtaagtggccctcttgtctgggggatgaatgaaggagccatttacttgtggactttgcctatgtttcattgtaatggttggtgtttcacctggtcactagcagctctctgtggaaccagcatatgccttagacaggtaacagctgaggcagtctattcggctatcgccaaatatggcgtgactcacttctgtgctgcacccgtggttttgaacacaatagtcaatgccgcagctgaagaaacaatactccctctccctcacaccgttcatgtaatgacagctggtgccgccccacccccttctgttctctttgcaatgtcccaaaaaggtttccgtgttacgcacacatatgggctgtctgaaacttatggtccttccaccatctgtgcatggaagcccgagtgggattcgctgcctccagaacagcaagcccgcctcaatgcacgccaaggcgttcgttacacagctctagaaggtcttgatgtcgtgagcactcaagacatgaaacccgttcctgccgatggtaaaaccgtaggagagatagtgatgcggggcaacgctataatgaagggctacttaaagaacccaaaagcaaacgaggagacttttgcagggggatggttccattctggtgatcttggtgtgaaacatcctgatggatatattgaaatcaaggacaggtcaaaggacatcatcatctccggaggcgaaaacataagtagcgtagaggttgagaatattttatactcgcatccagcgattttagaggtatctgtggttgcaaggcctgatgtccgatggggagagtctccttgtgcatttgtgacgccgaagccgggagcgaataagtccgatgagcgccgactggcggaggatataatgaagttttgccgggagaaaatgccggcttattgggttccaaagtctgtcatcttcgggccattgcctaaaacggctacgggcaagatacagaaacatgtgctgagggccaaggcgaaggaaatgggacctgtcaagtacagtaaattatgagtgcaactgggtcgagcttctttagtctcttctgcttgttagtactatgaagccaggagtactttgcgtgtaatctttaataatggtacaccttcctacttttctcgagaaaactagtaatcttcctgatgataccgt

SEQ ID NO: 2695 - DNA, 2113 bp, Prunus persica
atgctcgtagtagcaacaagcaagaaaaataaaagcagtctaaaccttgaacacgtgcttctttctcataactctgaatttctgagagagagagagagagagattagaggaggtgcaggagagatggtggtggagcgagacatagacgatctgccgaagaacaacgcgaactacacggcattaacgccgctgtggtttttggagagagcagctgtggtgcatcccaccagaaaatcggtggtccacggatctcttcactacacgtggcagcagacttaccagcgttgccgccgtttggcctccgctctttccaagcgctccatcggccttggcaccacggtgtcaataattgcaccaaatatcccagccatctatgaagctcattttggagttccgatggcaggagctgtgttaaatactgtcaatgtccgtctaaatgcaccaacaattgctttccttcttggtcattcatcgtctgtagttgtcatggtggatcaagaatattttcccttggcagaggaagctttgaaaatttgggaagagcaaagcaaaggccattacaagcctccactcttaattgttataggtgacgaaaattgtgatcctggggcactaaaaagtgctttgggaagaggcgccgttgaatatgagaaattcttggaaagtggtgaccctgagtatgcttggaaaccaccagaggatgagtggcagagcatttctctgggttatacttctggcacaacagccagtcctaagggggtggttttgcatcaccgtggggcttatctgatggctttgagtggtcctcttgtatgggggatgactgaaggagctgtatatctgtggactctacccatgttccattgcaatggttggtgtttcccttggtcagttgcagctctttgcgggacaaacatatgccttcgacaggttacagcaaaggcagtttattcagctatagccgagtatggtgtgactcacttttgtgctgcacctgtggtactcaacaccatagtcaatgctccaccagatgagactatcctgccgctccctcatgttgtacacgtaatgacagctggtgctgcccctccaccctctgttctccttgcaatgtcccaaaagggcttccgagtcactcatacttatggtctgtctgaaacttatggcccctccacagtatgtgcttggaagcctgagtgggacttactttcccctgtaacccaagcacgacttaatgcacgtcaaggtgttcggtacattggtttggagggcttggatgttttcaaccctcagactatgcaacctgttcccgcagatggagctaccatgggagagataatgatgcggggaaaccttgtaatgaaggggtatttaaagaacccaaaggtgaatgaggaagtttttgcgaatggatggtatcatactggggatcttgctgtgaagcatccagatgggtacatagaaattaaagacagatcaaaggacattatcatctctggaggtgagaacatcagtagtgttgaggtagagaatactctatatcaacacccggccatatttgaggtatcagtggttgcaaggccacatgagaagtggggagaaactccttgtgcttttgtgacattgaagccgggtgtcgataagtctgacgaaaagcgtctggcagaagatataattaacttctgccggtccaagctacctgcttattgggttcccagatcagtggtatttggaccattgccaaagacagctaccggaaagatacagaagcacttgctgagggccaaggccaaagagctgggacctctcaagatgagtaagttataaaactgtatgatgttggtcattgtacaaaagcgctaataaaggattgcactgtaattagtgccgagctaggattgttagactcttctgtccttattggcattaatgatgtgactgaaacttgtcttatacagactatgaactaggaaattagattgagatttctctccaagtttgatttgtggctggcttatccagttattagtcgtctatattgacaaactcccaggttaatccccttttttcaaatgtcttattcatagaaaataaacgtttgtgattgtataaa

SEQ ID NO: 2696 - DNA, 1976 bp, Castanea mollissima
agagagagagagagagtggtggtgatgggtcaagacatcgacgatttgccaaaacatgcagccaacttcacagctttgacgccgctttggtttttggacagagctgctttggcacaccccgacaaaacttcactcctccatggatctctacgctacacgtggcgtgacacgtacaaccgttgccgtcgattggcctcttctctctccaaacactccatcggcctcggttccacggtagccgtaattgcaccaaacatcccagccctgtatgaagctcattttggaattccaatggctggagctgttctaaatgctgtaaatattcgtctaaatgcatcaaccattggtttccttcttggtcattcattagctgctgtagtgatggtggatcaagagtattttggcttagcagaagaagctttgaaaatctgggcagagaaaagcagaagtttcaagcctccacttctgatagtcataggtgacaaaaactgtgaccccaatggactcaaatacgctttaggaagaggggctattgaatatgagaaattcctggaagctggtgatcctgagtttgcttggaaaccaccagaggatgagtggcagagcatttctttgggttatacatctggtactactgctagtcctaagggggtggtgttacatcacaggggggcatatatcatggctatgagtaatcctattatctgggggatgaatgacagacctgtatacctatggactctgcccatgttccattgcaatggttggtgtttcccttggactcttgctgctatttgtgcgacaagcatatgccttcgccaggttaaggctaaggaaatctattcagccatagccaaacatggcgtgacacacttttgtgctgctcctgtggttctcaacagcatagttaatgctccacctgaagaaactatccttcccctccctcatactgttcatgtaatgacagctggtgcagcccctcccccttctgtcctcctttcaatggctgaaaaaggcttccgtgtcacacacacttatggtctctcagaaacctatggcccctccactgtttgtgtgtggaagcctgagtgggactctctaccccctgtaacccaagcccgtctaaatgcacgccaaggtgttcggtatgttggtttagagtgcgtagatgttgtcaaccccaaaacaatgcaacctgttcctgctgatggaactacagttggggagatagtattccggggtaatgttgtgatgaagggctacttaaagaacccaaaagcaaatgaggaggcttttgcaaatgggtggtaccattctggagatcttgctgtaaagcatcaagatggatatatagaaattaaagatagggccaaagacatcattatatctggaggtgaaaatatcagtagtgtggaggtagaaaatgctttatacttgcacccagcgatttttgaggtatcagtggtggcaaggccggacgagaggtggggtgagtctccttgtgcttttgtgacattgaagcctaatgtagataaatcggacgagcagcgattggcggaagatataataacgttctgcaaatctaagttgcctgcttattgggtaccaaagtcggttatatttggaccattaccaaagacagctactgggaagatacagaagcatttgctgagggccaaggcaaaagagatggggcctgtcaggaatagtaagctatagctctcgatggtgactgtagaaagaaagaagaataagagactgctttcagttcttaacatgtttttcttttgatggtttgtacttgttgcatccaatcctaaaatctctttgtttctatttataagtgccaaatgttgtgctggcagattgtaagaaattagctggtattcagcaaaacgttatcctaatctggtactgtaataactttgaagacttccatgatgggtattaaaaaaaaacattattgcatactgtta

SEQ ID NO: 2697 - DNA, 1959 bp, Ricinus communis
gcactctttatgtcactcaccactggaaaaggtcgaataaccactgatataaataacaaaacaatcattcatttctcttaccattcatctcatcgctgtttcgcttgtagagagattatggctaaagatatagatgatctaccaaagcttcaagctaactacacggccctgacgccgttatggtttctagagcgagctgctacggtgcaccctaccagaacagctgtggtccatggatcagaacgctactcgtggctgcagacctatcaccgatgccgtcgattggcctccgctctgaataaccgcaacatcggtgctggtagcacggtagcagtaatagcaccaaatattcctgccttgtatgaagctcactttggagttccaatggccggagcagtgttgaacacagtaaatattcgtttagatgcaccgacaattgctttccttttaggccattcaagatctacagttgtgatggtggaccaagagtactttcacttggcagagggagctttcaaaatcttggcagaaaaagagaataattttagtcctccactgttgattgttatagctgatgaaagctgtgatcccaagcaactgcaacatgcactgaaaagaggagccattgaatatgagaagtttttggaaaatggggaccctgaatttgcttggaaaccaccagaggatgagtggcaaagtattgctttgggttacacttctggtacaacagccagtcccaagggggttgtgcttagtcaccgaggggcttatctcatggctttaagttgtgctatgatttggggtctaaatgaaggagctgtttatctgtggactttgcctatgttccattgcaatggttggtgctacacttggtcgcttgctgctctttgtggaacaaacatatgtctgaggcaggtaacggctaaggcagtttattcagcaattgcaaatcaaggtgtgacccacttctgcgctgcacctgtggtgctcaacaccatagtaaatgctccaaaagaagaggctatccttcccttacctcgtgttgtccatgtaaatacagctggtgctgcaccgcctccttctcttctctttgcaatgtcagagaaagggttccgtgttacccatacctatggcctttcagaaacttatggtccgtcgactgtatgtgcatggaagcctgagtgggattcactgcctcctatcaaacaagctcgcctcaatgcacgccaaggcgtaagatacattggcttggaaggcctggacgtagtcgatactaaaaccaataagcctgttcctgcagatggtaaaactatgggagaaatagtgatgcgtggaaatttggtaatgaagggatacttgaagaacccagaagctaacaaagaagcctttgcaaatggttggtttcattctggtgatctcgcagtaaagcatcctgatggctatatagaaataaaggatagaaacaaagacattatcatctctggaggtgaaaatattagcagcttggaggtagaaaatgtgctgtacacacacccagcagtgtttgaagtatctgtggtagcaagagaagacgagagatggggagagtcaccatgtgcttttgtgacattaaaagaaggaacagataaatctgatgaagggcgtttagcagaagatataatgaagttctgcaagtcgaaaatgcctgcttactgggttccaaaatctgtcgtctttggaccattgcctaaaactgctactggaaagattcaaaagcatgtgctgagggataaagcaaaaaagatgggacctgtcaaaaagagcaagctatagtatgcatgatttagatagtttaaggaaataataagcagtgcggatcatgtgtatttgtattaaattgacctttacctgtttgcgcaggcgtacttgcctgtgtttcagaatttagaggactagaataaatcctagagatgaattata

SEQ ID NO: 2698 - DNA, 1909 bp, Ricinus communis
gcaaaaagaggcgttatttggggagagatggtggtcaaagatatagatgagctcccaaaaaacgcagctaactacactgcgttgacgccacttctattcctggacagagcagccaccgttcatccgagcagagtatcacttgtccatggatccacgcactacacttggttacagacttacaaacgctgccgacgtttggcttctgctctaaccaatcactccgttgggtttggtagcacggtagcaataattgctccaaatgtgcctgctatgtatgaagcacactttggagttccaatggctggagctgtggtaaattgtgtgaatatacgtctaaatgcatcaactgttgctttccttttaggccattccaagtctgaagttgtgatggtggaccaagaattcttttcgctagcagaggaagctttggaaatcttggcaaagagtgaatcctcttttaaacctgcactattgattgtcatagctgataaaagctgtgatcccaagtcactaaaacatgctttaggaagaggggccattgaatatgaaaagttcctggaatctggtgatcctgagtttgcttggaaacaaccagaggatgagtggcagagtattgctttaggttatacttctggtacaacagctagccctaaaggtgtggtgctgagccaccgaggagcgtatctaatgtccttgagtaatcctctaatctggggaatgaatgaaggtgctgtatacttatggactctaccgatgttccattgtaatggttggtgtttcacttggtcacttgcagctctttgtgggacaaacatatgtcttcgacaggtaacagctaaggcagtctattcagctatagcaaacaatggtgttagtcacttttgcggtgcgcctgtggttctcaacaccatagtgaatgctccaaaggaggaaaccattcttcctctaccccgcattgtacatgtaatgactgctggcgctgccccgcccccatccgttctctttgcaatgtcggaaaaaggtttccgtgtaacacatacttatggtctctcagaaacttatggcccttccacagtgtgtgcctggaaacctgaatgggactcacagccccctattgtccaggcacgcctaaatgctcgccaaggagtccgttacattggcttggaaggcctagatgttgttgaccctaaaactatgaaacctgtccctgcagatggaaagaccattggagaaatagtgatgaggggcaatattgtgatgaaaggctacttaaagaacccaaaagccaatgaagaagcttttgcaaacggatggtttcattctggggatcttgctgttaagcatccagacaattatatggagattaaggacagatcaaaggacatcattatttctggaggagaaaacataagtagcctagaggtggaaaatatattatacacgcacccagcagtatacgaggcatcggtagtggctaggccagatgagcagtggggtgagtcaccctgtgcttttgtaacactaaagccaggagtcaacagatctgatgaaagatatttagctgaagaactaataaagttttccaggtcaaagatgcctgcttactgggttccaaaatctgtagtgtttggaccattaccaaagacggctactgggaagattcagaagcatgtgctgagggctagggcaaaagagatgggacctgtcaagaagagtaagctataattagtattctgcaaagttaaaagagattggcatccttttggtgctgcagatggtttgtacttttaagagataaagctttttcatccttgtaaccgcgattatgcgattgattcctttctaattattcaccagcctatcggcaaggatgtttatacttaatatgtacaggtcaaattcagaattg

SEQ ID NO: 2699 - DNA, 1993 bp, Quercus alba
aagagagagagagagagagagagagagagagagagaggtggtggtggtgatgggtcaagacatagacgatttgccaaaaaatgcagccaacttcacagctttgacaccgctttggtttttggacagagctgctttggctcaccccgacaaaacttcactcctccatggatctctacgctacacgtggcgtgacacttacaaccgttgccgtcgattggcctcttctctctctaaacactccgtcggcctcggttccacggtagccgtaattgcaccaaatgtcccagccctgtatgaagctcattttggaattccaatggctggagctgttctaaatgctgtaaatattcgtctaaatgcatcaaccattggtttccttcttggtcattcattagctgcagtagtgatggtggatcaagagttttttggcttagcagaagaagctttgaaaatctgggcagagaaaagcagaagtttcaagcctccacttctgattgtcataggtgacaaaaactgtgaccccaatggactcaaatacgctttaggaagaggggctattgaatatgagaaattcctggaagctggtgatcctgagtttgcttggaaaccaccagaggatgagtggcagagcatttctttgggttatacatctggtactactgctagtcctaagggggtggtgttacatcacaggggggcatatatcatggctatgagtaatcctcttatctgggagatgaatgacagacctgtatacctatggactctgcccatgttccattgcaatggttggtgtttcccttggactcttgctgctatttgtgcaacaagcatatgccttcgccaggttagggctaaggaaatctattcagccatagccaaacatggcgtgacacacttttgtgctgctcctgtggttctcaacagcatagttaatgctccacctgaagaaactatccttcccctccctcgtactgttcatgtaatgacagctggtgcagcccctcccccttctgtcctcctttcaatgactgaaaaaggcttccgtgtcacacacacttatggtctctcagaaacctatggcccctccactgtttgtgtgtggaagcctgagtgggactcactaccccctgtaacccaagcccgtctaaatgcacgccaaggtgttcggtatgttggtttagagtgcttagatgttgtcgactctaaaacaatgcaacctgttcctgctgatggaactacagttggggagatagtattccggggtaatattgtgatgaagggctacttaaagaacccaaaagcaaatgaggaggcttttgcaaatgggtggtaccattcgggagatcttgctgtaaagcatcaagatggatatatagaaattaaagatagggccaaagacatcattatatctggaggtgaaaacatcagtagtgtggaggtagaaaatgctttatacttgcacccagcaatttttgaggtatcagtggtggcaaggccggatgagaggtggggtgagtctccttgtgcttttgtgacattgaagcctaatgtagataaatcggatgagcagcgtttggcaaaagatatactaacgttctgcaaatctaagttgcctgcttattggataccaaagtcggttatatttggaccattaccaaagacagctactgggaagatacagaagcatttgctgagggccaaggtaaaagagatggggcctgtcaggaatagtaagctatagctcttgatggtgactgtagaaagaaagaagaataagagactgcttttcagttcttaacatgtttttcttttgatggtttgtacttgttgcatccaatcctacaatctctttgtttctatttgtaagtgccaaatgttgtgctggcagattgtaagaaattagctggttattcagcaaaacattatcctaatctggtactgtaataactttgaagacttccatgatgggtattaaaaaaaaagcattatt

SEQ ID NO: 2700 - DNA, 1889 bp, Vinca minor
atcaggaagcttatctagaattcatgagaatggtggtggagaaagatatagatgatctaccgaagaatccagctaattacgccaccttaacgccactagtgttcttagaaagggcggcgctggttcatcctaatcggaaatcacttatacatggctctattcacttcacttggctccaaacttaccaacgttgccggagattggcctccgctctcactcaacgatccgtcacttttggtagcacggtttcagttattgcaccgaatgtgccagcaatgtatgaaggtcattttggaattccaatgtccggagctgttctaaacgctgttaatgttcgtttaaatgcacagactattgcttttcttttggggcattcagaatctgctgttataatggttgatcaagaatttttcaccctaaccgaggaagctttaaaaattttatctgaaaagagtgggaacaagtttaagcctcctcttctgattgttattgctgatgaaagttgtgatccgaagttacttcaacatgctcttaggaaaggtgctattgaatacgaggaattcctgaaatcaggtgatccgaactttgcatggaaaccaccacaggatgaatggcatagtattactcttggttacacttctggcactacggcaagtcccaagggtgtggtattgcaccatcgaggggcctatttaatggctttgagtaatcccataatctgggggattcaagaaggggcagtatacctttggactctacccatgttccactgcaatggttggtgttttacttggactttggctgctatttgtgggacgaatgtgtgccttagacaggtgacggcaaagggtgtctactcggccatagctaatcaaggagtgacccatttctgtgctgcacctgtggtgctcaataccctattgaatgctccacaagaggagacgattcttccacttcctcgtcttgtacatgtaatgacagctggtgctgccccacctccttcagtactttttgcaatgtcccaacaaggctttcgtgttactcatacatatggcctctctgaaacctatggcccctcgacagtatgtgcgtggaaacctgaatgggattcacttccacctgaaactcaagcccgtctcaatgctcgccaaggtgtcagatacgtcggtttggaaggtctagacgttgttaacacacaaaccatggagcccgtcccagctgacggaaagacagtgggggaaattgttttcagaggtaaccttgtgatgaaagggtatttaaaaaatccaaaagctaacgaggagtcttttgccggtggctggtatcactccggtgatcttgcagtgaagcatccagacaactacatcgaaattaaggacagatcgaaagatattattatatcaggaggcgaaaacatcagcagtgttgaggtagaaaatattctatatcaacatccagcaatcttggaagtttcagtggtggcaaggccagatgaacgttggggcgaatcgccttgtgctttcgtgacattaaagccaggggcagaaaagtctgacgaaaaacgcttagctgaagatattatgagcttcagtaaatcaaagatgccagcatattgggttccaaaatctgtgatatttggtccgttgccaaaaactgctaccgggaaaattcagaagaacttgttaagggttaaggccaaagagcttggacctgtgaagaggagcaagttataatacaaggcagcatttagatgatgatgataaaaattactattttaggtcccccagaggacaagattctggcaaaataaggagactgtaaaaatatagggtgactctttctcagaatgtctctattacttctgttgtcagcacatttctaaatacttt

SEQ ID NO: 2701 - DNA, 1828 bp, Cajanus cajan
ggggatagacgacttgccaaagaacgcagccaactacaccgcgttaacgccgttatggtttctccaaagagcagcccaggtgcaccccactagaaactccctcatccacggatctcggcgctacacgtggcaacaaacttaccaccgttgccgtcaatttgcctctgctctttccaaccgttccatcggtctcgccaaaactgtagctgttattgcacccaatattccagctctttatgaagctcactttggaattccaatggcaggggctgtgctgaaccctgttaacattaggctaaatgcatccacaatagcttttcttcttggtcattgcacagctgcagcagtaatagttgatcaagagttcttttctttggcagaagaagctttgaaaatatggtctgagaaagccaagaccttcaacccaccactacttgttgtcattggtgatgaaaactgcgaccctaagacacttaggtatgctctgggaaaaggagccattgaatatgaggattttctccaaagtggtgaccctgaatatgcatggatacccccggaggatgagtggcagagcatatctttgggttacacatctggtaccaccgctagtccgaagggcgtggtgttgcaccaccgtggagcctatctcatgtctctgagtggcgctcttatttggggaatgactgaaggtgctgtgtatctttggacactgccaatgtttcattgcaatggttggtgtttcacgtggacacttgcagctctgtgcggtacaaacatatgtcttcgccaggtaacagcgaaggcagtatatgaagccattgccaagtataaagtgacgcatttttgtgcagcaccagtggttctgaacacaataatcaatgctccgtccgaggaaaccatacttcctctaccccatgttgtgcatgtgaacacagctggggctgctcctcctccttctgttctcgctggcatgtccaaacgaggctttcgtgtcacacacacttacggtctctcagaaacttatggcccctctgtctactgtgcctggaagccagaatgggattcacttccgcctgaggaccaagctcggctcaatgcaagacaaggggttcggtacattagcttggaaggccttgaagttgtgaacacaaaaaccatgcaaccagttcctgctgatggcaaaaccgttggtgagattgtgatgaggggcaatattgtgatgaagggctacttgaagaaccctgaggctaacaaagagacctttgcaaatggatggtttcattccggggatcttgctgtgaagcatgaagatggatacattgaaatcaaggacaggtcaaaggatattatcatctctggtgctgaaaatattagcagtgtggagatagagaatgctctttactcgcatcctgcaatactggaggcagcagtggtggcaagggctgatgaaaaatggggtgagtctccctgtgcttttgtgacattgaagccaggagtggataagagcaatgagcaagttatagttgaggatatactcaagttctgcagggccaaaatgcctgcttattgggtcccaaaatctgttgtatttggacccttacccaagactgctactgggaagatacagaagcatttactcagggccaaggcaaaagagatgggaccagtcaggatgagcaagttataaacactgatcatggcgaaaaatgatgctagttgttgctgtttgtgactagaattctgcttattagtaaaagctgttactcttatatataattataatagtaataataatgatatagctgaacttttttatatgttcttcaac

SEQ ID NO: 2702 - DNA, 2005 bp, Glycine max
gccattcattgattttatgtttgtttttgcgagcgtaaggttgaggagaagagatggtgggagcacggccacgggacatagatgacttgcccaagaacgccgccaactacacagcgcttacgccgttgtggtttctagagagagctgctacggtccaccccaccagaaactccctcatccacggatctcgtcgctacacgtggcagcagacttaccaccgttgccgtcgattcgcctccgctctttctaatcattccatcggtcttggaaacactgtagctgttattgcacccaacattccagctctttatgaagctcactttgggattccaatgtcaggggctgtgttgaaccctgttaatattaggctaaatgcatccacggtagcttttcttcttggtcattgcacagctgcagcagtaatagttgatcaagagtttttttctttggcagaagaagctttgaaaatatggtctgagaaggccaaaaccttcagccctccacttttaatagtcatcagtgatgaaaattgcgaccctaaggcacttaaatatgctctgggcaaaggagccattgaatatgaggattttcttcaaagtggtgatcctgagtatgcatggaaacccccagaggatgagtggcagagcattgcattgggttacacatccggtaccactgctagtccgaagggtgtggttttacatcaccgtggagcttatctcatgtctctgagtggagctcttatttggggaatgactgaaggtgctgtgtatctttggacacttcccatgttccattgcaatggttggtgctacacttggacacttgcagctctgtgtggtactaacatatgccttcgccaggtaacagcgaaggcagtgtatggagccattgccaagtataaagtgactcatttttgtgcagcaccagtggttcttaacacactaattaatgccccagctgaggacaccattcttcctctaccccatgttgtgcatgtgaatacagctggggctgcacctcctccttctgttctttccggcatgtctgaacgtggatttcgtgtcacacacacttatggtctctcagaaacctatggcccctctgtctactgtgcctggaaaccagaatgggaatcacttccccctgaaaaccaagcccggctcaatgcaagacaaggtgttaggtacattggcttggaaggcctggctgttgtgaacacaaaaaccatggaacctgttcctgctgatggtaaaactgttggtgagattgtgatgcggggtaattctgtgatgaaaggctacttaaagaaccctaaggctaacgaggagacctttgcaaatggatggtttcattctggggatcttgctgtgaagcacccagatggatatatagaaattaaagacagatcaaaggacatcataatctctggtgctgaaaatatcagcagtgtagagatagagaatactctttactcacatccttcaatactggaggcagcagtggttgcaagggcagatgaaaaatggggcgagtctccctgcgcttttgtgacattaaagccaggagtggataaaagcaatgagcagcgtataattgaggatatactaaagttcagcagggccaagatgcctgcttattgggttccaaaatcagttgtgtttggagccttacctaagacagctactgggaagatacagaagcatatactgagggccaaggcaaaagagatgggacctgtaaagttgagcaagttataaacatattgaaatgatcatgacgaaaaacgaactagttataaacatattgagtactttataaacatattgagatagcctatttgtgattgggattctgcatacttatctataataatatagccgaaccttttatatgtggttcaaaagtagttgttggataagaccaacgtgtcacttatctattttgaagtcaataaatccatcctggcttccattatataatttttaacgtgtatttttctcca

SEQ ID NO: 2703 - DNA, 3016 bp, Malus domestica
catcccacaacacaaaaataatcaaaggaaaacaaatggagaaaaaatggcttctgcttttctcaatggcagctgcaatgctgctagcgatcaacgttgtgaacggtcaagaggattcagcggtgaagccgttggtgaagatagtgaagggcaagaaggtgtgcgacaaggggtgggagtgtaaaggatggtctgtttattgttgtaaccagaccatttctgactacttccaagcttaccactttgaggaccttttctccaagcgtaactcgccggtggcgcacgccgtgggattctgggactaccactctttcatcaccgctgctgccgattaccagcctcatggattcggtaccacaggtggcaagctccaggggatgaaggaagttgctgcttttcttgggcatgttggcagcaaaactacgtgtggctatggggttgccaccggaggaccattggcttggggtctatgctacaacaaggaaatgagccctagccagttatactgtgatgactactacaaatacacttacccctgctctcctggtgcttcataccatggccgtggtgccttgccactctattggaactacaactatggagaaacaggtcaagccctaaaggtggacttattaaaccatccagaatacatagaacaaaatgcaaccctagccttccaggctgcaatctggaggtggatgacgccagtaaagaagaacatcccttcagcccacgatgtctttgtcggcaaatggaagccaaccaagaacgacactttatccaaaagagttcctggctttggcaccaccatcaatgtgctctatggagaccaagtctgtggccaaggtgacgttgactccatgaacaacatcgtctcccattacctgtattaccttgacaaaatcggggttggccgcgaagaggctggccctcatgacgtgctcagctgcgctgaacagaaggcttttcaaccttcatcatcttcttcgtcttcgtcttcgtcttcatcttcatcttcttgagctggtttgtcataattctgaatttctgagtctccagtcagagaaagagagaggtagaacaggtgcatcaaagatggtggtggggcgagacatagacgatctgccgaagaacgaagccaactacacggcattaacgccgctgtggtttctggatagagcagctctggtgcaccccaccagaacatccatggtccatggatcaattcgctacacgtggcagcagacttaccagcgttgccgccgtttggcctccgctctcgccaagcgctccatcggcctcggcaccacggtatcgataatagcaccaaatgtgccagccctctttgaagctcattatggagttccaatggcaggagctgtgttaaacactgtaaatgttcgtctaaatgcagcgactattgctttccttcttggtcattcatcgtctgttgttgtgatggtggatcaagaattttttcccttggcagaggaagctttgaaaatatgggcagagaaaagcgaaggcagttgcaagcctccactcttagttgtcataggtgatgaaagctgtgatcctatggcactaaaaagtgctttgggaagaggcgccattgaatatgagacattcttggaaagtggtgaccctgagtttgcttggaaaccaccagaggatgagtggcagagcattgctctgggttatacttctggcacaacagccagccctaagggggtggttttgcatcaccgtggggcttatctgatggctttgagtggtcctcttgtatgggggatgactgaaggagctgtatatctgtggactctacccatgttccattgcaatggttggtgtttcacttggtcacttgcagctctttgtgggacaaacatatgccttcgacaggttacagcaaaggcagtatattcagccatagccgagcatggcgtgactcacttttgtgctgcacccgtggtactcaacactttggtcaatgcttccccagaggagactatccttcctctcccacatgttgtacaggtgatgacagctggtgctgcccctccaccttctattctttttgcgatgtcccaaaagggcttccgagtcacgcacacttatggtctgtcagaaacttatggcccctccacagtatgtgcgtggaagcctgagtgggactcgctgccccctgtaaaacaagcgcggcttaatgcacgccaaggtgttcggtacattggcatggagggtgtagatgttttcaaccctgagactatgcaaccagttccagctgatggagctaccatgggggagataatgatgcggggaaatctcgtaatgaaggggtatttaaagaacccaaaggtgaataatgaagttttcgccaatggttggtttcattctggtgatctggcagtgaagcatccagataactatatcgaaatcaaagacagatcaaaggacattatcatctccggaggtgagaacatcagtagtgtggaggtagagaacactctatatcaacacccagccatattcgaggtatcggtggttgcaaggccacatgagaagtggggtgaaactccttgcgcttttgtgacattgaaaccgggtgtcgataagtctgatgagaatcgtatggcagaagatataatgaagttctgccggtccaagctacctgcgtactgggttccgagatccgtggtatttggaccattgccaaagaccgctactgggaagatacagaagcatttgctgagggccaaggccaaagagctgggacctgtcactttgagtaagttataactgcattgtgttggccattgtataaaaggctaataaacgcttggatcatgtttagtgccaagcttgtttctcttgttaagactcttctgtcatttttcttttggtaagaagtggatgtatgattaagcgaggagaagagcgagggtcgaactttcgcttcctcgggatttaatgatgtaatctaagttctcatgtgtgcaggttttttgttaaacca

SEQ ID NO: 2704 - DNA, 1824 bp, Cucumis sativus
ccgcctgacgtttgttggtagagagagaaccaccgatacccaccaaatagagagagaagaactcggttgccgagccatggccggagccagagacatcgacgatctaccgaagaaccacgccaactacaccgccttgacgccactgtggtttattgagagagccgccttggttcatccttccagattatcggtcgtccatggatctcgccgctacaactggcgtcagacctaccaacgctgccgccgtttggcttccgctctttcaaaccgctccatcggcgccggagacacggtagcaataattgctccaaatattccagctatctatgaagctcattttggagttcccatggctggagctgtactgaattgtgttaatattcgtctaaatgctcaaacaatttcatttcttctcggtcactcagcatctgcagttgttatggtggatcaagagtttttccctttagcagaggaagctttgaacatactagctgcaaagggtgatggccattacaagcctccacttctaattgtaattggcgatgaaaactgtgatccggaagcactcaaatatgctttatcaaaaggggctatcgagtacgagaaattcttggaaataggcaatcctgagtatgcttggaaaccaccagaggatgagtggcagagcattactttaggctatacgtctggtacaactgcaagtcctaaaggggtggttttaagccacagaggggcgtatgtcatgtctttgagtgcaggcctagtgtgggggatgaatgaaggagctatatatctttggactcttccaatgttccattgcaatggttggtgttacacatgggcactggctgctctctgtggaacaagtatatgcctccggcaggtcacagctaaggcagtttattcagccatagccaagcataaagtaacacatttttgtgctgctcctgtggttcttaatactattgttaatgcccctaaagaagatactatccttcccctcccccatgttgtccatgtcatgacagcaggagctgctccacctccttcggtattatatgcaatgtcacagaagggcttccggattactcacacttatggcctatctgaaacttacggtccttctacaatatgtgcatggaagccagaatgggactcattgcctccagaagcccaagcacgaatgaatgctcgtcaaggtgtacggtacgttggattggagggtctagacgttgtgaacactcaaacaatgcaacccgtaccgtctgatggaaaaactgttggagagatagtaatgcgtgggaacgctgttatgaaaggctacttaaagaacccaaaagcaaacaaagaggcattcgcaaatggctggtttcactctggtgatcttggtgtaaaacatccagatggttacatagaaataaaagacaggtcaaaggatatcatcatttctggaggtgaaaacattagcagtgtggagatagagaacactctctaccaacacccggcgatactggaggtgtcagttgtcgctagggcagacgaacggtggggagaatctccttgtgcttttgtgacattgaagtcgaagatagataagggtgatgagcagcgaatggctgaggatattatgaagttttgtaagtcgaaaatgccagcttactgggtcccaaaatctgtggtatttggggagctaccgaaaacggcaactgggaaagttcaaaagcatctgctgagggcgaaggctaaggagatgggacctgttaagatgagcaagttgtaatgaatattgtcccacttgaaatgagctttgcttcggtaggtaaa

SEQ ID NO: 2705 - DNA, 2039 bp, Trigonella foenum-graecum
atgagatgagatgagacagaagagtcagtcacggtagagttggcagaaaacaaataaaataaagacaaattgcacacgagtattttccccacacatttgtgtctgaacaatcgaagaggagagcgcgcagtggcgatggttacgaaacaggacatagacgaccttccaaagaacgcggcgaactacatagctttaacaccgttatggttcttagaaagagcagctcaggttcatccaaccagagaatctctcatccatggatcacgtcactacacgtggcatcaaacttaccaacgctgccgtcgattcgcttccgctctttccaaccgttccatcggtctcggaaacacggtagctgttattgcacccaatattccagctctgtatgaagctcattttgggattccaatggcaggggcagtgataaaccctgtgaatattaggctaaatgcatccacaatagcttttcttcttggtcattgcactgcatcagttgtaattgtggatcaagagttcttttcattggctgaagaagctttgaaaatatggtctgagaaaaccaaaacattcaagtctccgattttaattgtcattggcgatgagaactgcgaccctaagtcacttagatatgcgttgagcaaaggagccattgaatatgaggactttcttcgaagtggtgaccctgaataccattggaaaccaccagaggatgagtggcagagcattgctttgggttatacatctgggaccactgctagtccgaaaggtgtggttttgcatcaccgcggagcgtatctcatgtctcttagcggagcacttatatggggaatgaatgaaggagcggtatatctttggactctacccatgtttcattgcaatggttggaactacccctggacacttgcagctgtctttggcacaagcatatgcctccgccaggtatcagcaaaggcagtatatgaagccattgctaagtacaaagtgactcatttttgtgcagcaccagtggtgcttaactcaataattaatgctccggctgaggaaaccatacttcctctacctcatgttgtacatgtgaatactgctggtgctgctcctcctccttctgttctttccggcatgtctgaacgaggatttcgtgtcacacacacttatggtctttcagaaacctatggcccgtccgtctattgtgcctggaaaccagagtgggactcacttccaccagaatcccgtgcccggctccatgcaagacaaggggttaggtacattgccttggaatgcttggatgttgtgaacacaaaaaccatgcaacctgtacctgctgatggtaaaactgttggcgaaatcgtgatgcgtggtaatgctgtcatgaaaggctacttaaagaatcctaaagctaacgaagagagctttgcaaatggatggtatcattccggtgatcttgcggtaaagcatccagatggatatatagaaattaaagacagatcaaaggacatcatcatctcaggtgctgaaaatatcagcagtgtagaggtagaaaatgctctgtactcgcatcctgcgatacttgaggcatcggtggttgctagaccagacgataaatggggcgagtctccgtgtgcgttcgtgacgttaaagccaggagttgatagtagtaacgagcagcgtttagtcgaggatatactgaagttctgcagggccaagatgcctgcttattgggtaccgaaatcggttgtctttggaccgttacctaagacagctactgggaaggtacagaagcatctgctgagggctaaggcaaaggagatggggcctctcaagatgagtaagttgtaatcatattagagtgataatgtcgataaaagctactagttcttgctggtatgtgatgtgttattagaattgtagtaataatcagtaagaattgttattctataataataataataataaaaacttttagctgttcttaaaagacagttcaatatttttatcccattatgcaatttggatactacctttcatagtactaatatatt

SEQ ID NO: 2706 - DNA, 1973 bp, Catharanthus roseus
aagccgtaaacaaattcgtcctttctacattcctaatcccttacaaatcctatatatatataattaataaatcccatcttcttcgtttttcagctccgccacacacagataatcggagaagatcacgttttatagccgaagagaggaagaaaaatagataattaattaattatgggggttgtagagaaagatatcgatgatctgccgaagaattcagctaattatacgacgctgacgccattggggtttttggaaagggcggctcaagttcatcctaatcggaaatctgttattcatggctctattcattatacttggcttcaaacttatcaccgttgccgccaattggcttccgccctcagtcaacgctccgtcacatttggaagcacggtttcggtcattgcaccaaatgtgccagcgatgtatgaatctcattttggaatcccaatggctggagcagttctaaatgctgtcaatattcgtttaaatgctcaaactattgcttttcttctggggcactcatcatctgctgttataatggtggaccaagaatttttcaccctagcagaggaagctttaaaacttttatctgaaaagagcaagggcaagtttaaacatcctcttctgattgttattgctgatgaaagctgtgatcccaagtcactccaacatgctcttaggaaaggcgctattgaatatgaggaattcctgaaaacaggtgacccaaactttgcatggaagccaccacaggatgaatggcatagtattactcttggttacacctctggcacaacagcaagtcccaagggtgtggtactgcaccatcgaggggcatatttaatggcaatgagtaatgctataatttgggggatgcaagaaggggctgtatacctgtggactctacccatgttccattgcaatggttggtgtttcacttggacactggcagctatttgtgggacaaatgtgtgccttagacaggtgacagcaaagggtgtctactcggccatagctaaccaaggcgtgacccatttctgtgctgcccctgttgtgctcaatacccttgtgaatgctccacaagaagaaaccattcttcctctccctcgtctggtgcatgtaatgacagcaggtgcagctccacccccttccgttctttttaaaatgtcccaacaaggctttcgtgttgctcatacatatggcctctctgaaacctatggcccctcaactatatgtgcatggaaacctgagtgggattcactaccacctgaaactcaagcccgtatgaatgctaggcaaggtgtcagatacgttggattggaaggtctagatgttgtcaacacacagaacatgaagcctgtcccagcagatggaaccacggtgggggaaattgtttttagaggtaatgttgtgatgaagggatacttaaagaatccaaaagccaacgaagaggcttttgccggtggatggtttcattctggtgatcttgcagtgaagcatccagataactacatcgaaatcaaggacagatcaaaagatattattatatctggaggcgaaaacatcagtagtgttgaggtagaaaatgttctatatcaacatccagcaatcttggaagtttctgtggtttcaaggccagatgaacgttggggcgaatcaccttgtgctttcgtgacattaaagccaggggcacaaaaatctgacgagccacgcttggctgaagatattataagtttcagtagatcaaaaatgcctgcatattgggttccaaaatctgttatatttggtccattgccaaagactgcaactgggaaaatccagaaacacatattaagggccaaagccaaggagcttggacctgtcaagaaaagcagattataatacaaggcagagcagtagatgatgatgaaaaaatctacagtccgaaggccaggagggcattctggtaaaaataagtaggccattattctttccat

SEQ ID NO: 2707 - DNA, 2405 bp, Glycine max
actcattcattttgtttgtttttgcgagcgtaaggttgaggtgtggagaaagcgcgaaagggtgggtggtgaagaagagatgatggtgagagcacggccaagggacatagatcacttgcccaagaacgccgccaactacacagcgttaacgccgttgtggtttctagaaagagctgctacggtgcaccccaccagaaactccctcatccatggatctcgtcactacacgtggcagcagacttatcaccgttgccgtcgattcgcgtccgctctttctaaccattccatcggtctcggaaacactgttgctgtaattgcacccaatattccagctgtttatgaagctcactttgggattccaatggctggggctgtgttgaaccctcttaatattaggctaaatgcatccacaatagcttttcttcttggtcattgcacagctgcagcagtaatagttgaccaagagttcttttctttagcagaagaagctttgaaaatatggtctgagaaggccaaaaccttcagccctccacttttaatagtcattggtgatgaaaattgcgaccctaaggcacttaaatatgctctgggcaaaggagccgttgattatgaggattttctccagagtggagatccagaatatgcatggaaacccccagaggatgagtggcagagcatttcattgggttacacatccggtaccactgctagtccgaagggtgtggttttacatcaccgtggagcctatctcatgtctctgagtggagctcttatttggggaatgactgaaggagctgtgtatctttggacacttcccatgtttcattgcaatggttggtgttacacttggacacttgcagctctgtgtggtacaaacatatgccttcggcaggtaacaccgaaggcagtatatgaagccattgccaagtataaagtgagtcatttttgtgcagcaccagtggttcttaacacaatagttaatgccccagccgaggacaccattcttcctctaccccatgttgtgcatgtgaatacagctggggctgctcctcctccttctgttctttccggcatgtctgaacgaggatttcgtgtcacacacacttatggtctctcagaaacctatggcccctccgtctattgtgcctggaaaccagaatgggaatcacttccccctgaaaaccgagcccggctcaatgcaagacaaggtgttaggtacgttggcttggaaggcctggatgtggtgaacacaaaaaccatggaacctgttcctgctgatggtaaaactgttggtgagattgtgatgcggggtaattctgtgatgaaaggctacttaaagaaccctaaagctaacgaggagacctttgcaaatggatggtttcattccggggatcttgctgtgaagcatccagatgggtatatagaaattaaagacagatcaaaggacatcataatctctggtgctgaaaacatcagcagtgtagagatagagaatactctttactcgcaccctgcaatactggaagcagcagtggttgcaagggcagatgagaaatggggcgagtctccctgcgcttttgtgacattaaagccaggagtggataaaagcaatgggcagcgtataattgaggatatactaaagttctgcaaagccaagatgcctgcttattgggttccaaaatcagttgtgtttggagccttacctaagacagctactgggaagatacagaagcatatactgagggccaaggcaaaagagatgggacctgtaaagttgagtaagctataaacatattgaaatgatcatgacgaagaaagatgctagttgttgcaatttgtgattaggattctgcatacttattagtcaaagttggtatgtataatatcatagcagaggcttttatctgcggttcaaaagtagttttttggataagaccaacgtgtcactcatctattttgaagtcaataaatccattttggcttccattataaattttagcgtgtattttcctccattatgtgacgcaatttgaggtcagggataatgttcagataaaagtctttcatatactccaagattcaagttcatgaaaattggctgacatgtgatgtagtccagtatctcggctatcattcattattgggttcggttatgtcatattgaaacgtgcagaagtctggctctaagttatattgcttggttttaatagaatcattatcaagattcaagcttacctttcgatatccttattaagccaatgaagcttcaagatagttcatataagtttttgacgttttacagacagatattgattgatttattaaggttggcaatcgccaatcgcacactgataagtgatcagatatatggtatgctagcttcacatttcccggaacttgaggat

SEQ ID NO: 2708 - DNA, 1090 bp, Triticum aestivum
ccaccccgtcacgcgcacgccccacgaggaagagggagcaccgagcggcggcggcggcggccatggcgcggtgcagcaacgggctgctgggcctgctgaacgcgggggtgctggtgctcgccctcgtcgtcctcggcggcggcatctggctgagccaccgggcctccaccaccgactgcgagcggttcctggagcggccggtcatcgcgctcggcgccctcctcctcgcgctctccctcgcgggcctcgccgggtccctctgccgcgcctcctgcctcctctggctctacctcgtcgcgctcttcctcctcatcgcgctcctcctcgtcttcaccgtcttcgccttcgtcgtcaccaaccgcggcgccggctccgtcgtctccggccgcggctacaaggagtaccgcctcggggagtactccacctggctccagcgccgggtcgagagcgccgacaactgggccaagatccgcagctgcctccgcgacggcggcgtctgccagaggttcggggccaggggggagtcgctgcagcagttcgtcaccaacaacctctccccgattcagtctggatgctgcaagcccccaaccgggtgcaacttcacctaccagagcgagaccgtctgggccaaacctactggcctcaactctaccaacgaccctgactgcaacacgtggtcgaatgatcagagggccctctgctacgactgccagtcatgcaaggccggcgtgcttgccaacctgaagaacgactggaagaagatcgccaccgtcaacatcatattcctcatcttcctcatcatcgtctactctgttgggtgctgcgctttcaggaacaacaggcgggacaactcgtacccagcctggaagtgagtgagatgcctggcgaggcttaggtaattaggctgatgttcagcgttagcagttggctcgttgtcctgtgtcaagcaacactatcgtctatcctgtagctccgatgatgtttgaaccgtcgatagttggtaatggcgcatgcttgctatatttgctatgccgacctcaaacatatcatatatggaggttcctattatcatgatatgagatatgttcat

SEQ ID NO: 2709 - DNA, 1110 bp, Triticum aestivum
ccccacccccaccccgtcacgcgcacgccccacgaggaagagggagcaccgagcggcggcggcggcggccatggcgcggtgcagcaacgggctgctgggcctgctgaacgcgggggtgctggtgctcgccctcgtcgtcctcggcggcggcatctggctgagccaccgggcctccaccaccgactgcgagcggttcctggagcggccggtcatcgcgctcggcgccctcctcctcgcgctctccctcgcgggcctcgccgggtccctctgccgcgcctcctgcctcctctggctctacctcgtcgcgctcttcctcctcatcgcgctcctcctcgtcttcaccgtcttcgccttcgtcgtcaccaaccgcggcgccggctccgtcgtctccggccgcggctacaaggagtaccgcctcggggagtactccacctggctccagcgccgggtcgagagcgccgacaactgggccaagatccgcagctgcctccgcgacggcggcgtctgccagaggttcggggccaggggggagtcgctgcagcagttcgtcaccaacaacctctccccgattcagtctggatgctgcaagcccccaaccgggtgcaacttcacctaccagagcgagaccgtctgggccaaacctactggcctcaactctaccaacgaccctgactgcaacacgtggtcgaatgatcagagggccctctgctacgactgccagtcatgcaaggccggcgtgcttgccaacctgaagaacgactggaagaagatcgccaccgtcaacatcatattcctcatcttcctcatcatcgtctactctgttgggtgctgcgctttcaggaacaacaggcgggacaactcgtacccagcctggaagtgagtgagatgcctggcgaggcttaggtaattaggctgatgttcagcgttagcagttggctcgttgtcctgtgtcaagcaacactatcgtctatcctgtagctccgatgatgtttgaaccgtcgatagttggtaatggcgcatgcttgctatatttgctatgccgacctcaaacatatcatatatggaggttcctattatcatgatatgagatatgttcataagttgtctgtg

SEQ ID NO: 2710 - DNA, 1047 bp, Triticum aestivum
ccccaccccgtcacgcgcacgccacaacccccacaagggaagcgagagcggcggcgggcggcggccatggcgcggtgcagcaacgggctgctgggcctgctgaacgcgggggtgctggtcctcgccctcgtcgtcctcggcggcggcatctggctgagccaccgggccgccaccaccgactgcgagcggttcctggagcggccggtcatcgcgctgggtgccctgctcctggcgctctccctcgcgggcctcgcggggtccctctgccgcgcctcctgcctcctctggctctacctcgtcgcgctcttcctcctcatcgcgctcctcctcgtcttcaccgtcttcgccttcgtcgtcaccaaccgcggcgccggctccgtcgtctccgggaggggctacagggaataccgcctcggggagtactccacctggctccagcgccgggtcgagagcgccggcaactgggccaagatccgcagctgcctccgcgatggcggggtctgccagaggttcggcgccaggggggagtccctgcagcagttcgtcaccaacaacctctccccgattcagtctggatgctgcaaacccccaactgggtgcaacttcacctaccagagcgagaccgtctgggccaaacctactggcttcaactctaccaacgaccccgactgcaacacgtggtcgaatgatccgagggccctctgctatgactgccagtcatgcaaggctggcgtgctcgctaatgtgaagaatgactggaagaaaatcgccaccgtcaacatcatattcctcatcttcctcatcatcgtctactctgttgggtgctgcgctttcaggaataacaggcgggacaactcgtacccagcctggaagtgagtgagatgcctggcgaggcttaggtaattaggatgatgttcagtgttaatggttggctcattgtcgtgtgtcaagcaacactatcgtctatgctatagcgccgatgatgtttgaactgtcgatagttggaggttcctattatcatgatatgagatatgttcagaagttgcc

SEQ ID NO: 2711 - DNA, 1084 bp, Triticum aestivum
acgccctcccacctactcgaaacccccaccccgtcacgcgcacgccacaacccccacaagggaagcgagagcggcggcgggcggcggccatggcgcggtgcagcaacgggctgctgggcctgctgaacgcgggggtgctggtcctcgccctcgtcgtcctcggcggcggcatctggctgagccaccgggccgccaccaccgactgcgagcggttcctggagcggccggtcatcgcgctgggtgccctgctcctggcgctctccctcgcgggcctcgcggggtccctctgccgcgcctcctgcctcctctggctctacctcgtcgcgctcttcctcctcatcgcgctcctcctcgtcttcaccgtcttcgccttcgtcgtcaccaaccgcggcgccggctccgtcgtctccgggaggggctacagggaataccgcctcggggagtactccacctggctccagcgccgggtcgagagcgccggcaactgggccaagatccgcagctgcctccgcgatggcggggtctgccagaggttcggcgccaggggggagtccctgcagcagttcgtcaccaacaacctctccccgattcagtctggatgctgcaaacccccaactgggtgcaacttcacctaccagagcgagaccgtctgggccaaacctactggcttcaactctaccaacgaccccgactgcaacacgtggtcgaatgatccgagggccctctgctatgactgccagtcatgcaaggctggcgtgctcgctaatgtgaagaatgactggaagaaaatcgccaccgtcaacatcatattcctcatcttcctcatcatcgtctactctgttgggtgctgcgctttcaggaataacaggcgggacaactcgtacccagcctggaagtgagtgagatgcctggcgaggcttaggtaattaggatgatgttcagtgttaatggttggctcattgtcgtgtgtcaagcaacactatcgtctatgctatagcgccgatgatgtttgaactgtcgatagttggaggttcctattatcatgatatgagatatgttcagaagttgcctgtgaaaaaaaaaa

SEQ ID NO: 2712 - DNA, 1204 bp, Triticum aestivum
ccacgcgtccggcaccgcacgccctcccacctactcgaaccccccaccccaccccgtcacgcgcacggcacaatcccctcgagggaagcgagagcggcggcggcggccatggcgcggtgcagcaacgggctgctgggcctgctgaacgcgggggtcctggtcctcgccctcgtcgtcctcggcggcggcatctggctgagccaccgcgcctccaccaccgactgcgagcggttcctggagcggccggtcatcgcgctcggtgccctcctcctggcgctctccctcgcggggctggcgggctccctctgccgcgcatcctgcctcctctggctctacctcgtcgcgctcttcctcctcatcgcgctcctcctcgtcttcaccgtcttcgccttcgtcgtcaccaaccgcggcgccggctccgtcgcctccgggaggggctacagggagtaccgcctcggggagtactccacctggctgcagcgccgggtcgagaacgccgacaactgggccaagatccgcagctgcctccgcgacggcggcgtctgccagaggttcggggccaggggggagtcgctgcagcagttcgtcaccaacaacctctccccgattcagtctggatgctgcaaacccccaaccgggtgcaacttcacctaccagagcgagaccatgtggaacaaacctcctggcttcaactctaccaatgaccctgactgcaacacgtggtcgaatgatccgagggccctctgctatgactgccagtcatgcaaggctggcgtgctcgctaatgtgaagaatgactggaagaaaatcgccaccgtcaacatcatattcctcattttcctcatcattgtctactctgttgggtgctgcgctttcaggaacaacaggcgggacaactcgtacccagcctggaagtgagtgagatgcctggaggggcttggcttaggtaattaggatgatgttcagtgttaatggttggctcatggttgtgtgtcaagcaacactatcgtctatgctatagcgctgatgatgtttgaactgtcgatagttggtaatggtgcatgcttgctatatttgctatgccgacctcaaatatatcgtttatggaggttcctgttatcatgatatgagatatgttcagaagttgtctgtgatcttttctgttctttgcgtagcatagagtcagtctattgcttctgtctgg

SEQ ID NO: 2713 - DNA, 1205 bp, Triticum aestivum
ccacgcgtccggcaccgcacgccctcccacctactcgaaccccccaccccaccccgtcacgcgcacggcacaatcccctcgagggaagcgagagcggcggcggcggccatggcgcggtgcagcaacgggctgctgggcctgctgaacgcgggggtcctggtcctcgccctcgtcgtcctcggcggcggcatctggctgagccaccgcgcctccaccaccgactgcgagcggttcctggagcggccggtcatcgcgctcggtgccctcctcctggcgctctccctcgcggggctggcgggctccctctgccgcgcatcctgcctcctctggctctacctcgtcgcgctcttcctcctcatcgcgctcctcctcgtcttcaccgtcttcgccttcgtcgtcaccaaccgcggcgccggctccgtcgcctccgggaggggctacagggagtaccgcctcggggagtactccacctggctgcagcgccgggtcgagaacgccgacaactgggccaagatccgcagctgcctccgcgacggcggcgtctgccagaggttcggggccaggggggagtcgctgcagcagttcgtcaccaacaacctctccccgattcagtctggatgctgcaaacccccaaccgggtgcaacttcacctaccagagcgagaccatgtggaacaaacctcctggcttcaactctaccaatgaccctgactgcaacacgtggtcgaatgatccgagggccctctgctatgactgccagtcatgcaaggctggcgtgctcgctaatgtgaagaatgactggaagaaaatcgccaccgtcaacatcatattcctcattttcctcatcattgtctactctgttgggtgctgcgctttcaggaacaacaggcgggacaactcgtacccagcctggaagtgagtgagatgcctggaggggcttggcttaggtaattaggatgatgttcagtgttaatggttggctcatggttgtgtgtcaagcaacactatcgtctatgctatagcgctgatgatgtttgaactgtcgatagttggtaatggtgcatgcttgctatatttgctatgccgacctcaaatatatcgtttatggaggttcctgttatcatgatatgagatatgttcagaagttgtctgtgatcttttctgttctttgcgtagcatagagtcagtctattgcttctgtctgga

SEQ ID NO: 2714 - DNA, 798 bp, Avena sativa
gcggcggcggcgacgcaggcgcagcaatggcgcgctgcagcaacgggctcctgggcatgctcaacgccggggtgctcgtgctctccctcgtggtcctcggcggcggcatctggctcagccaccgcgccgccaccaccgactgcgagcggttcctggagcggcccgtcatcgcgctcggggtgctcctcctcgcgctctccctcgcgggcctcgcgggctccctctgccgcgcctcctgcctcctctggctctacctcgtcgcgctcttcctcctcatcgcgctcctcctcgtcttcaccgtcttcgccttcgtcgtcaccaaccgcggcgcaggctccgtcgtatccggcaggggctacaaggagtaccgcgtcggggagtactccacctggctgcagaggagggtggagaactccgacaactgggccaagatccggagctgcctccacgacggcaaggtttgccagaagctcggggccaggagggagacgctgcagcagttcgtcaccaacaatctctccccgatccagtccggatgctgcaagcccccaaccggatgcaacttcacctaccagagtgagactatctggatcaaacctcctggcctcaactctaccgatgaccccgactgcaacacatggtcaaatgatcagaatgctctctgctacgactgccagtcatgcaaggctggagtgcttgctaacctgaggaatgactggaagaagattgccactgtcaacatcattttcctcatcttcctcatcatcgtatactctgttgggtgctgcgctttcagga

SEQ ID NO: 2715 - DNA, 1236 bp, Oryza sativa
aagtaacccgaggaagaagaagacgacgacgaagaagccaagcggccgcaacctcgcagccatggcgcggtgcagcaacggcctcctcggcctcctcaacgccggcgtgctggtcctcgccgtggtggtgctgggcggcgggatctggctcagcaaccgcgccgccaccactgactgcgagcggttcatggagcgccccgtcgtcgcgctgggcgtgctcctccttgcgctctccctcgccggcctcgccggcgcgctctgcggcgcctcctgcctcctgtggctctacctcctcgcgctcttcctcctcatcctcgccctcttcgtcttcaccgtcttcgccttcgtcgtcaccaaccgcggcgccggctgggtcgtctccgggagagggtacagggagtaccgcctcggggactactccacgtggctgcagaggagggtggagaactccgcgaactgggccaagatccggagctgcctccaggacggcaaggtctgcgagaagcttggggccaggcgcgagaccatggaccagttcgtcggcagcaatctctccccgattcagtctggatgctgcaagcccccaacaggatgcaacttcgcctacgtgagcgagaccgtctggaccaaaccttctggctttaactctaccgatgacccggactgcacgacatggtcgaatgatcagaccgccctgtgctacgactgccagtcatgcaaagctggtgtgctcgctaacctgaagaatgactggaagaagattgcgactgtcaacatcatcttcctgatcttcctcatcatcgtctactccgttgggtgctgcgctttcaggaacaacaggcgggacaactcgtacccggcttggaaatgatctgcattggcgatgtataggttcttaggtcgtgttcggtaatgtttagctcgctcgcgtttcaagcaaccctgtcgtatatcatgccttactgttttatgcatcaaccgctgctagttgaagcatggttgctatcttgcctacatgatgtatgaattgaaggcttatgaaagatatgtttggtcaaattcctttgtggcctggcggcatagtttattacctgttggttcatagtactgtttctgtgtttctgttctgcatcttgcaggtgaatgtcggaaccttcatggattctttctccttacagagaaaaccagtcctttttgcaatatcatccaaaatacagaaagctgttgcagtgctgc

SEQ ID NO: 2716 - DNA, 1010 bp, Brachypodium distachyon
gccatggcgcggtgcagcaacgggctcctgggcctgctgaacgcgggggtgctggtcctctccctcgtggtcctcggcggcggcatctggctgagccaccgcgcgaccaccacggactgcgagcggttcctggagcggcccgtcatcgcgctcggggtgctcctcctggcgctctccctcgcgggcctggctgggtccctctgccgcggcgcatcctgcctcctctggctctacctcctcgcgctcttcctcctcatcgcgcttctcttcgtcttcaccgtcttcgccttcgccgtcaccaaccccggcgccgggtccgccgtctccgggagagggttcaaggagtaccgcctcggggcctactccacctggctgcagaagcgggtcgaggactccgggaactgggctaagatccggagctgcctccacgacggcggcgtctgccagaagcttggggacaggaaggagacgctgcagcagttcgccctcagcaacctctccccgattcagtctggatgctgcaagcccccaacagggtgcaacttcgcctaccagagtgagactgtctggacgaaaccccctggcttcaactctaccgataacccagattgcatcacatggtcaaataatcagaacgtcctctgctacgactgccagtcatgcaaggctggcgtgctcgctaacctgaagaacgactggaaaaagattgccaccgtcaacatcatattccttgtcttcctcatcgtcgtctactctgttggttgctgtgctttcaggaacaacaggcaggacaactcgtacccagcttggaagtgagattcatgctgatggttaggtaattaggcaagtcagtccgaatgtttggctcattgtggtgtgtcaagcaccttatcatctaactatatccctgatgatgtgtgaaccattgttagtttgtgcatgcttgctgtattgggctcgaatacatcatttattgatgatcctattatcatgatatgtttacaagcccc

SEQ ID NO: 2717 - DNA, 1395 bp, Zea mays
ccaaccatacacaagctttgcatccaatagcccacccaccagctgcgaaatctcctccaaacaacaactgaaccggacaaagaaagaaggccaaaaagggagtctcctttccaagttcaaaattcgaaacgtcccaagagaaaccgaaaccaccataaaaaccagcaaccaaccgtcatcgccgcacaagcgcacgcactcctcgccgtggaccaactccgaagccccatcccgtcccaactcccaagagccgaacgcgagcggcggccgccatggcgcggtgcagcaacggcctcctgggtctcctcaacgcgggcgtgctggtcctcgccatcgtcgcgctggggggcggcgcctggctcagccaccgcgcgtccaccaccgactgcgagcggttcctcgagcggcccgtcatcgcgctgggcgtgctcctcctcgcgctctccctcgcgggcctggccggcgcgctctgccgtgcctcctgcctcctctggctctacctcctcgcgctcttcctcctcatcctgctcctcttcgcattcaccgtcttcgcgttcgtcgtcaccaaccgcggcgccgggtgggtcgtctccggcagggggtacaaggagtaccgcctcggggactactccacctggctgcaaaggagggtggagaactcgcagaactgggccaagatccgcagctgcctccaggacggcaaggtctgccagaagcttgcgtccagaaaggagacggccgcccagttcgtcaacagcaacctctccccgatccagtctggatgctgcaagccaccaacgggttgcaacttcacctaccagagcgaaactgtctggaccaagcccgctggtttcaacaccacaactgacgaccctgactgcaccacatggtcgaacgaccagaccgtgctctgctacgactgcatggcctgcaaggcaggcgtgctggccaacctgaagaacgactggaagaagatcgccaccgtcaacatcgtcttcctgatcttcctcgtcgtcgtctactccgtcgggtgctgcgcgttcaggaacaaccggcaggacaactcgtacccggcctggaaatgaggtgcgcgtggcaatgtataggttgtttatgctatcatgctatgtgagtgactgcgtttcggtgaggaggggttcgctccttggtgtctagcaacctaccgtatgtattaactattaatgtgtccggttcatgtcactggtcgatgctgttttgccctcgaacgcatgatgatagtgtcccaaggctattatccagatatatgccgaaaaaaaatatgcgttttctgtgggcgtgtatcttgttgaattttgacgcttctgttcggatgtgcaccactaaacaaatgacgggaagaaatattgcaaaatt

SEQ ID NO: 2718 - DNA, 1131 bp, Panicum virgatum
  misc_feature (666)..(667): n is a, c, g, or t
  misc_feature (676)..(676): n is a, c, g, or t
ggcagaagcgcacgcccccctcgccgcagttccacccccacccgaaccccgaggagcggcggcggcggattcggccatggtgcggtgcagcaacggcctcctgggcctcctgaacgcgggcgtgctggtcctggccgtcgtcgcgctgggcggcggcgcgtggctgagccaccgcgcctccaccgactgcgagcggttcctcgagcggcccgtcatcgcgctgggcgtgctcctcctcgcgctctccctcgcgggcctggcgggggcgctctgccgcgcgtcctgcctcctctggctctacctcctcgctctcttcctcctcatcgtgctcctcttcgcattcaccatcttcgccttcgtcgtcaccaaccgcggcgccgggtgggtcgtctccggcagggggtacaaggagtaccgcctcggggactactccacctggctgcagcggagggtcgagaacgccgggaattgggccaagatccggagctgcctccaggacggcaaggtctgccagaagcttggggacaggaaggagacggtcacccagttcgtcaacagcaacctctccccgatccagtctggatgctgcaagccaccgaccggctgcaacttcacctaccagagcgagactgtctggatcaaacccgctggcttcaacactaccanngacgatccngactgcaccacatggtcgaacgtccagaccgtgctctgctatgactgtatggcgtgcaaggcgggcgtgctcgccaacctgaagaacgactggaaaaagatcgccaccgtcaacattgtcttcctgatcttcctcatcgtcgtctactccgtggggtgctgcgctttcaggaacaaccggcaggacaactcgtacccggcctggaagtaaggtgcgcgtggctatgtataggttgttagggtgtgtaattgtgtcgcggtgtggtcttatgtgtcaaccgtcagtagttgatgcttgctagtatgttgctctgagctctcgaacgtgaaatgatgtgtgaatgctgctaatcaagatatgtcgaaaatttgtctgtccaccagctgttctgggcttgagttttaacgcttctattcgaaatttcagtgctgaacactgcatgggttcgtgcaggg

SEQ ID NO: 2719 - DNA, 1023 bp, Sorghum bicolor
cggccatggtgcggtgcagcaacggcctgctgggcctcctgaacgcgggggttctggtcctcgcggtcgtcgcgctggggggcggcgcgtggctcagccaccgcgcgtccaccaccgactgcgagcggttcctggagcggcccgtcatcgcgctgggggtgctcctcctcgtgctctccctcgcgggactcgcgggcgcgctctgccgcgcctcctgcctcctctggctctacctcctcgcgctcttcctcctcatcctgctcctcttcgccttcaccgtcttcgccttcgtcgtcaccaaccgcggcgccgggtgggtcgtctccggcagggggtacaaggagtaccgccttggggactactccacctggctgcagaggagggtcgagaactcgcagaactgggccaagatccgcagctgcctccaggacggcaaggtgtgcgagaagctcgcggccaggaaggagacggtcgcccagttcgtcaacagcaacctctccccgatccagtctggatgctgcaagccaccgacaggttgcaacttcacctaccagagcgagactgtctggatcaagcccgctggcttcaacactacaagtacaactgacgaccccgactgcaccacatggtcgaacgaccagaccgtgctctgctacgactgcatggcctgcaaggcaggcgtgctcgccaacctgaagaacgactggaagaagatcgccaccgtcaatatcatcttcctgatcttcctcatcgtcgtctactccgttgggtgctgcgcgttcaggaacaatcggcaggacaactcgtacccggcctggaaatgaggtgcgcgtggcaatgtataggttgtttagtgtttcggtgagctcggttcgcgcctgtgtctagcaagctaccgtatgtattaatgtgctcgggtcatgtcacttgttgatgctgttttgcccgcgaacgcatgatgatagcgtctgaaggctattatattatcgagatatgtgtcgaaaaaattaggcgtattctgct

SEQ ID NO: 2720 - DNA, 825 bp, Setaria italica
cggcggcggcggattcggccatggtgcggtgcagcaacggcctcctgggcctcctgaacgcgggcgtgctggtcctggccgtcgtcgcgcttggcggcggcgcgtggctgagccaccgggcttccaccgactgcgagcggttcctcgagcggcccgtcatcgcgctgggcgtcctcctcctcgcgctctccctcgcgggcctggcgggggcgctctgccgcgcctcctgcctcctctggctctacctcctcgcgctcttcctcctcatcgtgctcctcttcgccttcaccatcttcgccttcgtcgtcaccaaccgcggcgcagggtgggtcgtctccggcagggggtacaaggagtaccgcctcgactactccacctggctgcagcggagggtcgagaacgcagggaattgggccaaggtcaggagctgcctccaggacggcaaggtctgccagaagcttgcggacaggaaggagacggtcacccagttcgtcaacagcaacctctccccgatccagtctggatgctgcaagccacccaccggctgcaacttcacctaccagagtgagaccgtctggatcaaacccactggcttcaacactaccaccgacgaccccgactgcaccacatggtcgaacgaccagaccgccctctgctacgactgcatggcgtgcaaggcaggtgtgctcgccaacctgaagaacgactggaagaagattgcaaccatcaacattgtcttcttgatcttcctcatcgtcatctactctgtcgggtgctgtgcgttcaggaacaaccggcaggacaactcgtacccggcctggaagt

SEQ ID NO: 2721 - DNA, 1655 bp, Zea mays
ttccaacacctgtcccgccgcccccgctataaaaacccgcgacgccggccgagggcgccccaagccaacacggtcacacgactgcataattgtgctcgctcgccgggccccgggacgtgacacatcgcacggccgaagcagcttgccggctgccgcgtttcgcctcccgcctgccgtgccgcccgtgaccgcgagaaggccggcagctttgcatgaggaggaggaggatgggggcactgcacgtcgtcggcgagcccaggatcagcttccgccagcagcctgcagcagtcgtcgcgaagaacggcggccacggcgccgtcgtcgaggagatccacggcctgatccgcgtctacaaggacggacacgtggagcggctcccggcgatcccagccgtgccctgcacgtggggcggcacggccccggacgcgccgggcggcgtcgtcgcgagggacgtggtggtggaccccgcgacgggggtgtgggcgcggctgtacgcgccgacgtcggcgggggacggagccaggcgccccgtcgtggtgtacttccacggcggcgggttctgcgtcgggtccgcggcctggagctgctaccacgagttcctcgcccagctcgcggcgcgcgcgggctgcgccgtgatgtccgtggactaccggctggcgcccgagcaccgcctgccggccgcgttcgacgacgggctggccgcggtgcggtggctgcggcaccaggccgcagcgtcagcgtcagcgtcagcgtgctgcaacgacgacctgtcgtggtggcgggcccgctgcggctttgaccgcgtgttcctcatgggcgacagcgcgggcgccagcatcgccttgcacgtggccgcgaggctcgggcagggccagcttggcgcgctgccccccttgaccgtcaggggcgccgtcctgatccagccattcctgggcggcgaggggcgtaccgcgtccgagaagaacgtggcgcagccgccacggtcggcgctgacgctggccacctccgactgctactggcggctggcgctgccggccggagccagccgcgagcacccctggtgcaacccgctgtcgggccgcgccgcgccgcgcctggagaccactccgctgcccccgctcctggtgtgcgtctcggagacggacatcctgcgggaccgcaacctggagctgtgcagggcgttgcgcgaggcgggcaagcgcgtggagcaggccgtgtacggcggcgtcgggcacgcgttccaggtgctccacaactgccacctgtcccagccgcggacgcaggagatgctcgcgcacatcaaggccttcgtcagcgccaggtagcaggcgccgcagcagcagccgcctcctccattcgtcgttggtccctaacaaacagacactcgccatgttaattaatccactacctaatcctaatccaatcgaagagtagatgccgtgtaagcaaccagaaccagccttgtgcagtactgtatcagtagtgtgtgacttggagcagaaagcgtccaatgcccagcccgggttgttgttgtagcggtgtcggaaagcaaaagcttatcactacactaccccggtcgtctggccgcttcatatacatgtatgatccgccgttcatttcatttcatcttgttaagaaagcctgatgctgtttct

SEQ ID NO: 2722 - DNA, 1546 bp, Triticum aestivum
gggtcaacgccgcataattgtgtccgccgccggctcccgggacaccgcacagcgcacagacaacccaaggcctagcaccactctccttgtctcgcacctgcctgccggctgcgccgctagcgatcgagctaagtcgacgcgcgcgcgtgggcttttgcatgataaggaggaggatgggggcactgcacgtcggcgagccgcgggtcagcttccagcagcaggtcggcaagaacggcgggggccacggcgccgtcgtggaggagatacacgggctcatccgcgtgtacaaggacgggcacgtggagcgcctcccggcgatccccgacgtcccctgcacgtggggctcgacggccgccgcgagcggcgtcctcgcgcgcgacgtggcggtcgaccgcgccacgggggtgtgggcgcgcctgtacgcgccggccgccgcggcggggaaggtccccgtggtggtgtacttccacggcggcgggttcagcgtcggctccgccgcgtggagctgctaccacgagttcctcgcccagctccccgcgcgggcgggctgcgccgtgatgtccgtcgactaccgcctggcgccggagaaccgcctgcccgccgcgttcgacgacgggctcacggcgctgcggtggctgcggcagcaagcgagcagaaacgcggccgcctccgacgaggtctcgtggtggcgcagccggtgcaggttcgaccgcgtgttcctcatgggcgacagcgcgggcgccgccatcgcgttccacgtcgcggcgcgggccgggcagggccagctgggcgcgctggcgccgctctcggtcaagggagccatactgatccagcccttcttcggcggggaggcccgcacggcgtcggagaagagcatgccgcagccgccggggtcggcgctgagcctgtcgacctcggacagctactggcgcatggcgctcccggccggcgccgggcgcgaccacccctggtgcaacccgctggcccgcggcgccccccggctggagacgctggcgctgccgcccgtgctggtgtgcatctcggaggcggacatcctgcgcgaccggaacctggagctgtgcagggcgctgcgcaaggccggcaagagcgtggagcaggcgacgtacggcggcgtggggcacgccttccaggtgctccacaactgccacctgtcccagccgcgcacgcaggagatgctcgcccacatccgggccttcgtcagcgccaggtccagctgacaggcagacaccactcctccgccgtgccatgtcagtgtcacccgccgattaattacataatccactaccagttccagagtagatgccgtgtaagcagtattagcagtagcttgtggtactcgcccaagtgaaggaaaagacaagaagaaaagggtccaatgccgaacttggatcgtggtgtcggaaagcaaaagtgtggcgcaaaaataacactttctccatgtatgtatgtgtatcgtgttgttcattgtactcctacttacttgcaaaggcggatcaatatatatatataattattaaaaaaaaaa

SEQ ID NO: 2723 - DNA, 1478 bp, Saccharum officinarum
aggttcgtttcggtttggattgattggtttcatcggtggtgaggttagggtcttggagtggattgatttgggattctgtgttcgacgatttggggaaggaggcaatggcgaccgcggggaaggtgatcaagtgcaaagctgcggtggcatgggaggccggcaagccgctgtcgatcgaggaggtggaggtagcgcctccgcaggccatggaggtgcgcgtcaagatcctcttcacctcgctctgccacaccgacgtttacttctgggaggccaaggggcagactcccgtgttccctcggatctttggtcatgaggctggaggtatcatagagagtgttggagagggtgtgactgacgtagctcccggtgaccatgtccttcctgtgttcactggggagtgcaaggagtgcccccactgcaagtcggcagagagcaacatgtgtgatctgctcaggatcaacactgaccggggtgtgatgattggcgatggcaagtcacgattttcaatcaatggaaagcctatctaccacttcgttgggacttccaccttcagcgagtacactgtcatgcatgttggttgtgttgcaaagatcaaccctgaggctccccttgataaagtctgtgttcttagttgtggtatttctactggtcttggtgcatcaattaatgttgcaaaaccaccaaagggttcaacagtggctattttcggtctaggagctgttggtcttgccgctgcagaaggtgcaaggattgctggagcgtctaggatcattggtgttgacctgaaccccagcagattcgaagaagctaggaagtttggttgtactgaatttctgaacccaaaagaccacaagaagcccgtgcaggaggtacttgctgagatgaccaatggaggggttgatcgcagtgtggaatgcactggcaacatcaacgctatgatccaagcatttgaatgtgttcatgatggctggggtgttgctgtgctggtgggtgtgccacataaggatgctgagttcaagactcacccgatgaacttcctgaatgagaggaccctgaagggaaccttctttggcaacttcaaaccacgcactgatctgccaaatgtggtggagctgtacatgaaaaaggagctggaggtggagaagttcatcacacacagcgttccgttcgcggagatcaacaaggcgttcgacctgatggcaaagggggagggcatccgctgcatcatccgcatggagaactagatttcgctgtctggtttgtgatctgacctgggttgggttaataaaagagtcaatgctgagcctgccctttcgatgaggaggtagatacacgctggtgatggaccacgcttgtgtgtcgcgttcagtttggctttgtcaatcagtagagcagcttcccgtgtctaattatatatcggcatgagtcttgtgaaccatcatcttttggcgtaatatatggtatggtgccactatgag

SEQ ID NO: 2724 - DNA, 1689 bp, Panicum virgatum
tccctctccggctcctcacgggattcgattcgcttcggtttggattgggttgtttcctgaatcctgatttgatcggtggtgcgcttggagctgcttggtttgggattcttctcggagatttctggggaacgaggcaatggcgaccgccgggaaggtgatcaagtgcaaagccgcggtggcatgggaggccgggaagccgctgtcgatcgaggaggtggaggtggctccgccgcaggccatggaggtgcgcgtcaagatcctctacacctcgctctgccacaccgacgtctacttctgggaggccaaggggcagacgcccgtgttccctcggatctttgggcatgaggcaggaggtatcatagagagtgttggagagggtgtgactgacgtggcccctggtgaccatgtccttcctgtgttcactggggagtgcaaggagtgcccccactgcaagtcagccgagagcaatatgtgtgatctgctcaggatcaacactgaccggggtgtgatgattggtgatggcaagtcgcggttttcaatcaatgggaagcctatctaccattttgttgggacatccaccttcagcgagtacactgtcatgcatgttggttgtgttgcaaagatcaaccctgaggctccccttgataaagtttgtgttcttagctgtggtatttctactggtcttggtgcaacaattaatgttgcaaaacctccaaagggttctacagtggctattttcggtctaggagctgttggtcttgctgctgccgaaggtgcaaggattgctggagcgtcaaggatcattggtgttgatctaaaccccagcagattcgaagaagctaggaagtttggttgcactgaatttgtgaacccaaaagaccacaacaagccagtgcagcaggtacttgctgagatgaccaatggaggagttgaccgcagcgtggaatgtactggaaacatcaacgctatgatccaagcatttgagtgtgttcatgacggatggggtgtggctgtgcttgttggtgtgccacacaaagatgctgaattcaagactcacccaatgaacttcctgaacgagaggaccctgaagggaaccttcttcggcaactataagccacgcactgacctgcccaatgtggttgagctgtacatgaagaaggagctggaggtggagaagttcattacgcacagcgtcccattcgcggagatcaacaaggccttcgacctgatggcgaagggggagggcatccgctgcatcatccgcatggagaactagattcagtcgcgtggcttgcctgattcgggtttgggctaataaaggtagcagtgtctggtgagcctgccctgtcgatgggggaggaaagatacacagtggtggcatcccacccatgtgtgtcacgtccagtttggccttgtcaatcagtagggtgtagcttccagcgtctgtgattatctatcggcatgagagtctctcgaactgtctttcggcttaatatatggtatggtacgtaccactatgagtttgagtcgaccaggctgttttggttcatttgtgctgcactggttggtgatttttgctgatctgtttgtggtcctgtgaatcagttgaatttcatcttgcctctggtggtttcaacgttaggaaccaacaagtggtgacagaatgttttctttaccgttcagactttt

SEQ ID NO: 2725 - DNA, 1659 bp, Sorghum bicolor
aaaccacggtccacggaccacggctgcgttccagtccaggtggaggctgtgcaaccccggttttcgctcgctgcgccgtggtttgctgcccaaggtggccggaggtggcgaaaccgcacccggatccttcccatcgtttctcatctcttcctcctttagagcttagtatataatcagggctcttgtctcctggctcctcacaggttcgtttcggtttggattgattggtttgatcagtcgtggggtgagggtcttggagtcgattgatctgggatactgttagaggatttggggagggggcaatggcgaccgcggggaaggtgatcaagtgcaaagctgcggtggcatgggaggccggcaagccgctgtcgatcgaggaggtggaggtagcgcctccgcaggctatggaggtgcgcgtcaagatcctcttcacctcgctctgccacaccgacgtctacttctgggaggccaaggggcagactccggtgttccctcggatcttcggtcatgaggctggaggtatcatagagagtgttggagagggtgtgactgacgtagctcccggtgaccatgtccttcctgtgttcactggggagtgcaaggagtgcgcccactgcagatcggcagagagcaacatgtgtgatctgctcaggatcaacactgaccggggtgtgatgattggcgatggcaagtcacggttttcaatcaatggaaagcctatctaccattttgttgggacttcaaccttcagcgagtacactgtcatgcatgttggttgtgttgcaaagatcaaccctgaggctccccttgataaagtttgtgttcttagttgtggtatttctactggtcttggtgcatcaattaatgttgcaaaaccaccaaagggttctacagtggctattttcggtctaggagcagttggtcttgccgctgcagaaggtgcaaggattgctggagcatcaaggatcattggtgttgacctgaaccccagcagattcgaagaagctaggaagtttggttgtactgaatttctgaacccaaaagaccacaagaagcccgtgcaggaggtacttgctgagatgaccaacggaggggttgaccgcagtgtggaatgcactggcaacatcaatgctatgatccaagcatttgaatgtgttcacgatggctggggtgttgctgtgctagtgggtgtgccacacaaggatgctgagttcaagacccacccaatgaacttcctgaacgagaggaccctgaagggaaccttctttggcaacttcaaaccacgcactgatctgccaaatgtggtggagctgtacatgaaaaaggagctggaggtggagaagttcatcacacacagcgttccgttcacggagatcaacaaggccttcgacctgatggctaagggagaaggcatccgctgcatcatccgcatggagaactagatttcgctgtctggtttgtgatctgacctgggttgggttaataaaaggggcaatgctgagcctgcccgttcgatgcggtagatacaggaccacgcttgtgtgtcgcgttcagtttggctttgtcaatcagtagaacaggttcccgtgtcttgtaattatatatcggcatgagtcttatgaaccaccatcttttggcgtaatatatatatggtatgct

SEQ ID NO: 2726 - DNA, 1688 bp, Panicum virgatum
aaccgcaccctccgtcccctcctccttcccctcccccacgcttgccgccgggccggagctatatataggcggggcaatccctctccggctcctcacggattcgattcgcttcggcttcgattgggcttttgtgtcctgatttgatcggtgccgcgcttggagctgcttggtttgggattccgctcggggatttctggggaacgagacaatggcgaccgccgggaaggtgatcaagtgcagagccgcggtggcatgggaggccgggaagccgctgtcgatcgaggaggtggaggtggcgccgccgcaggccatggaggtgcgcgtcaagatcctctacacctcgctctgccacacagacgtctacttctgggaggccaaggggcagactcccgtgttccctcggatcttcggtcatgaggctggaggtatcatagagagtgttggagagggtgtgactgacgtggcccctggtgaccatgtccttcctgtgttcactggggagtgcaaggagtgtccccactgcaagtcggcagagagcaacatgtgtgatctgctcaggatcaacactgacaggggtgtgatgattggtgatggcaagtcgcggttttcaatcaatgggaagcctatctaccactttgttgggacttccaccttcagcgagtacactgtcatgcatgttggttgtgttgcaaagatcaaccctgaggctccccttgataaagtttgtattcttagctgcggtatttctactggtcttggtgcaacaattaatgttgcaaaaccgccaaagggctcaacagttgctattttcggtctaggagctgttggtcttgctgctgcagaaggtgcaaggattgctggagcgtcgaggatcattggtgttgatctgaaccccagcagattcgaagaagctaggaagtttggttgcactgaatttgtgaacccaaaagaccacaacaagccagtgcagcaggtacttgctgagatgaccaatggaggtgttgaccgcagcgtggaatgcactggcaacatcaacgctatgatccaagcttttgagtgtgttcatgatggttggggtgtggctgtgctggtcggtgtgccacacaaggatgctgaattcaagactcacccaatgaacttcctaaacgagaggaccctgaagggaaccttcttcggcaactacaagccacgcactgacctgcccaatgtggttgagctgtacatgaagaaggagctggaggtggagaaattcatcacgcacagcgtcccgttcgcggagatcaacaaggccttcgacctgatggctaagggggagggcatccgctgcatcatccgcatggagaactagattctgtcggcctggtgggtgggtttgtctgaatcgggatgtgttaataaaggtagcagtgcttggtgagcctgccctgtcgatgggggaggcaggatgcacggtggtcgcgagccatgcttctgtgtcacgtccagtttggccctgtcaatcagtagggtgtagcttccagcgtctgtaattatctatccgcatgagagtctttccaactgtcttcggcttaatatatggtatggtatcactatgagtttcagtggactggcctgctgccgttcatttgtgatgctgcgatgctttggttggtcatttgtgatgatgcgatgctttggttggtcatttg

SEQ ID NO: 2727 - DNA, 1612 bp, Setaria italica
cccccacgctcagcgcctcgcccggagctatatatagacggggcgctcccctctggctcctcacggattcgatttggcttggattgggttggatttgatcggtgtgaggtgattagtgctgcttgatttgggattccgttcggggatttggggaacgaggcaatggcgacggccgggaaggtgatcaagtgcaaagccgcggtggcatgggaggccgggaagccgctgtcgatcgaggaggtggaggtggcgccgccgcaggccatggaggtgcgcgtcaagatcctctacacctcgctctgccacaccgacgtctacttctgggaggccaaggggcagactcccgtgttccctcggatcttcggtcatgaggctggaggtatcatagagagtgttggagagggtgtgactgacgtggcccctggtgaccatgtccttcctgtgttcactggggagtgcaaggagtgcccccactgcaagtcggcagagagcaacatgtgtgatctgctcaggatcaacactgacaggggtgtgatgattggcgatggcaagtcacggttttcaatcaatggaaagcctatctaccactttgttgggacatccaccttcagtgagtacactgtcatgcatattggttgtgttgcaaagatcaaccctgaggctccccttgataaagtgtgtgttcttagctgcggtatttctactggtcttggtgcaacaattaatgttgcaaaaccgccaaagggctcaacagttgctattttcggtctaggagctgttggtcttgctgctgcagaaggtgcaaggattgctggagcgtcaaggatcattggtgttgacctgaacccaagcagattcgaagaagctaagaaatttggttgcactgaatttgtgaacccaaaagaccacagcaaaccagtgcagcaggtacttgctgatatgaccaatggaggagttgaccgcagtgtggaatgcactggaaacgtcaacgctatgatccaagcatttgagtgtgttcatgatggctggggtgtcgctgtgctggttggtgtgccacacaaggatgctgagttcaagactcacccgatgaacttcctgaacgagaggaccctgaagggaaccttcttcggcaactacaagccacgcactgacctgcccaatgtggtggagctgtacatgaagaaggagctggaggtggagaaattcatcacgcacagcgtcccgttctcggagatcaacaaggcctttgacctgatggcgaagggggagggcatccgctgcatcatccgcatgcagaactagattcagtcgcctggttttatccgattcgggtcgggtcaataaacgcggcagtgccgagtgagcctaccactgtctggtggggaggaagatacacgcttgtgtgtgtgtcacggtcagtttggcattgtcaatcagtagagtacctctagcgtctgtaattgtctatcggtattggcatgagtgcacaagtgagttttgggtctcatcagattgttccggttcacttgttgtgatgctttggttgtgtgtgctgctatttgcgtgcaaatcttgctgaatttaggaggctgaactccaggacagtggccgc

SEQ ID NO: 2728 - DNA, 1456 bp, Cynodon dactylon
gcaccgcacggattcgaatcgatcgagtttcgggttgggtggttcgataggtcgtgtgaggcgagtctttggaggagcgtttggttgatttgggatttctgctggagaagcaaatggcgaccaccgggaaggtgatcaagtgcaaagccgcggtggcatgggaggccgggaagccgctgtcgatggaggaggtggaggtggcgccgccgcaggccatggaggtgcgcatcaagatcctcttcacctcgctttgccacaccgacgtctacttctgggaagcaaagggacagactccggtgttccctcggatctttggtcatgaggctggaggcattgtggagagtgttggagagggtgtgactgaccttgctcccggggaccatgttcttcctgtgttcactggggaatgcaaggaatgcgcccactgcaagtcagctgagagcaacatgtgtgatctgctcaggatcaacacggacaggggtgtgatgatcggtgatggcaagtcacggttttcaatcaatgggaagcctatttaccatttcgttgggacttccaccttcagcgagtacactgtcatgcatgttggctgtgttgcaaagatcaatcctgaggctccccttgataaagtttgcgttctcagctgtggtatttctactggtcttggtgcctcaatcaatgttgcaaaaccacctaaaggttcaactgtggccgtatttggtcttggagccgttggccttgctgctgcggaaggtgcaaggattgcaggagcatctagaataattggtgttgacctgaacccaaacagatttgaagaagctaggaagtttggttgcactgaatttgtgaacccgaaagaccacagcaagcctgtgcaggaggtacttgctgagatgaccaatggtggtgttgatcgcagtgttgagtgtacaggcaacatcaacgctatgatccaagcatttgaatgtgtgcatgatggttggggtgttgctgttctggtgggtgtaccacacaaggatgcagagttcaagactcacccgatgaacttcctgaacgagaggaccctgaagggaactttctttggcaacttcaaaccgcgtactgaccttcccaatgtggtggaactgtacatgaagaaggaactggagctggagaagttcatcacgcacaccgtgccattctcagagatcaacaaggcctttgacctgatggcaaagggggagggcatccgctgcatcatccgcatggaccactagacggttgatatatagcctccgatgaacttgtggagcagaataagatggcacaggcctgtgcttgcctttgtcagtgaggtagattgatacacgttcgtttagtgtatcacgtccagcgtttgtaaacagtagtgtggtaggtaattatctaccgtcatgagtcctttatgaacaatcttttggcgtaatatatggtatcttat

SEQ ID NO: 2729 - DNA, 1544 bp, Festuca arundinacea
  misc_feature (1233)..(1233): n is a, c, g, or t
gcacgaggccgcacccttcctttcccttcctcctttttaggacccgggtaggaactatatatagtccagccccccacgctcggttcccccacggatttgatccactgaagcgatttgggcttgtttcgtgcttagattgtggtcttcgttccggttgatttcttaggcgagggaacaatggcgaccgcggggaaggtgatcaagtgcaaagccgcggtggcatgggaggcggggaagccgctgtcgatggaggaggtggaggtggcgccgccgcaggccatggaggtgcgcgtcaagatcctcttcacctccctctgccacaccgacgtctacttctgggaggccaaggggcagactcccgtgttccctcggatcttcggtcatgaagctggaggcatagtggagagtgttggagagggtgtgactgaggttgcccctggtgaccatgtcctccctgtgttcaccggggagtgtaaggaatgcccccactgcaagtctgcggagagcaacatgtgtgatcttctcaggatcaacaccgacagaggtgtgatgatcagcgatggcaagtcacggttctctattgatggcaagccgatttaccatttcgtagggacttccaccttcagtgagtatactgtcctgcatgttggttgtgttgcaaagatcaaccctgaggctccccttgataaagtctgtgttcttagctgtggtatttctactggtcttggtgcgtcgattaatgttgcaaaaccgccaaagggttcgacagtcgcgatatttgggctaggagctgttggacttgctgctgcagaaggtgcaaggattgcaggagcatcaaggatcattggtgttgacctgaatgctaacagatttgaagaagctaggaaatttggctgcacagaatttgtgaacccaaaagatcacagcaagccggttcaagaggtacttgctgagatgacaaatggcggagttgaccgcagtgttgaatgcactggcaacatcaatgctatgatacaagcatttgaatgtgttcatgatggctggggtgtagctgtgctggtgggtgtgccacacaaggatgccgaattcaagacccacccaatgaacttcctgaatgagaggactctgaagggcaccttcttcggtaacttcaaaccacgcactgacctgcccaatgtcgtggagatgtacatgaagaaggagctggaggtggagaagttcatcacccacagngtgccgttctcggagatcaacaaggccttcgacctcatggcgaagggcgagggcatccgctgcatcatccgcatggagaactaggtctctcacctgcttacgaacgctccaacgtagtatgtaataagtgctgggggtggtctctgaacctgccgtggttgagatcagacacgcatcgttgatgagatacgctgccgtgtatcatcgtcgtttgctgtttcgccttcctaagccagtagcgtagctttatcctccggtgtcttctgtaattacttaccgatggaacagtggtacgagctcccttttggcgt

SEQ ID NO: 2730 - DNA, 1614 bp, Leymus cinereus x Leymus triticoides
  misc_feature (25)..(25): n is a, c, g, or t
  misc_feature (27)..(27): n is a, c, g, or t
  misc_feature (32)..(33): n is a, c, g, or t
cccactcggttccccacggatttgntnctgtnngcgagagaccagttctcgatttcgattccggggagaatatttgaggcgagagagatggcgacggccgggaaggtgatcaagtgcaaagccgcggtggcatgggaggcggggaagccgctgtccatggaggaggtggaggtagcgccgccgcaggccatggaggtgcgcgtcaagatcctcttcacctccctctgccacaccgatgtctacttctgggaggccaaggggcagactcccatgttccctcggatcttcggtcatgaagctggaggcatagtggagagtgttggagagggtgtgactgatgttgcccctggtgaccatgtcctccctgtgttcactggagagtgtaaggaatgcccacattgcaagtctgcggagagcaacatgtgtgatctgctcaggatcaacaccgacagaggtgtgatgatcggggatggcaagtcacgcttctctattggcgggaaaccgatttaccatttcgtagggacttccaccttcagtgagtatactgtcatgcatgttggctgtgttgcgaagatcaaccctgaggctccccttgataaagtctgtgttcttagctgtggtatttccactggccttggcgcatccattaatgttgcaaaaccaccaaagggttcgacagtggcgatatttgggctaggagctgttggccttgctgctgcagaaggtgcaaggattgcaggtgcatcaaggatcattggtgttgacttgaacgccaacagatttgaagaagctagaaaatttggctgcacggaatttgtgaacccgaaagatcacagcaagccagttcagcaggtgctcgctgagatgacaaatggtggagttgaccgcagtgttgagtgcactggcaacgtcaatgctatgatacaagcatttgaatgtgttcatgatggctggggtgtagctgtgctggtgggtgtgccacacaaggacgccgaattcaagacccacccgatgaacttcctgaatgagaggactctgaagggcaccttcttcggtaacttcaagccgcgaactgacctgcccaatgtcgtggagatgtacatgaagaaggagctggaggtggagaagttcctcacacacagcgtgccattctcagagatcaacaaggcgttcgacctcatggcgaagggggagggcatccgctgtatcatccgcatggagaactaggcctcctcgcgtgcttctgatcgctccaatgtaataagtgctggggggtggtttctgaacctgccttggtgagatcatcagtgatgggcctatcatcgtctgctgtttcgccttccttggccaagtagcgtagtattattagttcaagtatatctgtaattacctaccggagaagtggttgtgcgagctctcctttgtcagcaatatatgctgctgctgctactactactatggccacgagtttcagttgaatcagtctgttctcagcttgatgtttccatctcccgttgattctgctgcgttgcttattgagtactatttcctactgcttggctgaatctgctgggacgttcaggcaatgtagtgtgctttcttctgcaaaaaaaa

SEQ ID NO: 2731 - DNA, 1897 bp, Oryza sativa
gccggccgtcgcgcatccgacggccactcaccatcggcgtcgggggaggcgaaaacagcggctgcaattccgcttccaggtggagggggaggaggcccggtttgtgtgccacgccgccccactccgtccgtggtttgctacccaagaagacaagaagaaggaagtggcgaaacctcaccctccatcctccatcctctcctttcttccttcgaggaggaggagctatatatagacggggatggttcatctagcctcctcaccggttttgatttgatctgtgtgatttgagtgagtgagtgagattctttggaggagggattttggtttggtttggtttggtggtttgtgcgggattttgtggggaggagagtaatggcgaccgcagggaaggtgatcaagtgcaaagcggcggtggcatgggaggccgcgaagccgctggtgatcgaggaggtggaggtggcgccgccgcaggccatggaggtgcgcgtcaagatcctcttcacctcgctctgccacaccgacgtctacttctgggaggccaagggacagactcccgtgttccctcggatcttcggccatgaagctggaggtattgtggagagtgttggagagggtgtgactgatcttgcccctggtgaccatgttctccctgtgttcactggggagtgcaaggagtgtccccactgcaagtcagcagagagcaacatgtgtgatctgctcaggatcaacactgacaggggtgtgatgattggtgatggcaaatcacgtttttccatcaacgggaagcctatttaccatttcgtcgggacttcgaccttcagcgagtacactgtcatgcatgttggttgcgttgcgaagatcaacccggcagctccccttgataaagtttgcgttcttagctgtggtatttctactggtcttggtgctacaatcaatgtggcaaagccaccaaagggttcaactgtggcgatttttggtctaggagctgtaggccttgctgccgcagaaggtgcaaggattgcaggagcatcaaggatcattggcattgacctgaacgccaacagatttgaagaagctaggaaatttggttgcactgaatttgtgaacccaaaggaccatgacaagccagttcagcaggtacttgctgagatgaccaatggcggagttgaccgcagcgttgaatgcactggcaacatcaacgccatgatccaagcatttgaatgtgttcatgatggctggggtgttgctgttttggtcggcgtgccacacaaggacgccgagttcaagacccacccgatgaacttcctgaacgagaggactctcaagggaaccttcttcggcaactacaagccacgcaccgatctgcccaacgtcgtcgagctctacatgaagaaggagctggaggtggagaagttcatcacacacagcgtgccgttctcggagatcaacacggcgttcgacctgatgcacaagggcgagggcatccgctgcatcatccgcatggagaactgaggtttttcaggggattatggtgttgggtaataagattgggcagcttgagcagcctgccttgggtgaatgatgatatacggttcttctgtgtatcctgggcaaatttctggctttgtcaatcagtaatagtacggtatgaattccagtgtctgtagctgcaaagagtttgttaagaatcagtgatcttttggcgtaatattatcatatatttatacgagtttcagttcgtcaccctcttcacttttcagaacttttttaagtcttatgacttcagagccaccaaacgtgctgtttttgaattccatggtggcttgaatttggtacatgttcatgtaaatgtgggatatttgtcatcagagatttgtgcgctcgagttgtggtttaa

SEQ ID NO: 2732 - DNA, 1530 bp, Hordeum vulgare
gtgaagtgagagatcagttctcgatttcgattccgggctcacagaatttttcgattcaaggcgacgcgaagcgacagagaaagatggcgacggccggcaaggtgatcaagtgcaaagccgcggtggcgtgggaggccgggaagccgctgaccatggaggaggtggaggtggcgccgccgcaggccatggaggtgcgcgtcaagatcctcttcacctccctctgccacaccgacgtctacttctgggaggccaaggggcagacccccatgttccctcggatcttcggccatgaagctggaggcatagtggagagtgttggagagggcgtgactgatgttgcccctggtgaccacgtcctccctgtgttcactggggagtgtaaggaatgcccacattgcaagtctgcggagagcaacatgtgtgatctgctcaggatcaacaccgacagaggtgtgatgatcggggatggcaagtcgcgcttctctattggcggcaagccgatttaccatttcgtagggacttccaccttcagtgagtacactgtcatgcatgtcggttgtgttgccaagatcaaccctgaggctccccttgataaagtctgtgttcttagctgtggtatttccactggtcttggcgcgtcaattaatgttgcaaaaccaccaaagggttccacagtggcgatatttgggctaggagctgttggccttgctgctgcagaaggtgcaaggattgcaggtgcatcaaggatcattggtgttgacctgaacgccagcagatttgaagaggctaggaagtttggctgcacggaatttgtgaacccgaaagatcacaccaagccagttcagcaggtgctcgctgacatgacaaatggcggagttgaccgcagtgttgagtgcactggcaacgtcaatgctatgatacaagcatttgaatgtgttcatgatggctggggtgtagctgtgctggtgggtgtgccacacaaggacgctgaattcaagacccacccgatgaacttcctgaatgagaggaccctgaagggcaccttcttcggtaacttcaagccgcgcactgacctgcccaatgtcgtggagatgtacatgaagaaggagctggaggtggagaagttcatcacacacagcgtgccgttctcggagataaacaaggccttcgaccttatggcgaagggggagggcatccgttgcatcatccgcatggacaactaggcgtcctcctcaagtgcttctgatcgctccgatgtaataagcgctgggggccggcttctgaaccagatcatcggtgatggtaatacacttccatgtatcatcgtctgcggtttcgccttccttggccaaagtagcgtaatattagttatgtatatctgtaattaccttaccggagaagtggttgtactacgagctctttttcggcagcaatgtatgctgctgctgctgctgctgctatggccatgagtttcagttgaatcagtctgttctcaacctgatgtttccatattctgtgtcttcttgctgc

SEQ ID NO: 2733 - DNA, 1495 bp, Saccharum officinarum
attggattgatttgatttggtttcatcggtggtgtggtgacgttcttggagggagattctgtctggatttgggagtccggtgggggatttgatccaaggaagaagcaatggccaccgcggggaaggtgatcaagtgccaagcccccctggcatgggaggcccgcaagccgctgtccatccaagaagtggaggtggcgcctcctcacgccatggaggtgcgcgtcaagatactctttacctcgctctgccacactgacgtctacttttgggaggccaaggggcacacacccgtgttccctcggatcttcggtcatgaggctggaggcattgtggaaagtgttggagagggtgttactgaccttgcccctggtgaccatgtcctcccggtattcactggggagtgcaaggagtgtgcccactgcaagtcggcagagagtaacatgtgtgatctgctcaggatcaacactgaccggggtgtgatgattggtgatggcaaatcacggttttccatcaatgggaagcctatctaccattttgttgggacttccaccttcagtgagtacactgtcatgcatgttggttgtgttgcaaagatcaaccctgaggctcccctggacaaagtttgtgttcttagctgtggtatttctactggtcttggtgcatcaatcaatgttgcaaaaccgccaaagggttcaacagttgctatttttggtctaggagctgttggccttgctgctgcagaaggtgcaaggattgctggagcatcaaggatcattggtgttgacctgaacgccaacagattcgaagaagctaagaagtttggttgcactgaatttgtgaacccaacagaccacaacaagccagtgcaggaggtacttgctgagatgaccaatggaggggttgaccgtagtgtggagtgcactggtaacatcaacgctatgatccaggcatttgaatgtgttcatgatgggtggggtgttgctgtgctggtgggcgtgccacacaaggacgcagaattcaagactcacccaatgaacttactgaacgagaggaccctaaagggaaccttcttcggcaactacaaaccacgcactgacctgcccaatgtggttgagctgtacatgaagaaggagctggaggtggagaagttcatcacgcacagcgtgtcgttcgcggagatcaacaaggccttcgacctgatggccaagggggagggcatccgctgcatcatccgcatggagaactagattgcttgttctggttgtctggtctgggttgggttaataagggggcagtgtcctctgtggatgtggagccacgcttgtgtgtatcacgtccagtttggccttgtcaatcagtagagtagcttccagcgtctgtaagagtcgtgaacgtgctcggcataatatatggtttaactctgagtttcattcagtcaagaaagatcaaaaaaaaaaatcagcccgggaattccggaccggtgcttcacacgacg

SEQ ID NO: 2734 - DNA, 1459 bp, Triticum aestivum
ttgatcctgtgaagtgagagatcagttctcgatttcgattccgggctcagagaattccccaggcgagcgagcgagatggcgaccgccgggaaggtgatcaagtgcaaagccgcggtggcgtgggaggcggggaagccgctgtccatggaggaggtggaggtggcgccgccgcaggccatggaggtgcgcgtcaagatcctcttcacctccctctgccacaccgacgtctacttctgggaggccaaggggcagacccccatgttccctcggatcttcggtcatgaagctggaggcatagtggagagtgttggagagggtgtgactgagcttgcccctggtgaccatgtcctccctgtgttcactggggagtgtaaggaatgcccacattgcaagtctgcagagagcaacatgtgtgatctgctcaggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggctccccttgacaaagtctgtgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatcaaggatcattggtgttgacttgaacgccagcagatttgaagaagctagaaaatttggctgcacggaatttgtgaacccgaaagatcacaccaagccagttcaacaggtgctcgctgagatgacaaatggtggagttgaccgcagtgttgagtgcacgggcaacgtcaatgctatgatacaagcatttgaatgtgttcatgatggctggggtgtagctgtgctggtgggtgtgccgcacaaggatgccgaattcaagacccacccgatgaacttcctgaacgagaggactctcaagggcaccttcttcggaaacttcaagccgcgcactgacctgcccaatgtcgtggagatgtacatgagaaaggagctggaggtggagaagttcatcacacacagcgtgccgttctcggagatcaacaaggcattcgacctcatggcgaagggcgagggcatccgctgcatcatccgcatggagaactaagccgcctcacgcgcttctgatcgctccgatgtaataagcgctggggtgcggtttctgaacaagatcatcgtctgtggtttcgccttccttggcaaagtagcgtagtattagttcaagtatatctgtaattacgtaccggacaagtggctgtactacgaacgagctctcttttggcagcaatatatgctgctgctactactactatggccatgagtttcagttgaataagtgttctcagcctact

SEQ ID NO: 2735 - DNA, 1569 bp, Triticum aestivum
agcccggccccatatatacccccggcctccccacactcggttccccacggatttgatcctgtgaagtgagagatcagttctcgatttcgattccgggtctcagagaattccccaggcgagcgagcgagatggcgaccgccgggaaggtgatcaagtgcaaagccgcggtggcgtgggaggcggggaagccgctgtccatggaggaggtggaggtggcgccgccgcaggccatggaggtgcgcgtcaagatcctcttcacctccctctgccacaccgacgtctacttctgggaggccaaggggcagacccccatgttccctcggatcttcggtcatgaagctggaggcatagtggagagtgttggagagggtgtgactgagcttgcccctggtgaccatgtcctccctgtgttcactggggagtgtaaggaatgcccacattgcaagtctgcggagagcaacatgtgtgatctgctcaggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggctccccttgacaaagtctgtgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatctaggatcattggtattgacttgaacgccagcagatttgaagaagctagaaaatttggctgcacggaatttgtgaacccgaaagatcacagcaagccagttcaggaggtgctcgctgagatgacaaatggtggagttgaccgcagtgttgagtgcacgggcaacgtcaatgctatgatacaagcatttgaatgtgtccatgatggctggggtgttgctgtgctggtgggtgtgccgcacaaggacgccgaattcaagacccacccgatgaacttcctgaacgagaggactctcaagggcaccttcttcggaaacttcaagccgcgcaccgacctgcccaatgtcgtggagatgtacatgagaaaggagctggaggtggagaagttcatcacacacagcgtgccgttctcggagatcaacaaggcgttcgacctcatggcgaagggcgagggcatccgctgcatcatccgcatggagaactaggccgcctcacgtgcttctgattgctccgatgtaataagcgtttggggggcggtttctgaaccagatcatcgtctgtggtttcgccttccttggcaaagtagcgtagtgttagttcaagtatatctgtaattacgtaccggagaagtggtggtactacgagctctcttttggcagcaatatatgctgctgctgctgctgctgctgctgctactatggccatgagtttcagttgaatgagtctgttcttagcctacttgatgtttcaatgtcccgttgctgctgctgcgttgcttattcagta

SEQ ID NO: 2736 - DNA, 1510 bp, Triticum aestivum
ttgatcctgtgaagtgagagatcagttctcgatttcgattccgggctcagagaattccccaggcgagcgagcgagatggcgaccgccgggaaggtgatcaagtgcaaagccgcggtggcgtgggaggcggggaagccgctgtccatggaggaggtggaggtggcgccgccgcaggccatggaggtgcgcgtcaagatcctcttcacctccctctgccacaccgacgtctacttctgggaggccaaggggcagacccccatgttccctcggatcttcggtcatgaagctggaggcatagtggagagtgttggagagggtgtgactgagcttgcccctggtgaccatgtcctccctgtgttcactggggagtgtaaggaatgcccacattgcaagtctgcggagagcaacatgtgtgatctgctcaggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggctccccttgacaaagtctgtgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatcaaggatcattggtgttgacttgaacgccagcagatttgaagaagctagaaaatttggctgcacggaatttgtgaacccgaaagatcacaccaagccagttcaacaggtgctcgctgagatgacaaatggtggagttgaccgcagtgttgagtgcacgggcaacgtcaatgctatgatacaagcatttgaatgtgttcatgatggctggggtgttgctgtgctggtgggtgtgccgcacaaggacgccgaattcaagacccacccgatgaacttcctgaacgagaggactctcaagggcaccttcttcggaaacttcaagccgcgcactgacctgcccaatgtcgtggagatgtacatgagaaaggagctggaggtggagaagttcatcacacacagcgtgccgttctcggagatcaacaaggcgttcgacctcatggcgaagggcgagggcatccgctgcatcatccgcatggagaactaggccgcctcacgcgcttctgatcgctccgatgtaataagcgctggggtgcggtttctgaaccagatcatcgtctgtggtttcgccttccttggcaaagtagcgtagtgttagttcaagtatatctgtaattacgtaccggacaagtggctgtactacgaacgagctctcttttggcagcaatatatgctgctgctactactactatggccatgagtttcagttgaatgagtctgttcttagcctactgatgtttcaatgtcccgttgctttacttttccccttttcccccacacaa

SEQ ID NO: 2737 - DNA, 1482 bp, Avena sativa
gacggatttcatccagtgaagcgattcgtgctttgtttcttgctgagattgtggttttcgttccggtggaatttttttaggcgacagaacaatggcgaccgcggggaaggtgatcaagtgcaaagccgcggtggcatgggaggcggggaagccgctgtcgatggaggaggtggaggtggcgccgccgcaggccatggaggtgcgcgtcaagatcctcttcacctccctctgccacaccgacgtctacttctgggaggccaaggggcagactcccgtgttccctcggatcttcggtcatgaagctggaggcatagtggagagtgttggagagggtgtgactgaggttgcccctggtgaccatgtcctccctgtgttcactggggagtgcaaggaatgtccccattgcaagtctgcggagagcaacatgtgtgatctgctcaggatcaacactgacagaggtgtgatgattggcgatggcaagtcacggttctctattgacggcaagccaatttaccatttcgttgggacttccaccttcagtgagtatactgtcatgcatgttggttgtgttgcgaagatcaaccctgaggctccccttgacaaagtctgtgttcttagctgtggtatttctactggtcttggtgcgtcgattaatgttgcaaaaccgccaaagggttcgacagtcgccatatttgggctaggagctgttggacttgctgctgcagaaggtgcaaggattgcaggagcatcaaggatcattggtattgacctgaacgccaacagatttgaagaagctagaaaatttggctgcacagaatttgtgaacccgaaagatcacaccaagccggttcaagaggtactcattgagatgacaaatggcggagttgaccgcagtgtcgaatgcactggcaacattaatgccatgatacaagcatttgaatgtgttcatgatggctggggtgtagctgtgctggttggtgtgccacacaaggacgctgaattcaagacccacccaatgaagttcctgaacgagaggactctgaagggcaccttcttcggcaacttcaaaccgcgcacagacctgcccaacgtcgtggagatgtacatgaagaaggagctggaggtggagaagttcatcacccacagcgtgccgttctcagagatcaacaaggccttcgacctgatggcgaagggggagggcatccgctgcatcatccacatgtagaactaggtttcctcgcctgctttcgctcgctcctccaatggatgtaataagtgctagggggttgtttctggtttctgaacctgccttggtgagatcagacaactcatcggtgatgtgatatgcttccgtgtaccgtcatcgtaccttcctgagccattagcatagtattagcctctccagtttctgtaattacctaccgatggaacagtggtacgagctacgttttggccttaatagtatatgattataatgctgct

SEQ ID NO: 2738 - DNA, 1531 bp, Pseudoroegneria spicata
cagctccttcaattttcagtttaggacccagctgacacgaatatatgatccggtgaaaatattgattggagtttggtttggtgctgagattgcgattttcgttccggcgggattttttagttgaaagagaaatggcgaccgcagggaaggtgatcaagtgcaaagcggcggtggcatgggaggcagggaagccgctgtcaatggaggaggtggaggtggcaccgccgcaggccatggaggtgcgcgtcaagatcctcttcacctccctctgccacactgatgtctactactgggaggccaaggggcagactcccgtgttccctcgggtcttcggtcatgaagctggaggcatagtggagagtgttggagagggtgtgactgaggttgcccctggtgatcatgtcctccctgtgttcactggggagtgtaaggaatgtccacattgcaagtctgcagagagcaacatgtgtgatctgctcaggatcaacactgacagaggtgtgatgatcagcgatggcaagtcacgcttctctattgatgggaagccgatttaccatttcgtagggacttccaccttcagtgagtatactgtcatgcatgttggttgtgttgccaagatcaaccctgaggctccccttgataaagtctgtgttcttagctgtggtatttccactggtcttggtgcatccattaatgttgcaaaaccgcccaaggattcgacagtggcgatatttggtctaggagctgttggccttgctgctgcagaaggtgcaaggattgcaggtgcatcaaggatcattggtgttgacctaaatgccaacagatttgaagaagcaagaaaatttggctgcacggaatttgtgaacccgaaagatcacagcaagccagttcaagaggtactcgctgagatgacaaacggcggagtcgaccgtagtgttgaatgcaccggcaatatcagtgctatgatacaagcatttgaatgtgttcatgatggttggggtgtcgctgtgctagtcggtgtgccacacaaggacgccgaattcaagacccacccaatgaacttcctgaacgagaggactctcaagggcgccttcttcggtaacttcaagccatgcactgatctgcccaatgttgtggagatgtacatgaggaaggaactggaggtggaaaagtttatcacgcacagcgtaccgttctcggagatcaacaaggcctttgatctcatggccaagggggagggcatccgctgcatcatccgcatggagaactaggtgtcttcactcacctggttccaggcgctccaatgtaatatcagtcccagggccggtctctgacctagtaccttggtcagatcggtcactcatcagtgatgagacactcatctatgtcttcgccagccgctagtgtagtattagactccagtgtttgtattccctcaaaaaagaaaaagactccagtgtcagtaagtgtctaccagagaactcttggcacaatatatgctactactacttctgaggtttttgtttcttga

SEQ ID NO: 2739 - DNA, 1324 bp, Pennisetum glaucum
cctttatgtccatacacacacacacacacaccataaggtgcaaagagcagtagagagaaaggggttccgttctcgtcttcttggagtgatcgatcgagctgttctttgatttgaagagggagtgagacttgagagaacgtcaatggcgaccgcagggaaagtgatcaagtgcaaagccgcggtggcgtgggaggccgggaagccgctatcgatcgaggaggtggaggtggcgccgccgcaggccatggaagtgcgcgtcaagatcctctacacctcgctctgccacactgacgtctacttctgggaggccaagggacagactcccgtgttccctcggatcttcggtcatgaggctggaggtatcattgagagtgttggagagggtgtgactgacgtggcccctggtgaccatgtccttcctgtgttcactggggagtgcaaggagtgcccccactgtaagtcggctgagagcaacatgtgtgatctgctcaggatcaacactgaccggggtgtgatgattggtgacggcaagtcgaggttttcaatcaatgggaagcctatctaccattttgttgggacttccaccttcagcgagtacactgtcatgcatgttggttgtgttgcaaagatcaaccccgaggctccccttgataaagtttgtgttctaagctgtggtatttctactggtcttggtgcatcaattaatgttgccaaaccaccaaagggttcaactgtggcaattttcggtctaggagctgttggtcttgctgctgcagaaggtgcaaggattgctggagcgtcgaggatcattggtgttgacctgaaccccagcagatttgaagaagctaagaaatttggctgcactgaatttgtgaacccaaaagaccacaacaagccagtgcaggaggtacttgctgacatgaccaatggaggagttgaccgcagcgtggagtgcactggcaacgtcaacgccatgatctctgccttttgaatgtgttcatgatgggtggggagtcgccgtgctggtcggtgtgccgcacagggaggaccggttcaagacccacccgatgcaattcctgaacgagaagactctcaagggaaccttcttcggcaactacaagccccgcaccgacctgcccaacgtcgtcgagatgtacatgaagaaggagctggaggtggagaagttcatcacccacaacgtgcccttctcggagatcaacacggcgttcgacctgatgctcaaggggggagggcctgcgctgcatcatgaggatggaggactagaccttgattgccacttgccaaaaacctctcttggcacact

SEQ ID NO: 2740 - DNA, 1637 bp, Pennisetum glaucum
cacgccgcgcgcgtccgtggtttgctgcccacgaaggtggacgcgggtgtggcgaaaccgcaccctccttccttttcttcccctctcccacgcttagcgccgggccggagctatatatagcccgggcgcatcgccctcctggctcctcacacagattcgatttggtctggattgttggcttggaggtgaggtgcgtgcttggagttggagggagctgctttgtttgggattccgttcgggaatttggggaaggaagaagcaatggcgacggccgggaaggtgatcaagtgcaaagccgcggtggcatgggaggccggcaagccgctatcgatcgaggaggtggaggtggcgccgccgcaggccatggaagtgcgcgtcaagatcctctacacctcgctctgccacactgacgtctacttctgggaggccaagggacagactcccgtgttccctcggatcttcggtcatgaggctggaggtatcattgagagtgttggagagggtgtgactgacgtggcccctggtgaccatgtccttcctgtgttcactggggagtgcaaggagtgcccccactgtaagtcggctgagagcaacatgtgtgatctgctcaggatcaacactgaccggggtgtgatgacaagtcgaggttttcaatcaatgggaagcctatctaccattttgttgggacttccagtacactgtcatgcatgttggttgtgttgcaaagatcaaccccgaggctccccttgataaagtttgtgttctaagctgtggtatttctactggtcttggtgcatcaattaatgttgccaaaccaccaaagggttcaactgtggcaattttcggtctaggagctgttggtcttgctgctgcagaaggtgcaaggattgctggagcgtcgaggatcattggtgttgacctgaaccccagcagatttgaagaagctaagaaatttggctgcactgaatttgtgaacccaaaagaccacaacaagccagtgcaggaggtacttgctgacatgaccaatggaggagttgaccgcagcgtggaatgcactggaaacatcaacgctatgatccaagcattcgagtgtgttcatgatggctggggtgtcgctgtgctggtgggtgtgccacacaaggatgccgagttcaagactcacccaatgaacttcctgaacgagaggaccctgaagggaaccttctttggcaacttcaagccacgcactgacctgcccaatgtggtggagctgtagaagtggagaagttcatcacacacagcgtcccattctcggagatcaacaaggccttcgacctgatggcgaagggggagggcatccgctgcatcatccgcatggagcactagattcagtcgcctggtttcatccggttcgggtcgggtcaataaacacggcagcgcccagagtgaggctgccactgcctggtggcaagatacacgcctgtgtgtgtatcacgtgaagtttggcattgtcaatcagtagggtagctctagattctgtaattatctatcggtattggcatgagtcttgcgaactgtctttcggcttaacatatatggtaccttataccactatgagttctttcaatgggcattttttctggcttggttgtgatgct

SEQ ID NO: 2741 - DNA, 2373 bp, Hordeum vulgare
agacaagctacataactgaataaacagctgagtatcaagtaatcaaacaaacaagtaataataataaaacaaaggcgccaaactcatgtaaaaatcttaaaaagattggtcttctcaaaacagaaaccgcaggcttagagagtgtcacaaatttagtagttccacaatccacaacggccatagctctataggtaccgactggtaatacaggacaggacagagttttgcgataaaattgacgactggcaaagttctatttcttcttgtcaccagcaccacaccagcagacctcatcttcctcaggacacttgacatctcctctctcttcttctttgctctcttgtgagtaccaagctttctcttggcgaccttgagtgcacgcttgtcctttccaaccttaagaagctcagtgatgcgtttctcatatggagcgaatccagcaacctccctgatcaagttcctgacaaaatgcaccctctttgtgcctttccccttgcggtcggacgggcggggcggcagctcgcgcttggtgatgacgtggcccttgttgatgcccacgaagagccctgacttgggctgcgacggcgccatggccggagttcccgctcgctcctgctgacgttgagaacggacgcaaatgaaaccctaatccgccagttctcgatttcgattccgggctcacagaatttttcgattcaaggcgacgcgaagcgacagagaaagatggcgacggccggcaaggtgatcaagtgcaaagccgcggtggcgtgggaggccgggaagccgctgaccatggaggaggtggaggtggcgccgccgcaggccatggaggtgcgcgtcaagatcctcttcacctccctctgccacaccgacgtctacttctgggaggccaaggggcagacccccatgttccctcggatcttcggccatgaagctggaggcatagtggagagtgttggagagggcgtgactgatgttgcccctggtgaccacgtcctccctgtgttcactggggagtgtaaggaatgcccacattgcaagtctgcggagagcaacatgtgtgatctgctcaggatcaacaccgacagaggtgtgatgatcggggatggcaagtcgcgcttctctattggcggcaagccgatttaccatttcgtagggacttccaccttcagtgagtacactgtcatgcatgtcggttgtgttgccaagatcaaccctgaggctccccttgataaagtctgtgttcttagctgtggtatttccactggtcttggcgcgtcaattaatgttgcaaaaccaccaaagggttccacagtggcgatatttgggctaggagctgttggccttgctgctgcagaaggtgcaaggattgcaggtgcatcaaggatcattggtgttgacctgaacgccagcagatttgaagaggctaggaagtttggctgcacggaatttgtgaacccgaaagatcacaccaagccagttcagcaggtgctcgctgacatgacaaatggcggagttgaccgcagtgttgagtgcactggcaacgtcaatgctatgatacaagcatttgaatgtgttcagggtgtgccacacaaggacgctgaattcaagacccacccgatgaacttcctgaatgagaggaccctgaagggcaccttcttcggtaacttcaagccgcgcactgacctgcccaatgtcgtggagatgtacatgaagaaggagctggaggtggagaagttcatcacacacagcgtgccgttctcggagataaacaaggccttcgaccttatggcgaagggggagggcatccgttgcatcatccgcatggacaactaggcgtcctcctcaagtgcttctgatcgctccgatgtaataagcgctgggggccggcttctgaaccagatcatcggtgatggtaatacacttccatgtatcatcgtctgcggtttcgccttccttggccaaagtagcgtaatattagttatgtatatctgtaattaccttaccggagaagtggttgtactacgagctctttttcggcagcaatgtatgctgctgctgctgctgctactatggccatgagtttcagttgaatcagtctgttctcaacctgatgtttccatattctgtgtcttcttgctgcgttgcttattgagtatgtatttcctactgcttggctgaatcttctgggacgtgcttatggtatttggaactgaaggtactacttggtctgaaagttcaggcgatgtagtgtgcttcctgttttcaccgtttaaaaagacgggcctagaaaaaaggaaagatattaaggttgcaacaaatggtacgcatgtaatacgtcatttattgtaatctaaaaaggtactatttctt

SEQ ID NO: 2742 - DNA, 1538 bp, Elaeis guineensis
gatctctcttttggttatatatagctatgccaccgcccggtgctcttcgatcaagttgtgaaaggtagcgtctttggagagatatttgggttcttgtggagaaaaggaggaggatttggggaagagcttgagagacagagagattaagaggtagaggagatggcaagcactgctggtcaagtaatcaaatgcaaagcggcggtcgcgtgggaggccgggaagcctctggtgatcgaggaggtggaggtggcgccgccgcaggcgatggaggttcgggtgaagatcctttatacttccctctgccacactgatgtctacttctgggaagccaagggccagactccagtgtttcctcggatctttggccatgaggctggagggattgtggagagtgttggggagggtgtgactgatcttgcaccaggagaccatgtcctccctgtattcactggagaatgcaaagagtgtgctcattgtaagtccgaggagagcaacatgtgtgatctcctcaggatcaacactgaccgtggagtgatgatcaatgatgggaaaacaaggttcagtatcaatggaaagcccatttaccatttcgtaggaacctccactttcagcgagtacaccgtcattcatgttggctgtcttgccaagatcaacccctcggctcccctcgacaaagtttgtgttcttagctgtggcatttcaacagggtttggtgccactgttaatgttgcaaaaccaccgaagggatcgacggtggctatttttggattgggggctgtaggccttgcagctgcagaaggggccagagtttctggggcctcaaggatcattggtgttgacctgaaccccaacaggtttgaggaagcaaaaaagtttggttgcacagagtttgtgaatccattggaccataagaaaccagtccaagaggtgcttgctgaaatgactaatggtggagtcgatcgaagcgttgaatgcaccggcaacattaaagccatgatctctgcatttgaatgtgttcatgatggttggggtgttgctgtactggtcggggtgcctcacaaagatgccgagttcaaaacccaccctatgaacttcctcaatgaaaggactctcaagggaaccttctttgggaactataaaccgcgctctgaccttccttcagtcgttgagaagtacatgaacaaggagctagaattggagaagttcatcacccacagtgtatcctttgctgaaatcaacaaggccttcgacttaatgcttacgggtgcaggtctgcggtgcatcatccgcatggaggattagagaagcttattacaaattaaagcatgtcatatgcctcatcagtcttagactcgtgttttaataaaataaggcagctgagttcgactgtgaaattatctcagtccttatcttttctgtttgttggaaaaaattttgtgttacgtaacccctttgactgtattttgattgtgttgtttcttgcatgatgtaagtttcttttggagattatgagaagttggatatgttttcttttctca

SEQ ID NO: 2743 - DNA, 1533 bp, Panicum virgatum
cagcaaacaagtgtaacagggtgcgagaagaagcaggagctcccttgtcgtgttcttggagcgatccatcgagctgttctttgatttgtagaggtagtgagtgagagagaaagcaagggcgtcaatggcgaccgccgggaaagtgatcaagtgcaaagccgccgtggcgtgggaggccggcaagccgctgtcgatcgaggaggtggaggtggcgccgccgcaggccatggaggtgcgcgtcaagatcctctacaccgcgctctgccacaccgacgtctacttctgggaggccaaggggcaaaccccggtgttcccgaggattttaggacacgaagctggaggcattgtggaaagcgttggagagggtgtgaccgacctcgcaccaggcgaccatgtcctcccggtgttcaccggcgagtgcaaggagtgtgctcactgcaagtcagaggagagcaacatgtgtgacctcctgaggatcaacgtcgaccgaggtgtgatgatcggcgatggcaagtcccgcttctccatcaatggccagcctattttccactttgttgggacatctaccttcagcgagtacactgtcatccatgttggttgcctcgccaagatcaaccccgaggcgcctcttgacaaagtttgtgttctcagctgtggcatctcaactggtcttggtgcaacactgaatgttgcaaaaccgggtaagggttcgacggtggcgattttcggtctcggtgctgtaggccttgctgccatggaaggtgcgaggctggcaggggcatcaaggatcatcggtgtggacgtgaacccggcaaaatatgagcaagctaagaaatttggctgcactgactttgtgaaccccaaggaccacaacaagccagtgcaagaggtgctcattgagatgactaacggcggtgtcgaccgcagcgtggagtgcactggcaacgtcaacgccatgatatctgccttcgaatgtgttcacgatggatggggcgtcgccgtgctggtcggtgtcccgcacagggaggaccagttcaagacccaccccatgaacttcctgaacgagaagacgctcaagggtaccttcttcggcaactacaagccccgcaccgacctgcccaacgtcgtcgagatgtacatgaagaaggagctggaggtggagaagttcatcactcacagcgtgccgttctcagagatcaacacggccttcgacctgatgctcaagggggagggcctgcgctgcatcatgaggatggaggactagagctctccaccgtccgttgcaactactctgttgcacaaggaaattgaaaagtttagtgcgcaccctgtagtagtaatattgtggtcctgagatacgaacatgcccattcccctgtattccgtttcacggtttcatctttattgttagtgtgtggtcgggtttgggccaaaaacaaaaacaaaaaccaaaaaaagagaagtttgtggtcaggcttcagagtccatgtaattaccattttggataataaataatgagatgttgtcagtgtt

SEQ ID NO: 2744 - DNA, 1577 bp, Panicum virgatum
ctggtctccctgtgcgggacacgaccagcacagcagcagctagcagccaagtgtaacagggtgccaagaagcagtagctattagcgaaagggctccgatccgtgctcgtgttcttggagcgatccatccagctgttctttgatttgtagagggagtgagtgagggagaaagcaagggcgtcaatggcgaccgccgggaaagtgatcaagtgcaaagccgcggtggcgtgggaggccggcaagccgctgtcgatcgaggaggtggaggtggcgccgccgcaggccatggaggtgcgcgtcaagatcctctacaccgcgctctgccacaccgacgtctacttctgggaggccaaggggcaaaccccggtgttcccgaggatcttaggacacgaagctggaggcattgtggagagcgttggagagggtgtgactgacctcgcaccgggcgaccatgtcctccctgtgttcaccggcgagtgcaaggagtgtgctcactgcaagtcagaggagagcaacatgtgtgacctcctcaggatcaacgtcgaccgaggtgtgatgatcggcgatggcaagtctcgcttctccatcaatgggcagcctattttccactttgtcgggacatccaccttcagcgagtacaccgtcatccatgacggttgcctcgccaagatcaaccccgaggcgcctcttgacaaagtttgtgttctcagctgtggcatctcaaccggtcttggtgcaacactcaatgttgcaaaaccggctaagggttcgacggtggcgattttcggtcttggtgctgtaggccttgctgccatggaaggtgccaggctggctggggcatcaaggatcatcggtgtggacgtgaacccggcaaaatatgagcaagctaagaaatttggctgcactgactttgtgaaccccaaggaccacaacaaaccagtgcaagaggtgctcattgagatgaccaatggcggtgtcgatcgcagcgtggagtgcactggcaacgtcaacgccatgatttctgccttcgaatgtgttcatgatggatggggcgtcgccgtgctggtcggtgtcccgcacagggaggaccagttcaagacccaccccatgaactttctgaatgagaagacgctcaagggtaccttcttcggcaactacaagccccgcaccgacctccctaatgttgtcgagatgtacatgaagaaggagctggaggtggagaagttcatcacccacagcgtgccgttctcggagatcaacacggccttcgacctgatgctcaagggtgagggcctgcgctgcatcatgaggatggaggactagagctctccagcgtccgttgcaactactctgttgcacaaggaaggaaattgaaaagtttaatgcgcacctttgtgtagtagtaatgttgtggtcctgagatacgaacatgctcatcccctgtattccgtttcacggtttcatctttattgttagtgtgtggtaactggtcgagtttgggcccacgaaaaaaaaacaaaaaagagaagtggtggtcaggcttcagagtccatgtaattaccattttgcataacaaat

SEQ ID NO: 2745 - DNA, 1540 bp, Aristolochia fimbriata
aacgcatccgacgcgggggtcggacttcccttcatcatcagctactcttaactgcgttttctagctagatcgtggacagtgaaagaaagaagaaaggagaaatgtcgagtactgcgggcaaggttatccgatgcaaagctgccgtggcctgggaggcggggaagcccttggtgatggaagaagtggaggtggcccctcctcaggcaaatgaagtccgattgaagattctcttcacttctctctgccataccgacgtctatttctgggaagccaagggtcaaacaccactgtttcctcgcatttttggccatgaagctggagggattgttgagagcgttggggagggtgttaaagatctttctcctggtgaccatgtcctccctgttttcactggagaatgcaaggaatgtcgacactgcaaatcagaggagagcaacatgtgtgacctcctgaggataaacacggacaggggagtgatgataggtgacgaaaaatcaaggttctcaatcaatggaaaaccaatttaccactttgtgggtacctccacttttagtgaatacacggttgtgcatgtgggttgtgtggcgaagattaacccagaagctcctttggacaaagtttgtgttcttagttgtgggatatcaacaggcttgggtgccacattgaatgtcgccaaaccccccaagggttcaactgttgctgtttttggactgggagcagtgggtctagctgctgccgagggagcaaggcttgctggtgcttcaagaattattggagttgatttgaactctagccgatttgaagcagctaagaagtttggtgtgaccgaatttgtgaaccccaaagatcataacaagccagtacaagaagtgcttgcagaaatgaccggtggaggtgtagacaggagcgtcgaatgcaccggaaacgtcagtgccatgatatcagcctttgaatgtgtccatgatggttggggtgttgctgtgctagttggtgtgcccaacaaagatgatacgttcaagacccaccccatgaatcttctgaacgagaggactctgaaaggaaccttcttcggaaattacaaaccacggactgaccttccatctgtggtggagaagtacatgaaaaaggagttggaactggaaaaatttatcacccacagtgtccccttctccgagatcaacaaggcttttgagtacatgcttcagggagacggccttcgctgcatcattcgaatggatggctaagagtagtgagagagtttatatctggcatgggacggccacttagtttgggaataaaatagtccctgttcctagtgatgtaatatctctgttaaggtctctttcatcttctgtaaggaattgcgtttgtaagtagagttccatccgatgtgttgttaacacgaccagcttgttcaaaaatgaaaactgaaaaccccatctacctcaacttgtttagttgccatgaaggagagttggtcctacttattatatatcactaaaattcaccttgtaaataaatcatttcaacattttttcaa

SEQ ID NO: 2746 - DNA, 1418 bp, Pennisetum glaucum
gtgagacttgagagaacgtcaatggcgaccgcagggaaagtgatcaagtgcaaagccgcggtggcgtgggaggccgggaagccgctgtcgatcgaggaggtggaggtggcgccgccgcaggccatggaggtgcgcgtcaagatcctctacacggccctctgccacaccgacgtctacttctgggaggccaagggccaaactccggtgttcccgaggatcttaggacacgaagctggaggcattgtggagagcgttggagagggtgtgaccgagctcgcaccgggcgaccatgtcctcccggtgttcaccggtgagtgcaaggagtgtgctcactgcaagtcagaggagagcaacatgtgtgacctcctgaggatcaacgtcgaccgaggtgtgatgatcggcgatggcaagtcccgcttctccatcaacgggcagcctatcttccactttgttgggacatccaccttcagtgagtatacagtcatccatgtcggttgccttgccaagatcaaccccgaggcgcctcttgacaaagtttgtgttctcagctgtggtatctcaacgggtcttggtgcgacgctcaatgttgcaaaaccggttaagggttcaacggttgcgattttcggtcttggtgctgttggtcttgctgccatggaaggtgcaagactggctggggcatcaaagatcatcggcgtggacgtgaacccagcaaaatatgagcaagctaagaaatttggctgcactgactttgtgaaccccaaggaccacgacaagccggtgcaagaggtgctcattgagatgaccaatggcggcgtcgaccgcagcgtggagtgcactggcaacgtcaacgccatgatctctgcctttgaatgtgttcatgatgggtggggagtcgccgtgctggtcggtgtgccgcacagggaggaccagttcaagacccacccgatgcaattcctgaacgagaagactctcaagggaaccttcttcggcaactacaagccccgcaccgacctgcccaacgtcgtcgagatgtacatgaagaaggagctggaggtggagaagttcatcacccacaacgtgcccttctcggagatcaacacggcgttcgacctgatgctcaagggggagggcctgcgctgcatcatgaggatggaggactagaccttgattgccacttgccaaaaacctctcttggcacacttaggagaggaggacatcagaagttgaaagcgctctcccttgtgtagtatactgtagtaataatgtggttttgtttcacggttacatctttattgtcagtgcgtggtccctggtgaggtttcggccctcaaaaaatacaagtagtttgtggtaaggtttcagagtccctgtaattaccaatttgcacagcaataatgaaatgttttcagtgttgatgt

SEQ ID NO: 2747 - DNA, 1401 bp, Amsonia hubrichtii
gtcagatatttcagcttactttcctttcaaaaactcaaatttgtagctaattcttgaaaaagaagtggaggagatggcaagcactgctgggcaagtcatccgttgcaaagctgctgttgcatgggaaccggggaagccattaacgattgaggaagtagaggtggcgccaccccagaaaatggaggtccgcctcaagatcctcttcgcctccctctgccatactgatgtctacttttgggaagccaagggccagaaccctgtctttcctcgaattcttggtcatgaggcagcagggattgtggagagtgttggtgaaggtgtgacggagttgcagcctggtgatcatgttctcccagtcttcactggggaatgcaaagaatgtgctcactgcaaatctgaagagagtaatatgtgtgaccttctgaggattaacacagacagaggggtaatgattaacgatggaaaatcacgcttttcgattaatggcaaaccaatataccattttgttgggacttccacatttagtgagtacactgtggtccatgttggttgtgttgccaaaataaatccccttgctcctcttgacaaagttttggttctcagttgtggaatctccacaggcctgggtgctactttgaatgttgctaaaccgaaaaagggttcttcagttgctgttttcggattgggagcagtaggccttgctgctgcagaaggagccagaatagctggtgcttcaaggattatcggtgttgatctaaatcctgctaggtttgaagaagcaaagaagtttggagtgactgaatttgtgaaccccaaggactatgagaagcctgttcaagaggtgattgctgaaatgactgatggaggtgttgatagaagtgtagaatgtactgggaacacaaatgctatgatctctgcctttgagtgcgtccacgatggatggggagttgctgttctcgttggtgtaccacataaagatgctgagttcaagacacatcctgtgaacttcctgaacgagaggacactcaagggaacattctttggaaactataaaccgcgttctgaccttccatctgttgttgaacaatacatgactggggaacttgaattggagaaattcatcactcatgaagtaacattttctgagattaacaaggcgttcgactacatgctgaagggagaaggcattcgttgcctcatccgaatggggtgttaaatcaaatgatgccattaatgtccagcatatgaagctgctattgctttcattacaaaagaggatgaacaagtttagttgctgatatgcagaaatgccagtttcctaatcttgttgatgtttgaagttttcttctcagtaaattttcctgtgtgccacttgtaaaattaccattttgataataaaga

SEQ ID NO: 2748 - DNA, 1672 bp, Zea mays
cggtccaggcgttcttgctgcctccctcgtagactagactctagaccactatatatacagtactcgtccccgttttcttcctcaccaacttctcatcatcagccaagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataat

SEQ ID NO: 2749 - DNA, 1400 bp, Citrus clementina
agcaaacgttaaagcaagctttaaagagttctaaaaaatctttcagttctcagtttctcctaaaagatgtcaagcactgttggacaagtcatacgctgtagagccgcggtagcttgggaagcagggaagccactggtgatggaagaagttgaggtggctccgccgcaggctaatgaagttcgtgtgaagatcctctttacttccctttgccacactgatgtctacttctgggaagccaagggacagaaccctttatttcctagaatttatggccatgaggcaggagggattgtggagagcgtcggcgagggggtgactgatctcaaaccaggggatcatgttctgcctgtgttcaccggagaatgcaaggagtgtgctcattgcaagtcagaagaaagcaacatgtgtgatcttctcaggatcaatactgacagaggcgtcatgcttaacgacgggaaatcgagattttccatcaatggcaagcctatttatcatttcgttggaacctcaaccttcagtgagtacaccgttattcatgttggctgtcttgccaagatcaatccgttggctcctcttgacaaagtctgtgttctcagctgtggaatttcgacgggcctgggcgcaacacttaatgttgcaaaacctgcaaaaggctcaacagtggctgtatttggattgggcgctgtaggcctcgctgctgctgaaggggccaggattgccggggcttcaaggattattggtgttgatctgaattcaaatagatttgaagaagcaaagaagttcggtgcgactgaatttgtgaacccaaaagactacaataaaccaattcaagaggtaattgccgaaatgacgaatggaggagtggacagaagtgtggagtgcactggacatattgatgccatgatttcagctttcgaatgtgtccacgatggctggggtgtggctgttcttgtgggcgttcctcacaaagatgctgtgttcaagacgcaccccatgaatttgttgaatgaaagaactcttaagggcaccttctttggaaactacaagcctcgttctgaccttccttcggttgtagaaaaatatatgagcaaggagcttgaagtggaaaaattcattacccatacagtcccattctccgaaatcaacaaggcctttgagtacatgcttagaggagaaggtctccgatgcatcatccggatggaagagtagtttgtgtagataaataattcaaagtggtctgtgtcattgtcatgttcaagattttaatatttccaaagatgtctttataagtattgttgttttgtggtcataatgtaaaacgttattttctagtgcctttccgttgtatacttgtttgcgaattttttttttaaaaaaaagtgatgagaacaaattcagtg

SEQ ID NO: 2750 - DNA, 1435 bp, Citrus sinensis
ttaaagcaagctttaaagagttctaaaaaatctttcagttctcagtttctcctaaaagatgtcaagcactgttggacaagtcatacgctgtagagccgcggtagcttgggaagcagggaagccactggtgatggaagaagttgaggtggctccgccgcaggctaatgaagttcgtgtgaagatcctctttacttccctttgccacactgatgtctacttctgggaagccaagggacagaaccctttatttcctagaatttatggccatgaggcaggagggattgtggagagcgtcggcgagggggtgactgatctcaaaccaggggatcatgttctgcctgtgttcaccggagaatgcaaggagtgtgctcattgcaagtcagaagaaagcaacatgtgtgatcttctcaggatcaatactgacagaggcgtcatgcttaacgacgggaaatcgagattttccatcaatggcaagcctatttatcatttcgttggaacctcaaccttcagtgagtacaccgttattcatgttggctgtcttgccaagatcaatccgttggctcctcttgacaaagtctgtgttctcagctgtggaatttcgacgggcctgggcgcaacacttaatgttgcaaaacctgcaaaaggctcaacagtggctgtatttggattgggcgctgtaggcctcgctgctgctgaaggggccaggattgccggggcttcaaggattattggtgttgatctgaattcaaatagatttgaagaagcaaagaagttcggtgcgactgaatttgtgaacccaaaagactacaataaaccaattcaagaggtaattgccgaaatgacgaatggaggagtggacagaagtgtggagtgcactggacatattgatgccatgatttcagctttcgaatgtgtccacgatggctggggtgtggctgttcttgtgggcgttcctcacaaagatgctgtgttcaagacgcaccccatgaatttgttgaatgaaagaactcttaagggcaccttctttggaaactacaagcctcgttctgaccttccttcggttgtagaaaaatatatgagcaaggagcttgaagtggaaaaattcattacccatacagtcccattctccgaaatcaacaaggcctttgagtacatgcttagaggagaaggtctccgatgcatcatccggatggaagagtagtttgtgtagataaataattcaaagtggtctgtgtcattgtcatgttcaaaattttaatatttgcaaagatgtctttataagtattgttgttttgtggtcataatgtaaaacgttattttctagtgcctttccgttgtatacttgtttgcgaattttttttttaaaaaaaagtgatgagaacaaattcagtgtgagtgtgaacaaataacagattcattcatgtctaagataaaa

SEQ ID NO: 2751 - DNA, 1527 bp, Setaria italica
gccaagtgtaaaggggtgcaaagaagcagtagcgagagggttccgttctcgtgttcttggagtgatccatcgagctgttgtttcttttggagacggagggagactgtgagagagcgtcaatggcgaccgccgggaaagtgatcaagtgcaaagccgcggtggcatgggaggccggcaagccgctgtcgatcgaggaggtggaggtggcgccgccgcaggccatggaggtgcgcgtcaagatcctctacaccgcgctctgccacaccgacgtctacttctgggaggccaaggggcagactccggtgttcccgaggatcttaggacacgaagctggaggcattgtggagagcgttggagagggtgtgaccgagcttgcaccaggcgaccatgtcctcccggtgttcaccggtgagtgcaaggagtgtgctcactgcaagtcagaggagagcaacatgtgtgacctcctcaggatcaatgtcgacagaggtgtgatgatcggcgatgggaagtcccgcttctccatcaacgggcagcctattttccactttgttgggacatccaccttcagcgagtacaccgtcatccatgttgggtgccttgccaagatcaaccctgaggcgcctcttgacaaagtttgtgttctcagctgtggtatctcaacaggtcttggtgcaacactcaatgtcgcaaaaccggtgaagggttctcggtcttggagctgtaggccttgctgccatggaaggtgcgaggctggctggggcatcaaggatcattggtgtggacctgaacccagcaaaatatgagcaagctaagaattttggctgcactgactttgtgaaccccaaggaccacgacaagccagtgcaagaggtgctcattgagatgagcaatggcggcgtcgaccgcagcgtggagtgcactggcaacgtcaacgccatgatctctgccttcgaatgtgttcacgatggctggggtgttgccgtgctggtcggtgtcccgcacagggaggaccaattcaagacccacccaatgaacttcctgaaagagaagactctcaagggaaccttcttcggcaactacaagccccgcaccgacctgcccaatgtcgtggagatgtacatgaagaaggagcttgaggtggagaagttcatcacccacagtgtgccgttctccgagatcaacacggccttcgatctgatgcttaagggggagggcctgcgctgcatcatgaggatggaggactagagcttgattgccaggaacctctcttggcaactactctgttgcataagagaggaggacatcagaagttgaaggcgctccattgtgaagtagtaataatgtggtcctgagaaacgtacattgcccacccctgtattctgtttcacggtttcatctttattgtcggtgtgtggtcactggtcaggtttcggctctcaaaaaacaaaaaaagaagtttctggtcaggattcagagtccctgtaattaccattttgcacaacaataatgaagtgttgtcagtgttga

SEQ ID NO: 2752 - DNA, 1597 bp, Gossypium hirsutum
aaaatactaacatattcacgaacccatgttcgggaaaacaaataaattttaggcgtcgtttgctttgtggatcaaaagaaaaacagcgttttccttgggtgaattcttgcttccagttcatgaactcaatgtatatgtctcttacaaatgccccgtcaaagcaggcttctttgacgtgtaaaaatatcagtcccctcgattcttactttaagagatgccaagcttctaaaccccaatttactagaatatttttccaggtttccaaaaggaaaaaacggatagtttgccaagtaaatatgtctgcccaaagcactgctggtcaggtcattcgttgcaaagctgcggtggcatgggaagccgggaagccactagtgattgaagaagtggaggtggcaccaccacaagaaatggaggttcgtctgaagatcctcttcacctctctctgccacactgatgtttacttttgggaagccaagggccaaactccattattccctcgtatatttggtcatgaagctggggggattgttgagagtgtgggtgagggtgtgacacaccttaaacccggtgaccatgtgcttccggtcttcaccggggaatgcggcaactgtcgtcattgcaagtccaaggaaagcaacatgtgtgacctgctaaggatcaacactgaccgaggggtgatgcttagtgatggcaagaccaggttctccattaatggaaaacccatctaccatttcgttggcacatccaccttcagtgaatacactgttgctcatgttggcagtgttgccaaaatcaatcccgccgctcctcttgacaaagtttgtattctcagctgtggcatctctacaggtcttggtgccaccttgaatgttgcaaagcccaccaaaggttcaactgtggccatttttggactgggagcagtaggcctcgctgctgctgaaggggctagaattgcaggcgcttctaggattattggggttgatctgaatcctaacagatttgaggaagctaagaaatttggttgcactgaattcgtcaacccgaaagaccataacaagccggttcaagaggtgcttgctgaaatgacaaatgggggagttgatcgaagcgtcgagtgtactggaaacattaatgccatgatctctgcatttgaatgtgttcacgatggatggggtgttgcggtactcgtcggtgttccaaacagagatgatgcatttaaaacacatcccgtgaattttttgaatgagaggactctgaaaggaaccttctttggcaactacaagccccggtccgaccttccttcggtggtggaaaagtatatgaacaaagagcttgagctagagaaatttataacgcagcaagtggcattccgggatataaacaaggccttcgattacatgcttgctggggagggcatccgctgtatcattcgcatggatgcttgaaaatttgtaaacccttaataaagaaatgtgaataaattgagcagtcaatgcgtttcccttttcatgctttgtatattcatgtgacggtacccaccacgccttgtgttgatttgctttgatgtatcatcaaactacaattccatttctgtttt

SEQ ID NO: 2753 - DNA, 1603 bp, Gossypium hirsutum
atcaatctactaaaatactaacatattcacgaacccatgttcgggaaaacaaataaattttaggcgtcgtttgctttgtggatcaaaagaaaaacagcgttttccttgggtgaattcttgcttccagttcatgaactcaatgtatatgtctcttacaaatgccccgtcaaagcaggcttctttgacgtgtaaaaatatcagtcccctcgattcttactttaagagatgccaagcttctaaaccccaatttactagaatatttttccaggtttccaaaaggaaaaaacggatagtttgccaagtaaatatgtctgcccaaagcactgctggtcaggtcattcgttgcaaagctgcggtggcatgggaagccgggaagccactagtgattgaagaagtggaggtggcaccaccacaagaaatggaggttcgtctgaagatcctcttcacctctctctgccacactgatgtttacttttgggaagccaagggccaaactccattattccctcgtatatttggtcatgaagctggggggattgttgagagtgtgggtgagggtgtgacacaccttaaacccggtgaccatgtgcttccggtcttcaccggggaatgcggcaactgtcgtcattgcaagtccaaggaaagcaacatgtgtgacctgctaaggatcaacactgaccgaggggtgatgcttagtgatggcaagaccaggttctccattaatggaaaacccatctaccatttcgttggcacatccaccttcagtgaatacactgttgctcatgttggcagtgttgccaaaatcaatcccgccgctcctcttgacaaagtttgtattctcagctgtggcatctctacaggtcttggtgccaccttgaatgttgcaaagcccaccaaaggttcaactgtggccatttttggactgggagcagtaggcctcgctgctgctgaaggggctagaattgcaggcgcttctaggattattggggttgatctgaatcctaacagatttgaggaagctaagaaatttggttgcactgaattcgtcaacccgaaagaccataacaagccggttcaagaggtgcttgctgaaatgacaaatgggggagttgatcgaagcgtcgagtgtactggaaacattaatgccatgatctctgcatttgaatgtgttcacgatggatggggtgttgcggtactcgtcggtgttccaaacagagatgatgcatttaaaacacatcccgtgaattttttgaatgagaggactctgaaaggaaccttctttggcaactacaagccccggtccgaccttccttcggtggtggaaaagtatatgaacaaagagcttgagctagagaaatttataacgcagcaagtggcattccgggatataaacaaggccttcgattacatgcttgctggggagggcatccgctgtatcattcgcatggatgcttgaaaatttgtaaacccttaataaagaaatgtgaataaattgagcagtcaatgcgtttcccttttcatgctttgtatattcatgtgacggtacccaccacgccttgtgttgatttgctttgatgtatcatcaaactacaattccatttct

SEQ ID NO: 2754 - DNA, 1414 bp, Catharanthus roseus
gtcattaacagttgtcattaatatatacacatctcagtttactttcctttctaattagcctcaaatttctaaacggttcttgaagcagaagaaaaagaaatggcaagtactgctggccaagtcatccgttgcaaagctgctgttgcatgggagcccgggaagccattagtgatggaggaagtagaggtggcgcctccccagaaaatggaggttcgccttaagatcctattcacctccctctgccatactgatgtctacttttgggaagccaagggccagaatcccgtctttcctcgaattctcggtcatgaggctgcagggattgtggagagtgttggtgaaggtgtgacagagttgaagccaggggatcatgttctgccagtcttcactggggaatgcaaagactgtgctcattgtaaatctgaagagagtaatatgtgtgaccttctgaggattaacacagacagaggggtaatgattcaagatgggaaatcacgattttcaattaaaggcaaaccgatctaccattttgttgggacttcaacatttagtgagtatactgttgttcatgttgggtgtgttgccaaaatcaatccacttgctcctcttgacaaagtttgtgttcttagttgtggaatctccacaggccttggtgctactcttaatgttgctaaaccaacaaagggctcttcagtggctgtttttggattgggagctgtaggccttgctgctgcagaaggagccagaattgctggtgcttcaaggattataggtgttgacctcaatcctgctaggtttgaagaagcaaagaagtttggagtgacagaatttgtaaacccaaaggactatgataagcctgttcaagaggtgattgctgaaatgactggtggaggagttgatagaagtgtagaatgcactggaaacaccaatgccatgatctctgcctttgaatgtgtccatgatgggtggggagttgctgttcttgttggggttccacacaaagatgctgaattcaagacacatcctatgaacttcttgaatgagaggacactcaaggggaccttctttggaaactataaacctcgctctgatcttccatctgttgttgaaaaatatatgacaggggagctggaattggagaagtttatcactcatgaagtgaccttttctgagattaacaaggcctttgaatacatgctgaatggagaaggcctccgctgcctcatccgaatggagacttgaatcaaatgaagccatgaatgtcctgaatataaagctgctgcgtttatgcgttcttttacatatgataataaatatatgtctagtgttcgtatgcgttctatgtttccttctttttcttgatgtttgaaggtgtctttgaacttacccttttgataataaacaactctgtttg

SEQ ID NO: 2755 - DNA, 1481 bp, Manihot esculenta
accaagagcttcgctcaaaaactcacaaacaagttctaaaaattcttttccaaagcgtatatcctttttctgtctataaacatcaaattcttgtcctgtttttgggttgtcaaaggatagtaaaaatatggcaagcactgctggtcaggtgatacgttgcaaagctgctgtggcatgggaggctgggaagccactggtgattgaagaagtggaggtggcacctccacaggccaatgaagttcgtctgaagattctcttcacttctctatgccatactgatgtttacttctgggaagccaagggacagaatcctttattccccagaatttatggtcatgaggcaggagggattgtggagagtgttggtgagggtgtgacagatctgaaaccaggagaccatgttctgcctgtgttcacaggggaatgcaaggaatgtgctcactgtaaatccgaagagagcaacatgtgtagcctcctcaggataaacacagatagaggagtgatgcttaatgatggaaaatcaagattctcaatcaatggcaagcccatttatcatttcgttgggacctcaacctttagtgagtatactgttgttcacgttggctgtcttgccaagatcaaccccttggctcctcttgacaaagtctgtgttcttagttgtgggatctccacaggtcttggtgctactctcaacgttgcaaagcccccaaaggactcatccgtggctgtatttggactgggtgctgtaggccttgctgctgctgaaggggctagaatggctggggcttcaaggattattggtgttgatttgaactctggaagatttgaagaagcaaagaagtttggagtgaatgagtttgtgaacccaaaggaccacaagaagccagttcatgaggtgattgccgagatgactgatggaggagtagacagaagtgttgaatgtacaggaaacgttgatgcaatgatctctgcatttgaatgcgtccatgatggttggggtgttgcagtcctcgtaggggtgccccataaagatgctgtcttcaagactcacccagtgaatctcctaaatgaaaggactctcaagggtaccttcttcggaaactacaagcctcgcaccgacctcccttcagttgtggagaaatacatgaacaaggaacttgaattggaaaagttcatcacccattcagtaccattttctgagatcaacaaggcctttgagtacatgcttaaaggggaaagccttcgatgcattatccgcatggaggaatagaactgctgatgtttgtggtgaagcaataaatgattgaagttgttccgatgactgaaaataccttgaaaatatggtttctactataatttctcctaatgtaactcaccagttttacagtgttctgtttccctcaatacatcatcttcctgtgtgtacaataaagttctttctatacataatgaacaagcatttataagttttttggttttag

SEQ ID NO: 2756 - DNA, 1705 bp, Sorghum bicolor
aggcattctcgcttagtcctagaccactatatatacagtactcgtccccgctttcttcctcgccaacttctcatcatcagccaagtgtaaagggtgcgaagaaacagcagcaaaaggattccattctcgtgttcttggagtggtccatcgagcttcgtcagggagagctattgagagagagagagagagagagagagagagagagcaagcaatggcgaccgcagggaaagtgatcaagtgcaaagccgccgtggcgtgggaggccagcaagccgctgtcgatcgaggaggtggaggtggcgccgccgcaggccatggaggtgcgcgtcaagatcctctacaccgcgctctgccacaccgacgtctacttctgggaggccaagggccaaactccggtgttccccaggatcttaggacacgaagcgggaggcatcgtggagagcgttggggagggtgtgaccgagctcgcaccaggcgaccatgtcctcccggtgttcaccggcgagtgcaaggagtgtgcccactgcaaatccgaggagagcaacatgtgtgacctcctcaggatcaacgtcgaccgcggcgtgatgatcggcgacgggaagtcccgcttcaccatcaacgggcagcccatcttccacttcgttgggacatccaccttcagcgagtacaccgtcatccatgtcggctgcctcgccaagatcaaccccgaggcgcctctcgacaaagtctgtatcctgagctgtggtatctcaactggccttggcgcaacactgaatgtggcaaaaccagtaaagggttcgacagtggcgattttcggtcttggtgctgtgggccttgctgctatggaaggtgctagactggctggagcatcaagaatcttcggtgtggacatcaacccagcaaaatacgagcaagctaagaaatttggctgcactgatttcgttaaccctaaggaccacgacaagccagtgcaagaggtactgattgagctgaccaatggtggtgtcgaccgcagcgtggagtgcaccggcaacgtgaacgccatgatatctgccttcgaatgtgttcacgacggatggggtgtcgccgtgctggttggtgtgccacacagggaggatcagttcaagacccaccccatgaacttcctcaacgagaagactctcaaggggaccttcttcggcaactacaagccccgcactgacctgcccaatgtcgtcgagatgtacatgaagaaggagctggagctggagaagttcatcacgcacagcgtgcccttctcggagatcaacacggcgttcgacctgatgctcaagggggagagcctgcgctgcatcatgagaatggaggactagagcttcattgcaagctttgcttctgcatccatgctgcatatataccaacggacatgaaaagttgaagacgcttctcccttgtgcagtacatacagtagcaataaattgttaacgtttgtcctgacagacacacggccatgcccatcctgtattctgtttcacggtttcatctttattgtcagtgtgtgatgtgtgtggtcaggtttaatttcagcccttcttagaaaacccaaaaaaagaagaagaaaaaagaagtttgtggccagcttttagagtccctttatcacctgtatgtaattattaccattttgcataacaataatgaaatattgttgtcagtgttaataaggttct

SEQ ID NO: 2757 - DNA, 1578 bp, Saccharum officinarum
cgttggatcgcccgcatgtaccgacccgtacttactggctcgacccacgcgtgcgagccaagtgtaaaggtgcgaagaagcagtagcagaaggattccattctcgtgttcttggagtggtccatcgagcttcgtgagagaaagggcaagcaatggcgaccgcagggaaggtgatcaagtgcaaagccgccgtggcgtgggaggccggcaagccgctgtccattgaggaggtggaggtggcgccgccgcaggccatggaggtgcgcgtcaagatcctctacaccgcgctctgccacaccgacgtctacttctgggaggccaaggggcagactccagtgttccccagaatcttaggacacgaagcgggaggcatcgtggagagcgttggggagggtgtgaccgagctcgcaccaggcgaccatgtcctgccggtgttcaccggcgagtgcaaggagtgtgcccactgcaagtcggaggagagcaacatgtgtgacctcctcaggatcaacgtggaccggggcgtgatgatcggcgacggaaagtcccgcttcaccatcaacggacagcccatcttccacttcgttgggacatccaccttcagcgagtacaccgtcatccatgtcggctgcctcgccaagatcaacccggaggcgcctctcgacaaagtttgtatcctcagctgtggtatctcaactggccttggcgcaacactgaatgtggcaaaaccggtgaagggttcgacagtggcgattttcggtcttggggctgtgggtcttgctgctatggaaggtgctagactggctggggcatcaaggatcttcggtgtggacatcaacccagcaaaatacgagcaagctaagaaatttggctgcactgatttcgttaatcccaaggactatgacaagccagtgcaggaggtactcattgagctgaccaacggcggtgtggaccgcagcgtggagtgcaccggcaacgtcaacgccatgatatctgccttcgaatgtgtccacgacggatggggtgtggccgtgctggtgggtgtcccacacagggaggaccagttcaagacccaccccatgaacttcctcaacgagaagactctcaaggggaccttcttcggcaactacaagccccgcaccgacctgcccaacgtcgtcgagatgtacatgaagaaggagctggagctggagaagttcatcacacacagcgtgcccttctccgagatcaacacggcgttcgacctgatgctcaagggggagagcctgcgctgcatcatgaggatggaggattagagcttcaagcttgctatgcaatcaatgttgcataacaacggacatgaaaagttgaaggcgctcctcccttgtgcagtacagtagtaataaaatgttaatgttgtttgtcctgagacacgagcatgcccatcctgtattctgtttcacggtttcgtccttattgtccgtgtgtgggcaggtttaattccagcccttcttacaaaacccaaaagaaaaaaaaagtttgtggccaggttttcagagagtccctgtatgtaattaccattttgcataacaataatgaaata

SEQ ID NO: 2758 - DNA, 1860 bp, Eucalyptus grandis
acagtaaaaccagggaatttgatatctcgaactggtttcaacatcgcccgttgtatttttccttctcgtgacaaggctcattgaagtattcttccttctcgtgataaggcttattgaacaggtctaaataactgttcctagtaaaaggaactttcgcaatctttccccctttctttcttttctttttttttttttttgctaagaaggaaggttgcctctcctttagtttcgtgtatatatatccaccaaatgacactgccggggaaagcaaaagctaaaggcttcagtttgattgtttttaggtatcagataaaacacaagcccttcttctttgagaaaacaagatgtcaggcactgctggtcaggtgatacattgcagagctgctgttgcatgggaagcaggtaagcccttggtaattgaacaagtggaggtagcacctccacaagccatggaggttcgcttgaagatcctttatacctctctctgccacactgacgtctacttttgggaagccaagggacaaaaccccctatttcccagaatctatggtcatgaagctggagggattgtggagagcgtgggtgagggagtgactgatctgaaaccaggggatcatgtcctcccaattttcactggggaatgcaaggaatgtgcccactgcaaatcagaagagagcaacatgtgtgacctcctccggatcaacactgacagaggagtcatgctcagtgatgggaagtcgagattctccatcaaaggacagcccatataccactttctagggacttcaacattcagcgagtacaccgttgttcatgttggctgtgttgccaagatcaacccgctcgctcctctggacaaagtttgtgtcatcagttgtgggatctcaacaggcctgggagcaatggtaaacgtagcgaaaccacccaagggttcgacggtggctgttttcggattgggagctgttgggttatctgctgctgaaggtgcaaggattgcaggggcttcaagaattatcggtgttgatttgaatccaaatagatttcaagaagcaaagaagttcggtgtgactgaatttgtgaatccgaaagaccacaacaaacctgttcaggaggtgattgctgagatgacaaatggaggagttgataggagtgtcgagtgcactggaaatgtcgacgccatgatctccgcattcgaatgtgtacatgacggttggggcgttgctgttcttgtgggagtgccccataaagatgctgtcttcaagactcatcctattaatctgctgaacgagaggactctgaagggcaccttcttcggaaactataagccacgttcagacattccctccgtcgtagagaaatacatgaacaaagagcttgaagtggagaagttcatcactcatcaggtcccattctcggagatcaacaaggcctttgactacatgctcaaaggcgaaggcctccgatgcatcattcgcatggaggagtaaagaagcggatgaagaaccccatagcactgaagagaaagagaaacaacttgtgcgaggattcgttgaaattgcgtgcttgagggtccaattcacggttcgattcgactgtatttctgctatcttccatgtatttcctggaataattgcatctaaattgtaatccttcagcctttgaaaataatgcgtaattatatacttggacttaatccgatgtcttcaacagtttactgaagtgatgattggattcaaaacatcctcagaatccaaaactgtagggtgattcattttatagctttaaatgaagagttgaacccttccaccaagttggtataaactcctcgaataaatgcgcacgctttccctctaaaacaaa

SEQ ID NO: 2759 - DNA, 1661 bp, Ricinus communis
gctgtgatgacctttattaaagaaaaaaaaaccgttaattcactacaactctttgttcaatttcatcgttcataataagtataaataccttttgcatagcattactttttcccatcgagagctaaaagaattcaactactgttctaaaactctttttcgatacagttatataaaagcttttttctttttctttcccctttgtcttgttcttggattatcgatagaaaagaagaaggaagtgaatatggcatgctctgctggccaagttatacgttgcaaagctgctgtggcatgggaggctgggaagccactactgatagaagaagtggaggtggcacctccacaggctaacgaagttcgtctgaagatcctgtttacctctttatgccacactgatgtttacttctgggaagccaagggacaaaatcctttatttcctagaatatatggtcacgaggctggagggattgtggagagtgttggcgagggtgtgacagatctcaaaccaggagaccatgtactccctgtgttcacaggggaatgcaaggaatgtgctcattgcaaatcagaggaaagcaacatgtgtagcctcctcaggataaatactgataggggtgtaatgcttaatgatggcaattcaagattctcaatcaatggcaagcccatttatcactttgttgggacctccacctttagtgagtacactgtggttcatgttggctgtcttgccaagatcaaccccttggctcctcttgataaagtctgcgtgctcagttgcggaatctccacaggtctcggtgctaccctcaatgttgcaaagcctgcaaagggatcatcagtggttgtgtttggactgggagctgtaggccttgctgctgctgaaggggctagaatcgctggggcttcaaggattataggtgttgatgtgaactcgagtaggttcgaagaagctaagaaatttggcgtgactgagtttgtgaatccaaaggactacaagaaaccagttcaagaggtgattgctgagatgactgatggaggagtggacagaagtgttgaatgcacaggaaacattgatgccatgatctccgcattcgaatgtgtacatgatggctggggagttgcagtgcttgtaggggtgccccacaaagatgctgtcttcaggactcaccccgtgaatttactaaacgaaaggactcttaagggcaccttctttggaaactacaaacctcgctctgacctcccttcagttgtagagaaatacatgagcaaggaacttgaattggaaaagttcatcacacattcagtaccattttctgagatcaacaaggcctttgaatacatgcttaaaggtgaaggccttcgatgcattattcgcatggaggaataaagttgcttgaacaatccaagtccctgataagtgcacagaagaataacgatgcccatcttttgatgttatgctgtgtattaataatttgtaagaactgaaacaagggaaaacctagcaaacaatttctgctccctggcaaatgtaatgaggctcatggctgcttctgcatataatttgtgctaattaaacccatgtaacatgttatttattctgttttgtgagtgatgaacattaaatttcgaaattaaaattttttataacctttgtattcaat

SEQ ID NO: 2760 - DNA, 1211 bp, Cucumis sativus
atatctcaaaatttgtctctatcttttcatcgtttcaagttatgtcgaccactcttggtcaagtcatcaaatgcaaagctgctgtggcatgggaagctggaaagccactggtgattgaagaagtggaagtggcaccaccacaagctaatgaagttcgtgttaagatccttttcactgctctttgccacactgatgtttacttctgggaagccaaaggccaaacacctctgtttcctcgcatatttggacacgaagctggaggagttgtggagagtgtaggggagggtgtgactgatcttaaaccaggagaccatgttcttcctgtgttcactggtgaatgtggggattgtcgccattgtagatcggaagagagcaacatgtgtgatcttctccgaatcaacactgaccgtggcgttatgatcaatgatggcaagtcaagattctctataaatggaaaaccaatccatcactttgttggaacctcgacatttagcgaatacactgttgttcatgttggctgtctggcaaagatcaacccggctgcacctcttgacaaagtttgtgttctcagctgcggcatatccacagggcttggtgccactttgaatgttgcaaaaccaaaaaagggttcatctgttgctatctttggacttggagctgttgggctcgcagctgctgaaggagcgagaattgctggcgcatccaggatcattggtgttgatctgaatccaagtagattcgaagaagcaaagaaatttggttgcaacgaatttgtgaacccaaaggatcataacaagccagttcaggaggtgattgcggagatgaccgatggaggagttgacaggagtgtcgaatgcactggaagcattcaggcaatgatctcagcattcgaatgtgtccacgatggttggggtgttgctgtactcgtgggagtgccaaacaaagacgatgcattcaaaactcatccaatgaatctcctgaacgagaggactttgaagggtacattcttcggaaactacaaaccgagaactgacattcctggggttgttgagcagtacttgaagaaggagctggaattggagaagttcataacacatgcagtgccattttctgagataaacaaagcatttgattacatgctgaagggagagtcaattcgctgtattataaggatgggagagtgatttgtggtgttatttgtttatgaataa

SEQ ID NO: 2761 - DNA, 1356 bp, Triticum aestivum
gatggcgactgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaagggtcaaactccggttttccctaggatcttgggccatgaagctggaggcatcgtggagagcgtcggagagggcgtgaccgagcttgtgccgggtgaccatgtcctcccagtgttcaccggcgagtgcaaggactgtgcccactgcaagtcagaggagagcaacctttgtgatctcctcaggatcaacgtggatcgtggcgtgatgatcggcgatgggcagtctcgcttcaccatcaacgggaagccgattttccacttcgtcgggacctccaccttcagcgagtacaccgtcatccatgttggttgcctcgcgaagatcaaccccgaggcgcccctcgacaaagtttgtgttctcagctgtggcatctctactggacttggcgccacgctcaatgtcgcaaaaccaaagaagggttccacggtggcaattttcggtcttggagctgtaggacttgctgccatggaaggggctaggatggctggggcatcaaggatcattggtgtggatttgaaccctgcaaaatacgaacaagctaagaaatttggatgcacagactttgtgaacccaaaggaccacactaagcccgtgcaagaggtgcttgtcgagatgaccaatggtggagtcgaccgggcggtcgagtgcactggccacatcgacgccatgatcgccgccttcgaatgcgtccatgatggatggggtgtggccgtgctggtgggcgtgccgcacaaggaggcagtgttcaagacctacccaatgaacttcctcaacgagaggaccctcaaaggcaccttcttcggcaactacaagccgcgcaccgacctcccggaagtggtcgagatgtacatgaggaaggagctggagctggagaagttcatcacacacagcgtgcccttctcgcagatcaacacggcgttcgacctcatgctcaagggggagggcctgcgctgcatcatgaggatggaccagtagatcgccgcctcttatcattcatcaatgtgtctcgctgttttcagatttggtgcttgagaagcaaaagacaaagaaaatgaaaagttagaaatctccccttggataataattttctagtcacgagatgtgttcatctccatggtctcagagtgaactagtgggtctttgttttgtgtttggtctcagtgtgtcgtcggcagctttcagttagcatg

SEQ ID NO: 2762 - DNA, 1447 bp, Triticum aestivum
atcttctttctcttcgagttcttggagcttgcgaccgacagggcacagggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaagggtcaaactccggttttccctaggatcttaggccatgaagctggaggcatcgtcgagagcgtcggagagggcgtgactgagcttgtgcctggtgaccatgtcctcccggtgttcaccggcgagtgcaaggactgtgcccactgcaagtcagaggaaagcaacctttgtgatctcctcaggatcaacgtggatcgtggcgtgatgatcggcgatgggcagtctcgcttcaccatcaacgggaagccgattttccacttcgtcgggacctccaccttcagcgagtacaccgtcatccatgtcggttgcctcgccaagatcaaccccgaggcgcccctcgacaaagtttgtgttctcagctgtggcatctcaactggacttggcgccacgctcaatgtcgcaaaaccaaaaaagggttccacggtggcgattttcggtcttggagctgtaggacttgctgccatggaaggggccaggatggctggggcatcaaggatcattggtgtggatttgaaccctgcaaaatacgaacaagctaagaaatttggatgcacagactttgtgaacccaaaggaccacagtaagcccgtgcaagaggtgcttgtcgagatgaccaatggcggagtcgaccgggcggttgagtgcactggccacatcgatgccatgattgccgccttcgaatgtgtccatgatgggtggggcgtggctgtgctggtgggcgtgccgcacaaggaggcggtgttcaagacctacccaatgaacttcctcaacgagaggaccctcaaaggcaccttcttcggcaactacaagccgcgcaccgacctcccggaagtcgtggagatgtacatgaggaaggagctggagctggagaagttcatcacgcatagcgtgcccttctcgcagatcaacacggcattcgacctcatgctcaagggggagggcctgcgctgcatcatgaggatggaccagtagatcgccacctcccatcattcatcaatgtgtctcgctgttttcagatttggtgcttgagaagcaaaagataaaaaaacaaaaaaatagaaatcttcccttggataataatttattagtcgcgagatgtgttcatctctattgtctcagagagaacggatgggtatttgttttgggtttggtctcagtgtgtcgtcggcagctttcagttagcatgtaaattactatcattgtgcacaatagtattaatatcttgcagc

SEQ ID NO: 2763 - DNA, 1475 bp, Triticum aestivum
cacgcgtccgacgaaccgcaaagcagaagcagcgacaaagatccatctttgtgtctcttcttctggcgacagggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaagggtcaaactccggttttccctaggatcttaggccatgaagctggaggcatcgtcgagagcgtcggagagggcgtgactgagcttgtgcctggtgaccatgtcctcccggtgttcaccggcgagtgcaaggactgtgcccactgcaagtcagaggaaagcaacctttgtgatctcctcaggatcaacgtggatcgtggcgtgatgatcggcgatgggcagtctcgcttcaccatcaacgggaagccgattttccacttcgtcgggacctccaccttcagcgagtacaccgtcatccatgtcggttgcctcgccaagatcaaccccgaggcgcccctcgacaaagtttgtgttctcagctgtggcatctcaactggacttggcgccacgctcaatgtcgcaaaaccaaaaaagggttccacggtggcgattttcggtcttggagctgtaggacttgctgccatggaaggggccaggatggctggggcatcaaggatcattggtgtggatttgaaccctgcaaaatacgaacaagctaagaaatttggatgcacagactttgtgaacccaaaggaccacagtaagcccgtgcaagaggtgcttgtcgagatgaccaatggcggagtcgaccgggcggttgagtgcactggccacatcgatgccatgattgccgccttcgaatgtgtccatgatgggtggggcgtggctgtgctggtgggcgtgccgcacaaggaggcggtgttcaagacctacccaatgaacttcctcaacgagaggaccctcaaaggcaccttcttcggcaactacaagccgcgcaccgacctcccggaagtcgtggagatgtacatgaggaaggagctggagctggagaagttcatcacgcatagcgtgcccttctcgcagatcaacacggcattcgacctcatgctcaagggggagggcctgcgctgcatcatgaggatggaccagtagatcgccacctcccatcattcatcaatgtgtctcgctgttttcagatttggtgcttgagaagcaaaagataaaaaaacaaaaaaatagaaatcttcccttggataataatttattagtcgcgagatgtgttcatctctattgtctcagagagaacggatgggtatttgttttgggtttggtctcagtgtgtcgtcggcagctttcagttagcatgtaaattactatcattgtgcacaatagtattaatatcttgcagcctca

SEQ ID NO: 2764 - DNA, 1842 bp, Theobroma cacao
caaactaaactaattccgaccgttacaagatgagatttgccttgtcttggttcatatgtgctacaactaaaaaacaaaggctttcgtcagccgtgacaggagactccgagggctggttcggttaacggggcctaaaatccaaatctgctggcagcgtttgaaccacgtgtcgggaagtaataggaagaatacaggcgtcaaactgacacactgacacatacaaggtttgaaatgttacctagttgccaactcgccatataaaatgtaaagtccttttgtagtatagctaaagtccacctcctaaatactaattaaaaaagggttagggaagggacaataccagacgtctgtggaaagtgggaaagaggacaatacaaaggcgccgtttggttgccttgcagccactacacacaaaattccaaggaagaaaacagcggtttacgtttgctggttttttaccttctaacaccttctgccatctcaacttataaataccctctcaaaccaggccagtctcaagcataaatagttagtcaaattcctaaagaaaatcaaaaacccattactagtttcaaagaaaatatgtcaagcactgctggtcaggtcattcgttgcaaagctgccgtggcatgggaagctggaaagccactggtggttgaagaggtggagctggcaccaccacaggcaatggaggttcgtctgaagatcctctttacctctctctgccacaccgatgtttacttttgggaagccaaggggcaaactccattattccctcgcatatttggtcatgaagcaggggggattgttgaaagtgttggtgagggtgtgacagaccttaaacccggtgaccatgtgcttcctgtgttcactggggaatgcggggactgccgtcattgcaagtcagaggaaagtaacatgtgtgatctgcttaggatcaacactgaccgaggggtgatgcttaatgatggcaagaccaggttctctattaatggacaacctatttaccatttcgttgggacatctaccttcagcgaatacactgttgttcatgttggctgtgttgccaaaatcaatcctgctgctccactagacaaagtttgtgttctcagctgtggaatctctacaggtcttggtgccaccttgaatgttgcaaaacccactaagggttcaactgtggccatttttggattaggagcagttggccttgctgccgctgaaggggctagaattgcaggcgcttctaggattattggggttgatcttaattctaagaggtttgaggaagccaagaattttggttgcactgaatttgtgaacccaaaagaccatgacaagcctgttcaagaggtgctcgctgaaatgacaaatgggggagttgatcgaagtgtggagtgcactggaagcatcaatgccatgatttctgcatttgaatgtgttcacgatggatggggtgttgctgtgctagttggtgtgccaaataaggatgatgcatttaaaacccatcccatgaatctgctgaatgagaggacgctcaagggcaccttctttggcaactacaagccccgctctgaccttccttcagtggtggaaaagtacatgaacaaagagcttgagctggagaaattcatcacccatgaagtacctttctcagagatcaacaaggcctttgaatacatgcttcgtggggagggcctccgttgtatcatccgcatggatgcataaagcagaatgaagtccaagttaatctgtatttagcaatcatctgttttttactttgatagaaggatcccagacttgtgttgagcttcgtgatgaaagaaaatgtctttttgattttta

SEQ ID NO: 2765 - DNA, 1491 bp, Hordeum vulgare
accaaaatctacgtagcaacgaactgcagaagcagaaacagcgacagagatccgtctttctcttccagcgacagggatggcgaccgctgggaaggtgatcaagtgcaaagcggcggtggcgtgggaggccgggaagccgctgtcgatcgaggaggtggaggtggcgccgccgcaggccatggaggtgcgcgtcaagatcctctacactgccctctgccacaccgacgtctacttctgggaagccaaggggcaaactccggttttccctaggatcttaggccatgaagctggaggcattgtcgagagcgtcggagagggcgtgactgagcttgtgccgggtgaccatgtcctcccggtgttcaccggcgagtgcaaggactgtgcccactgcaagtcagaggagagcaacctttgtgatctccttaggatcaatgtggatcgtggcgtgatgatcggcgatgggcagtctcgcttcaccatcaacggaaaaccgatcttccacttcgtcgggacctccaccttcagtgagtacaccgtcatccatgtcggttgcctcgcaaagatcaaccccgaggctcccctcgacaaagtttgtgtcctcagctgtggtatctcaactggacttggtgctacgctcaatgtcgcaaaaccaaaaaagggttccacggtggccattttcggtcttggagctgtaggactggctgccatggaaggggccaggatggctggggcatcaaggatcattggtgtggatttgaaccctgcaaaatacgaacaagctaagaaatttggatgcacagactttgtgaacccgaaggaccacactaagcccgtgcaagaggtgctcgtcgagatgaccaatggcggagtcgaccgggcagtcgagtgcactggccacatcgacgccatgatcgccgccttcgaatgcgtccatgatgggtggggcgtggctgtgctggtgggtgtgccgcacaaggaggcggtgttcaagacccacccaatgaacttcctcaacgagaagaccctgaaaggcaccttcttcggtaactacaagccgcgcactgacctgccggaagtggtcgagatgtacatgaggaaggagctcgacctggagaagttcatcacgcatagcgtgcccttctcgcagatcaacacggcgttcgacctcatgctcaagggggagggcctgcgctgcatcatgaggatggaccagtaggagctggacctggagaagatcaccacagtgtttctcgctgttttcaggtttggtgcttgagaagcaaaagacaaaaaaaaaaacaaaaagtttgaaatctccccttggataataatgtactagtcgcgagatgtgttcatctctatggtcttagagggaacgaatgggtctttgttttgtgtttggtctcagtgtgtcatccacagctttcagttagcatgtaaattactatcattgtgtacaaatagtaatcaatatcttgcagcttctgtctt

SEQ ID NO: 2766 - DNA, 1475 bp, Hordeum vulgare
caacgaactgcagaagcagaaacagcgacagagatccgtctttctcttccagcgacagggatggcgaccgctgggaaggtgatcaagtgcaaagcggcggtggcgtgggaggccgggaagccgctgtcgatcgaggaggtggaggtggcgccgccgcaggccatggaggtgcgcgtcaagatcctctacactgccctctgccacaccgacgtctacttctgggaagccaaggggcaaactccggttttccctaggatcttaggccatgaagctggaggcattgtcgagagcgtcggagagggcgtgactgagcttgtgccgggtgaccatgtcctcccggtgttcaccggcgagtgcaaggactgtgcccactgcaagtcagaggagagcaacctttgtgatctccttaggatcaatgtggatcgtggcgtgatgatcggcgatgggcagtctcgcttcaccatcaacggaaaaccgatcttccacttcgtcgggacctccaccttcagtgagtacaccgtcatccatgtcggttgcctcgcaaagatcaaccccgaggctcccctcgacaaagtttgtgtcctcagctgtggtatctcaactggacttggtgctacgctcaatgtcgcaaaaccaaaaaagggttccacggtggccattttcggtcttggagctgtaggactggctgccatggaaggggccaggatggctggggcatcaaggatcattggtgtggatttgaaccctgcaaaatacgaacaagctaagaaatttggatgcacagactttgtgaacccgaaggaccacactaagcccgtgcaagaggtgctcgtcgagatgaccaatggcggagtcgaccgggcagtcgagtgcactggccacatcgacgccatgatcgccgccttcgaatgcgtccatgatgggtggggcgtggctgtgctggtgggtgtgccgcacaaggaggcggtgttcaagacccacccaatgaacttcctcaacgagaagaccctgaaaggcaccttcttcggtaactacaagccgcgcactgacctgccggaagtggtcgagatgtacatgaggaaggagctcgacctggagaagttcatcacgcatagcgtgcccttctcgcagatcaacacggcgttcgacctcatgctcaagggggagggcctgcgctgcatcatgaggatggaccagtaggagctggacctggagaagatcaccacagtgtttctcgctgttttcaggtttggtgcttgagaagcaaaagacaaaaaaaaaaacaaaaagtttgaaatctccccttggataataatgtactagtcgcgagatgtgttcatctctatggtcttagagggaacgaatgggtctttgttttgtgtttggtctcagtgtgtcatccacagctttcagttagcatgtaaattactatcattgtgtacaaatagtaatcaatatcttgcagcttctgtctt

SEQ ID NO: 2767 - DNA, 1247 bp, Manihot esculenta
atcaacaacaaaactcaaaatcaactgttgaattcttacagacttctaagcaaaagcttaatttttctgaagcagagaaagagaggaaagatggcaggcactgctggaaaggtcattcgttgcaaagctgctgtggcatgggaggcagggaagccactggtgatcgaagaagtggaagtggctcctcctcaggccagtgaagttcgtttgaagatcctattcacttctttgtgccacactgatgtttacttctgggaggctaagggtcagaatccattatttcctagaatttacggtcatgaggctggagggattgtggagagtgttggtgaaggtgtgactgatctcaaaccaggcgaccatgtcctccctgtgttcactggggaatgcaaggactgtgctcactgcaaatcagaagagagcaacatgtgtagcctcctcaggataaacacagataggggagtgatgcttaatgatggaaaatcaagattctcaattaagggcaagcctatttaccactttgttgggacatctacctttagtgagtacactgtggttcatgttggctgtcttgccaagatcaatcccttggcccctctggacaaagtctgtgttctaagttgtggaatctccacaggccttggtgccactctgaatgttgctaagcctccaaagggttcaacagtggctatctttggattgggagctgtaggccttgcggctgctgaaggagctaggattgctggggcttcaagaatcattggtgttgatgtgaattcaaatagatttgaagaagcaaagaagttcggagtgactgaatttgtgaacccacaacatcacaacaaaccagttcaggaggtgatcgctgagatgacagatggaggagtggacagaagtgtggaatgcacaggaaacgtcgacgccatgatttctgcatttgaatgcgtgcatgacggctggggagttgctgtccttgttggggtgccacacaaagaagcagttttcaagacccaccccatcaacgttttgaatgaaaggactctcaaaggtactttctttggaaactacaaacctcgcactgaccttccctcagttgtggaaaaatacatgaacaaggagcttgaacttgaaaagttcatcacccattcagtcccattctcaaagatcaacgaggcattcgagttgatgctcaaagcggaaagccttcgctgcatcatacgtatggagtaatagaaaaaaccttcatc

SEQ ID NO: 2768 - DNA, 1371 bp, Ipomoea batatas
tttacggccggggacccatcaacataccgattcaattcgcacttacaagtattttcagcttgctttttaaacactgagacaacaaaaatggcatgcactgctgggcaagtcattcgatgcaaagctgcggtggcatgggaagcagggaagccgctagtgatagaggaagtggaggtcgccccgccccagaaaatggaagtccgaatcaagattctcttcacttctctttgccacactgatgtctacttctgggaagccaaggggcaaaatcctgtctttcctcgcattctaggacacgaggccgcagggattgtggagagtgtaggagagggagtgacagagctagcaccaggggaccatgtgctacctgttttcactggggaatgcaaagaatgtagacactgcaaatcagaggagagcaatatgtgtgatctcctcaggatcaacactgacagaggggtaatgcttcacgaccagaaatcaagatttacaatcaacggccaaccaatctatcacttcgttggaacttccaccttcagcgaatataccgtttgtcatgttggttctattgccaagatcaacccacatgcacctcttgacaaagtttgtgtcctcagctgtggtatctccacaggtcttggtgccacattgaatgttgctaaaccaaaaccaggctcaacggtggctgtctttggattgggagctgttggccttgctgctgcagaaggggcaagaatggcaggtgcatcaaggatcattggtgttgatttggttcccagcagatttgaactagccaagaaatttggtgtgactgactttgtcaacccaaaagaccatagcaaaccagttcaagaagtgattgttgggatgactgatggaggagtggacagaagcgtggagtgcactgggaacattaatgctatgatttctgcattcgaatgcgtccacgatggatggggagtggcggtgctggtgggagtgccacacaaagaggcagtgttcaagactcaccccatgaacttgctgaacgagaggactctgaagggtactttctttggcaactacaagccccgcactgacctcccggctgttgtggagaaatacatgaacaaggaactggaattggagaaattcatcactcatgaagtgccgtttgctgagatcaacaaggcctttgatctgatgctcaaaggggaaggccttcgctgcatcatcaccatgtagactcttgtctgtcaaaaagaatgcttctattttgtgttcattatgtagtcattcatgttttccctttccccccaaaaaaggttgagttttgtgtgaatattacaaccatgtactttgtattatgttgtcaaatttcacaatactgaa

SEQ ID NO: 2769 - DNA, 1349 bp, Avena sativa
atcagcgaactgctaagtagaaacagcaacacagatcgatctttggagcttgcgactgacggcaatggcgacagccgggaaggtgatcaagtgcaaagctgcggtggcatgggaggccgggaagccgctgtcgatggaggaggtggaggtggcgccgccgcaggccatggaggtccgcgtcaagatcctctacaccgccctctgccacaccgacgtctacttctgggaggccaagggacaaactccggttttcccgaggatcttaggacacgaagctggaggcatcgtcgagagcgtcggcgagggtgttaccgagctcgtgccaggtgaccatgtcctccccgtgttcaccggagagtgcaaggattgtgcccactgcaagtcggaggagagcaacctgtgtgacctcctcaggatcaacgtggaccgtggcgtgatgatcggcgacggccagtcccgctttaccatgaacgggaaaccaatcttccacttcgtcggaacctccaccttcagcgagtacaccgtgatccatgtcgggtgcctcgccaagatcaaccccaaggcgccccttgacaaagtctgtgttctcagctgcggtatctctactggacttggtgcgacgctgaatgtcgccaaaccgaagaagggttcaactgtggcgatttttggtcttggagctgtaggccttgctgccatggaaggggccaagatggctggggcatcaaggatcattggtgtggacttgaaccctgaaaaatatgaacaagctaagaaatttggatgcaccgacttcgtgaacccaaaggaccacaccaagcccgttcaagaggtgcttgtggagatgaccaatggtggggtcgacagagccgtcgagtgtaccggcaacgtcaacgccatgatctccgccttcgaatgtgttcacgatggttggggcgtggctgtcctggtgggcgtcccccacaaggaggcggtgttcaagacccacccgatgaacttcctcaacgagaggacgctcaagggcaccttcttcggcaactacaagccgcgcaccgacctccccgaggtcgtggagatgtacatgaggaaggagctggaggtggagaagttcatcacgcacagcgtgcccttctcgcagatcaacacggcgttcgacctcatgctcaagggagagggattgcgctgcgtcatgaggatgggcgagtagatccagcttcatcttcgttttcaggaaaacgaagaggactgtgttaatactttcagcagcgattcgtcgctcaccagccgctgcaagttagcgtgtgtacatgaccattttgcacaataataataagcgttgcagtttatgtgct

SEQ ID NO: 2770 - DNA, 1383 bp, Triphysaria pusilla
tccgatcaatttaagctaacccaagatgtcaaccaccgccggtcaagtcatcaaatgcaaagctgctgttgcatgggaagccggaaagccactggtaattgaagagattgaggtggcgccgccgcagaaaatggaggtccgaatgaagattcttttcacctccctttgccacactgatgtctatttctgggaagctaaggctcaagattccgtctttcctcgaatcttcggccacgaagcatctgggattgtggagagtgtaggcgagggcgtaacggagctcgtcccaggcgatcacgtactccccgtattcacgggtgaatgtggagattgtgcccactgcaagtcccaagaaagcaacatgtgtacccttcttaggatcaactgtgacaggggagtgatgctaaatgacgaaaagcccagattttcgatcaacggaaagcccatttatcattttgtcggcacgtctacttttagcgagtatactgtggttcatgctggatgtgttgccaagataaatccacttgctcctctcgataaagtttgcgtgctcagttgcgggatttcgacaggccttggtgctacattgaatgttgctaaaccgccaaagggttcgtcggttgctattttcggacttggagcagtcgggctggcggctgcagaaggagcaagattggctggtgcttcgagaattattggcgtcgatttgaaccctgctcgattcgaaaatgccaagaaatttggagtgactgaatttgtgaacccaaaagaccatgacaagccagttcaagaggtaattgctgagatgactgatggaggagtggatcgaagcgtagaatgtaccggaaacgtcaacgccatgatctctgcatttgaatgtgttcatgatggatggggtgttgctgttcttgttggtgtgccacataaagacgcggttttcaagactcatccgatgaacttattgaacgagaggactctaaagggtacttttttcgggaactataagccgcgttctgatttgccgtcggttgtcgaaatgtacatgaagaaggaacttgaagtggagaagtttataacacatgaagtgccgtttgctgagataaatacggctttcgatctgatgctgaaaggtgaagggctccgttgtattatccgaatggagtgaagaagatgaaatgattctacttttgttattgtgtttaaatatggttttatgttcttcaattttgttttccagtttgatgttttatcttcgtgttttctcgaagttcaaaaccgagcttaattgaataaattatcggttttcctaaattttatctttgattattctatgtattctacaatatctaagaagataaataattttatcgttgtcgtgaaaaa

SEQ ID NO: 2771 - DNA, 1766 bp, Eucalyptus grandis
gggaaaaaccagaaaccacgacaccgccgtggattgccaccttccatggaaagcgcgaatgaggaaaaatcagaaactgtaggtagttctgttctagagagtccctggtttctctccatctcctgctttcccgaagtttcccccgaaaaaggtaaaacagaaaagcaaacaaaacaatgagccgctcgaacttttctccctctctcctcgattcggcgggcttaacgggtataaataccacccccgagcccaacccacttcctcacatctgcgcaagaacggttcttgaggtcaaagagatcagagaaatcaggcagtttcagaattcgggtagtgggatattgctgaggttgagatggcgggcaccgctggtcaggtcattcgctgcaaagctgcggtgtcgtgggaagctggaaagccgcttgtgatggaagaagtggaggtggctcctccgcaggcgatggaggtccggatcaagatcctcttcacctccctttgccacaccgatgtttatttctgggaagccaagggacaaaccccagtgtttccccgcatttttggtcatgaagcatcagggattgtggaaagtgtcggtgaaggcgtgacagaacttcaacctggtgatcatgtccttcctgtgttcactggagaatgcaaggagtgtccgcattgtaaatccgaggagagcaatatgtgtgacctgctcaggataaacacggatcggggagttatgcttaatgataacaagtcgaggttctcgatcaacgggaagcccatttaccattttgttggcacttcgaccttcagtgagtacaccgtggttcacgttggctgtgttgccaagatcaaccctgcagccccgcttgacaaagtctgtgtgctcagctgcggtatctccacaggtcttggtgccaccctgaatgttgcgaagccaaagaaggggcaatcggtagccatttttggacttggagctgtcggccttgctgcagctgaaggggctagaatgtcgggagcttcaaggattattggagttgatctgaacccaaacagattcgatgaagccaagaaatttggagtcaccgagtttgtgaatcccaaggaccacagcaaacctgttcaagaggtgattgctgaaatgaccaatggtggtgttgatcgaagtgttgagtgcactggaaatatcaatgccatgatctctgcattcgaatgtgttcatgatggatggggggttgctgttctcgttggcgttcctaacaaagatgatgcattcaagacccatccgatgaatctcttgaatgagaggactctcaagggcactttctttggcaacttcaagccaaggactgaccttccctctgttgtagagaagtacatgaataaggaacttgagctggagaagttcattacacacgaggttcctttctcggagatcaacaaggccttcgactacatgcttcaaggcgccggccttcgctgcctaatccgcatgggcgagtagaatcactgagggtgcggagcatggtcgcttcgcttcggggagagaggccaaaacttttcttgcatttgaggtttcttgctgcatcgtttttatctgcccgtgtcttgaggcagaagagtgatttcataaatgagtctttgctgctgtaaatggtttattagtaactaatgagtggattatttcgtgttctatcgtcagaaagatatggagattcatatggttctttgttacgccatattgtctgacaattgagtgctcatctttggaa

SEQ ID NO: 2772 - DNA, 1500 bp, Theobroma cacao
  misc_feature (134)..(134): n is a, c, g, or t
aagcataaatagttagtcaaattcctaaagaaaatcaaaaacccattactagtttcaaagaaaatatgtcaagcactgctggtcaggtcattcgttgcaaagctgccgtggcatgggaagctggaaagccactngtggttgaagaggtggagctggcaccaccacaggcaatggaggttcgtctgaagatcctctttacctctctctgccacaccgatgtttacttttgggaagccaaggggcaaactccattattccctcgcatatttggtcatgaagcaggggggattgttgaaagtgttggtgagggtgtgacagaccttaaacccggtgaccatgtgcttcctgtgttcactggggaatgcggggactgccgtcattgcaagtcagaggaaagtaacatgtgtgatctgcttaggatcaacactgaccgaggggtgatgcttaatgatggcaagaccaggttctctattaatggacaacctatttaccatttcgttgggacatctaccttcagcgaatacactgttgttcatgttggctgtgttgccaaaatcaatcctgctgctccactagacaaagtttgtgttctcagctgtggaatctctacaggtcttggtgccaccttgaatgttgcaaaacccactaagggttcaactgtggccatttttggattaggagcagttggccttgctgccgctgaaggggctagaattgcaggcgcttctaggattattggggttgattttaattttaagaggtttgaggaagccaagaattttggttgcactgaatttgtgaacccaaaagaccatgacaagcctgttcaagaggtgctcgctgaaatgacaaatgggggagttgatcgaagtgtggagtgcactggaagcatcaatgccatgatttctgcatttgaatgtgttcacgatggatggggtgttgctgtgctagttggtgtgccaaataaggatgatgcatttaaaacccatcccatgaatctgctgaatgagaggacgctcaagggcaccttctttggcaactacaagccccgctttgaccttccttcagtggtggaaaagtacatgaacaaagagcttgagctggagaaattcatcacccatgaagtacctttctcagagatcaacaaggcctttgaatacatgcttcgtggggagggcctccgttgtatcatccgcatggatgcataaagcagaatgaagtccaagttaatctgtatttagcaatcatctgttttttactttgatagaaggatcccagacttgtgttgagcttcgtgatgaaagaaaatgtctttttgatttttatgcattgtacatgaagaatgccatgcttgttgcatggatgaatgtgttctgtatcgtctctctctaatggtgctttcacttcagatatgcgaactggaaactaagctttctttgataagacgttataatttttaattgatcaatagctatggtacaaagagatttacttgcttca

SEQ ID NO: 2773 - DNA, 1148 bp, Ricinus communis
atgacaagcactgttggcaaggtcattcattgcaaagctgctgtggcatgggaggcagggaagccactagtgattgaagaagtagaggtggcacctccacaggctaatgaagttcgtttaaagatcatcttcacttctttatgccacactgatgtttacttctgggaagccaaggggcagaacccgttatttcctagaatttatggccatgaggcaggagggattgtggagagtgttggtgaaggtgtgaatgatctcaaaccaggtgatcatgtcctcccagtatttactggggaatgcaagaattgtgctcactgcaaatccgaagagagcaacatgtgcaacctcctgaggataaatactgacaggggagttatgcttaatgatggaaaatcaagattttccattaaaggcaagcctatttaccacttcgttgggacatccacttttagcgagtacacagtggttcatgtaggctgtgttgccaaaatcaatcccttggctcctttggacaaagtctgcgtgctaagttgtggaatctcaacaggtcttggtgccactttgaatgtggccaagcctccaaagggttcaactgtggctatctttggattgggagctgtaggccttgctgctgctgaaggagctaggattgctggggcttcaagaattattggtgtggatgtgaattcaaatagatttgaggatgcaaagaagtttggcgtaactgagtttgtgaacccaaaacatcatgagaaaccggttcaggaggtgattgctgagatgactaatggaggagtcgatagaagtgttgaatgtacaggaaacgtggatgcaatgatttctgcatttgaatgtgtacatgacggctggggagttgctgttctggttggagtgccacacaaagaagctgttttcaagacccaccccatgaatgttttgaatgaaaggactctcaaaggtaccttcttcggaaactacaagcctcgaaccgatcttccttcagttgtggaaaagtacatgaccaaggaacttgaactggaaaagttcatcacgcattcagtccctttctccgagatcaacgaggcctttgaactcatgcttaaaggggaaagccttcgctgcatcatccgaatggaggaatagaggcc

SEQ ID NO: 2774 - DNA, 1547 bp, Castanea mollissima
tttcagtcacggtcttgatcaggagctcagcggtaccacatcatggttttgaatcccggagttggagccttattggaaggcaaatatgggaaccctctgtgttctaaacgctatatataccctcatagagcgtacccatctctccacaacgaattcaaagcaatcagtgatcaaaaatcaaagtcaagaaagagtgaagaaaattaaaaaaacatgtcttcaaccactgctggtcaagtcatacgttgcaaagctgctgtggcatgggaagctggaaagccactagtgatagaagaagtggaagtggcaccaccacaggccatggaggttcgtctcaagatcctcttcacctccctctgccacacagatgtttacttctgggaagccaagggacagaccccattgtttcctcgcatatttggtcatgaagctggcgggattgttgagagcgttggtgagggtgtgacagacctcaaacctggtgaccatgtgcttcctgtcttcactggggagtgcaaggagtgtcggcattgcaagtcagaggagagcaacatgtgtgacctcttgaggataaacactgaccgaggcgtgatgctcaacgatggcaagtcaagattttctattaatggacaacccatttaccattttgttgggacttccacctttagtgaatacactgtggttcacgttggttgtgttgccaaaattaatcctgctgctcctctggacaaagtttgtgttctcagctgtggaatctcaacaggccttggtgctaccttgaacgttgcaaaacccaaaaagggatcaacggtagctgtttttggactgggtgctgttggactagctgctgctgaaggggctagaatttctggtgcttcaaggattatcggtgttgatctgaatgcaaagagatttgatgaagccaagaaatttggtgtcaccgagtttgtgaacccaaaagaccatgacaagcctgttcatgaggtgcttgctgaaatgaccaatggtggagttgatcgaagtatcgagtgcactggaagtatcaatgccatgatttctgcatttgaatgtgttcatgatggatggggtgttgctgtacttgttggtgtcccaaacaaagatgatgcatttaaaacccacccaatgaatatcttgaatgagaggactatcaagggtaccttctttggcaactacaaaccacggtctgacttgccttcggtggttgaaaagtacatgaataaggagcttgagctagagaagttcatcacccatgaagtctctttctcggaaatcaacaaggcctttgagtacatgcttagaggtgaaggccttagatgcattatccgcatggatgcatagagcagaattgaaatgatgagtatttctgagtgtaattaacaaaaataaacttatactcacaaatgaaattagcttctggtaggatagtttggaacgaagtcttgtgtctctgtttagaatgctgtaaaagaattgaaatgtctatttcccagatcatttaaatcaaaatactccgatgagtttatatt

SEQ ID NO: 2775 - DNA, 1417 bp, Quercus alba
acgaattcaaagcaatctgtgataaaacatcaaagtcaagaaagagtgtgaagaaaagtaaaaaaacatgtcttcaaccactgctggtcaagtcatacgttgcaaagctgctgtggcatgggaagctggaaagccactagtgatagaagaagtggaagtggcgccaccacaggctatggaggttcgtctcaagatcctcttcacctccctctgccacacagatgtctacttctgggaagccaagggacagaccccattgtttcctcgcatatttggtcatgaagctggcgggattgttgagagcgttggtgagggtgtgacagacctcaaacctggtgaccatgtgcttcctgtcttcactggggagtgcaaggagtgtcggcattgcaagtcagaggagagcaacatgtgtgacctcctgaggataaacactgaccgaggcgtgatgctcaatgacggcaagtcgagattttctattaatggacaacccatttaccattttgttgggacttctacctttagtgaatacactgtgctacatgttggtagtgttgccaaaattaatcctgctgctcctctggacaaagtttgtgttctcagctgtggaatctcaacaggccttggtgctaccttgaatgttgcaaaacccaaaaagggatcgacggtagctgtttttggactcggggctgttggactagctgctgctgaaggggctagaattgcgggtgcttcaaggattattggtgttgatctgaatgcaaagagatttgatgaagccaagaaatttggtgtcaccgagtttgtgaacccaaaagaccatgacaagcctgttcatgaggtgcttgctgaaatgaccaatggtggagttgatcgaagtattgagtgcactggaagtatcaatgccatgatttctgcatttgaatgtgttcatgatggatggggtgttgctgtacttgttggtgtcccaaacaaagatgatgcatttaaaacccacccaatgaatatcttgaatgagaggactatcaagggtaccttctttggcaactacaaaccgcggtctgacttgccttcggtggttgaaaagtacatgaataaggagcttgagctagagaagttcatcacccatgaagtctctttctcggaaatcaacaaggcctttgagtatatgcttagaggtgaaggccttagatgcattatccgcatggatgcatagagcaggattgaaatgatgagtatttctgaaatgatgcatagtttggagtgaagtcttgtgtctctctttagagtgctgtaaaaaaattgaaatgtctattttccggatcatttaaatcaaaatactcagtgagtttatattgaacttttagcatgttttcttgtctcttcgagttatcaaatgatacacttatttagagacacg

SEQ ID NO: 2776 - DNA, 1398 bp, Quercus alba
gcggggaacgaattcaaagcaatctgtgataaaaaatcaaagtcaagaaagagtgaagaaaagtaaaaaaacatgtcttcaaccactgctggtcaagtcatacgttgcaaagctgctgtggcatgggaagctggaaagccactagtgatagaagaagtggaagtggcaccaccacaggccatggaggttcgtctcaagatcctcttcacctccctctgccacacagatgtttacttctgggaagccaagggacagaccccattgtttcctcgcatatttggtcatgaagctggcgggattgttgagagcgttggtgagggtgtgacagacctcaaacctggtgaccatgctcttcctgtcttcactggggagtgcaaggagtgtcggcattgcaagtcagaggagagcaacatgtgtgatctcctgaggataaacactgaccgaggcgtgatgctcaatgacggcaagtcgagattttctattaatggacagcccatttaccattttgttgggacttctacctttagtgaatacactgtgctacatgttggtagtgttgccaaaattaatcctgctgctcctctggacaaagtttgtgttctcagctgtggaatctcaacaggccttggtgctaccttgaatgttgcaaaacccaaaaaaggatcgacagtggctgtttttggactcggggctgttggactagctgctgctgaaggggctagaattgcgggtgcttcaaggattatcggtgttgatctgaatgcaaagagatttgatgaagccaagaaatttggtgtcaccgagtttgtgaacccaaaagaccatgacaagcctgttcatgaggtgcttgctgaaatgaccaatggtggagttgatcgaagtatcgagtgcactggaagtatcaatgccatgatttctgcatttgaatgtgttcatgatggatggggtgttgctgtactcgttggtgtcccaaacaaagatgatgcatttaaaacccacccaatgaatatcttgaatgagaggactatcaagggtaccttctttggcaactacaaaccacggtctgacttgccttcggtggttgaaaagtacatgaataaggagcttgaggtagagaagttcatcacccatgaagtctctttctcggaaatcaacaaggcctttgagtacatgcttagaggtgaaggccttagatgcattatccgcatggatgcatagagcaggattgaaatgatgattatttctgagtgtaattgaagaaaatgaacttttactcacaaatgaaattagcttctggtaggatagtttggagcgaagtcttgtgtctcgctttagtgtgctgtaaaagaattgaaatttctattttccagatcatttaaatcaaaatactcggtgtgt

SEQ ID NO: 2777 - DNA, 1412 bp, Populus trichocarpa
gcaaactactcaaagaagcctcaaagaaaaagctgttaaagttcgtttaagacaagaaagaatatgtcaagcactgctggtcaagtcatacgttgcaaagctgctgtggcatgggaagctggaaagccactggtgatggaggaagtggaggtggctccacctcaagccatggaggttcgtttgaagatcctcttcacttccctctgccacaccgatgtatacttctgggaagccaagggtcaaaccccattgtttcctcgcatctttgggcatgaagcaggagggatcgttgagagtgttggggagggcgtgacagacctcaaacccggtgaccatgtgcttccagtcttcacaggagagtgtaaggaatgccgacattgcaaatcagaagagagtaatatgtgcgatcttctcaggattaacactgacaggggtgtgatgctgaatgatggcaagtcaaggttttcgatcagagggcagcccatttaccattttgttggcacctcaacctttagcgagtacactgtggttcatgttggctgtgttgccaagatcaatcctgctgctcctctcgacaaagtttgtgttctcagctgtggaatctctacaggtcttggtgccaccttgaatgttgcaaaaccaaagaaaggctcttcgatagccattttcggactgggagctgtaggcctcgcggctgctgaaggggctcggattgctggtgcttcaagaatcattggtgtcgatttgaattccaatagattcgatgaagccaagaagtttggtgtcactgagtttgtgaacccaaaagatcataacaagcctgttcaagaggtgatagctgaaatgaccaatggaggagttgatcgaagtgtcgagtgtactggaagcatcaatgccatgatttctgcatttgaatgcgtccatgatggatggggtgttgctgtactcgttggtgtgccgaacaaagatgattctttcaaaacccatccgatgaatgtcctgaacgagaggactctcaaggggaccttcttcggcaactacaaaccgcgctccgaccttccttcagttgtcgagaagtacatgaacaaggagctggagctagagaaattcatcacccatgaagtccctttctcagaaatcaacaaggctttcgagtacatgcttagtggagctggcctgaggtgtattatccgtatgggtgcataaaagaagactggtttggtttgccttggtgtgacaggaagcaataaaattcttgtttgagattgttgattaaagaaagtttctgtgtttgagtgtcagagttcttgataatacagtgtgtaatttctttcattgtagatggaaaaaaaaatattaaagcccatttctggtatgtatatgtaaatcaaaatttgacttgtactttttca

SEQ ID NO: 2778 - DNA, 1253 bp, Quercus alba
attcaagcaatctctagttcaaacatcaaagtcaagaaagagtgaagaaaattcaaaaacatgtcttcaaccactgccgctcaagtcatacgttgcaaagctgctgtagcatgggaagctggaaagccactagtgatagaagaagtggaagtcggcaccaccacaggccatggaggttcgtctcaagatcctcttcacctccctctgccacactgatgtttacttctgggaagcaaagggacagactccattgtttcctcgcatatttggtcatgaagctggcgggattgttgagagcattggtgagggtgtgacggacctcaaacctggtgaccatgtgcttcctgtcttcaccggagagtgcaaggagtgtcggcactgcaaatcagaggagagtaacatgtgtgacctcctgaggataaacactgaccgaggcgtgatgctcaatgatggcaagtcgagattttcaattaatggacaacccatttaccattttgttgggacttccacctttagtgaatacactgtggtacatgttggttgtgttgccaaaattaatcctgctgctcctctagacaaagtttgtgttctcagctgtggaatctcaacgggtcttggtgctaccttgaatgttgcaaaaccaaaaaaagggtcaacagtagcaatttttggattgggggcagttggtctagctgctgctgaaggggctagaattgctggtgcttcaaggattattggggttgatctgaatgctaagcgttttgatgaagccaagaaattcggtgtcactgagtttgttaacccaaaagaccatgacaatcctgttcaagaggtgattgctgaaatgactggtgggggagttgaccgaagtgttgagtgtactggaagtatcaatgctatgatttctgcattcgaatgtgttcatgatggatggggtgttgcagtacttgttggcgtcccgaacaaagatgatgcattcaaaactcatccaatgaatatcttaaatgagaagactctcaagggtacgttttttggcaattacaaaccacgatcggacctaccttctgtggttgaaaggtacatgaacaaggagcttgagctggagaagttcattacccatgaagtcccattctcagagatcaacaaggcctttgagtatatgcttaaaggtgatggtctccggtgtatcatccgcatggatgcatagaatagaattgagatgataagtacttagtgtaactaaaaaaaataac

SEQ ID NO: 2779 - DNA, 1381 bp, Momordica charantia
tcgatcgtcaacacaaaaatccaatcaattttcatattcatctaaattcttacaaatctttgatcttctgattaacccatgtcgactgctggtcaagtcatcaaatgcaaagctgctgtagcgtgggaagctggaaagccacttgtgattgaggaagtggaagtggcaccaccacaggctaatgaagtccgtgtcaagatcctcttcactgctctctgccacactgatgtttacttttgggaggccaagggccaaacgcctctgtttcctcgcatatttgggcatgaagctggaggagttgtggagagtgtgggggagggagtgacggatctgcagccaggagaccatgttcttccggtgttcactggggaatgcggggattgtcgccattgtcagtcggaggagagcaatatgtgtgatcttctccggatcaacaccgaccgcggtgtcatgatcaatgacggcaagacgaggttctctattaacggacagcccatccatcactttgtaggaacctccacgtttagcgaatacactgtcgtccatgttggatgtctagccaagatcaacccggctgcccctctagacaaagtttgtgttcttagctgcggaatatccacaggccttggagctactttgaatgtggcaaagccaaagaagggttcatctgttgcaatctttggacttggagctgttggcctcgctgctgctgaaggagcaagaatttccggggcatccagaatcattggtgttgatctcaacccaagtcgatttgaagaagcaaagaaatttggctgcaacgagttcgtgaatccaaaggatcataacaaacctgttcaagaggtgattgcagagatgaccgatggaggagtcgatcggagcgtcgaatgcactggaagtatccaggccatgatctctgcattcgaatgtgtccatgatgggtggggtgttgctgtgctcgtcggagtgccaaacaaggacgacgcattcaaaactcatccgatgaatctcctgaacgagaggactctcaagggcaccttctttggaaactacaagccccgaaccgacattcccggggtggtcgagaagtacttgaacaaggagctggaactggagaagttcattacacattctgtgccgttttctgagatcaacaaggcgtttgaatacatgctgaagggagagtccattcgctgcattataaagatgggagattgatttgttgagggaagaatcattgttattgtgattgtttttaagtgttgtgtgagaactctgaatcttcggtttttcgtttgttgaaggggaaattaagatgcgttgatgtgcaggttgatcgttacagttatgcatttcttctcaataaattataacatcactt

SEQ ID NO: 2780 - DNA, 1186 bp, Triticum aestivum
aagatccatctttctctctgagtttccggagcgaccgggggagttgatggcgaccgccgggaaggtgatcaagtgcaaagcggcagtggcatgggaggccgggaagccgctgtcgatcgaggaggtggaggtggcgccgccgcaggccatggaggtgcgtgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgtgccaggtgaccatgttctgccggtgttcactggcgagtgcaaggattgtgctcactgcaagtcagaggagagcaacctttgtgacctcctcaggatcaatgtcgaccggggcgtgatgatcggcgatgggcagtcccgtttcaccatcggtgggaaacctatattccacttcgtcgggacctctaccttcagcgagtataccgtgatccatgtcggttgcctcgccaagatcaaccccgaggcgcccctcgacaaagtttgtgttctcagctgtggcatctcaactggacttggcgccacgctcaatgtcgcaaaaccaaaaaagggttccacggtggcgattttcggtcttggagctgtaggacttgctgccatggaaggggccaggatggctggggcatcaaggatcattggtgtggatttgaaccctgcaaaatacgaacaagctaagaaatttggatgcacagactttgtgaacccaaaggaccacagtaagcccgtgcaagaggtgcttgtcgagatgaccaatggcggagtcgaccgggcggttgagtgcactggccacatcgatgccatgattgccgcctccgaatgtgtccatgatgggtggggcgtggctgtgctggtgggcgtgccgcacaaggaggcggtgttcaagacctacccaatgaacttcctcaacgagaggaccctcaaaggcaccttcttcggcaactacaagccgcgcaccgacctcccggaagtcgtggagatgtacatgaggaaggagctggagctggagaagttcatcacgcatagcgtgcccttctcgcagatcaacacggcattcgacctcatgctcaagggggagggcctgcgctgcatcatgaggatggaccagtag

SEQ ID NO: 2781 - DNA, 1554 bp, Malus domestica
aaagcaccgtcttttgaacatcatcaattatactacttatagcaaaaatacatcaaacatcacaagaaaaagaagctcatcctctataatgtctacagctggtcaggttatcaaatgcaaagccgcggtggcatgggaagcggggaagccactgtcaattgaggaagtggaggtggcaccaccgcagaaacatgaagttcgcttgaagatcctcttcacctctctttgccacaccgatgtctacttctgggaagccaaaggacaacaaccgctgtttcctcgcatttttggtcatgaagctggaggagttgtggaaagcgtaggtgagggcgtaaccgaactccagccgggtgaccatgtcctccctgtgttcactggggagtgcagggagtgcgcgcactgtaagtcggaggaaagcaacatgtgtgatctgctgaggatcaatactgataggggtaccatgatcaatgatggccagtccaggttctccaaggatggaaaaccaatttatcactttgtaggtacttctaccttcagtgaatacaccgtttgtcacgttggctcagttgctaagatcaacccggctgctccccttgacaaagtttgtgttcttagttgcggaatatgcacaggttttggtgccactgtgaatgttgcaaaaccgaaaaagggttcatctattgccatctttggattgggagctgttggtcttgctgctgctgaaggtgcaagggtttctggctgttcaaggatcatcggtgttgatttgaatcccagtcgctttgaggaagccaagaagtttggggtgaatgaattcgtgaatccgaaagatcataacaaacctgtgcaagaggtgattgctgagatgaccaacggcggagttgataggagtgttgagtgcaccggaagcatccaggctatgatctctgcatttgaatgtgttcatgatggttggggtctcgctgtacttgttggtgtgccaaacaaagatgatgcattcaaaacccatccaatgaatttcttgaacgagaggactcttaagggtaccttctatggtaactacaagccccgcaccgatctaccaggtgttgtggagaagtacatgaacaaggagctggaagtggagaaattcatcactcattcggtcccattcgctgagatcaacaaagcgttcgacttgatgctttctggacagtccattaggtgcatcatctgcatggagaattagaggaaaaaaactagttttgttatgcaaaactagtttggttatggatcatcaaagcaaagcaatacagtccattaggtccatttggtggatcatctgcctgcagaatggagggaatttatatatctatctgatgtctatttgaataagttttgttatggatttgagggtttttgcaaatttggaaaggagaatcaacttacggtaatgctgtgcgtttaaattaaattgcttctgctgtgttgtaagaattactagttgtgagatagtttggtaaacaatatttttaaaagcacttttaatgtaaaaactgtgtctcagtgtggtaa

SEQ ID NO: 2782 - DNA, 1552 bp, Malus domestica
aaagcaccgtcttttgaacatcatcaattatactacttatagcaaaaatacatcaaacatcaaaagaaaaaagaagctcatcctctataatgtctacagctggtcaggttatcaaatgcaaagccgcggtggcatgggaagcggggaagccactgtcaattgaggaagtggaggtggcaccaccgcagaaacatgaagttcgcttgaagatcctcttcacctctctttgccacaccgatgtctacttctgggaagccaaaggacaacaaccgctgtttcctcgcatttttggtcatgaagctggaggagttgtggaaagcgtaggtgagggcgtaaccgaactccagccgggtgaccatgtcctccctgtgttcactggggagtgcagggagtgcgcgcactgtaagtcggaggaaagcaacatgtgtgatctgctgaggatcaatactgataggggtaccatgatcaatgatggccagtccaggttctccaaggatggaaaaccaatttatcactttgtaggtacttctaccttcagtgaatacaccgtttgtcacgttggctcagttgctaagatcaacccggctgctccccttgacaaagtttgtgttcttagttgcggaatatgcacaggttttggtgccactgtgaatgttgcaaaaccgaaaaagggttcatctattgccatctttggattgggagctgttggtcttgctgctgctgaaggtgcaagggtttcgggctgttcaaggatcatcggtgttgatttgaatcccagtcgctttgaggaagccaagaagtttggggtgaatgaattcgtgaatccgaaagatcataacaaacctgtgcaagaggtgattgctgagatgaccaacggcggagttgataggagtgttgagtgcaccggaagcatccaggctatgatctctgcgtttgaatgtgttcatgatggttggggtctcgctgtacttgttggtgtgccaaacaaagatgatgcattcaaaacccatccaatgaatttcttgaacgagaggactcttaagggtaccttctatggtaactacaagccccgcaccgatctaccaggtgttgtggagaagtacatgaacaaggagctggaagtggagaaattcatcactcattcggtcccattcgctgagatcaacaaagcgttcgacttgatgctttctggacagtccattaggtgcatcatctgcatggagaattagagaaaaaaaactagttttgttatgcaaaactagtttggttatggatcatcaaagcaaagcaatacagtccattaggtccattaggtggatcatctgcctgcagaatggagggaatttatatatctatctgatgtctattcgaataagttttgttatggatttgagggtttttgcaaatttggaaaggagaatcaacttacggtaatgctgtgcgtttaaaaataaattgcttctgctgtattgtaagaattattagttgtgagatagtttggtaaacaatatttttaaaagcacttttaatgtaaaaactgtctcagtgtggt

SEQ ID NO: 2783 - DNA, 1559 bp, Cucumis melo
acctataaatactctcactcacttcttccttcatcatcatcatcgtcatttctctttctaacccaaatcaaattttgtttctctctctctctctctctcttcaaatccctttcaccataacccacaactatgtccactgccggtcaggtcatcaaatgcaaagctgctgtggcttgggaggccggaaagccacttgtcattgaagaagttgaagtggcaccaccgcaagctaatgaagtccgattgaagatccttttcacttctctctgtcataccgatgtttatttctgggaagccaagggacaaaccccattgtttcctcgtatttttggacatgaggctggaggaattgttgagagtgttggagaaggagtgaaagatcttcaaccaggagatcatgttcttcctattttcactggtgaatgtggggattgtagtcattgtcaatctgaagaaagcaatatgtgtgatcttcttcgaatcaataccgatcgtggagttatgatcaatgatggcaaaactagattctccaaaaatggacaacccattcatcattttgttggaacctccacttttagtgaatacactgttgttcatgttggttgcttggctaagatcaaccctgctgcccctcttgacaaagtttgtgttcttagctgcggcatttccacaggccttggtgccactttgaatgttgcaaagcctaaaaagggtcaatctgttgcgatcttcggacttggagctgttggacttgctgctgctgaaggagcaagaattgctggtgcatctaggatcattggtgttgatctgaacccggctcgattcgaagaagcaaagaaatttggttgcaacgaatttgtgaatccaaaggatcacaacaagccagttcaagaggtgattgctgagatgacgaacggaggagttgaccgaagcgtcgagtgtacgggaagcatccaagcaatgatcgcagcatttgaatgcgttcacgatgggtggggtgttgctgttcttgtgggagtcccaaacaaagacgatgcattcaaaactcatcctatgaatttccttaacgaaagaactctaaagggtacattcttcggcaactacaaaccccgaaccgacattccgggggtggtcgagaagtacttgaacaaggagctggaattggagaagttcattacacatacagtgtcattttctgagatcaacaaggcgtttgattacatgctgaaaggggagtcgattcgatgcattattagaatggataattgaaataataactgtgggatgagatgaaaataagggaataagattatgtggtgattgaaagaggctggagagttctggttttccttatttctttctaagtttgtgtttaatgttttctgagagtggaatgttcgcgatagtgttatcgcctttttgtcaatttcatccaactcttgaaatattgtagtcatattataatcgaaaagaaaaaataaaatacacttttgctttctttctgtcaaaaaaaaaactgagacacgcaacaggggtaggcaaggcacacaggggatagg

SEQ ID NO: 2784 - DNA, 1273 bp, Persea americana
aagagagcagaagaagaagaagaagaacagagatgtcgagctcaacagctggtcaggttatacgatgcaaagccgcggttgcatgggaagcaggaaagccgttggtgatcgaggaggtagaggtggcgccacctcaagtgatggaggttcgattgaagatcctctttacctctctctgccacactgacgtctacttctgggaagcaaaggggcaaactcccgtcttccctcgaatctttggacatgaagcaggggggattgttgagagtgtgggagagggtgtaacagaactaaaaccaggggaccatgtcctccctgtattcacaggggaatgcaaggaatgtgcccactgcaagtccgaggagagcaacatgtgtgacctcctcaggattaacacagatcgtgggcggttgatgatcagtgatgggcaatcaaggttctccatcaatggaaagcccatctaccattttgttggtagctccactttcagcgaatacactgttgtccatattggttgtcttgcaaaaatcaaccctttggctcctcttgataaagtctgtgttcttagctgtgggatctcaacaggtcttggtgccgctctgaatgttgcaaaaccaaagaagggttcaactgttgctgttttcgggcttggagcagtaggccttgctgctgctgaaggggcaaggatttcaggggcttcgaggatcattggcattgacttgaaccctagtagatttgatgaagccaagaagtttggtgtcaccgagtttgtaaacccaaaagaccatgaaaaaccagttcaagaggtgattgttgagatgactggtggaggagtagaccgtagcatcgaatgtactggaaacgtcaatgccatgatatcagcattcgaatgcgtccatgatggttggggtgttgctgtgctagtcggtgttcctcataaggatgccgtgttcaaaacccaccccatgaatttgctgaatgagaggactcttaagggaaccttctttggaaactacaagccacgctctgatctgccttctgttgttgaaaaatacatgaacaaggagcttgaattggagaaattcatcactcatgaagtccccttctctgagatcaacaaggcctttgagtacatgctcgacggggctggcctccgatgcataattcgtatggaaggatagaatgaactgaatttcacatgagaggatagaatggagtgagtttcatcctcctgatgtaggacatggaataaaaggatggaatgttgatgtta

SEQ ID NO: 2785 - DNA, 1431 bp, Quercus alba
ggccgcccgggcaggtacgcggggacaacaaattcaagcaatctgtgttcttcaaacatcaaagtcaaataacagttgacaaaaagccaaaaagatgtcttcttcaaacactgctggtcaagtcatacgttgcaaagctgctgtggcatgggaagccggaaagccactggtgatagaagaagtggaagtggcaccaccaaaggcgatggaggttcgtctcaagatcctcttcacctccctctgccacacagatgtttacttttgggaagccaagggacagaccccattgtttcctcgcatatttggtcatgaagctggcgggattgttgagagcgtcggtgagggtgtgacagacctcaaacctggtgaccatgtgcttcctgtcttcactggggaatgcaaggagtgtcggcattgcaagtcagaggagagcaacatgtgtgacctcctgaggataaacactgaccgaggcgtgatgctcaatgatggcaagtcgagattttctattaatggacaacccatttaccattttgttgggacttctacctttagtgaatacactgtggtacatgttggttgtgttgccaaaattaatccagctgctcctctggataaagtttgtgttctcagctgtggaatctcaacaggtcttggagctaccttgaatgttgcaaaaccaaaaaaagggtcaacagtagcaatttttggattgggggctgttggtctagctgctgctgaaggggctagaatcgctggtgcttcaaggattattggggttgatctgaatgctaagcgttttgatgaagccaagaaattcggtgtcactgagtttgtgaacccaaaagaccatgacaagcctgttcaagaggtgattgctgaaatgactggtgggggagttgaccgaagtgttgagtgtactggtagtatcaatgctatgatatctgcattcgaatgtgttcatgatggatggggtattgctgtacttgttggcgtcccaaacaaagatgatgcattcaaaacgcatccaatgaatatcttaaatgagaggactctgaagggtaccttttttggcaattacaaaccaagatctgacctaccttctgtggttgaaaggtacatgaacaaggagcttgagctggagaagttcattacgcatgaagtccctttctcagagatcaacaaggcctttgagttcatgctaaaaggtgatggtctccgatgtatcatccgcatggatgcatagaaaataattgagatgataagcacttttgagtgtatctaaaaaaaataaccttagtgcttcttgtaggaaaattggttaattcttatgtcctctcatttgctttttgtttaaaagaatcaaaatccccattaacttgtataataatgtaatttcacaattctgtaatgaatttcagcaaattttctgtt

SEQ ID NO: 2786 - DNA, 1789 bp, Eucalyptus grandis
acacgaaagagagcctcaggcgtggagggccacgtcctgcatccaatgaacgtcggagccgtccccgaaccaaaccggcaaccgcggaaagcgccgttggattccttccctagcctcgctgttcccctacccctccaggagcgagagttggtgggaaagccagaattccgtccaaagttttcgccagtccctggtttctctccgagcaagaacaagcaatttgaactcctcctctcctcgactcggcgagctgcgctttgtataaaagccaccgccgtgcccgacccacttcctcacatccgcactagaaccggttcttgagggcgaagagatcagtggaaacagagcagtttccggaattcgggtggtaggatatcgctgagttcgagatggcgagcaccgctggtcaggtcattcgctgcaaggctgcggtggcatgggaagctggaaagccgcttgtgatggaagaagtggaggtggctcctccgcaggcgatggaggttcgtatcaagatcctcttcacctccctttgccacactgacgttttcttctgggaagccaagggacaaaccccgttgtttcctcgcatctttggtcatgaagcatcagggattgtcgaaagtgtcggtgagggtgtcactgaacttgaacccggtgatcatgtccttcctgtattcaccggagaatgcaaggagtgccggcattgtaaatcagtggagagcaatatgtgtgacctgctcaggataaacacggatcgaggggttatgcttaatgataatgcgtcgaggttctccatcaatgggaagcccatttaccattttgttggcacttcgacttttagtgagtacaccgtggttcatgtcggttgtgtcgccaagatcaaccctgcagccccgctggacaaagtctgtgttctcagctgcggcatctctacaggtcttggtgccaccttgaatgtcgcgaagccgaagaaggggcaatcggtagccatttttggactcggagctgtgggccttgctgcagctgaaggggctcgaatggcaggggcttcaaggattattggagtggatctgaatccaaacagattcgccgaagccaagaaatttggagtcactgagtttgtgaatcccaaggaccacaacaaacctgttcaagaggtgattgctgaaatgactgacgggggtgttgatcgaagccttgagtgcactggaaatatcaacgccatgatctctgcatttgaatgtgttcatgatggatggggggttgctgttcttgtcggcgtccctagcaaagatgatgcattcaagacccatccgatgaatctcttgaacgagagaactctcaagggcactttctttggcaactacaagccaaggactgaccttccctctgttgtagagaagtacatgaataaggaacttgatgtggagaagttcattacgcatgaggttcctttctcggagatcaataaggcattcgactacatgcttcaaggcgctagccttcgctgtattatccgcatgggtgcctagaatcgctgacactgcagaccattttgcttcaaggggaagacaaactttgccgagcttttgaagttattgctgcgccgttgttatatgcccgtgtcttgaggcgtaagagtgatgaataaataacccctttgctgctgtaaatggtttgttagccattaatggatgttcatgttcgaattctcgtgataatgtcaactttaatttaagtaagatgatgagatgaaatcttgcattatcagctgctttgcttcataaaa

SEQ ID NO: 2787 - DNA, 1426 bp, Citrus sinensis
ttgaaggaaccgaaaacggtattctcgtgcgcacactgctttaaatagcgagcgaacccagattccttgttcaggctaaacactgctaattttacaggtgttgagagtatcatcattcatcatcaatatgtctggcacagctggtcaagttattcgctgcaaagcggcggtggcatgggaggcggggaagccactagtgattgaagaagtggaggtggctccaccacagaaaaatgaagttcgattgaagatcctcttcacctctttatgccatactgatgtttacttctgggaagccaagggacaaacacctctctttcctcgcatttttggtcatgaagctggagggattgtagaaagtgtaggggagggggtaactgatctccaaccaggagaccatgttcttcctgtattcacaggagagtgcaaggaatgtcctcactgtcattcagaggaaagcaatatgtgtgacctcctccggatcaatactgacaggggtgttatgattaatgatggtcagtcaaggttctcgattaaggggaagccaatttaccattttgtgggcacttctaccttcagtgaatacactgttacccacgtcggttgtgttgctaagatcaatcctgctgcccctcttgacaaagtttgtgtactcagctgcggaatctccacaggttttggggctactgttaatgttgccaaaccgaagaagggccagactgttgccatttttggattgggtgcagttggccttgctgctgccgaaggggcaagagtatcaggggcttccaggatcattggtgttgatttgaacccaagcagattcaatgaagccaagaagtttggggttaccgagtttgtgaatccaaaagattatgacaaacctgttcaacaggtgattgctgaaatgaccaatggtggagtggatagaagtgttgaatgtactggaagcgtccaggccatgatctcagcatttgaatgcgttcacgatggttggggtgttgctgtgcttgtgggcgttcctcacaaagatgctgtgttcaagacgcaccccatgaatttgttgaatgaaagaactcttaagggcaccttctttggaaactacaagcctcgttctgaccttccttcggttgtagaaaaatatatgagcaaggagcttgaagtggaaaaattcattacccatacagtcccattctccgaaatcaacaaggcctttgagtacatgcttagaggagaaggtctccgatgcatcatccggatggaagagtagtttgtgtagataaataattcaaagtggtcagtgtcattgtcatgttcaaaattttaatatttgcaaagatgtctttataagtattgttgttttgtggtcataatgtaaaacgttatttttctagtgcctttccgttgtatacttgtttgcgaattt

SEQ ID NO: 2788 - DNA, 1432 bp, Mimulus guttatus
agggtttaatcatctcatcaaacaattagataaaaatcaaatctttatactcttttttaatttaatctctactactactactacaagatgtcaagcactgctggcaaagtcatcaaatgcaaagctgctgtagcatgggaggcggggaagccgctggtgatagaggaggtggaggtggcgccgccgcagaagatggaggttcgcctgaaaatcctcttcacctccctttgccacactgatgtttacttttgggaagccaaggcccaagattccgtctttcctcgaattctcggtcacgaagcagcagggattgtggagagtgtaggagaaggtgtgacggaactcgttccgggcgatcacgtactccccgttttcaccggagaatgtggagactgtgctcactgcaaatcagaagagagtaatatgtgtactcttttgaggatcaatgtcgaaaggggagtgatgattaatgatgggaaatcgaggttttcgattaacgggaagccgatttatcactttgttggcacttcaacttttagcgaatacactgtggctcatgttggctgtgtagccaaaatcaacccccttgccccccttgacaaagtttgtgttctcagctgtggaatctccacagggcttggtgccacattgaatgttgcaaaaccgaaaaagggatcttctgttgcgattttcggacttggagctgttgggcttgctgctgcagaaggagcaagattggctggtgcttcaagaatcatcggtgtggatttgaactccggcagatttgaagaagctaaaaaattcggagtgactgaatttgtgaacccaaaagaccacgacgaacctgttcaaaatgtgatagctaagatgactgacggaggagtggatcgaagcgtggaatgtactggaaacatcggtgctatgatctctgcatttgaatgtgttcatgatgggtggggtgtggctgttcttgtgggggtcccacataaagacgcggtattcaagactcatccgatgaacgtgctgaacgagaggactctaaagggcactttcttcggtaactataagccccgttcggatcttccagcagttgtggaaatgtatatgaacaaggagttggaagtgggcaagtttataacgcacgaggtgccgtttgcggagataaacaaggctttcgagctgatgctgaaaggcgaaggccttcgttgcattatcaggatggagtaaaaaaaagatctcaaggatgatagacacatatctacccacgttattgttttaagaaatgtgttcttattgtgtgtgtgtttttttcgatatgttttctgcatttgtttttcacctagacatgtgtttctgcatttgtttttcagcttgtattacagtttgacatcccaagtttaataaaagaatgtgtgttttgtttgttaacttt

SEQ ID NO: 2789 - DNA, 1140 bp, Salvia sclarea
atgtcggccactgcgggtcaagtcatcaagtgtaaagctgctgttgcatgggaggccggaaagcctctggtgattgaagaggtggaggtggcgccgccgcagaaaatggaagtccggattaagattctctacacctcactttgccacaccgatgtctacttctgggaagccaaggctcaagattcagtctttccccgcattctgggacatgaagcagcagggattgtggagagcgtgggagagggcgtgacggaggtggcggcgggcgatcacgtgctccccgtgttcaccggagaatgcggcgaatgtgctcactgcaaatccacggagagcaacatgtgcagcctcctgaggatcaacacagagaggggagtgatgatcggtgatcagaaatcaagattctccatcaatgggaagcctatttaccattttcttggcacatccacatttagtgagtacactgtgcttcacgttggctgcgtcgccaagatcaaccctctcgcccctctcgacaaagtttgtgttctcagctgcggaatctccgcaggccttggtgctacgttgaatgttgccaaaccatttaagggctcctccgttgctgtttttggactcggagcagttggacttggtgctgcagaaggagcaagactggctggtgcttcgagagtgattggtgtggacttgaacactgctaggtttgaagaagcaaaaaaatttggtgtgactgagtttgtgaacccaaaagactacagcaagccagtccaagaggtaatagctgagatgactgatggaggggtggatcggagcgttgagtgcaccggaaacatcaacgccatgatctcagcgtttgaatgtgttcatgatggatggggagtggctgttcttgttggcgtgcctcacaaggacgctgtgttcaagactcatccggtcaacttcttgaacgagaggactcttaaaggaaccttcttcggcaactacaaacctcgctctggtcttccatcagttgtcgagatgtacatgaacaaggaactggaagtggagaagttcataacacacacggtgccgtttgcagagatcaacaaggcgtttgagctgatgctcaaaggggaggggcttcgttgtgttattcgaatggagtga

SEQ ID NO: 2790 - DNA, 1482 bp, Nicotiana tabacum
  misc_feature (1454)..(1454): n is a, c, g, or t
cggggagcctcagatatttaactcagtattcagaaacaacaaaagttcttctctacataaaattttcctattttagtgatcagtgaaggaaatcaagaaaaataaatgtcaagcactgtcgggcaagtcattcgttgcaaagctgctgtggcatgggaggcagggaagccattagtgatggaagaagtggaggtggcacctccacaaaaaatggaagttcgtcttaagatcctctacacttctctctgccatactgatgtctacttctgggaagcaaagggccaaaatccagtctttcctcgaattcttggacatgaagcagcagggattgtggagagtgttggagagggagtaacagaacttgcaccaggagaccatgttttgcctgtgttcacaggggaatgtaaagattgtgctcactgcaaatcggaagaaagcaatatgtgtagcctcttaaggattaacactgataggggagtaatgattcaagatggacaatcaagattttccataaatggaaagcctatttaccattttgttgggacttctacctttagtgagtacactgtggttcatgttggttgtgttgctaaaatcaacccccttgctcctcttgacaaagtttgtgtcctcagttgtggaatctctacaggtcttggtgcaactttgaatgtggctaaaccaacaaaaggatcaagtgtggctatatttggactgggggctgtaggccttgctgctgcagaaggagcaagaattgctggtgcttcaaggataattggtgttgatttaaatgctagcagatttgagttagctaagaaatttggtgtgacagagtttgtgaatcctaaggatcataataaaccaattcaagaggtaattgctgagatgactgatggcggagtagacaggagtgtggaatgtacaggccacattgatgctatgatttcagcatttgaatgtgtccatgatggttggggagtggctgttcttgttggagtaccacataaagaagctgtattcaagacacaccctatgaagttgttgaatgaaaggactctcaaggggacattctttggaaactacaagccccgttctgatcttccttctgtcgtcgagaaatacatgaacaaggaacttgaattggagaagttcatcactcacaaactcccatttgctgaaatcaacaaggcatttgatttaatgttgaagggagaaggccttcgttgcatcatcaacatggaggactaattgctataccaactatatattctactcgctactctttgagaaaagaccaataaattgtcattgtcttattttaaatttgttcgtttggtgattgagttgtaatattctggtccaactccatccatgtctcttcttgcttttttcgctaataggtatgctttgtccttcataatgccatatctatctgttaaaatgtaatcttgttntaaacaaaaaaacaaaaaaaaacacggg

SEQ ID NO: 2791 - DNA, 1404 bp, Catharanthus roseus
  misc_feature (448)..(448): n is a, c, g, or t
cattaatatatacacatctcagtttactttcctttctaattagcctcaaatttctaaacagttcttgaagcagaagaaaaagaaatggcaagtactgctggccaagtcatccgttgcaaagctgctgttgcatgggagcccgggaagccattagtgatggaggaagtagaggtggcgcctccccagaaaatggaggttcgccttaagatcctattcacctccctctgccatactgatgtctacttttggtaagccaagggccagaatcccgtctttcctcgaattctcggtcatgaggctgcagggattgtggagggtgttggtgaaggtgtgacagagttgaagccaggggatcatgttctgccagtcttcactggggaatgcaaagactgtgctcattgtaaatctgaagagagtaatatgtgtgaccttctgaggattaacacanacagaggggtaatgattcaagatgggaaatcacgattttcaattaaaggcaaaccgatctaccattttgttgggacttcaacatttagtgagtatactgttgttcatgttgggtgtgttgccaaaatcaatccacttgctcctcttgacaaagtttgtgttcttagttgtggaatctccacaggccttggtgctactcttaatgttgctaaaccaacaaagggctcttcagtggctgtttttggattgggagctgtaggccttgctgctgcagaaggagccagaattgctggtgcttcaaggattataggtgttgacctcaatcctgctaggtttgaagaagcaaagaagtttggagtgacagaatttgtaaacccaaaggactatgataagcctgttcaagaggtgattgctgaaatgactggtggaggagttgatagaagtgtagaatgcactggaaacaccaatgccatgatctctgcctttgaatgtgtccatgatgggtggggagttgctgttcttgttggggttccacacaaagatgctgaattcaagacacatcctatgaacttcttgaatgagaggacactcaaggggaccttctttggaaactataaacctcgctctgatcttccatctgttgttgaaaaatatatgacaggggagctggaattggagaagtttatcactcatgaagtgaccttttctgagattaacaaggcctttgaatacatgctgaatggagaaggcctccgctgcctcatccgaatggagacttgaatcaaatgaagccatgaatgtcctgaatataaagctgctgcgtttatgcgttcttttacatatgataataaatatatgtctagtgttcgtatgcgttctatgtttccttctttttcttgatgtttgaaggtgtctttgaacttacccttttgataataaacaactctgtttgatcct

SEQ ID NO: 2792 - DNA, 1334 bp, Triticum aestivum
aacgaactgcagagcagaaacagcgacagagatccgtcttcttcctcttcgagttcttggagcttgcgaccgacagggacggggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgttaccgaactcgtgccgggtgaccatgtcctcccggtgttcactggcgagtgcaaggactgtgcccactgcaagtcagaggagagcaacctctgtgacctcctcaggatcaacgtggatcgtggcgtgatgatcggtgatggggagtctcgcttcaccatcaatgggaaaccgatcttccacttcgtcgggacctccaccttcagcgagtacaccgtgatccatgtcgggtgcctcgccaagatcaacccagaggcgccccttgacaaagtttgtgttctcagctgtggtatctcaactggacttggtgctaccctcaatgttgcgaaaccgaaaaagggttcgacggtggccattttcggtcttggagctgtaggccttgctgccatggaaggggccaagatgtctggggcatcaaggatcattggtgtggatttgaaccctgcaaaatacgaacaagccaagaaatttggatgcactgactttgtgaacccaaaggaccacaccaagcccgtgcaagaggtgcttgtcgagatgaccaatggtggagtcgaccgcgcagttgagtgcactggccacatcgacgccatgatcgccgccttcgaatgtgtccatgatgggtggggcgtggcggtgctggtgggcgtcccgcacaaggaggcggtgttcaagacaagcccgatgaacttgctcaacgagaggaccctgaagggcaccttcttcggcaactacaagccgcggaccgacctcccggaagtcgtggagatgtacatgaggaaggagctggacgtggagaagttcatcacccacagcgtgcccttctcgcagatcaacacggcgttcgacctcatgctcaagggggagggcctgcgttgcgtcatgaggatggacgagtagatggtctcttattcatcgtgtgtctctttgttttagtgttcacggtttggtctttggtttcattgcgtctgtcggcagctttcagttagcatgtaaattactattaataa

SEQ ID NO: 2793 - DNA, 1485 bp, Brachypodium distachyon
accaaatatctcatcatcaaacctacaaatgccaagaagaaacagcatcagataccaacttttctccttgagttcttgccttcttggtgctagcaaccaacatcaataaatggcgactaccgggaatgtgatcaagtgcaaagcggcggtggcatgggaggccgggaagccgctgtcgatggaggaggtggaggtggcgccgccacaggccatggaggtgcgcgtcaagatcctcttcaccgccctctgccacactgacgtctacttctgggaagccaaggggcaaactccggttttccctaggatcttaggccatgaagctgggggcattgttgaaagtgtcggagaaggcgtgaccgagctcgtgccgggtgaccatgtccttccggtgttcaccggtgagtgtaaggagtgtgctcactgcaagtcagaggagagcaacctgtgtgacctcctcaggatcaacgttgaccgaggcgtgatgatcggcgatggtcagtcccgcttcaccattgacgggaaaccaattttccactttgtcggcacatcaaccttcagcgagtacaccgtgatccatgtcgggtgcctagcgaagatcaaccctgaggcgcccctcgacaaagtttgtgttcttagctgcggtatttcaactggtcttggtgccacactcaatgtggcgaaaccgaaaaaggattcaactgtggcgattttcggtcttggggctgtaggcctttctgccatggaaggggccaggatggctggggcatcaaggatcattggtgtggacatgaaccctgctaaatttgaacaagctaagaaatttgggtgcactgactttgtgaaccccagggaccacaccaagccagtgcaagaggtgcttgtggagatgaccaacggaggcgtggaccgggccgtcgagtgcactggcaacgtcaacgccatgatctccgccttcgaatgcgtccatgatggttggggcgtggcagtgctggtgggagtcccccacaaggaggccgtgttcaagacccacccaatgaacttcctcaacgagaagaccctgaaaggaaccttcttcggcaactacaagccgcgcaccgacctgccagaagtcgtcgagatgtacatgaggaaggagctggagctggagaagttcatcacccacagcgtgccattctcgcagatcaacacggcgttcgacctcatgctcaagggggagggcctgcgctgcgtcatgcggatggaggagtagatcagcagcctgccgctgcttaaaatttgtgcataagaaggacatgaaaaagaagagtttccaatgtttccttagtaataatgatgtactatcggtcgtcgcatttgtttggacttttagtttcttgtcagtgtgcttcatcagcaattaagcttccgtttagcgtgtaaattgacattttctgaacaaaagtagtgataataatactttgcattttctgtgataatattccatgt

SEQ ID NO: 2794 - DNA, 1537 bp, Cichorium intybus
gcaaacccggtggccggtttctagttttggtattagcatcctgtttaatagattctaccaactcaattcagaaccatctagggttcattagattaatgcacttactcgatcggtcgatcctataaatacctagctcttcagataactgtttcgtatcaagcaattgacaaaagcaatcaaagttgttttcagattcactgtttcagcgatcaggtaacaaagaaagaaaaatggcgagcactactgaccaggtgattcgatgcaaagccgccgtggcgtgggaagccggaaagccactggtgattgaagaagtggaggtggcgccaccccagaaaatggaagttcgaatcaagatcctcttcacctccttgtgccacaccgatgtgtacttctgggaagcaaagggtcagaatcctgtgtttccccgaattttagggcatgaagctggaggtgttgtcgagagtgttggggaaggagtgactgatcttcaaccaggggatcatgttctccctgttttcaccggagaatgcaaagaatgcgctcactgtaaatcggaagagagcaacatgtgcgacctactgaggatcaacaccgatagaggagtcatgcttcacgatcaaaaatctcgattctccatcaacggaaaacccattttccattttgtcggaacttcaactttcagtgaatacaccgtcgttcatgttggttgtcttgccaaaatcaaccctcttgctcctctcgacaaagtttgcgtcctcagttgtggtatctcaacaggccttggtgctactttgaacgttgctaaacccaaaaaaggctcatctgttgccattttcggattgggagctgtggggcttgctgctgctgaaggtgcaagaatttctggtgcttcaaggatcattggtgttgatcttaatgctaacagatttgagcttgcaaagaaatttggggtgactgagtttgtgaatccgaaagactgcaagaaaccagtacaagaagtgattgcagagatgacaaatggaggagttgacaggagtgttgaatgcacgggtcatatcgatgctatgatctccgcctttgaatgtgttcatgatggttggggtgttgcggttcttgtgggtgttccacataaagatgctgtttttaagacaagtccattgaatctattgaatgaaaggactctgaagggaaccttttttggaaactataaacctcgatctgatattccttctgtggtcgagaagtatatgaataaggaacttgagttggagaagttcataacacatgaagtgccattttctgagataaataaggcgtttgatttgatgcttaaaggtgaaggtcttcgatgtatcattcggatgggtgcttagaaaagattttcaaaatgttgtatagtatgcaagagagtgggagttttcattcttggttaaaatcctgttatttttatttgcatttaaattggaataattatgcttgcctttttgtttcttgtgcacttgtggtaattcttatggagaggctatttgctatttat

SEQ ID NO: 2795 - DNA, 1598 bp, Taraxacum officinale
agtagcacaactattgtttttaaaccaaaaccgccaattagtggctgctttgcggtttcttgttttccttaaacggtgggttcatctttgtcaacggaaaaccaagcaaatcaaaaccaggtggccggtatttagctccggtttagcctcctgtattctacttgattctactaacactcactccatcctataaataccaattcttcagatttcaacttcatataaactcatcaagcaatcaacaaaaccaattaaagttgttttcagaattcagatactctgtttcagcgatcaagtaacaagaagataaaaaatgtctaccactactgacaaggtgattcgatgcaaagccgcggtggcttgggaagccggaaagcctctggtgatcgaagaagtggaggtggcgccacctcagaaaatggaagttcgaatcaaaatcctcttcacctctctctgccacaccgatgtttacttctgggaagcgaaaggccagaatcctgtatttcctcgaattttggggcatgaagctggaggggttgtggagagtgtaggggaaggggtgacggatcttcaaccaggcgatcacgttcttcctgttttcaccggcgaatgcaaagaatgcgcgcactgtaaatccgaagagagcaacatgtgcgacctccttcgaatcaacaccgatagaggcgtcatgattcatgatcaaacatctcgcttctccatcaacggcaaacccatatttcatttcgtcggaacttcaactttcagtgagtacaccgtcgttcacgtcggctgtctcgccaaaatcaaccctcttgctcctctcgacaaagtttgcatcctcagctgcgggatctccacaggtctcggtgctactctgaacgttgcaaaacctaaaaaaggctcatctgtcgccattttcggactaggagccgtcgggcttgcggctgctgaaggtgcaagaatggcaggggcttcaaggatcatcggtgtcgatctcaacgccaacagattcgagcttgcaaggaaatttggggtgactgaatttgtgaacccgaaagactacgagaaaccagttcaagaagttattgcagagatgactaatggcggtgttgaccggagtgttgaatgcactggtcatattgatgccatgatctccgccttcgaatgtgttcacgatgggtggggtgtagctgttcttgtgggtgttccacataaagatgctgttttcaagacaagtccaatgaatttattgaacgaaaggactctaaagggtactttttttggaaactataaacctcgatcggatattccttctgtggttgaaaagtatatgaataaggaacttgagttggagaagtttataacacatgaagtgccgttttctgagataaataaggcgtttgatttgatgcttaaaggtgaaggtctacggtgcataattcggatggatgcgtgaatggaagggaaaggtttttaaaatgttgtgtagttaataatatatgaagtgtcttcttgatctttattatgtatggagtctatggatgtttctgtgttgaaatcatgagtttgtatgttccaatgattataatgttttgcac

SEQ ID NO: 2796 - DNA, 1601 bp, Lactuca sativa
gatcaatatactctccccatcctataaatacccaattcttcattactccttcatatcaagcagttaacaaacccaattgaagttgttttcatattctctgtttcaacgatcaagtaactagaagataaaaatgccaagcactactaaccaggtgattcgatgcaaagcggcggtggcatgggaagccggaaagccactggtgattgaagaagtggaggtggcgccaccccagaaaatggaagttcgaatcaaaatcctcttcacctccctgtgccacaccgatgtttacttctgggaagccaagggtcagaatcccgtgtttcctcgaattttaggacatgaagctggaggggttgtggagagtgttggggaaggtgtgactgatcttcagcccggagatcatgtcctccctgttttcaccggagaatgcaaagagtgcgcccactgtaaatcagaagagagcaacatgtgcgaccttttgagaatcaacaccgatagaggagtcatgattaacgatcaaaaatctcgattttccatcaacggaaaaccaattttccatttcgtcggaacttcaactttcagtgaatacaccgtcgttcatgttggctgtctcgccaaaatcaaccctcttgctcctcttgacaaagtctgcgtcctcagctgtgggatctccacaggtcttggtgctactctgaacgttgcaaaacctaaaaaaggctcatctgtcgccatttttggattgggagctgtggggcttgctgctgctgaaggtgcaagaattgcaggggcttcaaggatcattggcgttgatctcaatgccaacagatttgagcttgcaaagaaatttggagtgactgagtttgtgaaccctaaagatcacacgaaaccagtacaagaagtgattgcagagatgacaaatggaggagttgacaggagtgttgaatgcactggtcatattgatgctatgatatctgctttcgaatgtgttcatgatggttggggtgttgctgttcttgtgggtgttccacataaagatgctgttttcaagacaagtccattgaatctgttgaacgaaaggactctgaagggaactttttttggaaactataaacctcgatcagatattccttctgtggttgaaaagtatatgaataaggaacttgagttggagaagttcattacacatgaattgccattttctgagatcaataaggcttttgatttgatgcttaaaggtgaaggtctccgatgcataattcggatgggtgaataaatggagtggaaagatttttaaaatgttgtataactatagttcaagtttcataacctatcaagtgtcttctttgatcttcattatgtatgagagtttttgtgttgaaatcctgagtttatatattccaatagttattagttcacttctcttggtaaattttaatgtttttgcatcatacattgtagtagaaagattatttttgtcaaagtttaatcctctgtttaattttttattgtcaccttaaactcgatatataccacactttcgaacactaattgtatacctacaagtgtttttgtataaaatttatattgctataattgctttc

SEQ ID NO: 2797 - DNA, 1319 bp, Orobanche aegyptiaca
atcaagaaagctaataacaagatgtctagtactgcaggtcaggtcataaaatgcaaagctgctgttgcatgggaagccgggaagccactggtgattgaagagattgaggtggcgccgccgcagaaaatggaggtccggttgaagattctattcacctcactttgccacactgacgtttacttctgggaagccaaggcacaagactctgtctttcctcggattctcggacacgaagcagcagggattgtggagagtgtaggagagggtgtaacagaacttgctccaggggatcacgtactccctgtattcacaggggaatgtggaaaatgtgctcattgcaaatctgaggaaagcaatatgtgtagccttctaaggatcaacactgagaggggagttatgattaacgatgaaaaaacaagattttctattaacggaaagcctatttaccattttgttgggacatccacttttagtgaatacactgttcttcatgttggctgtgttgctaaaatcaatcctcttgctcctttggataaagtttgtgtactcagctgcggcatttcaacaggacttggtgctacattgaatgttgctaaaccgaaaaagggttcgtcggttgctatttttggacttggagcagttgggcttgctgctgcagaaggagccagattagctggtgcttcaagaattattggcgtggatttgaattctgccagatttgaagaagctaagaaatttggtgtgacagaatttgtgaatccaaaagagtacgacaagccagttcaagaggttatagctgagttgactgatggaggtgttgatcgaagtgttgaatgtaccggaaacattaacgccatgatctctgcatttgaatgcgttcatgatggatggggtgttgcggttcttgttggtgtgcctcataaagatgccgtttttaagactcatccggtgaatttcttgaatgagaggactctgaagggtactttctttggaaactataaaccgcgttctgatcttccagcggtcgtagaaatgtacatgagaaaggaacttgaagtggagaagtttataactcatgaggtgccatttgctgagattaacaaggcttttgagctcatgttgaagggtgaaggcctccgctgtatcatacggatgtagtaaagataaaatgattgtatttttattattgtgacgttcttatgttcaaagatgtcttttaagttactgaattcgttttttttcccatgtttactgttatcttattgttttctccaacaagacaagttcaattgaataaatagtctgttcttttttttatc

SEQ ID NO: 2798 - DNA, 1458 bp, Solanum tuberosum
aaacaatcaaagttgtgttctataaaaagttatcatatttagtgatcagtaaaaaaatcaagaaaatgtcgactactgtaggccaagtcattcgttgcaaagctgctgtggcatgggaggctggtaagccattagtgatggaggaagtggatgttgctcctccacagaaaatggaagttcgtcttaagatcctctacacttcactctgtcatactgatgtatacttctgggaagctaagggtcaaaatccagtctttcctagaattcttggacatgaagcagcagggattgtggagagtgttggagagggagtaacagaacttgcaccaggagaccatgttcttcctgtctttacaggagaatgcaaagattgtgctcactgtaaatctgaagaaagcaatatgtgtagcctcttaaggattaacactgacaggggagtgatgattaatgatggacaatcaaggttttccatcaatggaaagcccatttaccattttgttgggacctccacttttagtgagtacactgtggttcatgttggatgtgtcgccaaaattaacccccttgctcctcttgacaaagtatgtgtccttagttgtggaatctcgacaggccttggagcaactttgaatgttgctaaaccaacaaaaggctcaagtgtggctatatttggactaggagctgtaggccttgcagctgcagaaggagccagaattgctggtgcttcaaggataattggtgttgatttaaatgctagtagatttgagcaagctaagaaatttggtgtgacagagtttgtgaacccaaaggactatagtaaaccagttcaagaggtaattgctgagatgactgatggcggagtcgataggagtgtggaatgtactggccatattgatgctatgatttcagcatttgagtgtgtccatgatggctggggagtggctgtacttgttggagtaccccataaagaagctgtgttcaagacacaccctatgaactttttgaatgaaaggactctcaaaggaaccttctttggaaactacaaacctcgttcggatattccttctgttgttgagaaatacatgaataaagaacttgaattggagaaattcatcactcatacacttccatttgctgaaatcaataaggcttttgatttaatgttgaagggagaaggccttcgttgcatcatcaccatggaggactaaacttactgtcctagaaaaggagcttctagctagtcgctactctttgagaaaagaccaataaattgtcactgtcttattttccctttcttgtttggtgattgagttgtaacattcctgtccaactccatccatatcttttcttttgtttttttgcttatagatgtgctttgtgtttcgcaatgccatatctctttcggttcttgtaaaaaatgcaaattctctctgttttatctcaagtatatttacagaa

SEQ ID NO: 2799 - DNA, 1410 bp, Triticum aestivum
aagatccatctttctctctgagtttccggagcgaccgggggagttgatggcgaccgccgggaaggtgatcaagtgcaaagcggcagtggcatgggaggccgggaagccgctgtcgatcgaggaggtggaggtggcgccgccgcaggccatggaggtgcgtgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgtgccaggtgaccatgttctgccggtgttcactggcgagtgcaaggattgtgctcactgcaagtcagaggagagcaacctttgtgacctcctcaggatcaatgtcgaccggggcgtgatgatcggcgatgggcagtcccgtttcaccatcggtgggaaacctatattccacttcgtcgggacctctaccttcagcgagtataccgtgatccatgttgggtgcctagcgaagatcaaccctgaggcacccctcgacaaagtttgtgttctcagctgtggtatctcaactggtcttggtgcgactctcaatgtcgcaaaaccaaaaaagggttcgacggtggcaattttcggccttggagctgtgggccttgctgccatggaaggggccaagatggctggggcatcaaggatcatcggtgtggacttgaaccctgcaaaatacgaacaagccaagaagtttggctgcaccgactttgtaaacccaaaggaccacaccaagccagtgcaagaggtgcttatcgagatgacaaacggtggagtcgacagagccgtggagtgcacgggtcacgtcgacaccatgatatccgcctttgaatgcgttcacgatgggtggggcgtggcggtgctggtgggcgttccgcacaaggaggcggtgttcaagacccacccgatgaacttcctcaatgagaggaccctgaagggcaccttcttcggcaactacaaaccgcgcaccgacctcccggaagtcgtggagatgtacatgaggaaggagctggacgtggagaagttcatcacccacagcgtgcctttctcgcagatcaacacggcgttcgacctcatgctcaagggagagggacttcgctgcgtcatgaggatggacgagtaaatcaagcttcttcgtcacaccctcgctgctttaaacaaaagaaaaataaattatcaggacttccctggactaataatgtatagtcgttagatgcgcatgtgtattttttgtcaccaagaacgaacatgtatgtgttttgtgttcacggtttggtctttatatttcagtgtgtcaccacctcttctgagtgtacatgaacattttccagagtaataatagtctgc

SEQ ID NO: 2800 - DNA, 1465 bp, Triticum aestivum
aatcaaccaactgcaaagcagaaacagcagcaaagatccatctttctctctgagtttccggagcgaccgggggagttgatggcgaccgccgggaaggtgatcaagtgcaaagcggcagtggcatgggaggccgggaagccgctgtcgatcgaggaggtggaggtggcgccgccgcaggccatggaggtgcgtgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgtgccaggtgaccatgttctgccggtgttcactggcgagtgcaaggattgtgctcactgcaagtcagaggagagcaacctttgtgacctcctcaggatcaatgtcgaccggggcgtgatgatcggcgatgggcagtcccgtttcaccatcggtgggaaacctatattccacttcgtcgggacctctaccttcagcgagtataccgtgatccatgttgggtgcctagcgaagatcaaccctgaggcacccctcgacaaagtttgtgttctcagctgtggtatctcaactggtcttggtgcgactctcaatgtcgcaaaaccaaaaaagggttcgacggtggcaattttcggccttggagctgtgggccttgctgccatggaaggggccaagatggctggggcatcaaggatcatcggtgtggacttgaaccctgcaaaatacgaacaagccaagaagtttggctgcaccgactttgtaaacccaaaggaccacaccaagccagtgcaagaggtgcttatcgagatgacaaacggtggagtcgacagagccgtggagtgcacgggtcacgtcgacaccatgatatccgcctttgaatgcgttcacgatgggtggggcgtggcggtgctggtgggcgttccgcacaaggaggcggtgttcaagacccacccgatgaacttcctcaatgagaggaccctgaagggcaccttcttcggcaactacaaaccgcgcaccgacctcccggaagtcgtggagatgtacatgaggaaggagctggacgtggagaagttcatcacccacagcgtgcctttctcgcagatcaacacggcgttcgacctcatgctcaagggagagggacttcgctgcgtcatgaggatggacgagtaaatcaagcttcttcgtcacaccctcgctgctttaaacaaaagaaaaataaattatcaggacttccctggactaataatgtatagtcgttagatgcgcatgtgtattttttgtcaccaagaacgaacatgtatgtgttttgtgttcacggtttggtctttatatttcagtgtgtcaccacctcttctgagtgtacatgaacattttccagagtaataatagtctgcagtttctgcgttcaaaaaaaaaa

SEQ ID NO: 2801 - DNA, 1400 bp, Triticum aestivum
aagatccatctttctctctgagttttcggagcgatcgtgggagttgatggagaccgccgggaaggtgatcaagtgcaaagcggcggtggcatgggaggcagggaagccgctgtcgatcgaggaggtggaggtggcgccgccgcaggccatggaggtgcgcgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgcgccaggtgaccatgtcctgccggtgttcactggcgagtgcaaggattgtgctcactgcaagtcagaggagagcaacctttgtgacctcctcaggatcaatgtcgaccggggtgtgatgatcggagatgggcagtcccgctttaccatcggtgggaaaccgatattccactttgttgggacctctaccttcagcgagtacacagtgatccatgttgggtgcctagcgaagatcaaccccgaggcacccctcgacaaagtttgtgttctcagctgtggtatctcgactggtcttggtgcgactctcaatgtcgcaaaaccgaagaagggttcgacggtggcaattttcggtcttggagctgtaggccttgctgccatggaaggggccaagatggctggggcatcaaggatcatcggtgtggacttgaaccctgcaaaatacgaacaagctaagaagtttggctgcaccgactttgtaaacccaaaggaccacaccaagccagtgcaagaggtgcttgtagagatgacaaacggtggagtcgacagagccgtggagtgcacgggtcacgtcgatgccatggtatccgccttcgaatgcgttcacgatgggtggggcgtggcggtgctggtgggtgtcccccataaggaggcagtgttcaagacccacccgatgaacttcctcaatgagaggaccctgaagggcacctttttcggcaactacaagccgcgtaccgacctcccggaagtcgtggagatgtacatgagaaaggagctggacgtggagaagttcatcacacacagcgtgcctttctcgcagatcaacacggcgttcgacctcatgctcaagggagagggacttcgctgcgtcatgaggatggacgagtagatcgagcttcttcgtcacaccctcgctgctttaaacagaagaagaagaaaattataaggacttccctcgagtaataatgtatagtcgtaagaacgaacatgtatgtgttttgtgctcacggtttggtctttggggcgccaccctgtggccccgcttgagaaaaagttgtgtgcatgttttcatttaaaaaaatacatagtgttctcgcctccgt

SEQ ID NO: 2802 - DNA, 1449 bp, Triticum aestivum
aatcaaccaactgcaaagcagaaacagcaacaaagatccatctttctctctgagttttcggagcgatcgtgggagttgatggagaccgccgggaaggtgatcaagtgcaaagcggcggtggcatgggaggcagggaagccgctgtcgatcgaggaggtggaggtggcgccgccgcaggccatggaggtgcgcgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgcgccaggtgaccatgtcctgccggtgttcactggcgagtgcaaggattgtgctcactgcaagtcagaggagagcaacctttgtgacctcctcaggatcaatgtcgaccggggtgtgatgatcggagatgggcagtcccgctttaccatcggtgggaaaccgatattccactttgttgggacctctaccttcagcgagtacacagtgatccatgttgggtgcctagcgaagatcaaccccgaggcacccctcgacaaagtttgtgttctcagctgtggtatctcgactggtcttggtgcgactctcaatgtcgcaaaaccgaagaagggttcgacggtggcaattttcggtcttggagctgtaggccttgctgccatggaaggggccaagatggctggggcatcaaggatcatcggtgtggacttgaaccctgcaaaatacgaacaagctaagaagtttggctgcaccgactttgtaaacccaaaggaccacaccaagccagtgcaagaggtgcttgtagagatgacaaacggtggagtcgacagagccgtggagtgcacgggtcacgtcgatgccatggtatccgccttcgaatgcgttcacgatgggtggggcgtggcggtgctggtgggtgtcccccataaggaggcagtgttcaagacccacccgatgaacttcctcaatgagaggaccctgaagggcacctttttcggcaactacaagccgcgtaccgacctcccggaagtcgtggagatgtacatgagaaaggagctggacgtggagaagttcatcacacacagcgtgcctttctcgcagatcaacacggcgttcgacctcatgctcaagggagagggacttcgctgcgtcatgaggatggacgagtagatcgagcttcttcgtcacaccctcgctgctttaaacagaagaagaagaaaattataaggacttccctcgagtaataatgtatagtcgtaagaacgaacatgtatgtgttttgtgctcacggtttggtctttggggcgccaccctgtggccccgcttgagaaaaagttgtgtgcatgttttcatttaaaaaaatacatagtgttctcgcctccgtataaaaaaacatctcac

SEQ ID NO: 2803 - DNA, 1542 bp, Triticum aestivum
ccttgtccaacaaaacatgcaacttctttccctacttgcactccaagcatacccttaattactcgccgattcctccagaaccaggactatatatacacggctcgcctcgccttcgttcctcaccaaaatctacagccaacgaactgcagagcagaaacagcgacagagatccgtcttcttcctcttcgagttcttggagcttgcgaccgacagggacggggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgttaccgaactcgtgccgggtgaccatgtcctcccggtgttcactggcgagtgcaaggactgtgcccactgcaagtcagaggagagcaacctctgtgacctcctcaggatcaacgtggatcgtggcgtgatgatcggtgatggggagtctcgcttcaccatcaatgggaaaccgatcttccacttcgtcgggacctccaccttcagcgagtacaccgtgatccatgtcgggtgcctcgccaagatcaacccagaggcgccccttgacaaagtttgtgttctcagctgtggtatctcaactggacttggtgctaccctcaatgttgcgaaaccgaaaaagggttcgacggtggccattttcggtcttggagctgtaggccttgctgccatggaaggggccaagatgtctggggcatcaaggatcattggtgtggatttgaaccctgcaaaatacgaacaagccaagaaatttggatgcactgactttgtgaacccaaaggaccacaccaagcccgtgcaagaggtgcttgtcgagatgaccaatggtggagtcgaccgcgcagttgagtgcactggccacatcgacgccatgatcgccgccttcgaatgtgtccatgatgggtggggcgtggcggtgctggtgggcgtcccgcacaaggaggcggtgttcaagacaagcccgatgaacttgctcaacgagaggaccctgaagggcaccttcttcggcaactacaagccgcggaccgacctcccggaagtcgtggagatgtacatgaggaaggagctggacgtggagaagttcatcacccacagcgtgcccttctcgcagatcaacacggcgttcgacctcatgctcaagggggagggcctgcgttgcgtcatgaggatggacgagtagatggtctcttattcatcgtgtgtctctttgttttagtgttcacggtttggtctttggtttcattgcgtctgtcggcagctttcagttagcatgtaaattactattaataagtgtggcacaatagcgtgcaatttctgtgttaatattgggtcttccgttgcaaatcattcttctattttca

SEQ ID NO: 2804 - DNA, 1437 bp, Triticum aestivum
ccaacgaactgcaaagcagagacagcgacagagatccatcttctttctcttcgagttcttggagctagcgaccgacagggacagcgatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgtgacggagctagtgccgggcgaccatgtcctcccggtgttcaccggcgagtgcaaagactgtgcccactgcaagtcagaggagagcaacctttgtgacctccttaggatcaacgtggatcgtggcgtgatgatcggggatgggcagtcacgcttcaccatcaacgggaaacccatcttccactttgtcgggacctccaccttcagtgagtacaccgtcattcatgtcggttgcctcgccaagatcaaccctgaggcgccccttgacaaagtttgtgttctcagctgtggtatctcaactggacttggtgctaccctcaatgtcgcgaaaccgaaaaagggttccacggtggccatattcggtcttggagctgtaggccttgctgccatggaaggggccaagatggctggggcagcaaggatcattggtgtggatttgaaccctgcaaaatacgaacaagctaagaaatttggatgcactgactttgtgaacccaaaggaccacaccaagccagtgcaagaggtgcttgtcgagatgaccaatggcggagtcgaccgtgcggttgagtgtactggccacatcgacgccatgatcgccgccttcgaatgtgtccatgatgggtggggcgtggcggtgctggtgggcgtcccacacaaggaggcggtgttcaagacaagcccgatgaacttgctcaacgagaggaccctgaagggcaccttcttcggcaactacaagccgcggaccgacctcccggaagtcgtggagatgtacatgaggaaggagctggacgtggagaagttcatcacccacagcgtgcccttctcgcagatcaacacggcgttcgacctcatgctcaagggggagggcctgcgctgcgtcatgaggatggacgagtagatcgcttcttatccatcgttttaacatttggtgcttgagaagcacaggcaattttttttagaaaacctccgtcgggtaataatcgtgtgtgctagtcgtgagatgtgcatgtgttcatctctatgctctttgtttagtgttcacggtttggtctttggtttcattgtgtctatcggcagctttcagttggcatgtaaattactattaataa

SEQ ID NO: 2805 - DNA, 1488 bp, Triticum aestivum
ccaacgaactgcaaagcagagacagcgacagagatccatcttctttctcttcgagttcttggagctagcgaccgacagggacagcgatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgtgacggagctagtgccgggcgaccatgtcctcccggtgttcaccggcgagtgcaaagactgtgcccactgcaagtcagaggagagcaacctttgtgacctccttaggatcaacgtggatcgtggcgtgatgatcggggatgggcagtcacgcttcaccatcaacgggaaacccatcttccactttgtcgggacctccaccttcagtgagtacaccgtcattcatgtcggttgcctcgccaagatcaaccctgaggcgccccttgacaaagtttgtgttctcagctgtggtatctcaactggacttggtgctaccctcaatgtcgcgaaaccgaaaaagggttccacggtggccatattcggtcttggagctgtaggccttgctgccatggaaggggccaagatggctggggcagcaaggatcattggtgtggatttgaaccctgcaaaatacgaacaagctaagaaatttggatgcactgactttgtgaacccaaaggaccacaccaagccagtgcaagaggtgcttgtcgagatgaccaatggcggagtcgaccgtgcggttgagtgtactggccacatcgacgccatgatcgccgccttcgaatgtgtccatgatgggtggggcgtggcggtgctggtgggcgtcccacacaaggaggcggtgttcaagacaagcccgatgaacttgctcaacgagaggaccctgaagggcaccttcttcggcaactacaagccgcggaccgacctcccggaagtcgtggagatgtacatgaggaaggagctggacgtggagaagttcatcacccacagcgtgcccttctcgcagatcaacacggcgttcgacctcatgctcaagggggagggcctgcgctgcgtcatgaggatggacgagtagatcgcttcttatccatcgttttaacatttggtgcttgagaagcacaggcaattttttttagaaaacctccgtcgggtaataatcgtgtgtgctagtcgtgagatgtgcatgtgttcatctctatgctctttgtttagtgttcacggtttggtctttggtttcattgtgtctatcggcagctttcagttggcatgtaaattactattaataattgtgtcccaacagtaatactagcgtgcaatttctgtgttaaaaaaaaacc

SEQ ID NO: 2806 - DNA, 1372 bp, Mimulus guttatus
taattatttcttctataaattaggatttcataaccataaacaactcagacaaaacatcaatctttaacacaagaagatgccgccgccgtcgtcagccaccgccggtcaggtcataaaatgcaaagctgccgttgcatgggaagccggaaagccgctggtgattgaagaaattgaggtggcgccgccgcagaaaatggaggtccgcctgaggattctcttcacctccctctgccacaccgatgtctacttctgggaagccaaggcgcaagactctgtttttcctcggattttcggtcacgaagcagcaggaattgtggagagtgtgggagaaggtgtgacggaattagtgccgggcgatcacgttctaccggtgttcacgggtgaatgcggagaatgtgctcactgtaaatccgaagagagcaacatgtgtacccttttaaggatcaacaccgaaaggggagtgatgattaatgacggaaaatcgagattttcgattaacggaaagccgatttaccattttatcgggacatccacgtttagcgagtacaccgtcgttcatgttggctgtcttgccaagatcaatccactcgcccctctcgataaagtttgcgtgctcagctgtggaatttccaccgggcttggtgctatgttgaatgttgctaaaccgaaaaagggttcttcggttgctattttcggtcttggagctgttgggcttggtgctgcagaaggagcaagattggctggtgcttcgagaattattggtatagatttgaaccctagcagatttgaagaagcaaagaaatttggtgtgactgaatttgtgaatccaaaagactataccaagccaattcaagaggtgatagctgagatgacagatggaggagtggatcgaagcgttgagtgtaccggaaacatcaacgcgatgatctctgcattcgaatgtgttcatgatggatggggagttgctgtactcgtcggtgtgcctcataaagactcggaattcaaaactcacccggtgaatttcttgaacgagaggactttaaagggtactttctttggtaactataaaccacgcaccgatcttccgggggttgtcgaaatgtacatgaacaaggagcttgaagtggagaagtttataactcacgaggtgccgtttgctgaaattaacaaggctttcgaactgatgctgaaaggtgaagggcttcgttgtatcatcaaaatggagtgaagagattattccccatactctactatttgaccataactcaggggttgggacgtaatttgccattttataataaactttgagttattttatttcatgtactttgtctttttaaaattaacaagttattgaattatctgttgtgtt

SEQ ID NO: 2807 - DNA, 1467 bp, Euonymus alatus
aaatggaaatcccgtacatgggttttcttgagcagtagtttttttctctcattataaatacagtaattgtctccatcttctacacaatcaaagctaaaacaacacttcttattactctaaaatcatccaagcaagcaagcatgtctagcacagctggtcaagtcatacgctgcaaagctgcggtggcatgggaggcagggaagccactagtgattgaggaagtggaggtggcgccaccacaggctaatgaagttcggttgaagattctgttcactgctctgtgtcacactgatgtctacttctgggaagccaagggccagacaccggtgtttcctcgcatatttggtcatgaagctggaggaattgtggagagcgtgggtgaaggtgtcactgatctcaaacctggtgaccatgtcctccctgtgttcactggggagtgcaaggagtgcccacactgtctgtctgaagaaagcaacatgtgtgatctcctgaggatcaacactgacaggggcgttatgctcaatgatggcaagtcaagattctctatcaatggaaagcccatatttcactttgttggaacctccaccttcagtgaatacactgttgtccatgtgggttgtcttgcaaaaatcaatcctgaagctccccttgacaaagtttgcattcttagttgtggcatatccacaggtcttggtgctactctgaatgttgcaaaacctaagaagggtcaatctgtagctatttttggattgggagccgttggccttgcggctgctgaaggtgcgaggatggctggggcttcaaggatcattggtatcgatctgaacccgagcaggttcaatgaagctaagaaattcggtgttactgagtttgtgaatccaaaagattacgacaagcctgtacaagaggtgatcgctgagatgaccaatgggggagttgacaggagtgttgaatgcactggaagcattcaggccatgatctccgcgttcgaatgtgttcacgatggttggggtgttgctgtacttgttggtgtaccaaacaaagacgatgcattcaaaacacatcccatgaacttgttgaacgaaagaactctcaagggtaccttctttggcaactacaagccgcgcactgacattcccggcgtggttgaaaaatacatgaacaaggagatagagctggaaaagttcataactcactcggtgccgttctcggagattaacaaagcctttgattacatgctgaaaggagagagccttcggtgcatcattcgcatgggggattagatgatcataactgcagactgcagtactgttgagcatcagcagatatgaaaaatctcagactatgttaaaggggaatgttttttcgtattgttgtttcttctgagcttgtaaaaattcggaataaaacaggttacttgtacttggtttactgcattgtgctcccttttattcccaataaaaactc

SEQ ID NO: 2808 - DNA, 1315 bp, Lippia dulcis
ggcgaaaaaggaaatgtctagcactcagggtcaagttatccgctgcaaagccgccgtggcatgggagaccggtaagccgctggtgattgaagaggtggaggtggcgccgccgcagaaaatggaagttcgcgtgaagattctcttcacctccctttgtcacactgatgtttatttctgggaagccaagggacaaacacctctgtttcctcgcatatttggccacgaggctggcggaatcgtagaaagtgttggcgaaggcgtgacagaagtccagcccggggaccatgttcttcccattttcacaggggaatgcaaagaatgcaggcattgtaaatctgcagagagcaacatgtgtgatcttctcagaataaacacggatcgtggtgtcatgattggggatggtaaaagtcgattctccaaagatggtaaaccgatttatcactttcttggaacttcaacctttagcgagtacacggtcacgcatgttggaagtttggcgaagattaatccggaagcgcctcttgacaaagtttgtgtccttagttgtgggatatccacaggtcttggtgcggctcttaatgtcgctaaaccaactcagggttcgacggttgctgtttttggattgggagctgttggtcttgctgctgctgaaggggctcgtatttctggggcttcgaggatcattggtgtcgatctgaacccgagtcgctttgatgaagccaagaaatttggtgtgactgaatttgtgaacccaaaggatcataacaagccggttcaagaggtcattgctgagatgacggacggtggtgtggaccgtagtgttgaatgcaccggaaatgtaaacgctatgatctccgctttcgaatgtgttcatgatggttggggtgttgctgtacttgttggagtgcctaacaaggatgacgcattcaagactcaccccgtgaatttcttgaacgagagaactctcaaagggaccttttttggcaactataagccccgaagcgacattcctggcgtcgttgagaagtacatgagaaaggagctggagctggagaaattcatcacccatcaagttcctttctcggatatcaacaaggctttcgatatcatgttgaaaggcgagggtcttcgttgcatggtgtcgatggcaagttaagggatactctgtttttctagcaattatatgctgtgagagagtaatgtaaggttatgaataatgtttgagagcttgttcaaacatcttttacccttaagttagataaatatacaccatatgtattctatccaaattttctttaatcttatggttctacgg

SEQ ID NO: 2809 - DNA, 1505 bp, Coffea canephora
cggccgggggaccggaaaacaaacgcaatactttacagacagaataacgaaacacattttcaaaagcaacgcgttaaagagaagaagaaaaagaagaggaagaaagaagagatggcaagcactgctggacaggttatacgttgcaaagctgctattgcatgggaagcagggaagccactagtcattgaggaagtggaggtggcacctcctcagaaaatggaggtccggctcaagattctcttcacttccctctgccatactgatgtttatttctgggaagcgaagggccaacaccccgtgtttcctagaattctcgggcacgaggcatcagggattgtggagagtgtaggggaaggcgtgacagaacttcagcccggagaccatgtgctccctgttttcacaggggagtgtaaggaatgtcgtcattgcaaatcagaagaaagtaacatgtgtgatctcctcaggatcaacacagacaggggtgtgatgcttaatgatgggaaatcaaggttctcaattaatgggaaaccaatttatcattttgttgggacttccacatttagcgagtacactgtggtccatgttggttgtctagccaaaatcaatccccttgctcctcttgacaaagtttgtgtcttgagttgtggaatctccacaggccttggtgctactttgaatgttgctaaacctagaaggggatcatcagtggcagttttcggtttgggggctgttggccttgctgctgcagaaggggctagaatagcaggtgcctcaagaatcataggaatcgatctgcttcctgacagatttgaacaagcaaagaagtttggggtgaatgaatttgtaaatccaaaagattaccctaaaccagttcaagaggtaattgctgagatgactgatggaggagtggatagaagtgtggagtgtacaggaaacgtcaatgccatgatctcagcctttgaatgcgtgcatgatggctggggagttgctgttcttgttggtgttccacataaagatgctgtcttccagactcatcccatgaatgtcttgaatgagaggactctcaaaggaaccttctttggaaactataaacctcgttctgaccttccgtctgttgttgaaaaatacatgaacaaagaacttgaattggagaaatttatcactcatgaagtaacattttctgagatcaacaaggcttttgagtacatgctcaagggagaaggcttgcgatgcctaatccgtatggaggagtaaagaagaagaaccaaatgcttttaatgaagctgctattactacctgcgacttttaccaaatccctttacttgaagctttaaattgttcatatcataattatcagtcagatagttaaaattctcccaagttgaagttgacgttctgtattttgtcctaagatcaagcccttttcatgtgaccacgtactgccttttcttttccttcttttgttgcccaagtaaattatatatttgcacaattttctttggagg

SEQ ID NO: 2810 - DNA, 1673 bp, Solanum phureja
aaaaaaattataagtggacataaaacaaaatgagatacagtattgttttcccattggaatattcttgacaaaacctcaaacgactaacacaaaacaaacagctaaaaagcggttttggaaaatccagtgaccaaaacatgcaaatggttttactgtggcctattgtattttcacttttcccagttataaatatccccagaatcaactaagtaaacaaccaaagttgtgttctataaaaagttttcatatttagtgatcagtaaaaaaatcaagaaaatgtcgactactgtaggccaagtcattcgttgcaaagctgctgtggcatgggaggctggtaagccattagtgatggaggaagtggatgttgctcctccacagaaaatggaagttcgtcttaagatcctctacacttcactctgtcatactgatgtatacttctgggaagctaagggtcaaaatccagtctttcctagaattcttggacatgaagcagcagggattgtggagagtgttggagagggagtaacagaacttgcaccaggagaccatgttcttcctatctttacaggagaatgcaaagattgtgctcactgcaaatctgaagaaagcaacatgtgcagtctcttgaggattaacactgacaggggagtgatgattaatgatggacaatcaaggttttccatcaatggaaagcccatttaccattttgttgggacctccacttttagtgagtacactgtggttcatgttggatgtgtcgccaaaattaacccccttgctcctcttgacaaagtatgtgtccttagttgtggaatctcgacaggccttggagcaactttgaatgttgctaaaccaacaaaaggctcaagtgtggctatttttggactaggagctgtaggccttgcagccgcagaaggagccagaattgctggtgcttcaaggataattggtgttgatttaaatgctagtagatttgagcaagctaagaaatttggtgtgacagagtttgtgaacccaaaggactatagtaaaccagttcaagaggtaattgctgagatgactgatggtggagtcgataggagtgtggaatgtactggccatattgatgctatgatttcagcatttgagtgtgtccatgatggctggggagtggctgtacttgttggagtaccccataaagaagctgtgttcaagacacaccctatgaactttttgaatgaaaggactctcaaaggaaccttctttggaaactacaaacctcgttcggatattccttctgttgttgagaaatacatgaataaagaacttgaattggagaaattcatcactcatacacttccatttgctgaaatcaataaggcttttgatttaatgttgaagggagaaggccttcgttgcatcatcaccatggaggactaaatttactgtcctagaaaaggagcttctagctagttgctactctttgagaaaagaccaataaattgtcactgtcttattttccctttcttgtttggtgattgagttgtaacattctccatccatgtcttttcttttgttttttgcttatagatgtgctttgtgtttcgcaatgccatatctctttcggttcttgtaaaaaatgcaaattctctctgttttatctttaagtatatttacagaatttccgtgatttt

SEQ ID NO: 2811 - DNA, 1551 bp, Glycine max
ggcacagcaaaaagagaaaagtacttgtgtgtttgtgagtgattactaatcaaaaagtcaatcaaggagtttaaaagcaaagtataaatggcttcaaccactgctggaaaggtcatacgctgcaaagctgcggtagcatgggaagctggaaagccattggtgatagaagaagttgaggtagctccaccacaggcaaatgaggttcgtatcaagatcttgttcacctcactctgccacactgatgtctacttctgggaagccaagggacagacacctttatttccacggatatttggtcacgaagcaggaggaattgtggaaagtgttggtgagggtgtgacggatctcaagcccggtgatcatgtgcttccagtcttcactggggagtgcaaggagtgtgatcattgcaaatcagaagaaagtaacatgtgtgacctcctaaggattaacaccgaccgtggagtgatgctgaatgatggcaaggcaaggttttcaatcaatggacaaccaatataccactttgtgggaacctccactttcagtgagtacactgtagtccatgttggttgtgttgccaagatcaaccctgctgccccacttgacaaagtttgtgttctgagctgtggaatctcaacaggtcttggtgctacattgaatgttgcaaaaccaaacaaaggttcatcagtggctgtatttggattgggagccgtggggcttgctgctgccgagggagctagacttgctggtgcttccaggataattggggttgacttgaattctaagagatttactgaagctaagaagtttggagttaccgagtttgtgaatccaaaagattatgacaagccagttcaagaggtgattgctgaaatgactggtgggggagttgaccgaagtgttgagtgcactggaagtatcaatgctatgatctctgcattcgaatgtgtgcatgatggatggggtgttgctgtacttgttggtgtgccaaataaagatgatgctttcaaaactcatccaattaatgtcttgaacgaaaagactctcaagggtactttctttggcaactataaaccacgttctgaccttccatcagtggtggagatgtatatgaacaaggaacttgaactggagaaatttatcacccatgaagtacctttcgaagaaatcaacaaagcttttgaatacatgcttaaaggggagagcctgcgttgcataatccgcatgactgaatagaatttatataaacaactactttgagtattggaaataaaataaattaaaatgaaatatacttgagcatgtatgtagttgtggtcactgtaacaaaacattcttgagttttgctttaaatttcatagggaagttattgtatctcttgtaaatctcatgcgtttgtaccaaataaaacaagcttctcatgtatgctgtatttttatacaagtatgtatgcataatactcctattgtaacaaaacattcatatagtacttcattgttgagtggattgaagttgaaaatatttatgttggaaaagtctattaaaaatctcttg

SEQ ID NO: 2812 - DNA, 1457 bp, Glycine max
aaaagagaaaagtacttgtgtgtttgtgagtgattactaatcaaaaagtcaatcaaggagtttaaaagcaaagtataaatggcttcaaccactgctggaaaggtcatacgctgcaaagctgcggtagcatgggaagctggaaagccattggtgatagaagaagttgaggtagctccaccacaggcaaatgaggttcgtatcaagatcttgttcacctcactctgccacactgatgtctacttctgggaagccaagggacagacacctttatttccacggatatttggtcacgaagcaggaggaattgtggaaagtgttggtgagggtgtgacggatctcaagcccggtgatcatgtgcttccagtcttcactggggagtgcaaggagtgtgatcattgcaaatcagaagaaagtaacatgtgtgacctcctaaggattaacaccgaccgtggagtgatgctgaatgatggcaaggcaaggttttcaatcaatggacaaccaatataccactttgtgggaacctccactttcagtgagtacactgtagtccatgttggttgtgttgccaagatcaaccctgctgccccacttgacaaagtttgtgttctgagctgtggaatctcaacaggtcttggtgctacattgaatgttgcaaaaccaaacaaaggttcatcagtggctgtatttggattgggagccgtggggcttgctgctgccgagggagctagacttgctggtgcttccaggataattggggttgacttgaattctaagagatttactgaagctaagaagtttggagttaccgagtttgtgaatccaaaagattatgacaagccagttcaagaggtgattgctgaaatgactggtgggggagttgaccgaagtgttgagtgcactggaagtatcaatgctatgatctctgcattcgaatgtgtgcatgatggatggggtgttgctgtacttgttggtgtgccaaataaagatgatgctttcaaaactcatccaattaatgtcttgaacgaaaagactctcaagggtactttctttggcaactataaaccacgttctgaccttccatcagtggtggagatgtatatgaacaaggaacttgaactggagaaatttatcacccatgaagtacctttcgaagaaatcaacaaagcttttgaatacatgcttaaaggggagagcctgcgttgcataatccgcatgactgaatagaatttatataaacaactactttgagtattggaaataaaataaattaaaatgaaatatacttgagcatgtatgtagttgtggtcactgtaacaaaacattcttgagttttgctttaaatttcatagggaagttattgtatctcttgtaaatctcatgcgtttgtaccaaataaaacaagcttctcatgtatgctgtatttttatacaagtatgtatgcataatactcctattgt

SEQ ID NO: 2813 - DNA, 1304 bp, Helianthus annuus
cgcatagtacgcggggatctcaaacaacaaccaaaactcacaatttaatctcatttcaagaatattctctctttcaaccgatcaaacaaaagtatgtcgaccactacaggccaagttattcgatgcaaagccgccgtggcgtgggaagccggaaaaccgctggtgatcgaagaagtggaggtggcgccaccgcagaaaatggaagtccggattaagatcctcttcacttccctttgccacactgatgtttacttctgggaagccaaaggacaaaatcctgtattcccaagaattttaggacacgaagctggaggggttgtggagagtgttggggaaggagtgactgatcttcagccaggggatcatgtgcttcccgttttcacaggagaatgcaaagagtgtgctcactgtaagtccgaagagagcaacatgtgtgaccttcttaggatcaataccgacaggggagtcatgcttcacgatcagaaatctagattctcgatcaacggcaaacccatcttccattttgttgggacttctactttcagcgagtacacggttgttcatgttggatgtcttgcaaagatcaaccctcttgcccctcttgataaagtttgtgtcctcagctgtgggatctccacagggctaggagctactctgaatgttgcaaaaccgaaaaaaggctcttcggtggcggttttcgggctgggggcagtgggacttgctgctgctgaaggtgcaagaatttctggggctttcaggatcattggtgttgatctcaatgccaatagattcgagcttgcaaagaaatttggggttacagagtttgtgaacccaaaagattataagaagccagtgcaagaagtgattgcagagatgactaatggaggggttgacaggagtgttgaatgcactggtcatgttgatgctatgatctctgcttttgaatgtgttcatgatggttggggcgttgctgttcttgtaggtgttccacacaaagatgctgtgttcaagaccaatcccatgaatctgttgaacgaaaggactttgaaggggaccttctttggaaactataaaccgcgatctgacattccttcggttgtcgaaaagtatatgaacaaggaacttgagttggagaagttcataacacatgaagttccgttttcagagatcaataaggcctttgacttgatgcataaaggtgaaggtcttcgttgcatcattcgaatggatgcctaaataattcgaatgtgtgtgtttcacgtttctcattgtcgttgttagctgtcttaatcttgattgtaaat

SEQ ID NO: 2814 - DNA, 1707 bp, Solanum lycopersicum
gtataaaaaaattacaagtggacataaaacaaaatgagatacagtatttgtgtttccattggaatattagcttgacaaaaactcaaacgagcaacacaaaacaaacagctaaaaaacctgttttgaaaaatccagtgaccaaaacatgtaaatggttttactgtggcctattgttttttcacctttcccaattataaatatccactgcctcaactgagtaaacaaccaaaatttgtgttctataaaaagttttcatatttagtgatcactaaaaaaaaatcaagaagatgtcgactactgtaggccaagtcattcgttgcaaagctgctgtggcatgggaagctggtaagccattagtgatggaggaagtagatgttgctcctccacagaaaatggaagttcgtcttaagatcctctatacttcactctgtcatactgatgtatacttctgggaagctaagggtcaaaatccagtctttcctcgaattcttggacatgaagcagcagggattgtggagagtgttggagagggagtaacagaccttgcaccaggagaccatgttcttcctgtctttacaggggaatgtaaagattgtgctcactgtaaatctgaagaaagcaatatgtgtagcctcttaaggattaacactgacaggggagtgatgcttaatgatggaaaatcaagattttccatcaatggaaaccccatttaccattttgttgggacctctacttttagtgagtacaccgtggttcatgttggatgtgttgcaaaaattaaccctcttgctcctcttgacaaagtatgtgtccttagttgtggaatttcgacaggccttggagcaagtttgaatgttgctaaaccaacaaaaggctcaagtgtggctatatttggactaggagctgtaggcctcgcggctgcagaaggagccagaattgctggtgcctcgaggataattggtgttgatttaaatgctagtagatttgagcaagctaagaaatttggtgtgacagagtttgtgaacccaaaggactatagtaaaccagttcaagaggtaattgctgagatgactgatggcggagtcgataggagtgtggaatgtactggtcacattgatgctatgatttcagcatttgaatgtgtccatgatggctggggagtggcggttcttgttggtgtaccccataaagaagctgtgttcaagacacatcctctgaactttttgaatgaacggactctcaaaggaaccttctttggaaactacaaacctcgttcggatattccttgtgttgttgagaaatacatgaacaaagaacttgaattggagaaattcatcactcatacacttccatttgctgaaatcaataaggctttcgatttaatgctgaagggagaaggccttcgttgcatcatcaccatggcggactaaactttctgtcctagaaaaggagcttctactgtttgagaaaaaagaccaataaattgtcactgtcttattttccctttcgtgtttggttgagttgtaacattccatccatgtctcttcttttgtcttttgcttagatgttgtgctttgccatatctctttcgattcttgtaaaaaatgcaaattctctctgttttatctcaagtatatttacagaatttcagtgatttgataaatctaaactttatcataatataatccaaacagaatttcaattgaa

SEQ ID NO: 2815 - DNA, 1705 bp, Solanum lycopersicum
gtataaaaaaattacaagtggacataaaacaaaatgagatacagtatttgtgtttccattggaatattagcttgacaaaaactcaaacgagcaacacaaaacaaacagctaaaaaacctgttttgaaaaatccagtgaccaaaacatgtaaatggttttactgtggcctattgttttttcacctttcccaattataaatatccactgcctcaactgagtaaacaaccaaaatttgtgttctataaaaagttttcatatttagtgatcactaaaaaaaaatcaagaagatgtcgactactgtaggccaagtcattcgttgcaaagctgctgtggcatgggaagctggtaagccattagtgatggaggaagtagatgttgctcctccacagaaaatggaagttcgtcttaagatcctctatacttcactctgtcatactgatgtatacttctgggaagctaagggtcaaaatccagtctttcctcgaattcttggacatgaagcagcagggattgtggagagtgttggagagggagtaacagaccttgcaccaggagaccatgttcttcctgtctttacaggggaatgtaaagattgtgctcactgtaaatctgaagaaagcaatatgtgtagcctcttaaggattaacactgacaggggagtgatgcttaatgatggaaaatcaagattttccatcaatggaaaccccatttaccattttgttgggacctctacttttagtgagtacaccgtggttcatgttggatgtgttgcaaaaattaaccctcttgctcctcttgacaaagtatgtgtccttagttgtggaatttcgacaggccttggagcaagtttgaatgttgctaaaccaacaaaaggctcaagtgtggctatatttggactaggagctgtaggcctcgcggctgcagaaggagccagaattgctggtgcctcgaggataattggtgttgatttaaatgctagtagatttgagcaagctaagaaatttggtgtgacagagtttgtgaacccaaaggactatagtaaaccagttcaagaggtaattgctgagatgactgatggcggagtcgataggagtgtggaatgtactggtcacattgatgctatgatttcagcatttgaatgtgtccatgatggctggggagtggcggttcttgttggtgtaccccataaagaagctgtgttcaagacacatcctctgaactttttgaatgaacggactctcaaaggaaccttctttggaaactacaaacctcgttcggatattccttgtgttgttgagaaatacatgaacaaagaacttgaattggagaaattcatcactcatacacttccatttgctgaaatcaataaggctttcgatttaatgctgaagggagaaggccttcgttgcatcatcaccatggcggactaaactttctgtcctagaaaaggagcttctactgtttgagaaaaaagaccaataaattgtcactgtcttattttccctttcgtgtttggttgagttgtaacattccatccatgtctcttcttttgtcttttgcttagatgttgtgctttgccatatctctttcgattcttgtaaaaaatgcaaattctctctgttttatctcaagtatatttacagaatttcagtgatttgataaatctaaactttatcataatataatccaaacagaatttcaattg

SEQ ID NO: 2816 - DNA, 1344 bp, Centaurea maculosa
  misc_feature (14)..(15): n is a, c, g, or t
  misc_feature (519)..(519): n is a, c, g, or t
  misc_feature (834)..(834): n is a, c, g, or t
ttggcggggggatnnaacttaacaaaaaaaaacaaaccaattacaaaatttatttaaagatttctgtttcagcgatcaagaatgtcgactaatgttggtcaagtgattcgatgcaaagcggcggtggcgtgggaagccggaaagccgctggtgatcgaagaagtggaggtggcgccgccggaaaaaatggaagtccgagtcaagatcctcttcacctccctatgtcacaccgatgtttacttctgggaagccaagggtcagaatcctgtgtttcctcgaattttaggccatgaggctggagggattgtggagagtgttggtgaaggagtgactgagcttcagccaggagaccatgttcttcccgttttcaccggagaatgccgagaatgcgctcactgtaagtccgaagagagcaacatgtgcgatctcctaaggatcaacaccgatcggggtgtcatgatccacgatcaaaagtctcggttttcgatcaaagggaaaccgatcttccatttcgttggnacttcgacttttagcgagtacaccgtggtccacgttgggtgtcttgccaagatcaacccgcttgcccctctcgacaaagtttgcgttctcagctgtgggatctctacagggttaggtgctactttgaatgttgcaaaaccgaagaaaggccaatcggttgccatttttggactcggagctgtgggacttgcggctgctgaaggcgcaagaattgcgggtgcttcaaggatcattgggatcgatctgaatgccaacagattcgagcttgcaaagaaatttggggtaacggagtttgtgaacccaaaagaccacacnaaaccggtgcaagaagtgattgtggagatgacgaatggaggtgttgacaggagtgttgaatgcactggccacattgatgctatgatctctgcctttgaatgtgtccatgatggttggggtgttgctgtgcttgtgggtgttccacacaaagatgctgttttcaagacgaatccggtgaatctattgaacgaaaggactctgaagggtaccttctttggaaactataaaccgcgatcggatcttccatctgtggtcgaaaagtacatgaacaaggaacttgaggtggagaagttcataacacatcaagtgccattttcggagatcaataaggcctttgatttgatgcttaaagggaaggtcttcgctgcatcattcgcatgggtgaatagatcttttgcaactctagaaatcttgttcgattgttttcctttctcatgtttaaatttcgaataattttaatgtgtaaatgtttctattgctatgaaagttcttgtctactaccttccattc

SEQ ID NO: 2817 - DNA, 1360 bp, Triticum aestivum
ccttgtccaacaaaacatgcaacttctttccctacttgcactccaagcatacccttaattactcgccgattcctccagaaccaggactatatatacacggctcgcctcgccttcgttcctcaccaaaatctacagccaacgaactgcagagcagaaacagcgacagagatccgtcttctttctcttcgagttcttggagcttgcgaccgacaggacggggatggcgaccgccgggaaggtgatcaagtgcaaagcggcggtggcatgggaggccgggaagccgctgtcgatcgaggaagtggaggtggcgccgccgcaggccatggaggtgcgcgtcaagatcctctacaccgccctctgccacactgacgtctacttctgggaagccaaggggcaaactccggttttccctaggatcttgggccatgaagctggaggcattgttgaaagtgtcggagagggtgttaccgagctcgtgccgggtgaccatgtcctcccggtgttcactggcgagtgcaaggactgtgcccactgcaagtcagaggagagcaacctctgtgacctcctcaggatcaacgtggatcgtggcgtgatgatcggtgatggggagtctcgcttcaccatcaatgggaaaccgatcttccacttcgtcgggacctccaccttcagcgagtacaccgtgatccatgtcgggtgcctcgccaagatcaacccagaggcgccccttgacaaagtttgtattctgagctgtggtatctcaactggacttggtgctaccctcaatgtcgcgaaaccgaaaaagggttcgacggtggccattttcggtcttggagctgtaggccttgctgccatggaaggggccaagatatctggggcatcaaggatcattggtgtggatttgaaccctgcaaaatacgaacaagccaagaaatttggatgcactgactttgtgaacccaaaggaccacaccaagcccgtgcaagaggtgcttgtcgagatgaccaatggtggagtcgaccgtgcagttgagtgcactggccacatcgacgccatgatcgccgccttcgaatgtgttcatgatgggtggggcgtggcggtgctggtgggcgtcccgcacaaggaggcggtgttcaagacaagcccgatgaacttgctcaatgagaggaccctgaagggcaccttcttcggcaactacaagccgcggaccgacctcccggaagtcgtggagatgtacatgaggaaggagctggacgtggagaagttcatcacccaccgcgtgcccttctcgcagatcaacacggcgttcgacctcatgctcaagggagagggcctgcgctgcgtcatgaggatggacgagtag

SEQ ID NO: 2818 - DNA, 1508 bp, Hordeum vulgare
tgcaaagcagaagcagcaacaaaggtcaaaagagcgatctttctctttgagttcccgcagcgatcgagtgtaagttaatggcgaccgccgggaaggtgatcaagtgcaaagcggcggtggcatgggaggccgggaagccgctctcgatcgaggaggtggaggtggcgccgccgcaggccatggaggtgcgagtcaagatcctctacaccgccctctgccacactgacgtctacttctgggaagccaaggggcaaactccggttttcccaaggatcttaggccatgaggctggaggtattgttgagagcgtcggagagggcgtgaccgagctcgtgccaggtgaccatgtcctgccggtgttcactggcgagtgcaaggattgtgctcactgcaagtcagaggagagcaacctctgtgacctcctcaggatcaatgtcgaccggggcgtgatgatcggcgatgggcagtcccgcttcaccaccggtgggaaaccgatattccacttcgtcggaacctctaccttcagcgagtacaccgtgatccatgttgggtgcctagcgaagattaaccccgaggcgccccttgacaaagtttgtgttctcagctgcggtatctcaactggtcttggtgcgactctcaatgtcgcaaaaccgaaaaagggttcgacggtggcaatttttggtcttggagctgtaggccttgctgccatggaaggggccaagatggctggggcatcaaggatcattggtgtggacttgaaccctgcaaagtacgaacaagctaagaagtttggctgcacagactttgtaaacccaaaggaccacaccaagccagtgcaagaggtgcttgtcgagatgacaaacggcggagtcgacagagcagtggagtgtacgggacacattgacgccatgatatccgccttcgaatgcgttcacgatgggtggggcgtggccgtgctggtgggcgtcccgcacaaggaggcggtgttcaagacacacccgatgaacttcctcaacgagaggaccctgaagggcaccttcttcggcaactacaagccgcgcactgacctcccggaagtcgtcgagatgtacatgaggaaggagctggacctggagaagttcatcacgcacaacgtgccattctcgcagatcaacacggcgttcgacctcatgctcaagggagagggacttcgctgcgtcatgaggatggacgagtagatcgactgatcgagcttcttcgtcacatccctcgctgctttcagatttggtgctcgagaaaaacgaacaaaaaaagtttgtaagatcttacctccggtaataatgtatagtgagcatgtgttgagctcttttttgtcacaaagaaccaacatgtatgtgttttgtcacaaggaaccaacatgtatggtttgatctttattttcagtgtgtcgcgatcgcgacgcgaccgtttgagcaatctgtttgggcgtacatgaacattttccacagtgtaataatttgcagtttccc

SEQ ID NO: 2819 - DNA, 1533 bp, Hordeum vulgare
gcaaagcagaagcagcaacaaaggtcaaaagagcgatctttctctttgagttcccgcagcgatcgagtgtaagttaatggcgaccgccgggaaggtgatcaagtgcaaagcggcggtggcatgggaggccgggaagccgctctcgatcgaggaggtggaggtggcgccgccgcaggccatggaggtgcgagtcaagatcctctacaccgccctctgccacactgacgtctacttctgggaagccaaggggcaaactccggttttcccaaggatcttaggccatgaggctggaggtattgttgagagcgtcggagagggcgtgaccgagctcgtgccaggtgaccatgtcctgccggtgttcactggcgagtgcaaggattgtgctcactgcaagtcagaggagagcaacctctgtgacctcctcaggatcaatgtcgaccggggcgtgatgatcggcgatgggcagtcccgcttcaccaccggtgggaaaccgatattccacttcgtcggaacctctaccttcagcgagtacaccgtgatccatgttgggtgcctagcgaagattaaccccgaggcgccccttgacaaagtttgtgttctcagctgcggtatctcaactggtcttggtgcgactctcaatgtcgcaaaaccgaaaaagggttcgacggtggcaatttttggtcttggagctgtaggccttgctgccatggaaggggccaagatggctggggcatcaaggatcattggtgtggacttgaaccctgcaaagtacgaacaagctaagaagtttggctgcacagactttgtaaacccaaaggaccacaccaagccagtgcaagaggtgcttgtcgagatgacaaacggcggagtcgacagagcagtggagtgtacgggacacattgacgccatgatatccgccttcgaatgcgttcacgatgggtggggcgtggccgtgctggtgggcgtcccgcacaaggaggcggtgttcaagacacacccgatgaacttcctcaacgagaggaccctgaagggcaccttcttcggcaactacaagccgcgcactgacctcccggaagtcgtcgagatgtacatgaggaaggagctggacctggagaagttcatcacgcacaacgtgccattctcgcagatcaacacggcgttcgacctcatgctcaagggagagggacttcgctgcgtcatgaggatggacgagtagatcgactgatcgagcttcttcgtcacatccctcgctgctttcagatttggtgctcgagaaaaacgaacaaaaaaagtttgtaagatcttacctccggtaataatgtatagtgagcatgtgttgagctcttttttgtcacaaagaaccaacatgtatgtgttttgtcacaaggaaccaacatgtatggtttgatctttattttcagtgtgtcgcgatcgcgacgcgaccgtttgagcaatctgtttgggcgtacatgaacattttccacagtgtaataatttgcagtttcccacatcggcatcttcatttttaactgc

SEQ ID NO: 2820 - DNA, 1411 bp, Triticum aestivum
aagatcgatctttctctttgagttcccggagcgatcgagtgggttaatggcgaccgccgggaaggtgatcaagtgcaaagcggcggtggcatgggaggccgggaagccgctgtcgatcgaggaggtggaggtggcgccgccgcaggccatggaggtgcgagtcaagatcctctacaccgccctctgccacactgacgtctacttctgggaagccaaggggcaaactccggtttttccaaggatcttgggccatgaggctggaggcattgttgagagcgtcggagagggcgtgaccgagcttgtgccaggtgaccatgtcctgccggtgttcactggcgagtgcaaggattgtgctcactgcaagtcagaggagagcaacctttgtgacctcctcaggatcaatgtcgaccgaggcgtgatgatcggtgatgggcagtcccgcttcaccatcagcgggaaaccgatattccacttcgtcgggacctctaccttcagtgagtacacagtgatccatgttgggtgcctagcgaagatcaacccctcggcacccctcgacaaagtttgtgttctcagctgtggtatctcaactggtcttggtgcgacgctcaatgtcgcaaaaccgaaaaagggttcgacggtggcaattttcggtcttggagctgtaggccttgctgccatggaaggggccaagatggctggggcatcaaggatcatcggtgtggacttgaaccctgcaaaatacgaacaagccaagaagtttggctgcaccgactttgtaaacccaatggaccacaccaagccattgcaagaggtgcttgtcgagatgacaaacggtggagtcgacagagccgtggaatgcacgggtcacgtcgacgccatgatatccgccttcgaatgcgttcacgatgggtggggcgtggcggtgctggtgggtgtcccccataaggaggcggtgttcaagacccacccgatgaacttcctcaatgagaggaccttgaagggcaccttcttcggcaactacaagccgcgtaccgacctcccggaagtcgttgagatgtacatgaggaaggagctggacgtggagaagttcatcacccacagcgtgcccttctcgcagatcaacacggccttcgacctcatgctcaagggagagggacttcgctgcgtcatgaggatggacgagtagatccagcttcttcatcgcaccctcgctgctttaaacaaaagaagaagaaagttataaggacttccctcgagtaataatgtatagtcgttagatgcacatgtgtcttttttgtcaccgagaacgaacatgtatgtgttttgtgctcacggtttggtctttatatttcagtgtgtcgccaccccttctgagtgtacatgaacattttccagagtaataatagtctgc

SEQ ID NO: 2821 - DNA, 1501 bp, Triticum aestivum
cccacgcgtccgagcaaccaaccaaccaactgcaaagcagaagcaggaacgagagatcaagatcgatctttctctttgagttcccggagcgatcgagtgggttaatggcgaccgccgggaaggtgatcaagtgcaaagcggcggtggcatgggaggccgggaagccgctgtcgatcgaggaggtggaggtggcgccgccgcaggccatggaggtgcgagtcaagatcctctacaccgccctctgccacactgacgtctacttctgggaagccaaggggcaaactccggtttttccaaggatcttgggccatgaggctggaggcattgttgagagcgtcggagagggcgtgaccgagcttgtgccaggtgaccatgtcctgccggtgttcactggcgagtgcaaggattgtgctcactgcaagtcagaggagagcaacctttgtgacctcctcaggatcaatgtcgaccgaggcgtgatgatcggtgatgggcagtcccgcttcaccatcagcgggaaaccgatattccacttcgtcgggacctctaccttcagtgagtacacagtgatccatgttgggtgcctagcgaagatcaacccctcggcacccctcgacaaagtttgtgttctcagctgtggtatctcaactggtcttggtgcgacgctcaatgtcgcaaaaccgaaaaagggttcgacggtggcaattttcggtcttggagctgtaggccttgctgccatggaaggggccaagatggctggggcatcaaggatcatcggtgtggacttgaaccctgcaaaatacgaacaagccaagaagtttggctgcaccgactttgtaaacccaatggaccacaccaagccattgcaagaggtgcttgtcgagatgacaaacggtggagtcgacagagccgtggaatgcacgggtcacgtcgacgccatgatatccgccttcgaatgcgttcacgatgggtggggcgtggcggtgctggtgggtgtcccccataaggaggcggtgttcaagacccacccgatgaacttcctcaatgagaggaccttgaagggcaccttcttcggcaactacaagccgcgtaccgacctcccggaagtcgttgagatgtacatgaggaaggagctggacgtggagaagttcatcacccacagcgtgcccttctcgcagatcaacacggccttcgacctcatgctcaagggagagggacttcgctgcgtcatgaggatggacgagtagatccagcttcttcatcgcaccctcgctgctttaaacaaaagaagaagaaagttataaggacttccctcgagtaataatgtatagtcgttagatgcacatgtgtcttttttgtcaccgagaacgaacatgtatgtgttttgtgctcacggtttggtctttatatttcagtgtgtcgccaccccttctgagtgtaccatgaacattttccagagtaataatagtctgcagtttctgtgtttaagtcggtaaaaaaaaaa

SEQ ID NO: 2822 - DNA, 1303 bp, Arnica chamissonis
tttctcgactacccacttgtttaccagatcctataaatgcccatctactcagattacatcttcatttcaaaaacgataatcaaaaccagtttcagcgatcaagtaaggatgttgagtactgtaggtcacgtgattcgatgcaaagctgcggtggcttgggaggccggaaagccgctggtaattgaagaggtggaggtggcgccgccgcagaaaatggaagtccgagttaagatcctcttcacttccctctgccacactgatgtctacttctgggaagccaaagggcaaaatcctctgtttcctcggattttaggacatgaggctggaggggttgtggagagtgttggggaaggggtgactgatgttgagccaggggatcatgttctccctgttttcaccggagaatgcaaagaatgtgcacactgtaagtccgaggagagcaacatgtgcgatcttttgaggatcaacaccgacagaggagtcatgattcacgatcaaaaatccagattctcgatcaacggaaaacccgtcttccattttgtcgggacttctactttcagcgagtacaccgttgttcatgttggtagtcttgcgaaaatcaaccctcttgcccctctcgataaagtttgtgtcctcagctgtgggatctccacagggcttggagctactctgaacgtcgcaaaacccaaaaaaggctcatcggtggcgatttttggtctgggagctgtcggacttgctgctgctgaaggtgcaagaatggcaggggcttcaaggatcattggggtggatctgaatgccaacagatttgagcttgcaaagaactttggggttacagagtttgtgaacccaaaagattacaagaaaccggtgcaagaagtgattgccgagatgactaatggaggtgttgacaggagtgtggaatgcaccggtcatattgatgctatgatctctgcctttgaatgtgttcatgatggttggggtgttgctgttcttgttggtgttccacataaagatgctgtgttcaagacaagtcctctgaatctgttaaacgaaaggacgctgaagggtacctttttcggaaactataaacctcgatctgatattccgtctgttgtcgaaaagtatatgaacaaggaacttgagttggagaaattcataacacatgaagtgccattttctgagatcaataaggcctttgatttgatgcttaaaggtgaaggtcttcgttgcatcattcgtatgggtgcttaaataaatgtgtttttgcttgtcatgtactttgttttcatgttacctgtaaatg

SEQ ID NO: 2823 - DNA, 2038 bp, Theobroma cacao
tattcacaactcaaaagggtaaacgtaggacagagaatcagttgaaggaaatcaaagaaacgttgacggaaaatgccaagtactactgttggtcaggtcattcgctgtaaagctgcggtggcatgggaagccggaaagccactggtaatagaagaagtggaggtggcacctccacaggcaatggaggttcgcctgaagatcctgttcacctccctatgccatactgatgtttacttctgggaagccaaggggcagacacctttattccctcgtatatttggtcatgaagcaggcgggattgttgaaagtgttggtgagggtgttaccgacctcgaacctggtgaccatgtccttcctgttttcacaggagagtgcaaggagtgtcggcattgcaagtcagaggaaagcaacatgtgtgatctcctaaggatcaatactgacagaggggtgatgctccatgatggtaaatcaaggttctcaatcaatggacagccgatctaccattttgttgggacttcaaccttcagcgaatacactgttgttcatgttggttgtgtcgccaagattaatcctgctgctcctcttgacaaagtttgtgttctgagctgtggaatctcaacaggtctcggtgccacattgaatgttgcaaagcctggaaaaggttcaacagtagcaatatttggattgggagccgttggccttgctgctgctgaaggggctagaatggcaggtgcctcaaggattattggggttgatttaaattccaagagattcaatgaagccaagaaatttggagttacggagtttgtgaatccaaaagaccatggcaaacctgttcaggaggtgattgctgaaatgactggtggtggagttgatcgaagtgtcgaatgcactggaaacatcaatgctatgatatctgcatacgaatgtgttcatgatggatggggtgttgcagtacttgttggtgtgccaaacaaagatgataccttcaaaacacatccaatgaatgtcttgaatgagaaaacacttaagggtaccttctttggaaactacaagccgcgctctgaccttcctctggtggtggaaaaatacatgaacaaggagcttcagttggagaaattcatcacccatgaagtccctttctcagaaattaacaaggccttcgactacatgctccgtggagatagtcttcgatgcgtgatccgcatggatgcataaaataggatctaatctgtcagtgtcaaaagtctatctctgaaagacaaattaaaagataaaacgtcattgttgttggaaatattgtgaaaaagaaaaagtctcattatctggtttgagtcttaaatactgtacataacaaaataatgctcatgtttccaagtctatataaataaaattgtttggtatttttgttaaagtcttttggtgtatttttcttcatctgattctgcagtgccttgagatctaaaaccacttgtttaatgaatgtaaatccagcggtagggacttgaggctttttccttttgttttagctcagtaggaagctgtggcttttgatatatgattgcattgccatatgcgagtggttgtgtattctttaatttcattaagacaactcaatttcaacttagtagggtgctttatatattagctcagcataggaataattaagaacctatgcgtgattgttttattgcttgaatccttgaaagattgaacccttgtctttgtatttgattcaatggtaagtggtaacatgtagcactagcaggatgtccgatgtatggcggttgaacctagctattaatggaagttttatactagaatagtgtgtatcagaagtacaggcaccagattgaaggtttcaacatgcttttggattttggttaaccttgcttaagtgtaaagggggttcttatgataaagagaagaagcgttgtaaacaagtaaaaagatgtgtcagaggctgcaaagaggaagatcagagcaattcttgaagtatcgattgtagtggcaagtgaaagaaaagagaattagatag

SEQ ID NO: 2824 - DNA, 1680 bp, Citrus clementina
atcaaatattatctcactcatttaataaataagtggatgatgttttagtatgaatttttattttaaagattataatgtaagtagtaataattatattaaatttaattatatatatttattaattataagatttctagaaattttcaattacacgtgggatgggagtccactataatttggatgaagttgaaggaaccgaaaacggtgttgagagtatcatcattcatcatcaatatgtctggcacagctggtcaagttattcgctgcaaagcggcggtggcatgggaggcggggaagccactggtgattgaagaagtggaggtggctccaccacagaaaaatgaagttcgattgaagatcctcttcacctctttatgccatactgatgtttacttctgggaagccaagggacaaacacctctctttcctcgcatttttggtcacgaagctggagggattgtagaaagtgtaggggagggggtaactgatctccaaccaggagaccatgttcttcctgtgttcacaggagagtgcaaggaatgtcctcactgtcattcagaggaaagcaatatgtgtgacctcctcaggatcaatactgacaggggtgttatgattaatgatggtcagtcgagattctcgattaaggggaagccaatttaccattttgtgggcacttctaccttcagtgaatacactgttacccatgtcggttgtgttgctaagatcaatcctgctgcccctcttgacaaagtttgtgtgcttagctgtggaatctccacaggttttggggctactgttaatgtcgccaaaccgaagaagggccagtctgttgccatttttggattgggtgcagttggcctcgctgctgccgaaggggcaagggtatcaggggcttccaggatcattggtgttgatttgaacccaagcagattcaatgaagccaagaagtttggggttaccgagtttgtgaatccaaaagattatgacaaacctgttcaacaggtgattgctgacatgaccaatggtggagtggatagaagtgttgaatgtactggaagcgtccaggccatgatctcagcatttgaatgcgttcacgatggttggggtgttgctgtgcttgtgggtgtgccaaacaaagatgatgcattcaagactcatcccatgaatctgcttaatgagaggactcttaagggtaccttctttggcaactacaaacctcgctctgatcttccttctgttgttgaaaaatacatgaacaaggagttggaggtcgagaaattcatcactcacactgtgcccttctcggagataaacaaggcatttgacctcatgcttgcgggagaaagcattaggtgcatcattcgcatggatggttagatgtgtctgctgttgctgatcaatctaatggaggcagaatgaagatgatcacataattttccaagttatatattaccccgagaataagtaatttatgctgtatgtttgatgacttgctgcgaatggctttcaaagagttgtgttttctacatatttcttacagtccctttttttgttttgtttttctgtttgatgacttgctgcatatggcgtacaaagaggtgtgttttctacctatttcttacagtacttctttttgtagcttatgtaataaagattttcgtgtaaatcttctttcttata

SEQ ID NO: 2825 - DNA, 1698 bp, Eucalyptus grandis
aaaaaaccagaaactgggaaggatccgcaatacaaaaggcgctgcaagaagtcagcagagcatccatcgggcatggagagaaacagagcacgccggtcctggttttggggtgacctggttttcgcccttttcttctctcttgacgtggtctcgagataccgtcttcgaaactgagcacactggtttacagggtcgcgtggtttcgccgtttctttattccctccctcggacgttgattggtgctgaaccatgagtctttctcttcgcctcgcgggctacaaataccaccacccatcaccgtcttctcctcacatccagaaaaaggaatcatctttttcatcgctcaagaaagaagccgaggagtttggacaaccatgtcgagcactgtcgggaaagtcattcgttgcaaagctgcggtggcatgggaagccggaaagccactggtgatagaagatgtggaggtggctccaccgcaggccatggaggttcgagtgaaaatcgtcgtcacagcactctgccacacagatgtatacttttgggaagccaagggacaaaccccagttttccctcgcatatttggtcatgaagcagcagggattgtcgaaagcgtcggtgagggcgtgacagagctcaaacctggtgatcatgtgcttccagtgttcacgggggagtgcaaggagtgtcggcattgtaaatctgaggagagcaacatgtgtgacctcctcaggataaacacagacagaggagtgatgctgaacgatggcaaatcgagattctcgatcaatggaaaacccatttaccatttcgttggaacatcaacgtttagtcagtactcggtcattcatgtcggctgcctagccaagataaatcctgctgctcccatggacaaagtttgcattctcagctgtggagtctccactggtcttggggccactttgaatgttgcgaaacctccgaagggttcaactgttgctatatttggactaggtgctgttggcctttctgcagctgaaggtgccagaattgctggagcttcgaggatcattggtgtcgatctcaatccgaaaaggtttgacgaggccaagaaatttggcgttaccgagtttgtgaacccaaaagatcatcataagccagttcaggaggttcttgctgaaatgactgacgggggagtcgaccgaagcgttgagtgcacaggaagcgtcaatgccatgatctctgctttcgaatgcgttcatgatggatggggtgtggcagtacttgtcggagtgccaaacaaagacgacgccttcaagactcatccgatgaatttcctgaatgagaagacactcaagggcaccttctttggcaactacaagccgcgcaccgaccttccaaacgttgtcgagatgtacatgaggaaggagctcgagctggagaagttcatcacgcacgaagtctgtctctccgagatcaacaaggcgttcgactacatgcttaagggagagtcgctccgctgcatcatccgcatggatggatagaggagcctcagtggccgatcgggtttccgaatgtacgatcgccaataaaagtcgaaacataggatgttgaaagttcaaaagagtctccgtcttttgttcccccatgttggtttacttccctttgtacagtgtttatactatgttttactatgaatggagtttgaagaaacatgctagtccg

SEQ ID NO: 2826 - DNA, 1346 bp, Eucalyptus grandis
atgtcgaccactgtcgggaaagtcattcgttgcaaagctgcggtggcatgggaagccggaaagccactggtgatagaagaagtggaggtggctccaccgcaggccatggaggttcgagtgaaaatcgtcgtcacggcactctgccacacagatgtatacttttgggaagccaagggacaaaccccagttttccctcgcatatttggtcatgaagcagcagggattgtcgaaagcgtcggtgagggcgtgacagagctcaaacctggtgatcatgtgcttccggtgttcacgggggagtgcaaggagtgtcggcattgtaaatctgaggagagcaacatgtgtgacctcctcaggataaacacagacagaggagtgatgctgaacgatggcaaatcgagattctcgatcaatggaaaacccatttaccatttcgttggaacatcaacgtttagtcagtactcggtcattcatgtcggttgcctagccaagataaatcctgctgctcccatggacaaagtttgcattctcagctgtggagtctccactggtcttggggccaccttgaatgttgcgaaacctcccaagggttcaactgttgctatatttggactaggtgctgttggcctttctgcagctgaaggtgccagaattgctggagcttcgaggatcattggtgtcgatctcaatccgaaaaggtttgacgaggccaagaaatttggtgttaccgagtttgtgaacccaaaagatcatcataagccagttcaggaggttcttgcggaaatgactgacgggggagtcgaccgaagcatcgagtgcacaggaagcgtcaatgccatgatctctgctttcgaatgcgttcatgatggatggggtgtggcagtacttgtcggagtgccgaacaaagacgacgccttcaagactcatccgatgaatttcctgaatgagaagacactcaagggcaccttcttcggcaactacaagccgcgcaccgaccttccaaacgttgtcgagatgtacatgaggaaggagctcgagctggagaagttcatcacgcacgaagtctgtctctccgagatcaacaaggcgttcgactacatgcttaagggagagtcgctccgctgcatcatccgcatggacagatagaggagcctcagcagccgatcgggtttgcccgataagttcaatcaggtttccgaatgtacgatcgccaataaaagtcgaaacagaggatgttgaaagttcaaaagagtctccgtcttttgttccccccatgttggtttacttccctttgtacattgtgtatactatgttttactatgaatggagtttgaagaaagatgctagtc

SEQ ID NO: 2827 - DNA, 1186 bp, Triticum aestivum
aagatccatctttctctctgagttttcggagcgatcgtgggagttgatggagaccgccgggaaggtgatcaagtgcaaagcggcggtggcatgggaggcagggaagccgctgtcgatcgaggaggtggaggtggcgccgccgcaggccatggaggtgcgcgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgtgccaggtgaccatgtcctgccggtgttcactggcgagtgcaaggattgtgctcactgcaagtcagaggagagcaacctttgtgacctcctcaggatcaatgtcgaccggggcgtgatgatcggagatgggcagtcccgcttcaccatcggtgggaaaccgatattccactttgtcgggacctctaccttcagcgagtacacagtgatccatgttgggtgcctagcgaagatcaaccccgaggcacccctcgacaaagtttgtgttctcagctgtggtatctcgactggtcttggtgcgactctcaatgtcgcaaaaccgaaaaagggttcgacggtggcaattttcggtcttggagctgtaggccttgctgccatggaaggggccaagatggctggggcatcaaggatcatcggtgtggacttgaaccctgcaaaatacgaacaagctaagaagtttggctgcaccgactttgtaaacccaaaggaccacaccaagccagtgcaagaggtgcttgtagagatgacaaacggtggagtcgacagagccgtggagtgcacgggtcacgtcgatgccatggtatccgccttcgaatgcgttcacgatgggtggggcgtggcggtgctggtgggtgtcccccataaggaggcagtgttcaagacccacccgatgaacttgctgaatgagaggaccctgaagggcaccttcttcggcaactacaagccgcggaccgacctcccggaagtcgtggagatgtacatgagaaaggagctggacgtggagaagttcatcacacacagcgtgcctttctcgcagatcaacacggcgttcgacctcatgctcaagggagagggacttcgctgcgtcatgaggatggacgagtag

SEQ ID NO: 2828 - DNA, 1315 bp, Musa acuminata
gagtggcagaaatgtcgagcacggccggtcaggtcatcagatgtagagctgcggttgcttgggaggctgggaagccgctggtggtcgaagagatcgaggtggctcctccaaaggccatggaagttcgggtgaagatcctctacacttctctttgccacaccgatgtctacttctgggaagcgaagggccagactccggtgtttcctcggatcttcggccacgaagcaggaggagttgtggagagcgtgggggagggtgtgaccggtctcgctccgggagaccatgtcctgcctattttcacgggagaatgcggagaatgtgctcactgcaagtcccaagaaagcaacatgtgtgatctcctcagaataaacaccgacagaggagtgatgataggtgatgggcagtcgaggttctccatcaatggaaagccgatctaccatttcttgggcacctctaccttcagcgagtacaccgtcatccatgttggttgtctcgccaagatcaacccttcggcgcctcttgataaagtctgtgttgttagctgtggcatttcaacaggttatggtgctactgtcaatgttgcaagaccaccaaaaggctcgacagttgcggtttttggccttggagctgtaggacttgcagctgctgaaagggcaagggcctcaggggcatcaaggataatcggtgttgatcttaatcctagcagatttgagggagctaagaagtttggtgtaaatgagtttgtgaatccagcagaccataagaaaccagttcaagaggtgcttgctgaaatgaccaatggtggagtcgatcggagcatcgaatgcaccggcaacataaacgccatgatctccgcatttgaatgtgttcatgatggttggggtgttgctgtactcgtgggggttcctcacaaggatgccgtattcaagacacaccctgtgaacttcctcaacgaaaggaccttgaagggaaccttcttcggaaactacaaaccgcggtcggacattcccggagtcgtcgaaaagtatatgaacaaggagctggaactggaaaagttcataactcatagtgtgaccttctctgagatcaacaaggcttttgactacatgctccaaggtgtgggtcttcgttgtatcattcgaatggatggctagagtttttttgagcacgctcccaagttaagcttcaagcaggacttaaatgttagggaagagggaataaacttgtgttactttccaaagagagttggatcaagtggaacttctgatctgtgatctgctatgcttgtattaagtttggaggaagtgatagttac

SEQ ID NO: 2829 - DNA, 1569 bp, Beta vulgaris
cggccggggacaacaacaatatttcttatattgcccattaacccatcactcgtactatctcatttacaactttacatttcttggtgcaaattctaaacttttttttcttggataacaaacaaacaaacaaaaaaaggagaaagttttatatttcttagagaaaaattcggtccctttattttataaatagtataagaggttgaatttctgggaaaatattagaagttcaaaagatgacgagtactgctggtcaagttattcgttgcaaagctgctgtagcatgggaagctggaaaacccttggtgatggaagaagtggaggttgctcctccacagaaaatggaggttcgtgtgaagatcctcttcacctccctttgtcatactgatgtctacttttgggaggccaaggggcaaacaccagtgtttcctcggattctcggtcatgaagctggaggaattgtggaaagtgttggagagggtgtgacagacctccagccaggggaccatgtcctgcctgttttcactggtgagtgcaaggaatgtgcgcactgcaagtcagaggagagtaacatgtgtgatcttttgaggatcaatactgacaggggtgtgatgcttaatgacggaaaatcgaggttttcaatcaacggcaaacccatatttcattttgtcggcacatccacgtttagtgaatacacagtggttcatgttggttgcctggctaagatcaatcctgaagcaccccttgacaaagtctgtattctcagctgtggaatctctacaggttttggtgccactgtgaatgtcgcaagaccaaagaagggtcaaacagttgctattttcggcctaggagctgttgggcttgcggctgctgagggtgccagagtttctggtgcatcaaagatcataggggtggatctggtttctagtaggtttgaagcagcaaagaagtttggtgtgactgattttgtgaaccccaaagaccataacaaaccagtgcaagaggtaattgcggagatgaccaatggaggtgtggaccgaagcgttgaatgtactggaaatattcaagccatgatttcagcctttgaatgtgtccatgatggttggggtgttgctgttcttgttggtgtacccaacaaagatgacgccttcaagacgcaccctgtgaacttcctgaacgagaggacacttaaagggactttcttcggaaactataaaccccgtactgatattccaggggtcgtggagaagtacatgaacaaggaacttgagctggataaatttatcacccatgaagtcgcctttaaggatatcaacaaggctttcgaccttatgttgaaaggtgaaagtatcaggtgcattatccgcatggatgcatgaagttgaagatagagctctgtttatgttcttgtgttaaacgagttgtaaggatgaataaaaattagcaatgtttttttctgtatgatgttaatggatatggagggtttacttctcccatagtatatgagcttccgttgagaattagtgttcaaatttttatataccaaagttgaggaatgaaaggaccttgagc

SEQ ID NO: 2830 - DNA, 1625 bp, Ricinus communis
aatacaaaaccttaggcgccactagtaagctaagaaacaactgctagtagcacacaatggcaaacatcggcatactggatttctgtagttggcaatatttgttttagaaccagaattggatatttgtacatttgccctctctgggttttccttataaatatcaaacaaaatccctttctgttttccaattcaatcattctttagagagaaaataaaatcactatttagaagttaatacccaaaaaggaaaaagccatgtctagcacagttggtcaggtcattcgttgcaaagctgcggttgcatgggaggcagggaagccactggtgattgaagaagtggaggtggcaccgccacaggctaatgaagttcgtttgaagatcctcttcacctctttatgccacactgatgtttacttctgggaagctaagggacaagcaccattattccctcgcatatttggtcatgaagctagtggtattgtggagagtgttggtcctggtgttactgatctccaacctggcgatcatgtgcttcctgtgttcactggggagtgcaaggagtgccgtcattgcaaatcagaagagagcaacatgtgtgacctcctcaggatcaatactgataggggtgtgatgctcactgatgggaactcgaggttttctattaatgggaagccaatataccactttctgggcacctctacattcagtgaatacactgttgtccatgttggctgtgttgccaagatcaaccccgaagctcctcttgacaaagtttgtgttctcagttgtggaatatcaacaggtcttggtgccactttgaatgttgcaaaacccaagaagggtcagtctgtagcgatttttggactaggtgctgttggactagctgctgcagaaggggcaaggttatgtggagcttcaagaatcattggtgttgatttgaatcccagtcgttttgaagaagccaagaagttcggtgttaacgagtttgtgaatccaaaagattatgacaagcctgttcaacaggtacttgctgagatgactgatggaggagttgatcggagtgttgaatgcactggaagtatccaagccatgatctcagcttttgaatgcgtccatgatggctggggtgttgctgtattagtgggcgtccctaacaaggacgatgcgttcaaaactcatcctgtgaatctgctgaacgagagaactttaaaaggaaccttcttcggcaattacaagccccgcactgatcttccttctgttgtggaaaagtacatgaacaaggagctagaggtggagaaattcatcactcacagtgtgaaattctcggagattaacaaagcatttgactacatgctgaagggagagtctctgaggtgcattatttccatggagaactagagtactactctacatgatattcagttgtttactgcggccataatagattcttgtcaggttgtgttcttgagcttgtgaggagttgaataaatagtttctgcttcgctatttccacctatgaatggcctctagggagggaaaagaaaaacaaaattaagctttttctctatgtagagatgagtgattaatttaatatatatatatatatatattattttgctttgtta

SEQ ID NO: 2831 - DNA, 1607 bp, Citrus sinensis
ctgctataaatagcgagcgaacccagattccttgttcaggctaaacactgctaattttacaggtgttgagagtatcatcattcatcatcaatatgtctggcacagctggtcaagttattcgctgcaaagcggcggtggcatgggaggcggggaagccactggtgattgaagaagtggaggtggctccaccacagaaaaatgaagttcgattgaagatcctcttcacctctttatgccatactgatgtttacttctgggaagccaagggacaaacacctctctttcctcgcatttttggtcacgaagctggagggattgtagaaagtgtaggggagggggtaactgatctccaaccaggagaccatgttcttcctgtgttcacaggagagtgcaaggaatgtcctcactgtcattcagaggaaagcaatatgtgtgacctcctcaggatcaatactgacaggggtgttatgattaatgatggtcagtcgagattctcgattaaggggaagccaatttaccattttgtgggcacttctaccttcagtgaatacactgttacccatgtcggttgtgttgctaagatcaatcctgctgcccctcttgacaaagtttgtgtgcttagctgtggaatctccacaggttttggggctactgttaatgtcgccaaaccgaagaagggccagtctgttgccatttttggattgggtgcagttggcctcgctgctgccgaaggggcaagggtatcaggggcttccaggatcattggtgttgatttgaacccaagcagattcaatgaagccaagaagtttggggttaccgagtttgtgaatccaaaagattatgacaaacctgttcaacaggtgattgctgacatgaccaatggtggagtggatagaagtgttgaatgtactggaagcgtccaggccatgatctcagcatttgaatgcgttcacgatggttggggtgttgctgtgcttgtgggtgtgccaaacaaagatgatgcattcaagactcatcccatgaatctgcttaatgagaggactcttaagggtaccttctttggcaactacaaacctcgctctgatcttccttctgttgttgaaaaatacatgaacaaggagttggaggtcgagaaattcatcactcacactgtgcccttctcggagataaacaaggcatttgacctcatgcttgcgggagaaagcattaggtgcatcattcgcatggatggttagatgtgtctgctgttgctgatcaatctaatggaggcagaatgaagatgatcacataattttccaagttatatattaccccgagaataagtaatttatgctgtatgtttgatgacttgctgcgaatggctttcaaagagttgtgttttctacatatttcttacagtccctttttttgttttgtttttctgtttgatgacttgctgcatatggcgtacaaagaggtgtgttttctacctatttcttacagtacttctttttgtagcttatgtaataaagattttcgtgtaaatcttctttcttatacgccgttgcagtgttaatgatatggtaattacgccagtcgcttttgtcggcttcaaataaaaaaaaaaa

SEQ ID NO: 2832 - DNA, 1635 bp, Vitis vinifera
gactgaggagcaccatatctttggagtatctaagaaaatatgtcaggcactgctggtcaagtcatctgctgcaaagctgctgtggcatgggaagcagggaagccattagtgatagaagaagtggaggtggcacccccacaggccatggaggtccgtctcaagatcctctacacctccctatgtcacactgatgtctacttttgggaagccaagggacagacccctttgttccctcgaattttcggtcatgaagcaggagggattgtggagagtgttggggagggtgtgacagatctcaaaccaggagaccatgtgctcccaatattcaccggagagtgcaaggactgtgctcactgcaaatcagaagaaagcaacctgtgtgacctcctcaggataaacactgacagaggggtgatgatccatgatggaaaatcaagattcaccattaagggcaaacccatataccattttttgggaacttccacctttagtgagtacaccgtcgttcacgttggctgtgttgctaagatcaatcccttggcccctcttgacaaagtctgtgtcctcagttgtggcatctccacaggcctcggtgccactctcaatgtggcaaaaccgaccaagggctcaaccgtagccgtctttggactgggagctgtaggccttgctgctgcagaaggggctaggattgctggcgcttcgaggattattggggttgatttgaatccaaaaagatacgaaggggccaagaagtttggtgtgaccgactttgtgaacccaaaagaccatgagaaatcagttcaagaggttattgtggagatgaccggtggaggcgtcgacagaagcctcgaatgcactggaaatgtcaatgccatgatttctgcattcgaatgtgttcatgatggttggggtgttgcagtaattgtgggggtaccaaacaaagatgatgtcttcaagacccaccccatcaacctgttgaatgaaagaactctcaagggaaccttctttgggaactacaagccccgttctgatattccggctgtggtggaaaaatacatgaacaaggagcttgaggtggaaaaattcatcacccattcagttccgttctcagagatcaacaaggcctttgaatacatgctaaaaggggaaggccttcgatgcatcatccatatggagccatagaatatcttgagatgagagagtctaattgaataaaactaaggtgatcttgggtgactttcatattagaaggtttggttttagccggtgaaagagagcatctgtctggttgttactatgaaaataactatggttaataaaggaggtcaaaactcattccccttggctttaaatttttcaattttcagtggtgcaatgtgtgtattcatggaggttaatcctccccaggagatcaaattcttatttataattttcgcattgaggttaattagatgtgtattttggagtagcattgaaccgacttgcacccggtgattaaaatatcgcaatatttcggtgatatatcgttgaaatattgagtatcggtagacctcaacacaacatataggagagaaacatcgatacctcaatattacatttaatgatattttggggctatcaatgcggcctaacttt

SEQ ID NO: 2833 - DNA, 1388 bp, Actinidia deliciosa
ccccgcgtccggaagatgtttgtgagagagtttgtgagagaagttagagagagagagagagtgagctaggagatggcaagcactgctgggcaagtcatacgttgcagagctgcggtggcatgggaacctgggaagccactggtgatggaagaagtggaggttgcgcctccacaagcgatggaagtccgtctgaagatccttttcacctccctttgccacactgatgtttacttctgggaagccaagggacaaacaccattgtttcctcgcatatttgggcacgaagctggcgggattgttgagagtgttggggaaggtgtgacagatcttataccaggggaccatgtccttccagtatttaccggggagtgcaaagagtgtcggcattgcaagtctgaggagagcaacatgtgtgacctccttagaataaacactgaccgaggggtgatgctcaacgatggaaagtcaagattctcgattaagggaaaacctatttaccattttgtcggaacttctacttttagcgagtacactgtggttcatgttggttgtgttgccaagatcaaccctgctgctccactcgacaaagtttgcattcttagctgtggcatttccacaggtcttggtgccacgttgaatgttgcaaaaccaaaaaggggttctacggtagccatttttggattgggagcggtcggtcttgctgccgctgaaggagcgagaattgcgggtgcttcgaggattattggggttgatttgaactcaaagagatttgatgaagccaagaaatttggcgttacggaatttgtgaacccaaaagaccatgacaaacccgttcaagaggtgattgctgagatgactggcggcggagttgaccgaagtgtggagtgtactggaagtgtcaatgccatgatctctgcatttgaatgtgttcatgatggatggggtgttgccgtgcttgttggcgtgccaaacaaagacgatgctttcaaaacccatccgatgaatctcttgaatgaaaaaactctcaaaggcaccttctttggcaactataaaccacgttccgacctccctgctgtggtggaaaaatacatgaacaaggagcttgaactcgagaaattcatcacccatgaagtctctttctctgagatcaacaaggctttcgagtacatgctgaaaggagacagcctccgatgcatcatccggatggatgcttgaaaagatcggtgctgaattcaagattaccagagtgcggagaaattataataaagaattttgtttttgaacttttcagtgagtttgctggtgaaatctattttctttcattttctgtaaatatgatgccaagttgtggaatgtgagtattatatatgttcttgttgattccaaaa

SEQ ID NO: 2834 - DNA, 1477 bp, Lactuca sativa
tcgcgggatcaggaaccggcaatcaaacctggtggtcggtttacagttttggtatatacactccctcgacctataaatacacaattcttcagatttctccttcatatcaagcaattagcaaactcaactgaagttgttttcagattctctgtttcagcgatcagataacaaaaaaagattaaatgtcgagcactactaaccaggtgattcgatgcaaagcggcggtagcatgggaagccggaaagccactagtgattgaagaagtggaggtggcgccaccccaaaaaatggaagttcgaatcaaaatactcttcacctccctgtgccacaccgatgtttacttttgggaagccaagggtcagaatcccgtgtttccccgaattttaggacatgaagctggaggggttgtggagagtgtcggggaaggagtgactgagcttcagcccggagatcatgtcctccctgttttcaccggagaatgcaaagaatgcgctcactgtaagtcggaagagagcaacatgtgtgaccttttgagaatcaacaccgacaggggagtcatgattcacgatcaaaaatcccgattttccatcaacggaaaacccattttccatttcgtcggaacttcaactttcagtgaatacaccgtcgttcatgttggttgtctcgccaaaatcaaccctcttgctcctcttgacaaagtctgtgtcctcagttgtgggatctccacaggtcttggtgctactctgaacgttgcaaagcctaaaaaaggctcatctgtcgccatttttggattgggagctgtggggcttgctgctgctgaaggtgcaagaattgcaggtgcttcaaggatcattggtgttgatctcaatgccaacagatttgagcttgcaaagaaatttggagtgactgagtttgtgaaccctaaagactacaaaaaaccagtacaggaagtgattgcagagatgacaaatggaggagttgacaggagtgttgaatgcactggtcatattgatgctatgatatctgccttcgaatgtgttcatgatggttggggtgttgctgttcttgtgggtgttccacataaagatgctgttttcaagacaagtccattgaatctgttgaacgaaaggactctgaagggaactttttttggaaactataaacctcgatcagatattccttctgtggttgaaaagtatatgaataaggaacttgagttggagaagttcattacacatgaattgccattttctgagataaataaggcttttgatttgatgctcaaaggtgaaggtctccgatgcataattcggatgggtgaataaatgtagaggaaagtttttaaaaatgttgtataatagtagctcatatttcatatgataacacatcaagtgtcttctttgatcttattatgtacgcagtgtttctgtgttgggatcctgactttgagtttatatattccaatgattattagttc

SEQ ID NO: 2835 - DNA, 1372 bp, Leymus cinereus x Leymus triticoides
  misc_feature (852)..(852): n is a, c, g, or t
  misc_feature (1349)..(1351): n is a, c, g, or t
caactgcaaagcagaagcagcaacaaagatccatctttctctttgagtttccggagcgatcgggggagttgatggcgactgccgggaaggtgatcaagtgcaaagcggcggtggcatgggaggccgggaagccgctgtcgatcgaggaggtggaggtggcgccgccgcaggccatggaagtgcgagtcaagatcctctacaccgccctctgccacactgacgtctacttctgggaagccaaggggcaaactccggttttcccaaggatcttaggccatgaggctggaggcattgttgagagcgttggagagggcgtgaccgagctcgtgccaggtgaccatgtcctgccggtgttcactggtgagtgcaaggattgtgcccactgcaagtcagaggagagcaacctttgtcacctcctcaggatcaatgtcgaccggggtgtgatgatcggcgatgggcagtcccgcttcaccatcggtgggaaaccgatattccactttgtcgggacttctaccttcagcgagtacacagtgatccatgttgggtgcctagcgaagatcaaccccgaggcacccctcgacaaagtttgtgttctcagctgtggtatctcaactggtcttggtgcgactctcaatgtcgcaaaaccgaaaaagggttcgacggtggcaattttcggtcttggagctgtaggccttgctgccatggaaggggccaagatggctggggcatcaaggatcatcggtgtggacttgaaccctgcaaaaaaggaacaagctaagaagtttggctgcaccgactttgtaaacccaaaggaccacaccaagccagtccaagaggttcttgtcgagatgncaaacggcggagttgacagagccgtggagtgcacgggtcacatcgacgccatgatatccgccttcgaatgcgttcacgatgggtggggcgtggccgtgctggtgggtgtcccccataaggaggcggtgttcaagacccacccgatgaacttcctcaatgagaggaccctgaagggcaccttcttcggcaactacaagccgcgcaccgacctcccggaagtcgtcgagatgtacatgaggaaggagctggacctggagaagttcatcacccacagcgtgcctttctcgcagatcaacacggcgttcgacctcatgctcaagggagagggacttcgctgcgtcatgagcatggacgagtagatcgagcttcttcgtcacatcactcgctgctttcagatttggtgcttgagaaacacaagaaaaaaagaagtttatatgatcttacctcgtaataatgtatagtgagcatgtgttgagctcttttttgtcacaaagaannnaatgtatgtgttttgtcttca

SEQ ID NO: 2836 - DNA, 1395 bp, Elaeis guineensis
tgaaaagagtctgagagagtgatcattggaggggcatctgaggaagagtgaggtggaggtgatggcaagcactgttggtcaggtcatcaaatgcagagcggcggtggcatgggaggccgggaagccgctggtgatcgaggaggtggaggttgcgccgccgcaggcgatggaggtccggatgaagatcctttatacttccctttgccacactgatgtctacttctgggaagccaagggtcagactcctgtctttcctaggatctttggccatgaagctggagggattgtggagagtgttggggagggtgtgactgagcttgcaccaggagaccatgtcctccctatattcactggagaatgcaaagagtgtcctcattgtaaatcggaggagagcaacatgtgtgatctcctgaggataaacacagaccgtggagtgatgatccatgatgggaaatcgaggttcagtatcaaaggaaagcctgtttaccatttcttaggaacatcaactttctgcgagtacactgttgtccatgttggctgcgttgccaagattaaccccttggctccccttgataaagtttgtgttattagctgtggcgtttcaacagggtacggtgcggcagttaacgtcgcaaaaccaccaaagggatcgtcagtggctgtttttggtttgggagctgtaggtcttgctgctgcagaaggggctagagcttcaggagcatcaaggatcattggtgttgatgtcaaccccagcacgtttgaggcagcaaagaagttcggttgcacggagtttgtgaatccactggagcatgaaaaaccagtccaagaggtgattgctggaatgactaatggtggtgttgatcgaagcgttgaatgcactggcaacgtaaatgccatgatatctgcattcgaatgtgttcatgatggttggggtgttgctgtgcttgttggggtgcctcacaaagaagctgagttcaaaacacaccctctgaacttcctcaatgagaggactcttaagggaaccttctatggcaactataaaccgcgctctgacattccttcagttgttgagaagtatatgaacaaggagctagaattggagaagttcatcacccacagtttacctttctctgagatcaacaaggccttcgattacatgctcaagggggaaagccttcggtgcatcattcacatggatggttagagcaggtttacaccttggtaaagccactctggagagagactcgttacaaaataaagcatttcctgtgccatgtgaatcttagcctttgtgtttataataaaataggaaactgagcttgactgtgagatgagctgtgtcctcatcttttctgctagatgaataaaatttgcgttacatattccctgtctgtg

SEQ ID NO: 2837 - DNA, 1633 bp, Populus trichocarpa
gctcgagtgctccactgtctttccaaaagcaaattcaccgtcgacttgaaggccacgtgtgaccataaataagattaaaagataagacacagaagaaaatctcccaagtaactacgaaacgttaggcgccaccagtaatcaaaaccacttgacaaattccatcagaccactgtactgcttgcagagttgtagtcgtcattaagttcactatctctataaatcaaaccacgagacgagatagttgcagcgatcaaaacacataatccatcatctcagaaatacaaaagaagaagccatgtctagcacagttggtaaagtcattcgctgcaaagccgcggtggcatgggaagcagcgaagccactgtcgattgaagaagtggaagtggctccaccacaggctaatgaagttcgcttgaggatcctctttacctctttatgccacaccgatgtttacttttgggaagctaagggacaaacacctctgtttccacgcatattcggtcatgaagctggaggaattgtagagagcgtaggtcctggtgtgactgatctccagccaggtgaccatgtcctaccagtattcactggggagtgtggggattgcagacactgtaaatcagaagaaagcaacatgtgtgatctcctcaggatcaatactgataggggtgttatgctcactgatggaaaatcaaggttctctatcaacggaaagccaatttaccattttgttggcggttccacatttagtgaatacaccgtctgccatattgggtctgttgccaagatcaaccctgctgcccctctagacaaagtttgtattcttagctgtggaatatcaacaggccttggcgcagctttgaatgttgcaaaaccaaagaagggccacactgttgcggtttttggactgggtgccgttggtctcgctgctgctgagggagcaaggttatcaggggcttcgaggattattggggttgatttgaaccccagcagattcaatgaagcaaagaagtttggtgttactgagttagtaaacccaaaagatcatgacaagcctgttcaacaggtgattatcgagatgactgatggaggagttgatcggagtattgagtgcacaggaaatgtccaagccatgatctcagcatttgaatgtgttcatgacggttggggtgttgcagtgcttgttggtgtcccgggcaaagatgatgaattcaagacccacccaatgaatctgttaaatgagaggacccttaaagggaccttctttggcaactacaagcctcgcactgatcttcctggcgtggtggaaaaatatatgaataaggagctggaagtggagaaattcatcactcactctattcccttctcggagattaataaagcatttgattacatgctgaaaggagagggtctgaggtgcattattcgcatggagggttagctaaagaactgcaagatccacctgctacatggaggccttggctttcgatatagtagaaaagtaatgcaatggcttttggttctggtttttctatcttatgaagagataaaatataaaagttgttcgcggttgcactgtttgtggcggtggccttacggcatataataaacagagttttatctatttgaatacgtt

SEQ ID NO: 2838 - DNA, 1401 bp, Populus trichocarpa
acaacacaagaaacataaagtgcgttcaagtcaagaaacataaagttcgttcaagacaagaaagaatatgtcaagcactgctggtcaagtcattcgttgcaaagctgctgttgcatgggaagctggaaagccattagtgatggaggaagtggaggtggctccaccacaagctatggaggttcgtttgaagatcctcttcacttccctctgccatactgatgtttacttctgggaagccaaggggcaaaccccattgtttcctcgcatatttggccacgaagcaggagggattgtcgaaagtgttggtgagggggtgacagacctgaaacccggtgaccatgtgcttcctgtcttcacaggagagtgcaaggaatgccgacattgcaaatcagaggagagtaatatgtgtgatcttctgaggatcaacactgacagaggtgtgatgttgaatgatggaaagtctagattttcaattagagggcagcccatttaccactttgttggtacctcaacctttagtgagtacactgtggttcatgttggctgtcttgccaagatcaatccggctgctcctcttgacaaagtttgtatcctcagctgtggagtttcaacaggtcttggtgccaccttgaacgttgcaaaaccgaagaaaggctcgtcagtagccatttttggactaggagcagtaggccttgcagctgctgaaggggctcgaattgctggtgcttcaagaatcattggtgtcgatttgaattccaataggttcaatgaagccaagaaattcggtgtcacggagtttgtaaacccaaaagattataagaagcctgttcaagaggtgatagctgagatgaccaacggaggagttgatcgaagtgtcgagtgcactggaagtattaatgccatgatttctgcctttgaatgtgtccatgatggatggggtgttgctgtacttgttggtgtgcccaacaaagatgattctttcaaaacccatccaatgagtttcctgaatgagaagactctcaagggtaccttctttggcaactacaaaccgcgctccgaccttccttcagtggttgaaatgtacatgaacaaggagcttgagctggagaaattcatcacccatgaggtccctttctcagaaatcaacaaggcttttgactacatgcttagtggagcaagtctcaggtgtatcatccgcatggaagcgtaaaagaagactggtttgtccgtctgaatgtgagaaggaaacaataaaatcatgtttggcattgttaaatgttgaacaaagttggtgatgttttagtttcttccagtaaatttcttgtattgtaaatggcacattagcttcccagttcaggcatgtacagataaatcaaagcttcaagtgtttttctgacttca

SEQ ID NO: 2839 - DNA, 1143 bp, Fragaria vesca
atgtcaagtactgagggaaaggtcatatgctgcagagctgctgtggcatgggaagcagggaagccattagtgattgaagaagtagaggtagcacctcctcaggctaatgtagttcgtgtcaaaattctttatacctccttgtgccatactgacgtctacttctgggaagccaagggacaaaaccctttatttccaaggatctatggccatgaagcaggagggattgtggagagtgttggtgaaggggtgactgatctcaaagcgggtgatcatgtgctcccggtgttcactggggaatgtaaggagtgtgatcactgcaaatcagaagagagtaacatgtgtgacctgctcaggataaacacagacagaggagtgatgcttaatgatggaaaatcaaggttttcgattaagggcaaacctatataccactttgttgggacttcaacttttagtgtgtacaccgtgactcatgttggctgccttgccaagatcaacccccaaagtcctctagacaaagtttgcatcctcagctgtggaatctcaactggtttgggagctactcttaatgttcgaaaaccaaaaaagggctcaacagtggctgtgtttggattgggagctgtaggccttgcagctgctgaaggagcccggatggctggggcgtcaagaattattggtgttgatttgaattccaacagatttgaagaagctaagaagtttggtatcactgaatttgtgaaccccaaagaccacaagaaaccagttcaagaggtgattgctgagctgaccaatggaggagttgatcgaagcattgaatgcactggaaatattcaagccatgatacctgcatttgaatgtgtccatgatggttggggtgttgctgttcttgtgggagtgccacacaaagatgctgtcttcacgactcatccaatgaactttctgaatgagaggactctcaagggaaccttcttcggaaactacaagccacgaactgacattccctctgttgtggagaagtacatgaacaaggaactcgaggtagacaaattcatcacccatcaactcccattctcacaaatcaacaaggcatttgactacatgcttaaaggggaaggtattcgttgcataattaccatggaggagtga

SEQ ID NO: 2840 - DNA, 1287 bp, Helianthus annuus
atacgatgcaaagccgcggtggcatgggaagccggaaagccgctggtgatcgaagaagtggaagtggcgccaccgcagaaaatggaagtccgaattaagatcctcttcacttccctttgccacactgatgtttacttctgggaagccaaagggcaaaatcctgtatttccaagaattttaggacatgaagctggaggggttgtggagagtgttggggaaggagtgactgatcttcagcccggggatcatgtgcttcctgttttcacaggagagtgcaaagagtgtgctcactgtaagtccgaagagagcaacatgtgtgaccttctcaggatcaacaccgacaggggagtcatgcttcacgatcagaaatctcgattctcgatcaacggcaaacccatcttccattttgtggggacttctacttttagcgagtacacggttgttcatgttggatgtcttgcaaagatcaaccctcttgctcctcttgataaagtttgtgtcctcagctgtgggatctccacagggctaggagctactttgaatgttgcaaaaccgaaaaaaggctcttcagtggctgttttcggtctgggagctgtgggacttgctgctgctgaaggtgcaagaattgctggtgcttcaaggatcattggggttgatctcaatgccaatagatttgagcttgcaaagaaatttggggttacagagtttgtgaacccaaaagattacaagaaaccggtgcaagaagtgattgcagagttgactaatggaggagttgacaggagtgttgaatgcaccggtcatattgatgctatgatctctgcttttgaatgtgttcatgatggttggggtgttgctgttctagtgggtgtaccacataaagacgctgtgttcaagacaagtcccctgaatgtgttgaacgaaagaactctgaagggtaccttctttggaaactataaaccgcgatccgatattccttctgttgtcgaaaagtatatgaataaggaactagagttggagaaattcataacacatgaagtgccgttttctgagatcaataaagcctttgatctgatgcttaaaggtgaaggacttcgttgcatcattcgcatggatgcataaatggaaacaaatgattttcaaagtgttgtatatgagcgtataagagatgagaccggtataaattgtgtttgattgtagttgttgtattccatcttgtttatgaatgtttctatgaccgagcaaagaaaccgaggccagaaaaaagtacctcgggcgcggaccacgcta

SEQ ID NO: 2841 - DNA, 1158 bp, Gossypium hirsutum
agtaaatatgtcagcccgaagcactgctggtcaggtcattcgttgcaaagctgcggtggcatgggaggccgggagggcactgacgattgaagaagtggaggtggcaccaccgcaagcaatggaggttcgtctgaagatcctcttcacctctctctgccacactgatgtttacttttgggaagccaagggccaaactccagtctttcctcgtatatttggtcatgaagctgggggggttgttgagagtttgggtgagggtgtgacagaccttaagcccggggaccatgtgcttccggtcttcaccggggaatgcggcgactgtcgtcactgcaagtccgaggaaagcaacatgtgtgacctgctaaggatcaacactgatcgaggggtgatgcttagtgatggcaagactaggttctccattaatggaaaacccatctaccattttgttggcacatccaccttcagtgaatacactgttgtgcatgttggttgtgttgctaaagtcaatcccgccgctcctcttgacaaaatttgtgttctcagctgtggaatctctacaggtcttggtgccatcttgaatgttgcaaagcccaccaaaggttcaactgtggccatttttggactgggagcagtaggccttgctgctgctgaaggggctagaattgcaggcgcttctaggattattggagtcgatctgaatcctaacagatttgaggaagccaagaaatttggatgcaatgaattcgtgaaccctaaagactatgacaagccagttcaagaggtgctggctgaaatgacaaatggaggagttgatcgaagcgttgagtgcacgggaaacatcaatgccatgatctctgcttttgaatgtgtccacgatggatggggtgtagccgtactcgtcggtgttccgaacaaagatgatgcttttaaaacacatcccgtgaattttctgaacgagaggactctgaaaggtaccttctttggcaactacaagccccggtccgaccttccttcagttgtggagaagtacatgaacaaagagcttgagctggagaaatttataacgcatgaagtggcattctcagatataaacaaggctttcgattacatgcttgctggggagggcatccgctgtcttattcgcatggatacttgaaa

SEQ ID NO: 2842 - DNA, 1290 bp, Gossypium hirsutum
agtaaatatgtcagcccgaagcactgctggtcaggtcattcgttgcaaagctgcggtggcatgggaggccgggagggcactgacgattgaagaagtggaggtggcaccaccgcaagcaatggaggttcgtctgaagatcctcttcacctctctctgccacactgatgtttacttttgggaagccaagggccaaactccagtctttcctcgtatatttggtcatgaagctgggggggttgttgagagtttgggtgagggtgtgacagaccttaagcccggggaccatgtgcttccggtcttcaccggggaatgcggcgactgtcgtcactgcaagtccgaggaaagcaacatgtgtgacctgctaaggatcaacactgatcgaggggtgatgcttagtgatggcaagactaggttctccattaatggaaaacccatctaccattttgttggcacatccaccttcagtgaatacactgttgtgcatgttggttgtgttgctaaagtcaatcccgccgctcctcttgacaaaatttgtgttctcagctgtggaatctctacaggtcttggtgccatcttgaatgttgcaaagcccaccaaaggttcaactgtggccatttttggactgggagcagtaggccttgctgctgctgaaggggctagaattgcaggcgcttctaggattattggagtcgatctgaatcctaacagatttgaggaagccaagaaatttggatgcaatgaattcgtgaaccctaaagactatgacaagccagttcaagaggtgctggctgaaatgacaaatggaggagttgatcgaagcgttgagtgcacgggaaacatcaatgccatgatctctgcttttgaatgtgtccacgatggatggggtgtagccgtactcgtcggtgttccgaacaaagatgatgcttttaaaacacatcccgtgaattttctgaacgagaggactctgaaaggtaccttctttggcaactacaagccccggtccgaccttccttcagttgtggagaagtacatgaacaaagagcttgagctggagaaatttataacgcatgaagtggcattctcagatataaacaaggctttcgattacatgcttgctggggagggcatccgctgtcttattcgcatggatacttgaaacctatcaaacttcatttgtaatcgccatcgatcatacatatcttaatgttgtttccctttttcatgctctgtatactatatgagacagtaccaccacgcttctgttcctttgccttgatgaatcatcaaact

SEQ ID NO: 2843 - DNA, 1459 bp, Papaver somniferum
  misc_feature (141)..(141): n is a, c, g, or t
  misc_feature (162)..(162): n is a, c, g, or t
  misc_feature (186)..(186): n is a, c, g, or t
  misc_feature (192)..(192): n is a, c, g, or t
  misc_feature (222)..(222): n is a, c, g, or t
  misc_feature (228)..(228): n is a, c, g, or t
  misc_feature (231)..(231): n is a, c, g, or t
  misc_feature (240)..(240): n is a, c, g, or t
  misc_feature (327)..(327): n is a, c, g, or t
  misc_feature (421)..(421): n is a, c, g, or t
  misc_feature (456)..(456): n is a, c, g, or t
  misc_feature (465)..(465): n is a, c, g, or t
  misc_feature (474)..(474): n is a, c, g, or t
  misc_feature (498)..(498): n is a, c, g, or t
  misc_feature (673)..(673): n is a, c, g, or t
  misc_feature (787)..(787): n is a, c, g, or t
  misc_feature (823)..(823): n is a, c, g, or t
  misc_feature (850)..(850): n is a, c, g, or t
  misc_feature (859)..(859): n is a, c, g, or t
  misc_feature (862)..(862): n is a, c, g, or t
  misc_feature (949)..(949): n is a, c, g, or t
  misc_feature (976)..(976): n is a, c, g, or t
  misc_feature (1036)..(1036): n is a, c, g, or t
  misc_feature (1042)..(1042): n is a, c, g, or t
  misc_feature (1045)..(1045): n is a, c, g, or t
  misc_feature (1048)..(1048): n is a, c, g, or t
  misc_feature (1066)..(1066): n is a, c, g, or t
  misc_feature (1081)..(1081): n is a, c, g, or t
  misc_feature (1087)..(1087): n is a, c, g, or t
  misc_feature (1096)..(1096): n is a, c, g, or t
  misc_feature (1111)..(1111): n is a, c, g, or t
  misc_feature (1114)..(1114): n is a, c, g, or t
  misc_feature (1117)..(1117): n is a, c, g, or t
  misc_feature (1120)..(1120): n is a, c, g, or t
  misc_feature (1133)..(1133): n is a, c, g, or t
  misc_feature (1136)..(1136): n is a, c, g, or t
  misc_feature (1142)..(1142): n is a, c, g, or t
  misc_feature (1144)..(1144): n is a, c, g, or t
  misc_feature (1159)..(1159): n is a, c, g, or t
  misc_feature (1174)..(1174): n is a, c, g, or t
  misc_feature (1178)..(1178): n is a, c, g, or t
aaacacagaacaaatcaagatcaactagaaatttcaaaacaaatggcaaacacaactggtcaagtcatcaaatgcaaagctgctgttgcatgggaagcagggaaaccactagtaattgaagaagttgaagttgcaccaccncaagatatggaagttcgtatnaagattcttttcacttctctctgncacacngatgtttacttctgggaagccaagggacanacaccngtntttcctcgnattttcggtcatgaagcaggagggattgttgaaagtgttggtaaaggtgtgacagatatgcaaccaggagatcaagtacttccggtnttcaccggagaatgtaaggaatgtcggcactgtaaatcagaagagagcaatatgtgtgatctgcttagaatcaacactgacagaggtgtaatgntgaatgatggacaatcaaggttttcaatcaatggnaaaccgatntacaatttngtcggttgctctacttttagtgantacacggtctgttcatgttggttgtcttgctaagatcaatcctgaagctcctctggacaaagtttgtattcttagctgtgggatctctacaggtcttggtgctgctctgaatgtagcgaaacctaaaaaaggttcgaccgttgctgttttcggattgggagctgttggccttgcngcttgtgaaggggctagactatctggtgcttcaaggattattggggttgatctgaatgctaacagattcaatgaagcgaagaaatttgggtgtacagagttcgtgaatccaaangaccacacaaaaccagttcaagaggtgattgctganatgactgatggaggggtagaccgcagnattgagtgnacngggagtatccaagccatgatctctgcatttgaatgcgttcatgatggctggggtgttgcagtacttgtcggtgtgccaaacaaggangacgcattcaaaactcacccaatgaanctattgaatgagagaactctcaaaggtaccttcttcggaaactacaagccacggtcagancttccntcngtngtggaaatgtacatgaanaaggaacttgaactngagaanttcattacncatgaagttcccttngcnganatnaacaaagctttcnatntcatgntnaaaggagaaggtctnaggtgcattatccgnatgnagtgatccacagtcaccctttttatggccgggcatgtcactggttctgaattctggaagtagagattaataaaacctatgttgtgatttgaagagttgttaagtttttgtgcctggcgtgggaaataggagtagaagtgtaatgtggtctattttgatcaagttgtttggttttgttgctcaagttaggttctttgttgtttgtttagaagtaaaagaattccacttggtgaattttctttcttgttttataaataaacagaactgatatttgatactttc

SEQ ID NO: 2844 - DNA, 2066 bp, Eucalyptus grandis
ataagatgcgaatcaaaatttgagcaaatggatcaagtatagaatcatgccgatgcttgtactaaacggcataaaagaaggatcctgtatttgtatacttaatctccactaggcatgagtcctgatctttacgacaataaaataagaacccaaaccggagacagaaaccgctgcggtccaaaagtagctggaagctgactgttaacgcaccgaaagaggccaagaagggaaaaagcctccccgagattctgacctgcagaggtcaacgcaccgaaaaaaaccagaaactgggaaggatccgcaatacaaaaggcgctgcaagaagtcagcagagcatccatcgggcatggagagaaacagatcacgccggtcctggttttggggtgacctggttttcgcccttttcttctctctcacgtggtctcgagataccgtcttcgaaactgagctcactggtttacagggtggcgtggtttcgccgtttctttattccctccctcggacgttgattggtgctgaaccatgagtctttctcttcgcctcgcgggctacaaataccaccacccatcaccgtcttctcctcacatccagaagaaggaatcatctttttcatcgctcaagaaagaagccgaggagtttggacaaccatgtcgagcactgtcgggaaagtcattcgttgcaaagctgcggtggcatgggaagccggaaagccactggtgatagaagaagtggaggtggctccaccgcaggccatggaggttcgtgtgaaaattgtcgtcacagcactctgccacacagatgtatacttttgggaagccaagggacaaaccccagttttccctcgcatatttggtcatgaagcagcagggattgtcgaaagcgtcggtgagggcgtgacagagctcaaacctggtgatcatgtgcttccggtgttcacgggggagtgcaaggagtgtcggcattgtaaatctgaggagagcaacatgtgtgacctcctcaggataaacacagacagaggagtgatgctgaacgatggcaaatcgagattctcgatcaatggaaaacccatttaccatttcgttggaacatcaacgtttagtcagtactcggtcattcatgtcggctgcctagccaagataaatcctgctgctcccatggacaaagtttgcattctcagctgtggagtctccactggtcttggggccaccttgaatgttgcgaaacctcccaagggttcaactgttgctatatttggactaggtgctgttggcctttctgcagctgaaggtgccagaattgctggagcttcgaggatcattggtgtcgatctcaatccgaaaaggtttgacgaggccaagaaatttggcgttaccgagtttgtgaacccaaaagatcatcataagccagttcaggaggttcttgctgaaatgactgacgggggagtcgaccgaagcatcgagtgcacaggaagcgtcaatgccatgatctctgctttcgaatgcgttcatgatggatggggtgtggcagtacttgttggagtgccgaacaaagacgacgccttcaagacacatccgatgaatttcctgaatgagaagacgctcaagggcaccttcttcggcaactacaagccgcgcaccgaccttccaaacgttgtcgagatgtacatgaggaaggagctcaagctggagaagttcatcacgcacgaagtccgtctctccgagatcaacaaggcgttcgactacatgcttaagggagagtcgctccgctgcatcatccgcatggatggatagaggagcctcagtggctgatcaggttcgcccgataagttcgatcaggcttccgaatgtacgatcgccaataaaagtcgaaacataggatgttgaaagttcaaaagagtctccgtattttgttcccccatgttggtttacttccctttgtacagtgtgtatactatgttttactatgaatggagtttgaagaaagatgctagtccggattgtcactttttttctggtgcaaaagaactccaaagctaagttatgaaacgatatcactcttcgatgagc

SEQ ID NO: 2845 - DNA, 1384 bp, Silene vulgaris
aaaattaaagtctgttgttataaataggaggtttcatttgtcgaaagacgtacaaacaaatatttgcagaaataataatacagaaagaaacaaaaaaatgtcgaatactgctggacaagttattcgttgcaaagctgcggtagcatgggaggctggaaaaccattggtaatggaggaagtggaggtggctcctcctcagaagatggaggttcgggttaagatccttttcacttccctttgccatactgatgtttatttctgggaggccaagggccaaacaccggtttttcctcgcattctcggtcatgaagcaggaggaatcgtggaaagtgttggtgaaggtgtgactgaactacagccgggcgaccacgtcctgccagtcttcactggggaatgcaaggaatgtgctcactgcaaatccgaggagagtaacatgtgtgatttattgaggatcaatactgacagaggagtaatgcttaatgatggaaaatcaaggttttcaatcaatggcaaacccatttaccactttgtcggaacatccacatttagtgaatacactgttactcatgttggttgtcttgccaagatcaaccctaaagcaccacttgacaaagtctgtgttctaagctgtggaatctctacaggttttggtgctactgtgaatgttgctaaaccaaagaaaggtcatactgtcgctgttttcgggctaggagctgttggtctcgcggcttgcgaaggtgcaagagtttctggtgcttcaaggattattggtgtagatctccttcctagtaggtttgaagcagcaaagaatttcggtgtgaccgactttgtgaaccctaaagaccatgacaaaccagtgcaggaggtaattgctgagatgactaatggcggagttgaccgaagtattgaatgtactggaaatgtccaagctatgatttctgcttttgaatgtgtccatgatggttggggagttgctgtacttgttggtgtaccaaacaaagatgatgccttcaaaacccatcccatgaaatttctgaatgaaaggacattgaagggcactttctttggcaactacaaacctcggactgatataccgcttgttgtggagaagtacatgaacaaggagatggagctggacaaattcattacacatgaaatctccttcaaggacattaacaaggcctttgagttgatggcaaggggtgaaggtatcaggtgcatcatccgcatggacggatgaaacctacagctgcgtctttcttaatatggttaccttatagtgtcgagactcgagagagtagctaagaggctcatggtttaaatattagcaagtgtgttgtctttcagtcaataagggttgttcagatacgttgatattacgtgt

SEQ ID NO: 2846 - DNA, 1444 bp, Malus domestica
tttctcaccacaaaaaattaaacagttcaaactgttcttccaaaaagctttgagatttcaatttcatcaagtttttattggattctaagcaagaatgtctaatactgctggtcaggtcatacgctgcagagctgctgtagcttgggaagcagggaagccactggtgattgaagaagttgaggtggcaccaccacaagcaaatgaagttcgcataaagatcctttttacctctttgtgccacactgatgtctacttctgggaagccaagggacaaaaccctttatttcctagaatttatggtcatgaggcaggagggattgtggagagtgttggtgagggcgtgacggatctgaaagccggcgatcatgtcctgccggtgttcacaggggaatgcaaggactgcgctcactgcaaatcagaagagagcaacatgtgtgacctcctcaggataaacactgacaggggagtgatgctcagtgatggaaaatcaagattttcaatcaaaggcaagcctatctaccattttgttgggacttccaccttcagcgagtacactgttgttcacgttggctgccttgccaagatcaatccctcggcgcctctagacaaagtctgtctcctcagttgtggaatctccacaggtctcggagctactctaaatgttgcaaaaccaaaaaagggatcaaccgtggctgttttcggattgggagctgtaggccttgcagctgctgaaggagccaggttgtctggcgcttcaagaattatcggtgttgatttgcattcgggcagatttgaagaagcaaaaaagtttggcgtgacagaattcgtgaacccaaaagagcacgaaaaaccagttcaagaggtgattgctgagttgacgaatggaggagtggacagaagcattgaatgtacaggaagcactgaagccatgatatctgcatttgaatgtgtccatgatggttggggtgttgctgttcttgtgggagtaccacacaaagatgccgtcttcaagacgcatccggttaactttctgaatgagaggactctcaagggtacattcttcggaaactacaagactcgaacggacattccctctgtcgtggagaagtacatgaacaaggaactggagctagagaaattcatcacccacaaagtcccgttctcagaaatcaacaaggcatttgagtacatgcttaaaggggaaggtcttcgttgcataatccgcatggaggaatgaaaactaaaaaagcttcatcttttgatgttctgtgttcttaaattctaaattttcgatttcgtctttcggttttctttgttttctccagtttgatatgtttgtaatgcatatgagaatctgtttgcttctgtttggacagtttctatgaccatacatgtatatcaataaataaagaatacaagtcaatcagtttctgtttgtggaaaa

SEQ ID NO: 2847 - DNA, 1407 bp, Vitis vinifera
aaaggaaaaccaggcaaaacaactgtcaacagtgtgagaaggaatatagcctaaagatgtcaagcacagctggtcaggttatacgctgcaaagccgcggtggcatgggaagcgggaaagccgttggtgatcgaagaagtggaagtggcgcctccacaggtcatggaggtccgtctgaagatcctcttcacttctctctgccacaccgatgtttacttctgggaagccaagggacaaacccctttatttcctcgcatatttggtcatgaggcaggcgggattgtggagagcgtgggtgagggtgtgacagatctccaacctggagaccatgttcttcctgtattcaccggagaatgcaaggagtgccggcattgcaagtcggaggaaagtaacatgtgtgacctcctcaggataaacacagacagaggcgtgatgctcagtgataacaagtcaagattctctattaatggaaaacccgtttaccattttgtggggacttccacatttagtgaatacactgtggtccatgttggttgcgttgccaagatcaaccccgctgccccactcgacaaagtttgtgttcttagctgtggaatctctacaggtcttggtgctaccttgaatgttgccaaaccatcgaagggttcatcaatcgccattttcggtttaggagcagtggggcttgctgctgctgagggagctagaattgcaggtgctgccagaattattgggattgatctaaaccctaagagatttaatgacgcaaagaaatttggcgtcactgagtttttgaacccaaaggatcatgacaagcctattcaagaggtgattgctgagatgaccggtgggggagtggacagaagcgttgagtgtaccggaaatgtcaatgctatgatatctgcattcgagtgtgttcatgatgggtggggtgttgctgtactggttggtgtgccaaacaaagacgactcattcaaaacgcatcccgtgaatctattgaacgagaggactctgaagggcactttctttggcaactacaaaccccgttccgaccttccttcagtggtggaaaaatacatgaacaaggagcttgaagtggagaaattcatcacacatgaagtcccttttgcagagatcaacaaggccttcgaatatatgctgagcggggatgggcttcgatgcatcattcgcatggatgcataaaacattggagagatttgcctattccagtcggcataagtgtcttaagtactctgtcttttaatgcatttgagtttgctttttcaaagtgtgtttgcgtgatgagatcagattttgtggagagtaatgctatatgaataaagctttaatacaaacaatgtctatgcagttgcaatatataacagttttctcatctcatttattttttatt

SEQ ID NO: 2848 - DNA, 1386 bp, Actinidia deliciosa
ttctgttttcagtgaagaaggaaagggaagagatgtcaagcactgctggtcaagtcatacgttgcaaagctgcggtggcatgggaagcggggaagccactggtgattgaagaagtggaggtggcgccaccgcagaagatggaggtccggctgaagatcctctacaccgctctctgtcacactgatgtttacttctgggaagccaagggtcagaaccctgtctttcctcgaatcctcgggcacgaggcaggagggattgtggagagtgttggagagggagtgacagaacttacaccaggagaccatgtgcttccagtgttcacaggggaatgcaaggaatgtgctcactgtaagtcccaagagagcaacatgtgtgatctcctgaggatcaacacagacaggggaaccatgatccatgacggaaaatcgcgtttctcgatcaacggcaaacccatttaccacttcgttggaacgtccacttttagcgagtacacggtggttcacgaaggctgcatcgccaagatcaatccccttgcccctctcgacaaagtctgtgttcttagttgtggaatctccacaggctttggtgccactgtgaatgttgcgaaaccaacaaagggctcaacagtggctgtctttggattgggagctgtaggcctagctgctgcagagggagctagagtatccggtgcttcgaggattattggtgtggatctgaattctaacagatttgatcaagcaaagaagtttggtgtaacagagtttgtgaaccctaaagactataacaaaccagttcaagaggtgattgctgaaatgactggtggaggagtcgacagaagcatcgaatgcaccggaaacatcgatgtcatgatctcagcattcgaatgcgtccacgatggctggggtgttgctgttcttgtgggagtcccccacaaagacgccgtattcaagacacacccgatgaatttcctaaacgagaggacactaaagggcaccttctttggaaactataagccccggtcagacattccctccgtagtcgaaaaatacatgaacaaggaacttgaactggagaagttcatcactcatcaagtccccttctcagagatcaacaaggcatttgagtacatgttgaaaggcgaaagcatccgatgcatcatcagcatgaaggaatagacttaatttgcatcttttaattgtgaagtgataatagaagttgtaatccgggtgtttttatgcatctgtccaagatactcttcattaagcatgtaatttctacgggtttcttgtaattttgtcgttgaaaagcatgtaaatgaagcttttaaaaataaactttttgcgtttttttaaaataaactttttacgtttttttaaaaaaaaaaaa

SEQ ID NO: 2849 - DNA, 1571 bp, Arachis hypogaea
cccaagggggccatgcggggcattatgagccggggatcgatcaattttctctctcattactgaattgaagtttgtctctgttctttctgtgattaatcatgtctaacactgctggtcaaatcatcaagtgccgagctgcggttgcatgggaggcagggaagccattggtgattgaagaagtggaggttgcgccacctaaggccggtgaagtccgtttgaagatcctctacacctcactttgccacaccgatgtttacttctgggaagccaagggccagactccattatttcctcggatatttggtcatgaagctggagggattgtggagagtgtaggagagggagtgactcatctgaaaccaggtgaccatgccctccctgtgttcaccggagagtgtggcgaatgccctcactgcaagtcagaggagagcaacatgtgtgaccttctcaggatcaacactgacaggggtgtcatgatccatgatcaagaatcaagattctccattaagggaaaaccaatttaccactttgttgggacctccacattcagtgaatacactgtggttcatgctggatgtgttgcaaagatcaaccctgaagcaccacttgacaaagtttgtgttctcagctgtggaatctgcacaggtcttggtgccactatcaatgttgcaaaaccaaaacctggttcttctgttgctgttttggactcggagctgttggtcttgctgctgctgaaggggcaaggatttctggtgcatcaagaatcattggggttgatttagtttccagccgattcgaattagctaagaagtttggggttaatgaatttgtgaacccaaaagatcataacaaacctgtacaagaggtaattgctgaaatgaccaatggaggcgtggatcgttctgttgaatgtactggcagcatccaagctatgatctcagcatttgaatgtgtccacgatggttggggtgttgctgttcttgttggtgtgccaagcaaagacgatgctttcaaaactcatcctacgaacttcttgaatgagaggactctcaagggtaccttctatggtaactacaaaccccgaaccgatcttcctaatgttgtggagaagtacatgagaggggagttggaacttgagaaattcatcactcacactgttccgttctcagagattaacaaggcttttgatttgatgctgaaaggagagtccatcaggtgcatcattcggatggacgaataagctcaacagtgaggaaattgtccctgataggggacagttctctttcagagaaaaagaaaaagaaaaaaacaaaaataaacatcttatgtaatcccttttaaaagttatcgagtttgtggagtttgattttgaatgtagagaatggatgataggccttttcctactgccattgtgtagtttctgtttctgataaataaaaatatcgttgtcaaattcttgttcttgtcacatttttagcatttcttttatctcagtgatatagctgcatgtctgaatttttagtcccaaattggcatgttaatgtttatgtgtgataaaatgcaaccgttta

SEQ ID NO: 2850 - DNA, 1465 bp, Capsicum annuum
gcacgaggatcaactcataaacaaccaaagtttttctctattatactacaaaaaaagttctcattttttataatcagtaaaggaaatcaagaaaatatgtcaagcactataggacaagtcattcgttgcaaagctgctgtggcatgggaggctgggaagccattagtgatagaggaagtggaagtggcacctccacaaaaaatggaagttcgtcttaagattctctacacttctctatgtcatactgatgtctacttctgggaagctaagggccaaaatccagtctttcctcgaattcttggacatgaagcagcagggattgtggagagtgttggggagggagttatagaacttgcaccaggggatcatgttcttcctgtctttacaggggaatgcaaagattgttctcattgtaaatcagaagaaagcaatatgtgtagcctcttaaggattaacaccgacaggggagtgatgattcatgatggacaatcaagattttcaatcaatgggaagcccatttaccattttgttgggacctccacttttagtgaatatactgtggttcatgttggatgtgtcgcgaaaattaacccccttgctcctcttgacaaagtatgtgtccttagttgtggaatctcgacaggccttggtgcaactttgaatgttgctaaaccaacaaaaggctcaagtgtggctatatttggactaggggctgtaggccttgctgctgcagaaggagcaagaattgctggtgtgtcaaggataattggtgttgatttaaatgctagcagatttgagcaagctaagaaatttggtgtgacagagtttgtgaatccaaaggatcatagtaaaccagttcaagagataattgctgagatgactgatggcggagtcgataggagtgtggaatgtactggccatattgatgctatgatttcagcatttgaatgtgttcatgatggttggggagtggctgttcttgttggagtaccccataaagaagctgtgttcaagacacaccctatgaacttgttgaatgaaaggactctcaaaggaaccttctttggaaactacaagcctcgttcggatcttccttctgttgttgagaaatacatgaacagagagcttgaattggagaagttcatcactcatacactcccatttgctcaaatcaacaaggcttttgatttaatgttgaaaggagaaggccttcgttgcatcatcaccatggaggactaagcaagcttctagtcgcgagctactcttttataaaagaccaataaattcctcatcgtcttattttcatttgtttgtttggtgatttggtgattaagtcttcttgctctttgctagctaacagatatgctttgtcctttgcaatgccttatctatttctgttcttgtataaattgtaatttgtgttttgaatctttttagcaagtaatgttgaatgttctctagtatt

SEQ ID NO: 2851 - DNA, 1555 bp, Petunia hybrida
tggggtacggcacgaggaaactctaaactcaatattcaggcaaaacaagaaacgttatgcattattactcatatttcagtgtttagtgaagaaagaaatcaagaaaatatgtcaagcactgctggacaagtcatacgctgcaaagctgcagtggcatgggaagcagggaagccattggtgattgaggaagttgaagtgtcacttcttcagaaaatggaagttcgtctcaagatcctttacacttccctctgtcacactgatatctacttctgggaagccaagggccaaaatccagtctttcctcgtattcttgggcatgaggctgcagggattgtggaaagtgttggagagggagtaaccgaacttgtgccaggagaccatgttcttccagtgttcactggtgaatgcaagaattgtgctcattgcaaatcagaagagagcaatatgtgcagcctcttgagaatcaacactgataggggagtgatgattcatgatgatcaatcaagattctccatcaacggcaaaccgatttaccattttgttggaacctccacatttagtgagtacactgtggttcatgttggttgtgttgccaaaatcaaccctcttgcccctcttgacaaagtctgtgtcctcagttgtggaatttcaactggccttggtgcaactttgaatgttgccaaaccaacaaagggctcaagtgtggctgtgtttggactgggtgctgtaggccttgctgctgcagaaggagcaaggattgcaggggcttcaaggattatcggtgttgatttgaatgcaagcagatttgagctagcaaagaaatttggcgtgacagaatttgtgaacccgaaggactataacaaaccagttcaagaggttattgctgagatgactgatggaggagtcgacagaagcgtagagtgcactggccacattgatgctatgatttctgcatttgaatgtgtccatgatggctggggagtggctgtacttgtgggagtaccccataaagaagctgtgtttaagacacatccaatgaacttgttgaatgaaaggactctcaagggcactttctttgggaactacaagccacgatccgatctcccttctgttgtggagaaatacatgaataaggaacttgaattggagaagttcataactcatcaactcccattttctgatatcaacaaggcttttgatctcatgctgaaaggagaaggtcttcgctgcatcatccatatggagcactaagcttgtataaaaattttcccaacagtatcttcctttgttatgttattcctttgcaaaagcctataaataactggcgtttctgcttttccttccaaaacttcttgtaatttatctcgtctgtgtaaacgatcattttactgttataagttgtgccgctaacaaggcctacctattctcccaatgcaaccccgcgctcgggaattcattgataatgactttgccaggttctagggaggctactcttcttttttgtcgatcgagtgtcttgactatttttctccagtcaaatatagattattccctc

SEQ ID NO: 2852 - DNA, 1352 bp, Juglans hindsii x Juglans regia
  misc_feature (31)..(31): n is a, c, g, or t
  misc_feature (46)..(46): n is a, c, g, or t
  misc_feature (48)..(49): n is a, c, g, or t
  misc_feature (56)..(56): n is a, c, g, or t
  misc_feature (478)..(478): n is a, c, g, or t
  misc_feature (731)..(731): n is a, c, g, or t
  misc_feature (760)..(760): n is a, c, g, or t
  misc_feature (949)..(949): n is a, c, g, or t
  misc_feature (975)..(975): n is a, c, g, or t
  misc_feature (1168)..(1168): n is a, c, g, or t
  misc_feature (1237)..(1237): n is a, c, g, or t
  misc_feature (1239)..(1239): n is a, c, g, or t
  misc_feature (1244)..(1244): n is a, c, g, or t
  misc_feature (1251)..(1251): n is a, c, g, or t
ggggatctctcacaaccaaattaaacaaagngagcgattcttatcntnnttatccnaagtagtcatgtcgagcactgtcggtcaggttattaagtgcaaagccgcggtggcatgggaggctgggaagccgctggtgattgaagaagtggaagtggcaccacctcaggcaaatgaagtccgcgtgaagatccttttcacctccctttgtcacactgatgtttacttttgggaagccaaggggcagacaccgctgtttcctcgcatatttggtcatgaagctggaggaattgtggagagtgtaggcgagggtgttactgatctcaaaccaggagaccatgtcctccctatcttcactggcgagtgcaaggaatgtcgccattgtaaatcagaggaaagtaatatgtgtgacctcctcaggattaacactgacaggggtgttatgcttagcgatggcaagacgaggttctccaaaaatggncagccaatttaccattttgttggcacctctacatttagtgaatacactgttatccatgttggctgccttgccaagatcaaccctgcagccccacttgacaaagtttgtgttcttagttgcggaatatccacaggtcttggtgccactttgaatgttgcaaaacccaagaaggggcaatctgtggctgtctttggactgggtgccgtcggccttgctgctgctgaaggggcaaggattgctggggcttcaagantcattggtattgatctgaactccagtcgnttcgaggaagccaagaaatttggagtcactgaatttgtgaatccaaaagatcacgataagcctgttcaagaggtgattgctgagatgactgatggaggggtggatagggctgttgaatgtactggaagcatccaggccatgatctcagcttttgaatgcgttcatgatggttggggtgttgcagtgctngttggagtcccaaataaagacgactnattcaagactcatcctatgaacctgctgaacgagaggactcttaagggcaccttctttggcaactacaagccccgcactgatattcctggtgtcgtgggaaagtacatgaacaaggagcttgaagttgagaaatttatcactcactcagtcactttctcggagatcaacaaagcgttcgattacatgctgcangggaagtctatccgttgcattatcagcatggatgcttaaaacaccaggcgtgaactgatggaattcaanangatantagtaanaatgtttatgtttttgggcagagagaagaagatgttttacttgtctgtggttttggcgaatattaccccataaatataaatttacttatgtttttcctttg

SEQ ID NO: 2853 - DNA, 1326 bp, Prunus persica
tatcctttatgggatgatgtataaatacccacacatgctgcctttatttccaaccacaccagaaactttacactgttcttgaaagttactagtctgttacacactacaaagctttctcagagtttcaatttcaagttctcagtaaccaagaggaggaagaatgtctaaatctagtgctgttggacaggtcatacgctgcagagctgctgtagcatgggaagcagggaagccactggtgattgaagaagttgaggtagcaccaccacagacaaatgaagttcgtttgaaaatcctttatacctctttgtgccatactgatgtctacttctgggaagccaagggacaaaagcctttgtttcctagaatttatggtcatgaggcaggagggattgtggagagtgttggtgaaggcgtgacagatcttaaagccggcgatcatgtcctgcctgtgttcacaggggaatgcaaggactgtgctcactgtaaatcagaagagagcaacatgtgtgatctcctcaggataaacactgacaggggagtgatgctgagtgatgggaaatcaagattttcaattaaaggcaagccaatataccactttgttgggacttccaccttcagtgagtacactgttgttcatgttggctgccttgccaagatcaatcccttggctcctctggacaaagtctgtgtcctcagttgtggtatctccacaggtctgggagctactcttaatgttgcaaaaccgaaaaagggatcaacagttgctgtttttggattgggagctgtaggccttgcagctgctgaaggagccaggatttctggggcttcaagaattattggtgttgatttgaattccagcagatttgaagaggcaaaaaagtttggcgtaaccgaatttgtgaacccaaaggaccacaaaaagccagttcaagaggtgattgctgagctgaccaatggaggagtggacagaagcgttgaatgtactggaaatgttgaagccatgatatctgcatttgaatgtgtccatgatggttggggtgttgctgttcttgtgggagtaccacacaaagaggccgtcttcaagacgcatcccgtgaactttctgaacgagaggactctcaagggtaccttcttcggaaattacaagcctcgaaccgacattccctctgttgtggagaagtacatgaataatgaacttgagctggaaaagttcatcacccacaaagtcccattctcagaaatcaacaaggcatttgattacatgcttaaaggggaaggtcttcgatgcataatccacatggaggaatgaaagcttcatccttgatg

SEQ ID NO: 2854 - DNA, 1268 bp, Thalictrum flavum
aagagagagagagaaatatgtctagtgctgttggtcaggttattcgttgcagagctgcagtggcatgggaagcagggaagccactggtgatagaacaagtggaggtagctcctccacaggcaatggaggttcgtctgaagatcttattcacctctctttgccacactgatgtctatttctgggaagccaagggacaaacccctgtgtttcctcgcatattgggccatgaagccggcggaatcgtggagagtgttggagaaggtgtgacagatctcaaacccggtgaccatgtcctccctgtgttcactggagaatgcaaggaatgtgcccattgcaagtcagaggaaagcaacatgtgcgacctcctcagaataaatacagacagaggtgtgatgattggtgatggccaatcaaggttctctattaatgggaaaccaatatatcactttgttggaacctccacctttagtgagtacactgtttgtcatgtcggttctgttgcaaagataaaccctttggctccacttgacaaagtctgcgtccttagctgtggaattacaacaggtcttggtgccgccttgaatgttgcacaacccaagaagggttcaacagtggctatttttggattgggggcagttggccttggcgccgcagaaggtgctagaattgctggtgcttctaggattattggcatcgacatgaaccccaagcgtttcatagaagccaagaaattcggcattactgagtttgtgaaccccaaagaccatgacaagcctgttcaagaggtgcttgctgagatgactgatggaggagtagacaggagcattgaatgtactggccatgtcagtgccatgatctccgcttttgaatgcgttcatgatggttggggtgtagctgttcttgtgggcgtacctaataaagacgatgtgttcaagacccatcccatgaatttgttgaatgagaggacccttaagggtaccttcttcgggaactacaagcctaaatctgatctcccctctgttgtcgaaatgtacatgaacaaggaacttgaagtggagaagttcataacccatgaagtctcattgtccgaaatcaacaaggcttttgattacatgttggcaggtgatggtctccgctgcatcatccgcatggacgcataatttgttggcactttgacgtgggtttgtactagttgtaagcaagtcaaacataaataaggagttgcttggtttcaaacattgtatctattgaattctaagttttataat

SEQ ID NO: 2855 - DNA, 1382 bp, Taraxacum officinale
cggccggggattcaacaattaaaaacaaaccaaactgaagttgttttcagatcctctgtagcaattacataacaagaagaaaaaatgccgagcactaataaccaggtgattcgatgcaaagcggcggtggcatgggaagccggaaaacctctggtgatggaagaagtggaggtggcgccaccccagaaaatggaagttcgaatcaaaatcctcttcacctcactctgccacaccgatgtttacttctgggaagccaagggccagaatcccgtgtttcctcgaattttgggacatgaagctggaggggttgtggagagtgttggggaaggagtcactgatcttcagccgggagaccatgtcctccctgttttcaccggagaatgcaaagaatgcgctcactgtaagtcggaagagagcaacatgtgcgatcttctgagaatcaacaccgacagaggagtcatgattaatgatcaaacatctcgattttccatcaatggcaaacccattttccatttcgtcggaacttcaactttcagtgaatacaccgtcgttcacgtcggctgtcttgccaaaatcaaccctcttgctcctctcgacaaagtctgcatcctcagctgtgggatctcaacaggtcttggtgctactctgaacgttgctaaacctaaaaaagggtcatctgtcgccatttttggactcggagctgtggggcttgctgctgctgaaggtgcaagaatggcaggggcttcgaggataatcggtgttgatctcaatgccaacagatttgagcttgcaaagaatttcggggtgactgagtttgtgaacccgaaagaccacaagaaaccagttcaagaagttattgcggagatgacaaatggaggagttgacagaagtgttgaatgtaccggtcatattgatgccatgatctccgccttcgaatgtgttcatgatggttggggtgttgctgttcttgtgggtgttccgcataaagatgctgttttcaagacaagtccactgaatttattgaacgaaaggactctgaagggaaccttttttggaaactataaacctcgatcggatattccttctgtggttgaaaagtacatgaataaggaacttgagctggagaagtttataacacatgaagtgccattttctgagataaataaggcgtttgatttgatgcttaaaggtgaaggtcttcgatgcataattcggatgggtgcataaatggaaggggaattttttttataatgttgtataatagtaagtgcctttgttgatcttattatgtatgaatgtttctgttttatagataatgcccgagtttatatattcaaatgattatcagttcacttttctttgtaatccataatcttttttcc

SEQ ID NO: 2856 - DNA, 1390 bp, Arnica chamissonis
ttcttttcctgtttctcgactacccacttgtttaccagatcctataaatgcccatctactcagattacatcttcatttcaaaaacgataatcaaaaccagtttcagcgatcaagtaaggatgttgagtactgtaggtcacgtgattcgatgcaaagctgcggtggcttgggaggccggaaagccgctggtaattgaacaggtggaggtggcaccgccgcagaaaatggaagtccgagttaagatcctcttcacttccctctgtcacactgatgtctacttctgggaagccaaagggcaaaatcctctgtttcctcggattttaggacatgaggctggaggggttgtggagagtgtcggggaaggggtgactgatgttgagccaggggatcatgttctccctgttttcaccggtgaatgcaaagaatgtgcacactgtaagtccgaggagagcaacatgtgcgatcttttgaggatcaacaccgacagaggagtcatgattcacgatcaaaaatccagattctcaatcacggaaaacccgtcttccattttgtcgggacttctactttcagcgagtacaccgttgttcatgttggaagtcttgcgaaaatcaaccctcttgcccctctcgataaagtttgtatcctcagttgtgggatctccacagggcttggagctactctgaacgtcgcaaaacccaaaaaaggctcatcggtggcgatttttggtctgggagctgtcggacttgctgctgctgaaggtgcaagaatggcaggggcttcaagaatcattggggtagatctgaatgccaacagatttgagcttgcaaagaaatttggggttacagagtttgtgaacccaaaagattacaagaaaccggtgcaagaagtgattgcagagatgactaatggaggtgttgacaggagtgtggaatgcaccggtcatattgatgctatgatctctgcctttgaatgtgttcatgatggttggggtgttgctgttcttgttggtgttccacacaaagatgccgtgttcaagacgagtcctctgaatctgttaaacgaaaggacgctgaagggtacctttttcggaaactataaacctcgatctgatattccgtctgttgtcgaaaagtatatgaacaaggaacttgagctggagaaattcataacacatgaactgccattttctgagatcaataaggcctttgatttgatgcttaaaggtgaaggtcttcgttgcatcattcgtatgggtgcttaaatatgcttttgcctgtcatgtactctgttttcatgttactgtaaatgtgttgttgagatgttttgagtcctacctgtcaaagattctcagtttgaataacattatatatgagcgttatctcataatatt

SEQ ID NO: 2857 - DNA, 1439 bp, Cucumis sativus
acatcatcttttctatcccatttctatttttcttttcctctcttccattcacccctttccctctaaccaacaacaatgtccactgctggtcaggtcatcaaatgcaaagctgctgtggcttgggaggctggaaagccacttgtgattgaagaagttgaagtcgcaccaccacaagctaatgaagttcgtgttaagatccttttcactgctctttgccacactgatgtttacttctgggaggccaagggacaaaccccattgtttcctcgtatttttggacatgaggctggaggaattgttgagagtgttggagaaggagtgaaagatcttcaaccaggagatcatgttcttcctgttttcactggtgaatgtggggattgtcgtcattgtcaatctgaagaaagcaatatgtgtgatcttcttcgaatcaatactgatcgtggagttatgatcagtgatggcaaaactagattctccaaaaatggacaacccattcatcattttgttggaacctccacttttagtgaatacactgttgttcatattggttgcttggctaagatcaaccccgccgcccctcttgacaaagtttgtgttcttagctgcggcatttccacaggccttggtgccactttgaatgttgcaaagcctaaaaagggtcaatccgttgcgatctttggacttggagctgttggacttgctgctgctgaaggagcaagaatttctggggcatctaggatcattggtgttgatctgaatccggctcgtttcgaagaagcaaagaaatttggttgcaatgaatttgtgaatccaaaggatcatagcaagccagttcaagaggtgattgctgagatgacgaacggaggagttgaccgaagcgtggagtgtaccggaagcatccaagcaatgatcgcagcatttgaatgcgttcacgatgggtggggtgttgctgttcttgtgggagtcccaaacaaagacgatgcattcaaaactcatcctatgaatctccttaacgaaagaactctaaagggtacattcttcggcaactacaaaccccgaagcgacattccaggggtcgtcgagaagtacttgaacaaggagctggaactggagaagttcattacacatacagtgtcattttctgagataaacaaggcgtttgaatacatgctgaaaggggagtcgatacgatgcattattaaaatggataattgaaataataattgtgggatgagatgaaaacaagggaataagattatgtggtgattgaaagaaactggagagttctgtttttccttattatttcttagttgtgtttcatgttttttgagggtggaattttctcgatagtgttatcggctttttgtcaataccatccgacttttgggatattgtatccatattattattcaagagaaaagataaaatgcacttttgct

SEQ ID NO: 2858 - DNA, 1667 bp, Eucalyptus grandis
gaagcgacgtggattcccactctcgcttttcctaccgaccctccaagagctagagttcgggaatcagcacgggcaatttgaacttcttctctcatcgattcggcgagtctcgctcgtataaaagccaccgccgagcccgacccacttcctcacatctgcagaagaacccattcttgaagaagacagagatcagagaagacgagcagtttcagaattcgtgtggtaggatatcgctgaggtcgagatggcgagcaccgctggtcaggtcattcgctgcaaagctgcggtggcgtgggaagctggaaagccacttgtgatagaagaggtggaggtggctcctccgcaggcgatggaggttcgtatcaagatcctcttcacctcactttgccacaccgatgttttcttctgggaagccaagggacaaaccccgttgtttcctcgcatctttggtcatgaagcatcagggattgtggaaagtgttggtgaaggtgtcacagaacttgaacccggtgatcatgtccttcctgtattcaccggagaatgcaaggagtgccagcattgtaaatccgaggagagcaatatgtgtggcctgctcaggataaacacggatcgaggggttatgcttaatgataatgaatcgaggttctccatcaatgggaagcccatttaccattttgttggcacttcgactttcagtgagtacactgtggttcatgtcggttgtgttgccaagatcaaccctgcagccccaatggacaaagtctgtgttctcagctgtggtatctctacaggtctcggtgccaccttgaatgtcgcgaagccaaagaaggggcaatcagtagccatttttggactcggaactgtgggccttgctgcagccgaaggggctcgaatggctggggcttcgaggattattggagtggatcggaatccaaacagattcgtcgaagccaagaaatttggagtcaatgagtttgtgaatcccaaggaccacaacaaacctgttcaagaggtgatcgctgaaatgactgatgggggtgttgatcgaagccttgagtgcactggaaatatcgacgccatgatctctgcatttgaatgtgttcatgatggatgggggattgctgttcttgttggcgtccctagcaaagatgatgtattcaagacccatccaatgaatctcttgaacgagagaactctcaagggcactttctttggcaactacaagccaaggactgaccttccctctgttgtagaaaagtacatgaataaggaacttgatgtggagaagttcattacgcatgaggttcctttctcggagatcaataaggcattcgactacatgcttcaaggcactagccttcgctgtataatccgcatgggtgcctagaattgctgacgctgcagaccatcttgcttcaggaggaagacaaactttgccaagcttctgaagttattgctgtgccgttgttatatgcctgtgtcttgaggcgtaagagtgatgaataaatgaccctcttgctgctgtaaatggtttgctagcaattaatgaatgttcatgttcgaaatctcgtgataatgtcaactttatttgtaagatgatgagatgaaatattgcattatcagctgctttgcctcataatagaacgagagcgaaaagaaaccacaaa

SEQ ID NO: 2859 - DNA, 1345 bp, Trigonella foenum-graecum
ccactgttaactatgtccaacactgctggtcaggtcatcaagtgcagagctgcggttgcatgggaggctgggaagccactggtgatggaagaagtggaggtggcgccaccgcaggccggtgaagtccgtctcaagatactcttcacctccctttgtcatactgatgtttacttctgggaagctaagggtcagactccattgtttcctcgtatatttggtcatgaagctggagggattgtggagagcgtaggcgagggtgttactaatctgaaaccaggagatcatgccctccctgtattcacaggggaatgtggagaatgtccacattgtaactcagaggagagtaacatgtgtgatcttcttaggatcaacactgacagaggtgtcatgatcagtgacaacaagtctaggttctctattaagggacagcccatacaccatttcgttggtacttcgacattcagcgagtacactgtggttcatgctggatgtgttgcaaagatcaatcctgatgcaccacttgacaaagtttgtattctcagttgcggaatatgcacaggtcttggtgctactgtcaatgttgcaaaaccgaaacctggttcgtctgttgctatctttggacttggagccgttggccttgctgctgctgaaggggcaaggatttctggtgcatcaagaattattggggttgatttagtttccagccgatttgaattagctaagaagtttggagtaaatgagttcgtaaacccgaaagatcataacaaacctgttcaagaagtaattgctgaaatgaccaatggaggtgtggatcgtgctgttgaatgtaccggaagcatccaggccatgatttcagcattcgaatgtgtccacgatggttggggtgttgctgtacttgttggagtgccaaacaaagatgatgcattcaaaactcaccctatgaatttgctgaatgaaaggactcttaagggtaccttttatggtaactacaagccccgcaccgatcttcctaatgttgttgagaagtacatgaaaggggagctggaacttgagaaattcatcactcactcaatcccattttcagagattaacaaagcttttgattacatgctgaaaggggagtccatcagatgtatcatccgaatggaggaatgaaactaaaatagtgatgtaataataataatctcttctagggggactcacttctctctttggttgttgcaaaaataaatttcataaataatttccttttgataattgagtttgagtgaatttgtgaagtttgcatgtaagaaattgtgctgctgggattatctaatacaagataagctatattttgatttgt

SEQ ID NO: 2860 - DNA, 1345 bp, Vinca minor
acaacagtggaaccattgactatggagaatttgaagcagcacaagaatgtctagcactgctggtcaggttattaaatgcaaagcggccgtggcatgggaggcggggaagccattggtgatagaggaaatagaggtggctcctccacagaaacatgaagttcgtgtgaaaattatgtttacttccttgtgccacactgatgtttacttctgggaagctaagggtcaaacacctcttttccctcggatatttggtcacgaagctggaggcattgtggagagcgtaggtgaaggggtcactactttgaagcctggagaccatgttctacctattttcactggagaatgcggggagtgtcgccattgcaaatctaccgaaagcaacatgtgtgacctactaaggataaacactgacaggggtgaaatgcttcatgatggtaagtctcggttctcgaaagatgggaagccaatataccacttcgtcggaacttctaccttcagcgaatacactgttctccactttggttctctagcgaagatcaatcccgacgcaccacttgataaagtttgtgttcttagctgtgggatatcgacaggtcttggtgcaactttgaatgttgcaaaaccaacaaagggatcaactgttgctattttcggattaggtgctgtcggtcttgctgctgctgaaggggctcgaattgcaggggcttcaaggattattgggattgacttgaatcctaacagattcactgatgcaaagaaattcggtgtgaacgagtttgtgaacccaaaggatcataccaaacctattcagcaggttatctgtgaaatgacggatggaggagttgaccggagtgttgaatgcaccggaaatgtcaacgcgatgatctctgcctttgaatgtgttcacgatggatggggcgttgctgtacttgttggtgttccaaacaaggacgacgcgttcaaaacacatcccatgaatctgctgaatgagaggactctgaagggcaccttctttggtaactacaagcctcgttcggacattccaaacgttgtcgagaaatacatgaagaaggagctggaggtcgaaaagttcataactcaccatattcctttctcggagatcaacaaggccttcgatcttatgcttaaaggcgaaggaatccgttgcatcatccgtatggatggttaagggctcctggttgaggttcctagtgtttgcagaaccgaataaatgttaagagtttttatgagaaaataacctgagttttttactttctacaatgcaatttagaatttttgttatagtacattaagaagaaataaaatttcaaagaccttgttccaa

SEQ ID NO: 2861 - DNA, 1371 bp, Petunia hybrida
actcaagcaattcaactcagtattcagaaacaaacaaaggtctctgcaatttataaagttttcatataagtacattttagtgatcagtaaaagaaaatgtcaagcactgttggccaagtcattcgttgcaaagctgctgtggcatggcagccagggaagccattagtgattgaggaagtggaagtggcacctccacaaaaaatggaagttcgtcttaagatcctttacacttctctttgtcatactgatgtctatttctgggaagcaaaggggcaaaatccagtttttcctcgtattcttggacatgaagcagcagggattgtggagagtgtaggagagggagtaacagaactagttccaggagaccatgttcttcctgtgttcacaggggaatgtaaagattgtgctcattgtaaatcagaagaaagcaatatgtgtagtctcttaaggattaacactgataggggagttatgattcatgatggacaatcaagattttccataaatggaaagccaattttccattttgttgggacttctacatttagtgagtacactgtggttcatgttggttgtttggcgaaaatcaatccccttgctcctcttgacaaagtttgtgtcctcagttgtggaatttcgacaggtcttggtgcaactttggtggctaaaccaacaaaggggtcaagtgtggctatatttggattgggagctgtaggccttgctgctgctgaaggagcaagaattgctggtgcttcaaggataatagatgttgatttaaatgctagcagatttgaggaggctaagaaatttggtgtgacagagtttgtaaacccaaaggactatagtaaaccagttcaagaggtaatagctgagatgactgatggtggcgttgacaggagtgtggaatgtactggccacatagatgctatgatttcagcatttgaatgtgttcatgatggatggggagtggctgttcttgttggagtaccccataaggaagctgtctttaagacacaccctatgaacttgttgaacgaaaggactctcaaaggaaccttctttggaaattacaagcctcgttctgatcttccttctgttgtcgagaaatacatgaacaaagaacttgaattggagaaattcatcactcataagctcccatttgctcagatcaataaggcttttgatttaatgttgaagggagaaggtcttcgttgcatcatcaacatggaagactaaacttactatcgaaacaatgagctcctagtcgctgctccttgagacatgaccaataaacttttgtctttttcttcttttcttgtttgatgattgagttgtaacattcatgttcaattcatccatgccttttcttgc

SEQ ID NO: 2862 - DNA, 1378 bp, Prunus persica
caagacttttgatagtaaattaacagataaacatcacaaagttctgatacaatgtctacagctggtcaggttatcaagtgcagagccgcggtggcatgggaagcggggaagccactatcaattgaggaagtggaggtggcaccaccacagaaagaagaagtccgcttgaagatcctcttcacctctctttgccacactgatgtctacttctgggaagccaaaggacaacacccattgttccctcgcatttacggtcatgaagctggaggaattgtggaaagcgtaggtgagggtgtgactgatctccaaccaggagaccatgtccttccggtgttcacgggggagtgcaaggagtgcaggcactgtaagtcagaggaaagcaacatgtgtgatctcctgaggatcaatactgacaggggtactatgctcagtgatggcaagtccaggttctccaaggatggaaagccaatatatcactttcttggtacctctaccttcagtgaatacactgtatgtcatgttggttccgtcgccaagatcaaccctgcagcccctcttgaaaaagtttgtgttcttagctgtggaatatgcacaggttttggtgccaccgtgaatgttgcaaaacccaaaaagggctcgtctgttgccatttttggactgggtgctgttggtcttgctgctgctgaaggtgcaagggtttctggggctgcaagaatcattggagttgatttgaattccaaccgatttgaggaagccaagaagtttggcgtgaatgaattcgtgaatccaaaagatcataacaaacctgtgcaagaggtgattgctgaaatgaccgatgggggagtggataggagtgttgaatgcactggaagcgtccaggcgatgatttctgcatttgaatgtgttcatgatggttggggcgttgctgtactcgttggtgtgcctagtaaagatgatgcattcaaaacccatccagtgaatttcttgaatgagaggactcttaagggcaccttctatggtaactacaagccacgatccgatctgcccggggttgtggagatgtacatgaataaggagctggaagtggataaatttatcactcactcggtccctttcgctgagatcaacaaagcatttgatttgatgctttcaggacagtccatccggtgcatcattcgcatggaggattagagcaactaaggactttttatgtgataatggatagaatttatatatctatctgatgtctttaagaataattgtgttggtctggattttacaaattttgagatgataaacttaagatagtaggaggttttgacttttgtctttgatattatggtttttatgataataaaattttctgcatattttcttt

SEQ ID NO: 2863 - DNA, 1535 bp, Fragaria vesca
agagtcacagtatttcatttgacaatcctattctccaaggttgtaataacctctacacgaaatggtattctcgtacattcttcgcttaaagcggatttgtttgtctccctcactccctataaatactgccactaaccccattccagttccacatccaaaacaaacagtctttcaactcttacaaacacacacatcaaaatctcaaccatgtttgacactgctggcaaggttatcaagtgcaaagctgcggttgcctgggaagctgggaagccgctggtaattgaggaagtggaggtggcaccaccccagaaacatgaagtccgattgaagatcctcttcactgccctgtgccacactgatgtatacttctgggaagcaaagggacaaaatccactgttccctcggattttaggtcatgaagctggaggaattgtggaaagcgtaggcgagggtgtaactgaactccaaccgggagaccatgtcctcccagtgttcactggagagtgcaaggagtgcacacattgtaagtcagaggaaagcaacatgtgtgatctcctaaggatcaataccgataggggtactatgcttagtgatggcaaaaccaggttttccaaggatggaaagccaatttatcactttgttggtacctctacattcagtgaatacactgtttcacatgttggttccattgcgaagatcaaccctgcagcacctcttgacaaagtttgtgttcttagttgtggaatttgtacaggtttcggtgccactgtaaatgttgcaaagccaaaaaagggttcatctgttgccattttcggattgggtgctgttggtcttgctgctgctgaaggtgcaagggtttcaggggcttcaaggatcattggagttgatctcaactccaaccgatttgaggaagccaagaagtttggggtgaatgaatttgtgaatccaaaagatcataagaaacctgttcaggaggtgatagctgagatgactaatggtggagttgataggagtgtcgagtgcactggaagcatccaggctatgatctctgcctttgaatgtgttcatgatggatggggggttgctgtacttgttggagtgccaaacaaagatgatgcgttcaaaacccatccgatgaactttttgaacgagaggactcttaagggtactttttatggtaactacaagccccgcactgacctccctggtgttgtggagaagtacatgaacaaggagctggaattggacaaattcatcactcactctgttcctttctctgagatcaacaaggcattcgactacatgctggcaggagaaggaatccggtgcatcatccgcatggagcattagatcagtttcactttgcttgttcttatcttaataaaaagagtttatatatatcgtctatgtggtatggaaaagaataaactttggttatggaatttcaagactttactaatttgttatagttggagatttgcccttttaaatgatattgttaatgtcttaatgagaagtgttttgttctgcctcat

SEQ ID NO: 2864 - DNA, 1179 bp, Ananas comosus
aacttggaaaaagcacttttaaggagaagtgatttggtttgagagaaacattgaagagaggaggagagaagatggcaagcacagctgggaaagtgataaaatgcagagctgcggttgcgtgggaggcggggaagccgttggtgatcgaggaagtcgaggtggcgcctcctcaggcgatggaggttcggctgaagatcctctacacttccctttgccacaccgatgtctacttctgggaagctaagggtcagactcctgtttttcctcggattttcggccatgaagccggaggcgttgtagagagtgtaggcgagggcgtgaccgatctagcaccgggagaccacgtcctccctgtgttcaccggcgagtgcaaggaatgcgctcactgcaggtccgaggagagcaacatgtgcgaccttctgcggatcaacaccgacaggggagtgatgatcagcgatggcaagacgaggttttcgatcaacggaaagccgatatatcacttcgtcgggacctccacattcagcgagtacactgtcgtccatgtcggatgcgtggccaagatcaatcctctggcaccgctcgataaagtctgcgttctgagctgcggcatttcaacaggtctcggtgcgactcttaatgttgccaaaccacgaaagggttcgacggtggcgattttcggtttgggagctgtgggtctttcggctgccgagggagcgaggcttgcaggtgcatcgaggattatcggcgtcgatttgaactcaaggcgattcgaagaagctaagaagttcggcgtcaccgatttcgtgaatcctagcgaatacaacaaaccagttcaagaagttcttgctgagatgacaaacggcggagtcgatcgcagcgtggagtgcaccggcatataatgccatgatatcagcatttgaatgcgtgcacgacggctggggtgtagcagttttagttggggtgccgcacaaagatgcggtatttaagacccccccctgtgaacttcctcaatgagaaaaccctgaagggcaccttctttggcaactacaaaccgcgctccgatctcccttcagttgtagagaagtacatgaataaggagcttgaactggagaagttcatcacgcacaccgtgtcgttctcggagatcaacaagggcgttcgagtacatgctcaacgggg

SEQ ID NO: 2865 - DNA, 1351 bp, Helianthus annuus
cgcagagtacgcggggatctcaaacaacaatttaatctcatttcaagaatattctctctttcaagtatgtcgaccactacaggccaagttattcgatgcaaagctgctgtggcgtgggaagccggaaaaccgctggtgatcgaagaagtggaggtggcgccaccgcagaaaatggaagtccggattaagatcctcttcacttccctttgccacactgatgtttacttctgggaagccaaaggacaaaatcctgtattcccaagaattttaggacatgaagctggaggggttgtggagagtgttggggaaggagtgactgatctagagcccggggatcatgtgctccctgttttcactggagaatgcaaagagtgtgctcactgtaagtccgaagagagcaacatgtgtgaccttctcaggatcaacaccgacaggggtgtcatgcttcacgatcaaaaatctcgattttcgattaatggcaacccaatcttccattttgtggggacttctactttcagcgagtacacggttgttcatgttggctgtcttgcaaagatcaaccctcatgctcctcttgataaagtttgtgtcctcagctgtgggatctccacagggctaggagctactctgaatgttgcaaaaccaaaaaagggctcttcggtggcggttttcggtctgggagctgtgggacttgctgctgctgaaggtgcaagaatttctggggcttcaaggatcattggtgttgatctcaatgccagtagatttgagcttgcaaagaaattcggggttacagagtttgtgaacccaaaagattataagaagccagtgcaagaagtgattgcagagatgacaaatggaggagttgacaggagtgttgaatgcactggtcatgttgatgctatgatctctgcttttgaatgtgttcatgatggttggggtgttgctgttcttgtaggtgttccacacaaagatgctgtgttcaagaccaatccatgaatgtgttgaacgaaaggactatgaagggtaccttctttggaaactataaaccgcgatctgacattccttcggttgtcgaaaagtatatgaacaaggaacttgagttggagaagttcataacacatgaacttccattttcatacatcaataaagcctttgaactgatgcttaaaggtgaaggacttcgctgtatcattcctatggatgcttaaagcggtagtcataattcttaaatacgtgctcggctactatttacgatgctaaccatctttcatattacctgtaaatgtacttttgaggctgattgtcaaatattctcggcttgtcatgacttatttgaataaaattaatgttc

SEQ ID NO: 2866 - DNA, 1346 bp, Helianthus annuus
acaatctaatctcatttcaaaaatattctctgttcagcgatcaaacaaaagtatgtcgaccactacaggccaagttattcgatgcaaagccgcggtggcgtgggaagccggaaaaccgctggtgatcgaagaagtggaagtggcaccaccacaaaaaatggaagtccggattaagatcctcttcacttccctctgccacactgatgtttacttcagggaagccaaagggcaaaatcctgtattcccaagaattttaggacatgaagctggaggggttgtggagagtgttggggaaggggtgactgatcttcagccagggtatcatgttcttcctgttttcacaggagaatgcaaagagtgctcactgtaagtccgaagagagcaacatgtgtgaccttctcaggataaaaaccgacaggggagtcatgcttcacgatcaaaaatcccgattttcgatcaacggcaaacccgtctttcattttgtggggacttctactctcagtgagtacacggttactcatgttggatgtcttgcaaagatcaaccctcttgctcctcttgataaagtctgtgtcctcagctgtgggatctccacaggactaggagctactctgaatgttgcaaaaccgaaaaaaggctcttcggtggcggttttcgggctgggggcagtgggacttgctgctgctgaaggtgcaagaatttctggggcttcaaggattattggtgttgatcttaatgccaatagattcgagcttgcaaagaaatttggggttacagagtttgtgaacccaaaagattataagaagccagtgcaagaagtgattgcagagatgactaatggaggggttgacaggagtgttgaatgcactggtcatgttgatgctatgatctctgcttttgaatgtgttcatgatggttggggtgttgctgttctagtgggtgttccgcataaagatgccgtgttcaagacaagtcccatgaatctgttgaacgaaaggactctaaagggtaccttctttggaaactataaaccgcgatctgatattccttcggttgttgaaaagtatatgaacaaggaacttgaactggagaaattcataacacatgaagttccattttcagagatcaataaggcctttgatttgatgcttaaaggtgaaggtcttcgttgcattattcgtatggatgcttaaagtgaaagtcgtcattcttacatatgtgttatgttattacttacgttgttagccgtctttcatcttacatgtaaatgtattgttagccgtctttcatcttacatgtaaatgtactcttgaggtctgttgtcaaaagactctcggtttgtcatg

SEQ ID NO: 2867 - DNA, 1267 bp, Ipomoea batatas
atatacatacagataatactatacatacaatcacaccgaaatacagaaagctatggctgctaacactgctggtcaggtcattcgctgcaaagctgcggtggcatgggaagccggaaaacctttggttattgaggaagtagaggtggcgccgccacagaaaatggaagtccgtttgaagattctctacacctccctttgccacactgatgtttacttctgggaagccaagggtcaaactcctctattcccaagaatatttggacatgaagctggagggattgtagagagtgtaggtgaaggagtaacacatctccaaccaggagaccatgctcttccagtgttcactggggagtgtggcgattgccgccactgtaaatcagaggaaagcaatatgtgcgaccttctccggattaacactgacaggggggttatgattgaggatggaaatacgaggttcagcaaggatgggaagcccatatatcactttgttggaacttccacctttagtgaatacaccacactccatgctggttgtgttgccaagatcaatcctgaggcaccacttgacaaagtttgtgttctcagctgtggaatatccacaggatttggtgctactgtaaatgttgccaaaccgacaaaaggctcgactgttgccatttttggattgggagctgtaggccttgctgctgcagaaggagctaggttatctggggcatcgaggattattggtgttgatttgaacgccaataggtttgaagatgctaagaagtttggtgttaatgaatttgtgaatccaaaagatcacagcaagccagttcaagaggtgattgctgagatgacagatggtggggtggaccggagcgtggagtgcactggaaacatcaatgcaatgatctccgcattcgaatgtgttcatgatggttggggtgttgctgttcttgtgggggtgccgaacaaagacgatgcattcaagactcacccagtgaatctgctgaacgagaggactttgaaaggcaccttctttggcaattacaaaccaagatctgacctcccagctgtggtggagaaatacatgaaaaaggagctggagttggagaagttcatcacccaccaagtgtccttctcggaaatcaacaaagcctttgatctgatgctgaaaggggaaagcttgaggtgcatcatcaaaatggaacactgattcttcataatcattagctcttctgtgaagaagatggctggcagagtgtatccttacctaagtatgaga

SEQ ID NO: 2868 - DNA, 1364 bp, Fragaria vesca
cagtctttcaactcttacaaacacacacatcaaaatctcaaccatgtttgacactgctggcaaggttatcaagtgcaaagctgcggttgcctgggaagctgggaagccgctggtaattgaggaagtggaggtggcaccaccccagaaacatgaagtccgattgaagatcctcttcactgccctgtgccacactgatgtatacttctgggaagcaaagggacaaaatccactgttccctcggattttaggtcatgaagctggaggaattgtggaaagcgtaggcgagggtgtaactgaactccaaccgggagaccatgtcctcccagtgttcactggagagtgcaaggagtgcacacattgtaagtcagaggaaagcaacatgtgtgatctcctaaggatcaataccgataggggtactatgcttagtgatggcaaaaccaggttttccaaggatggaaagccaatttatcactttgttggtacctctacattcagtgaatacactgtttcacatgttggttccattgcgaagatcaaccctgcagcacctcttgacaaagtttgtgttcttagttgtggaatttgtacaggtttcggtgccactgtaaatgttgcaaagccaaaaaagggttcatctgttgccattttcggattgggtgctgttggtcttgctgctgctgaaggtgcaagggtttcagggcttcaaggatcattggagttgatctcaactccaaccgatttgaggaagccaagaagtttggggtgaatgaatttgtgaatccaaagatcataagaaacctgttcaggaggtgatagctgagatgactaatggtggagttgataggagtgtcgagtgcactggaagcatccaggctatgatctctgcctttgaatgtgttcatgatggatggggggttgctgtacttgttggagtgccaaacaaagatgatgcgttcaaaacccatccgatgaactttttgaacgagaggactcttaagggtactttttatggtaactacaagccccgcactgacctccctggtgttgtggagaagtacatgaacaaggagctggaattggacaaattcatcactcactctgttcctttctctgagatcaacaaggcattcgactacatgctggcaggagaaggaatccggtgcatcatccgcatggagcattagatcagtttcactttgcttgttcttatcttaataaaaagagtttatatatatcgtctatgtggtatggaaaagaataaactttggttatggaatttcaagactttactaatttgttatagttggagatttgcccttttaaatgatattgttaatgtcttaatgagaagtgttttgttctgc

SEQ ID NO: 2869 - DNA, 1494 bp, Nicotiana tabacum
  misc_feature (96)..(96): n is a, c, g, or t
gaattcggcacgaggctactctaatatatatatatcccgcaatcacataggagaataatatagtcagttcattaaaattactactcttgaacaaangaataagttactgtagcagacagataaaaagataccaacaacaatgtcagcaatgctgctggtcaggtcattcgttgcaaagctgcggttgcatgggaagcggggaagccattggtgattgaagaagtggaggtggcaccaccacaggaaggtgaagttcgcctcaagattcttttcacctccttgtgccatactgatgtttacttctgggaagctaagggccaaacaccactatttcctcgtattttcggacatgaagctggaggaattgtggagagtgtaggtgaaggtgttacagatctccaaccaggagaccatgttcttcctgtgttcactggtgaatgccagcagtgtcgacactgtaaatcagaggaaagcaacatgtgtgacctccttagaataaacacagacaggggagttatgatccatgatggtcagacaagattctccaaagatggcaagccaatatatcactttgttggaacttccacctttagtgaatacaccgttgtccattctggatgcgtcgccaagattgatccacaggcaccacttgacaaagtttgtgttctgagttgtgggatatcaacaggacttggtgcaactctgaatgttgccaaacctaccaaaggttctactgtagctatttttggcttgggagctgttggccttgctgctgctgaaggagctaggattgctggggcttctaggatcattggcattgatttgaatcccagcaggttcaatgatgccaagaagtttggtgtgacagagtttgtgaatccaaaagattatgataagcctgtccagcaggtcattgctgagatgacagatggaggtgttgaccgaagtgtcgagtgtactggaaatgtcaacgccatgatctctgcttttgaatgtgttcatgatggttggggtgtggcggtgcttgttggcgtgccaaacaaagacgatgcgttcaaaactcatccaatgaatctgttgaatgagaggactctcaagggcaccttctttggcaactacaagcccaaaactgaccttccatctgtggtgggcaagtacatgaataaggagctagagctggagaaattcattacccaccaagttccattttcagagatcaacaaagcatttgagtatatgctgaaaggggaaggtctacgttgcatgatcaccatgggacattgaaatgttaactaggaagtaaagacctagtatttatagtctcatactaataaaacaatattttattagagtaatgatgtaagtagtgtttgaagccaaaacatatctgttgtcaaaggctttagtttaatttccatattatgtaataattttactcttatgttttgaacggcttaagtatgatttccatgttatattatgcagcggccgcat

SEQ ID NO: 2870 - DNA, 1261 bp, Thalictrum flavum
agagatcatcgagaaagagagatagagagaaatatgtctagtactgctggtcaggttattcgttgcagagctgcagtggcatgggaagcagggaagccactggtgatagaacaagtggaggtagctcctccacaggcaatggaggttcgtctgaagatcttattcacctctctttgccacactgatgtctatttctgggaagccaagggacaaacccctgtgtttcctcgcatattgggccatgaagccggcggaatcgtggagagtgttggagaaggtgtgacagatctcaaacccggtgaccatgtcctccctgtgttcactggagaatgcaaggaatgtgctcattgcaagtcagaggaaagcaacatgtgcgacctcctcagaataaatacagacagaggtgtgatgattggtgatggccaatcaaggttctctattaatgggaaaccaatatatcactttgttggaacctctacctttagtgagtacactgtttgccatgtcggttctgtcgcaaagataaaccctttggctccacttgacaaagtctgcatccttagctgtggaatcacaacaggtcttggtgccgccttgaatgttgcacaacccaaaaagggttcaacagtggctatttttggattgggggcagttggtcttggtgctgcagaaggtgctaggattgctggtgcttctaggattattggcatcgacatgaaccccaagcgtttcatagaagccaagaaattcggcattactgagtttgtgaaccccaaagaccatgacaagcctgttcaagaggtgcttgctgagatgactgatggaggagtagacaggagcattgaatgtactggccatgtcagtgccatgatctccgcttttgaatgcgttcatgatggttggggtgttgctgttcttgtgggcgtacctaataaagacgatgtgttcaagacccatcccatgaattttttgaatgagaggacccttaaaggtaccttcttcgggaactacaagcctaaatctgatcttccctctgttgttgaaatgtacatgaacaaggaacttgaactggagaagttcataacccatgaagtctcattatccgatatcaacaaggcttttgattacatgttgggaggtgatggtctccgctgcatcatccgcatggacacataatttgttggcacgctgatgtgatttctactagttgtaagcaagtcatacataaataaggagttgcttggtttaaacattgtatcta

SEQ ID NO: 2871 - DNA, 1471 bp, Fragaria vesca
tatacgtacccaaagaagttagctttattttccacaacaaaatcacacagggttctgttcttacaagtctgtctgcaactacaaagcttttttcacaatttcaatttcaggttcttagctgcattacttgggtttttagtaagaatgtcaagtactgagggaaaggtcatatgctgcagagctgctgtggcatgggaagcagggaagccattagtgattgaagaagtagaggtagcacctcctcaggctaatgaagttcgtgtcaagattctttatacctccttgtgccatactgacgtctacttctgggaagccaagggacaaaaccctttatttccaaggatctatggccatgaagcaggagggattgtggagagtgttggtgaaggggtgactgatctcaaagcgggtgatcatgtgctcccggtgttcactggggaatgtaaggagtgtgatcactgcaaatcagaagagagtaacatgtgtgacctgctcaggataaacacagacagaggagtgatgcttagtgatggagaatcaaggttttcgattaagggaaaacctatataccactttgttgggacttcaacttttagtgagtacaccgtgactcatgttggctgccttgccaagatcaaccccaaagctcctctagacaaagtttgtgtcctcagctgtggaatctcaactggtttgggagctactcttaatgttgcaaaaccaaaaaagggctcaacagtggctgtgtttggattgggagctgtaggccttgcagctgctgaaggagcccggatggctggggcgtcaagaattattggtgttgatttgacttccaacagatttgaagaagctaagaagtttggtatcaccgaatttgtgaaccccaaagaccacaagaaaccagttcaagaggtgattgctgagctgaccaatggaggagttgatcgaagcattgaatgcactggaaatattcaatccattatatctgcatttgaatctgtccatgatggttggggtgttgctgttcttgtgggattgccacccaaagatgctgttttcacgactcatccaatgaactttctgaatgagaggactctcaagggaaccttcttcggaaactacaagccacgaactgacattccctctgttgtggagaagtacatgaacaaggaactggagctggacaaattcatcacccatcaactcccattctcacaaatcaacaaggcgtttgactacatgcttaaaggggaaggtattcgttgcataattaccatggaggagtgaaacttttttactttcgatgttgtatgtgaccgtacattcttactttccattttgtcttctattttctctactttgtcgagtttggtttacatgtaatgcaacaaatgtacgtccaaatgcttctgttatcctgtgaacaagtgaaatatcagatacatattcagtcaaaatactagcccttcta

SEQ ID NO: 2872 - DNA, 1396 bp, Prunus persica
acatccaaaaacacaagactttttatcgtaaattaacagataaacatcacaaagttctgatacaatgtctacagctggtcaggttatcaagtgcagagctgcggtggcatgggaagcggggaagccactatcaattgaggaagtggaggtggcaccaccacagaaagaagaggtccgcttgaagatcctcttcacctctctttgccacactgatgtctacttctgggaagccaaaggacaacacccactgttccctcgcatttacggtcatgaagctggaggaattgtggaaagcgtaggtgagggtgtgactgatctccaaccaggagaccatgtccttccggtgttcacgggggagtgcaaggagtgcaggcactgtaagtcagaggaaagcaacatgtgtgatctcctgaggatcaatactgacaggggtactatgctcagtgatggcaagtccaggttctccaaggatggaaagccaatatatcactttcttggtacctctaccttcagtgaatacactgtatgtcatgttggttccgtcgccaagatcaaccctgcagcccctcttgaaaaagtttgtgttcttagttgtggaatatgcacaggttttggtgccactgtgaatgttgcaaaacccaaaaagggctcatctgttgccatttttggactgggtgctgttggtcttgctgctgctgaaggtgcaagggtttctggggctgcaagaatcattggagttgatttgaattccaaccgatttgaggaagccaagaagtttggcgtgaatgaattcgtgaatccaaaagatcataacaaacctgtgcaagaggtgattgctgaaatgaccgatgggggagtggataggagtgttgaatgcactggaagcgtccaggcgatgatttctgcatttgaatgtgttcatgatggttggggcattgctgtactcgttggtgtgcctaataaagatgatgcattcaaaacccatccagtgaatttcttgaatgagaggactcttaagggcaccttctatggtaactacaaaccccgatccgatctgcccggtgttgtggagatgtacatgaataaggagctggaagtggataaatttatcactcactcggtccctttcgctgagatcaacaaagcatttgatttgatgctttcaggacagtccatccggtgcatcattcgcatggaggattagagcaacttgggactttttatgtgataatggagagaatttatttatatatctatctgatgtctttaagaataattgtgttggtctggattttacaaattttgagaggagcaacttaagatagtatgaggttcatgacttttgtctttgctattatggtttttatgataataaaattttctgcatattttcttt

SEQ ID NO: 2873 - DNA, 1357 bp, Solanum lycopersicum
tcaacaacaatgaatactgctggtcaggttattcgctgcaaagctgcggttgcatgggaagctggaaaacctttggtaattgaagaagtggatgttgcacctccacagaaacatgaagttcgtctcaagattctcttcacctcattgtgccacactgatgtttacttctgggaagctaagggacaaacacctttgtttcctcgaattttcggacatgaagctggaggaattgtggagagtgtaggtgaaggtgttacagatcttcaaccaggagatcatgttcttcctgtgtttaccggagaatgtcagcaatgccgtcactgtaaatcatcagaaagcaacatgtgtgaactcctaagaataaatacagacaggggagttatgattagtgatggtcaaacaagattttccaaggatggaaagccgatataccactttgttggaacttccacttttagtgaatacactgttgctcattctggttgcgtcaccaagatcgatccacaggcaccacttgacaaagtttgtgtcctgagttgcggaatatcaacaggacttggtgcgactctgaatgttgccaaacctactagaggttcttatgtggctatttttggtttgggagctgttggccttgctgctgctgaaggagctaggctagctggggcttctaggatcattggtattgatttgaatcccagcagattcaatgatgccaagaaattcggtgtcacagagtttgtgaatccaaaagatcatgataagcctgttcaggaggtgatcgctgagatgaccaatggaggtgttgaccggagtgtcgagtgtactggaaatgttaacgctatgatctctgcttttgaatgtgttcatgatggttggggtgtggctgtgcttgttggcgtgccaaacaaagacgatgcattcaaaactcatcccatgaacctgttgaatgagaggacactcaagggcaccttctttggtaactacaagcccaaaactgatctcccatctgtggtggccaagtacatgaataaggaactagagctggagaagttcatcacccatcaagtaccattttcagagatcaacaaagcatttgacattatgctgaaaggggaaggcctccgttgcatgatcactatgggacgttgaaatatgctaaatagggaaaataggacagtatattacctagtaatatagagcttgaatgtaataaaacaaacggtattttaatgggtaaaataatgttaaaagtagagtttggaggcaaagtatatgttttctaaaaggcctcctgagtttgctcaacatattgtgtaataatatttgcatattttgaaagactttttgagttttggtc

SEQ ID NO: 2874 - DNA, 1672 bp, Theobroma cacao
ttgtttcgtggtaaagtactttgaaaagtcttaactgttgctaggaactaaaatctatgtttttatttttgaaccataaacatgtaggattacatactaactattcacttcaccttcaaatattccctctagcctaggcataaagctttaaatatctccacaaactgctatcacattccaccaagaacaaaaccgatcacggctccaaaacaaccttttagagtgaccttgaaactttaacttgtatattttcttaaatctttttacaaagggaagaagatcaaagatgtcgagcactgcctctcaggtgatacgctgcaaagctgctgtggcatgggagtccgggaaaccactggtgatacaagaagtagaggtggcaccaccgcaggcaagtgaagttcgtttgaaaattctttttacctctttgtgccatactgatgtctacttctgggaagccaagggtcagaacccattatttcctaggatttatggccatgaagcaggcgggattgtggagagtgttggtgaatgtgtgacagaactcaaacctggtgaccatgtcctgcctgtgttcacaggggaatgcatggattgtgctcactgcaaatcagaagagagcaacatgtgtgacttgctcagggttaacactgacaggggtgtaatgcttaacgatgagaaaacaagattttcaatcaatgggaagcctatttaccattttgttgggacttccactttcagtgagtacactgtggttcacgctggctgtgttgccaagatcaaccccttggcttctcttgacaaagtttgtgttctcagctgtggaatatccacaggactgggtgctactcttaatgttgcaaaacctcccaagggctcaacggtggctgtctttggattgggagccgtgggacttgcagctgctgaaggggccaggattgctggtgcttcaaggattattggtgttgatattaactcaaatagatttgaaggagcaaagaaatttggcgtgacagagtttgtgaacccaaaagactacaagaagccagttcaggaggtgattgctgagataaccgatggtggagtggacagaagcattgaatgtactggaaatgtggatgctatgatctctgcatttgaatgtgtccatgatggctggggtgttgctgttcttgtgggggtgccacacaaagatgctgtgttcaagactcaccccataaatttgttgaatgagaggactctcaaaggtaccttcttcgggaactacaaaccccgttccgatcttccgtcagtggtggaaaagtacatgagcaaggaacttgaactagagaaattcataacacactcagtcccattctctgagatcaacaaggcttttgaatacatgcttaaaggcgaaggccttcgatgcatcatccgtatggagtagaggtagaacagcgagagcgtgaaaaggagtcaataaaacgtcgtcagtctttacgacatttgtgtgcttcaatatctcagtgtcaaatgtttgttatggcctctgagtagagcatgttaaaatcctggttttatgcacatggatgctaaatactacttaactattaataaatcccacctgcaagtatcatccattggttttggtttcgattttcttttctagttataataaaaatacaaatcgagg

SEQ ID NO: 2875 - DNA, 1357 bp, Humulus lupulus
gaactacaatcatctaagctgatctatcatagctttgaaaaaactgttactttcacaaaatcacagtcgttttctgaggagaaaaagaagaagaagaagaagccatgtcgagcacagctggtcaggtcattaagtgcagagctgctgtggcatgggaagctgggaagccactggtaattgaggaggttgaggtggcaccgccacaggctaatgaagttcgtttgaagatcctctttaccgctctttgccacacagatgtttatttctgggaagccaagggtcaaacaccggtgtttcctcgcatatttggtcatgaggcaggaggaattgttgagagtgttggtgagggtgtcaccgagcttcagccaggtgaccatgttctgccggtgttcaccggggagtgcggggattgccgccactgcaagtcgccggagagcaacatgtgtgatcttctaaggatcaacacggacagaggtgttatgctcaatgacgggaagaccagattctccaagaatggccagcccatttaccattttgttgggacctctaccttcagtgaatacactgttgtccattctggatgtgttgccaagatcaaccctgctgccccactcgacaaagtttgcgtacttagctgtggaatttgcacaggtcttggtgccactttgaatgttgctaagccagcaaagggatcaactgttgccatttttggattgggtgctgttggtcttgctgctgccgaaggtgcgaggatggctggcgctgcgaggatcatcggtgttgatttgaactcgaaccgattcgaagaagccaaaaagtttggagtcaatgagtttgtgaatccaaaagatcatagcaaaccagttcaagaggttattgctgaaatgaccgacggaggagtggacaggagtgtcgaatgtaccggaagcgtccaggccatgatctctgcctttgaatgtgttcatgatggatggggtgttgctgtactagtaggtgtgccaaacaaagatgatgcattcaagacccatccagtgaacttcttaaacgagaggactctaaagggtaccttctacggtaactataaaccccggtctgatcttcccggtgttgtggaacagtacatgaacaaggagttggacatagagaaattcatcactcacacagtcccattctctgagatcaacaaggcattcgagtacatgctgaaaggggagtctatccgttgcatcatccgcatggaagagtagagtgttgctcagatgggttctctgtgttccatcgaatagtcgttgagtgttgataatcgaagagaatatgccatgaaggagtttatatgtccagctaaataaatatgtct

SEQ ID NO: 2876 - DNA, 1312 bp, Zostera marina
tttttttgtttcaagatagacaaggaagagaaatggcgagtacagcaggaaaggtcatcaaatgcaaagctgccgttgcatgggaggcagggaaaccattggttatggaggaagtcgacgtcgcaccaccgcagaaagatgaggttcgtgtcaagatcaagttcacggcactctgtcacaccgatgtcttcttttgggaagccaagggccaaacgccggtgttccctcgtatctttggtcacgaggccggagggattgtggaaagtgtcggggaaggcgtgaccgacgtcgtgccgggagatcacgtcctcccggttttcactggggaatgtaaagaatgccgccactgcaaatcagaagagagtaatatgtgcgatctccttcgaataaacaccgatcggggtgtcatgctcgctgatggaaaatctagattctccatcaaaggcaaaccaatctaccattttgtcggaacctccactttcagtgaatacactattgtgcatgttggttgtttggctaagatcaaccctgaagcacctcttgacaaagtttgcattcttagctgtggaatttccaccggatttggcgcgacggttaatgtggcaaagccgaccaaaggttcttccgtcgccgtcttcggcctgggagccgtcggtctttctgcttgtgaaggagcgagggtttctggagcggcgagaataatcggtatcgacatcaatcctgatagatttgaagaagctaggaaattcgggtgcactgattttgtgaatccaaagggacacaccaaacctgttcaagaggttattgctgaaatgaccgacggtggagtagatcgttgtttggaatgtactggtaacatcaacgccatgatttctgcattcgaatgcgtccatgatggatggggtgtggctgttctggtgggagttcctcagaaagatgcagttttcaagactcacccactgcaatttctgagtgaaaaaacactcaagggaaccttctatggcaactacaaacctcgtaccgacatccctcgtgtcgtcgatctgtatatgaataagggattggaattggagaaattcataacccatgaagtcgccttcgctgacatcaacaaagcttttgatctgatgctcagtggtcagggtatccgttgcatcattcgcatggatgattagttttttcaaccttaagattttaccctgcatcttgctacttctgttgtaatggattttaccctctgtaatatttactaaaaagaaataaatgtcacctatgacaatggtcgttatcttaataaattcaattcaattca

SEQ ID NO: 2877 - DNA, 1238 bp, Malus domestica
aacacttcaaactgttctttcaaaaagctttaagatttcaatttcatcaagttttcattggattctaagcaagaatgtctaatacggctcaggtcatacgctgcagagctgctgtagcttgggaagcagggaagccactggtgattgaagaagttgaggtggcaccaccacaagcaaatgaagttcgcataaagatcctttttacctctttgtgccacactgatgtctacttctgggaagccaagggacaaaaccctttatttcctagaatttatggtcatgaggcaggagggattgtggagagtgttggtgagggcgtgacggatctgaaagccggcgatcatgtcctgccggtgttcacaggggaatgcaaggactgcgctcactgcaaatcagaagagagcaacatgtgtgacctcctcaggataaacactgacaggggagtgatgctcagtgatggcaaatcaagattttcaatcaaaggcaagcctatctaccactttgttgggacttccaccttcagtgagtacactgttgttcatgttggctgccttgccaagatcaatccctcggcacctctagacaaagtctgtgtcctcagttgtggaatctccacaggtctcggagctactctaaatgttgcaaaaccgaaaaagggatcaaccgtggctgttttcggattgggagctgtaggccttgcagctgccgaggagccaggttgtctggtgcttcaagaataatcggtgttgatttgcattcgagcagatttgaagaagcgaaaaagtttggcgtgacggaatttgtgaacccaaaagagcacaaaaaccagttcaagaggtgattgctgagctgacgaatggaggagtggacagaagcattgaatgtacaggaaatgttgaagccatgatatctgcatttgaatgtgtccatgatggttggggtgttgctgttcttgtgggagtaccacacaaagtagccgtcttcaagacgcatcaggttaactttctgaacaagagcaccctcaagggtacattcttcggaaactacaagcctcgaactgacattccctctgtcgtggagaagtacatgaacaaggaattggagctagaaaaattcatcacccacaaagtcccattctcagaaatcaacaaggcatttgagtgcatgcttaaaggggaaggtcttcgttgcataatccacatggaggaatgaaaactgaaaaggcttcatctttgatg

SEQ ID NO: 2878 - DNA, 1318 bp, Triticum aestivum
aaacctgtgactgcaagaagaagaagaagaaacagcgagggggggcatcgactgaagctcttggagtgaaatggcgaccgccgggaaggtgatcaagtgcaaagcggcggtggcgtgggaggccgggaagccgctgtctatggaggaggtggaggtggcgccgccgcaggccatggaggtgcgcgtcaagatcctctacaccgcgctctgccacactgacgtctacttctgggaggccaagggccaaactccggttttccctaggatcttgggccatgaagctggaggcattgtggagagtgttggtgagggcgtgactgagctggtgccgggagaccatgtcctcccggtgttcaccggagagtgcaaggagtgtgcccactgcaggtcagaggagagcaacctctgtgacctcctcaggatcaatgtcgaccgcggtgtcatgatcggcgacgggcagtcccgcttcaccatcgacggcaaaccgatcttccactttgttgggacgtccaccttcagcgagtacaccgtgatccatgtcgggtgcctcgccaagatcgaccccgaggcgcccctcgacaaagtctgcctccttagctgcggtatctcaaccgggctaggtgccaccctcaacgtcgccaagccgaagaagggtatgacagtggcgatttttggtcttggagctgtgggtctcgctgccatggaaggggccaggatgtccggcgcatcgaggattatcggtgtggacttgaaccctgcgaaacacgaacaagctaagaaatttggctgcaccgactttgtgaaccccaaggaccacaccaagccagtgcaagaggtgatcgtggagatgaccgatggcggagtcgaccgggcggtggagtgcacgggcaacgccgacgccatgatctccgccttcgaatgcgtgcacgatgggtggggggtggcggtgctggtgggcgtggcgcacaaggaggcggtgttcaagacccaccccatgaacttcctcaacgagaggacgctgaggggcaccttcttcggcaactacaagccgcgcacgggcctccccggcgtggtggacatgtacatgaggaaggagctggagctggacaagttcatcacccacagcgtgcccttctcgcagatcaacacggccttcgacctcatgctcaagggggaaggcctgcgctgcgtcatcaggatggaggagtagaggtagagcgcctggctcttcacccctcgctgctatcgtacaacacacatgtatcacctctttgctactccctctgtaaagaaatatatttctttattacagatgagg

SEQ ID NO: 2879 - DNA, 1333 bp, Triticum aestivum
tcgactgaactcttgcatgaaatggctaccgccgggaaggtgatcaagtgcaaagcggcggtggcgtgggaggccgggaagccgctgtcgatggaggaggtggaggtggcgccgccgcaggccatggaggtgcgcgtcaagatcctctacaccgccctctgccacaccgacgtctacttctgggaggccaagggccaaactccggttttccctaggatcttgggccatgaagctggaggcattgtggagagcgtcggcgagggcgtgacggagctggtgccgggagaccatgtcctcccggtgttcaccggagagtgcaaggagtgtgcccactgcatgtcagaggagagcaacctctgtgacctcctgaggatcaatgtcgaccgcggcgtgatgatcggcgacggccagtcccgcttcaccatcgacggaaaacccatcttccacttcgtcgggacgtccaccttcagcgagtacaccgtgatccatgtcgggtgcctcgccaagatcgaccccgaggcgcccctcgacaaagtctgcctccttagctgcggtatctcaaccgggctaggtgccaccctcaacgtcgccaagccgaagaagggtatgacagtggcgattttcggtcttggagctgttggccttgctgccatggaaggggccaggatgtccggcgcatcgaggattatcggtgtggacttgaaccctgcaaaacacgaacaagctaagaaatttggctgcaccgactttgtgaaccccaaggaccacaccaagccagtgcaagaggtgatcgtggagatgaccgacggcggagtcgaccgggcggtggagtgcactggcaacgccgacgccatgatctccgccttcgaatgcgtgcacgatgggtggggcgtggcggtgctggtgggcgtggcgcacaaggaggcggtgttcaagacccaccccatgaacttcctcaacgagaggacgctgaggggcaccttcttcggcaactacaagccgcgcaccgacctcccaggcgtcgtcgacatgtacatgaggaaggagctggagctggacaagttcatcacccacagcgtgcccttctcgcagatcaacacggccttcgacctcatgctcaagggggaaggcctgcgctgcgtcatcaggatggatgagtagagtagagcacctggctcttcttcatccctcgctgctattgcactacaacacacatgtattacctctttgcttaccttttttttaagccacgccccttaggactccggttcatgaaataaacagaagaaggttgctcgattaatttgcggaaacccaagtgaaaaccataaaa

SEQ ID NO: 2880 - DNA, 1395 bp, Triticum aestivum
gaagaagaagaagaaagagtgagggagatatcgactgaagctcttgcagtgaaatggctaccgccgggaaggtgatcaagtgcaaagcggcggtggcgtgggaggccgggaagccgctgtcgatggaggaggtggaggtggcgccgccgcaggccatggaggtgcgcgtcaagatcctctacaccgccctctgccacaccgacgtctacttctgggaggccaagggccaaactccggttttccctaggatcttgggccatgaagctggaggcattgtggagagcgtcggcgagggcgtgacggagctggtgccgggcgaccatgtcctcccggtgttcaccggagagtgcaaggagtgtgcccactgcatgtcagaggagagcaacctctgtgacctcctgaggatcaatgtcgaccgcggcgtgatgatcggcgacggccagtcccgcttcaccatcgacggaaaacccatcttccacttcgtcgggacgtccaccttcagcgagtacaccgtgatccatgtcgggtgcctcgccaagatcgaccccgaggcgcccctcgacaaagtctgcctccttagctgcggtatctcaaccgggctaggtgccaccctcaacgtcgccaagccgaagaagggtatgacagtggcgattttcggtcttggagctgttggccttgctgccatggaaggggccaggatgtccggcgcatcgaggattatcggtgtggacttgaaccctgcaaaacacgaacaagctaagaaatttggctgcaccgactttgtgaaccccaaggaccacaccaagccagtgcaagaggtgatcgtggagatgaccgacggcggagtcgaccgggcggtggagtgcactggcaacgccgacgccatgatctccgccttcgaatgcgtgcacgatgggtggggcgtggcggtgctggtgggcgtggcgcacaaggaggcggtgttcaagacccaccccatgaacttcctcaacgagaggacgctgaggggcaccttcttcggcaactacaagccgcgcaccgacctcccaggcgtcgtcgacatgtacatgaggaaggagctggagctggacaagttcatcacccacagcgtgcccttctcgcagatcaacacggccttcgacctcatgctcaagggggaaggcctgcgctgcgtcatcaggatggatgagtagagtagagcacctggctcttcttcatccctcgctgctattgcactacaacacacatgtattacctctttgcttaccttttttttaagccacgccccttaggactccggttcatgaaataaacagaagaaggttgctcgattaatttgcggaaacccaagtgaaaaccataaaatttatgtacccaatcaattatttcaacaag

SEQ ID NO: 2881 - DNA, 1387 bp, Aquilegia formosa
gaataatcattttcttgtctaccataccaagttgaaggaagttttaagaagaagaagaagaaaagaaatagatagatatggcaagcattagcaatactactggtcagatcattcgttgcaaagctgcggtagcatgggaagcaggaaagccacttgttatagaagaagtggaggtggcgcctccccaggcaatggaagttcgtgtgaagattctctttacctctctctgtcacaccgatgtctacttctgggaggccaagggacagaccccattgtttcctcgaatctttggtcatgaagcaggagggattgttgagagtgttgggagtggagtaacagatcttaagccaggggaccatgtcctccccgtgttcactggagagtgtaaggattgtgcacactgtaagtcagaagagagcaacatgtgtgacctactgaggattaatacggaccgaggtgttatgttaaatgatggacagtcgaggttctccatcaatggaaaacccatttatcactttgttggcacctccaccttcagtgaatatactgttgttcatgttggttgccttgccaaaatcaaccctgcagcgccattggacaaagtttgcattctcagttgtggaatctctacaggtcttggtgctgccttaaatgttgcaaaaccaaaacagggctctacagtagctgtttttggattgggagctgttggtcttgctgcttgtgaaggagcaagaattgctggtgctaagaggatcattggtgttgacttgaactccaaccggttcaatgaagccaagaacttcggtgttacggactttgtgaaccctaaggaccataacaaaccagttcaagaggtacttgctgaaatgacagatggcggagttgaccgaagcattgaatgtacaggaagtgttgctgcgatgatctctgcatttgaatgtgtacatgatggttggggtgttgctgtactcgttggtgtgccaaacaaagatgatgcattcaagacacaccctatgaatctgctgaatgagaggactctcaagggtactttctttgggaactataaaccacgtagcgatattccatcagttgtggagaagtatatgaacaaggagcttgagctggagaagttcattactcatgaggtcccattctctgaaatcaacaaggctttcgagtacatgcttcagggaaagagcattaggtgcatcattcgcatggaggcatagaatggatgtagcggtgtacctattctgaatgataagattataggattaagtctttgctttagttttggtttatttcaattccagttagaatgtgtgaacttactgcaaatctgttagtagtttgtctgaacttatggcaataaaatgaagtttctttc

SEQ ID NO: 2882 - DNA, 1762 bp, Theobroma cacao
aaaggctacgtggctgttcccagaggcgcccatggtaacgccaaaagaatgctacacagcggccaaaaccaaaaccatgacattgctcccacaaaaaccagacacaggattacccaaaaagacaactttgacaaattttgtacgctttgccaaatctattgatttgaactcaaatgggtattctcgtacattcaatttcttccacaacaactgttcaccctttttttttcctataaatatagagctagtcaaggtgtctctcatcctactacagaaagaaaaaacctataaaacagatcaagcgatctgataaagaaaatctttagctttgtcataagcgatcgtcagaggaaaacagccatgactactgctggtcaggtcatccgttgcaaagctgccgtggcatgggagtcagggaagccactgtcgatagaagatgtggaagtggcaccaccacagaaggatgaagtccgtattaagatactcttcacttctttatgtcacacggatgtctacttctgggatgctaagggacaagatcctctgtttcctcgcatacttggtcatgaagctggagggattgtggagagtgttggtgagggtgtgactgatctccaaccaggtgaccatgttctccccatctttactggagaatgcaaggagtgtcgccactgcttgtcagaagaaagtaacatgtgtgatctccttagaatcaacaccgataggggtacaatgattcatgatggaaaatctagattttccatcaatgggaagcctatctaccactttcttggcacctcaacttttagcgaatacactgttgtccatgttggccaggttgccaagattaatccatctgctccactcgataaagtgtgtgttttaagttgcggaatttccacaggttttggcgccactgtgaatgttgctaaacccaaaaatggtcagtctgttgcagtttttggactgggtgctgttggcctagctgctgcagaaggagcaagagtttctggtgcttctaggatcattggtgttgatttgaaccccaacagatttgaagaagctaagaagtttggtgttacagagtttgtgaatccaaaagatcacaacaaacctgttcaagaggtaattgctgagatgactggaggaggagttgatcgcagtgtcgaatgtacggggagcatccaggccatgatttctgcatttgaatgtgtccacgatggttggggtgtcgctgtgcttgtcggtgtgccaaacaaagatgatgcattcaaaactcatccaatgaatctactgaatgagaggactctcaagggtactttctttggcaactacaagcctcggtctcatattccaggcgttgttgaaaaatatatgaacaatgaacttgaactggataaattcatcactcactctgtccctttctctgagatcaacaaggcatttgaatacatgctccggggcgagggtttgagatgcataattcgcatggatgcttagggaacggctggattgacctgtggatgaagggcactagcttctttattttgaaagttctgtttattctgctgtctttcagttaccatgacttacattttgtgcagagcaaataaacaatctgtgctacatggtttgcagtttatgaaagtacatttttcctgttttgtctttacttctttctgcattgtgattgttttgtgctcaacttgctctatgttatcgccatagctatgcttgtttccctcggttgcaaggtttaatg

SEQ ID NO: 2883 - DNA, 1456 bp, Gossypium hirsutum
aaattgtcatttgactgaagcaaaccattggcttgtggttttgcatattggagtgagctgggattgggttccgctataaatagtgtcagcatagctttctacattcttcatccagcaccaaacgagaaatacacaagaaaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgacggaaaatccaggttttccattaatgggaagcctatctaccacttcctaggcacctctactttcagtgaatacactgttgtccatgtcggccaggttgccaagatcaatccggaggctccgcttgataaagtttgtgttctaagctgcggaatgtccacagggtttggtgccactgtgaatgtagctaaacccaaaaagggtcaatccgttgcaatatttggactaggtgctgtcggtcttgctgctgctgaaggagcaagagtttctggggcttccaggatcattggtgtcgatttgaaccctagcagattcgaactagccaagaacttcggtgttacggagtttgtgaatccgaaagatcacaacaaacctgttcaagaggtcattgctgagatgacgggtggaggagtcgaccgcagtgttgaatgtaccgggagcatccaggccatgatttctgcatttgaatgtgtccacgatggttggggagttgcagtgcttgtgggggttcccaacaaagacgatgcattcaaaactcatccagtgaatctactgaatgaaaggactctcaagggtactttctttggcaactacaaacctcgaactgatattcctgctgtcgttgagagatacatgaacaaggaacttgaacttgataagttcatcactcactctgttcccttctctgagattaacaaggcatttgagtacatgcttgctggcgagggcctgaggtgcgtgattcgcatggatgcataaggattggctggccatggatgaagggctttttgttaagtatatgtgcattttaagggaataaataatgtaatgtaatgctacatcgttgtgctgtttttaatggtaaatttttatcttatcataca

SEQ ID NO: 2884 - DNA, 1397 bp, Trigonella foenum-graecum
acacacaacttactcatccattcgattcctttctattctattctattctattcatcatccactgttaactatgtccaacactgctggtcaggtcatcaagtgcagagctgcggttgcatgggaggctgggaagccactggtgatggaagaagtggaggtggcgccaccgcaggccggtgaagtccgtctcaagatactcttcacctccctttgtcacactgatgtttacttctgggaagctaagggtcagactccattgtttcctcgtatatttggtcatgaagctggagggattgtggagagcgtaggcgagggtgttactaatctgaaaccaggagatcatgccctccctgtattcacaggggaatgtggagaatgtccacattgtaactcagaggagagtaacatgtgtgatcttcttaggatcaacactgacagaggtgtcatgatcagtgacaacaagtctaggttctctattaagggacagcccatacaccatttcgttggtacttcgacattcagcgagtacactgtggttcatgctggatgtgttgcaaagatcaatcctgatgcaccacttgacaaagtttgtattctcagttgcggaatatgcacaggtcttggtgctaccatcaatgttgctaaaccaaaacccggttcatctgttgctatctttggacttggagctgttggtcttgctgctgctgaaggggcaaggatgtctggtgcatcaagaatcattggagttgatttagtttccagccgattcgaattagctaagaagtttggggtaaatgagtttgtcaacccaaaagatcatgacaaacctgtacaacaggtaattgctgaaatgacaaatggaggcgtagatcgtgctgttgaatgtaccggtagcgtacaagctatgatctcagcatttgaatgtgtgcatgatggttggggtgtggctgtacttgttggagtgccaaacaaagatgatgcattcaaaacacatcctatgaatttgttgaatgaaaggactcttaagggtaccttttatggtaattacaagcctcgcaccgatcttcctaatgttgtagagaagtacatgaaaggggagctggaacttgagaaattcatcactcactcaatcccattttcagagattaacaaagcttttgattacatgctgaaaggggagtccatcagatgtatcatacgaatggaggagtaaatctctaaaacactgttgaattagtccctactaagggactgagttctcaacctggttcttgaaaaaataaataatgaaattatttacatgccatttctgtttattgaacttgtgaaactttgtgaagtttgattggagagagtgacatttggtacctgatatatgatgaatataatgtttgttt

SEQ ID NO: 2885 - DNA, 1314 bp, Aquilegia formosa
caaacactaccataggtttaagagagaaagaaagagatacaaaagctattttcagaaagatgtctagtactgctggtcaggttattcgttgcagagctgcagtggcatgggaagcagggaaaccactggtgatagaaaaagtagaggtagctcctccacaggcaatggaggttcgtctgaagatcttattcacctctctttgccacactgatgtctatttctgggaagcaaagggacagacccctatgtttcctcgcatatttggtcacgaagctggcggaattgtggagagtgttggagaaggtgtgacagatctcaaacctggtgaccatgtccttcctgtgttcactggagaatgcaaggaatgtgctcattgcaagtcagaagagagcaatatgtgcgacctcctcaggataaatacagacaggggtgtgatgattggtgatggccagtcaaggttctctattaatggcaagccaatatatcactttgttggaacctccacctttagtgagtacactgtttgccatatcggttctgtcgcaaagataagccctttggctccacttgacaaggtctgcatcctcagctgtggaatcacaacaggtcttggtgccgccttgaatgttgcacaacccaaaaagggttcaacagtagctgtttttggattgggggcagttggccttggtgctgcagaaggtgctaggattgctggtgcttctaggattattggcatcgacatgaaccccaagcgtttcatagaagccaagaagttcggcattaccgagtttgtgaacccaaaagaccatgacaagcctgttcaagaggtgcttgctgagatgactgatggaggagtagacaggagcattgaatgtactggcaatgtcaatgccatgatctccgcttttgaatgtgttcatgatggttggggtgttgccgttcttgtgggtgtacctaataaagatgatgtgttcaagacccatcccatgaatttgttgaatgagaggacccttaagggtaccttcttcgggaactacaagcctaaatctgaccttccctctgttgtcgaaatgtacatgaacaaggaacttgatctggagaagttcatcacccatgaaatctcattgtcagagatcaataaggcttttgagtacatgttgggcggtgatggtctccgctgcatcatccgcatggattcataattggttgccgcacagatgtggatttctactagttgtaaagcaagtgagacgtaaataaggagttggttggtttcaaagattgtattccatttaattactaagtttttataaa

SEQ ID NO: 2886 - DNA, 1363 bp, Aquilegia formosa
cagaaagctaacctccaactcaaactacataccaaacactaccataggtttaagagagaaagaaagagatacaaaagctattttcagaaagatgtctagtactgctggtcaggttattcgttgcagagctgcagtggcatgggaagcagggaaaccactggtgatagaaaaagtagaggtagctcctccacaggcaatggaggttcgtctgaagatcttattcacctctctttgccacactgatgtctatttctgggaagcaaagggacagacccctatgtttcctcgcatatttggtcacgaagctggcggaattgtggagagtgttggagaaggtgtgacagatctcaaacctggtgaccatgtccttcctgtgttcactggagaatgcaaggaatgtgctcattgcaagtcagaagagagcaatatgtgcgacctcctcaggataaatacagacaggggtgtgatgattggtgatggccaatcaaggttctctattaatggcaagccaatatatcactttgttggaacctccacctttagtgagtacactgtttgccatatcggttctgtcgcaaagataagccctttggctccacttgacaaggtctgcatcctcagctgtggaatcacaacaggtcttggtgccgccttgaatgttgcacaacccaaaaagggttcaacagtagctgtttttggattgggggcagttggccttggtgctgcagaaggtgctaggattgctggtgcttctaggattattggcatcgacatgaaccccaagcgtttcatagaagccaagaagttcggcattaccgagtttgtgaacccaaaagaccatgacaagcctgttcaagaggtgcttgctgagatgactgatggaggagtagacaggagcattgaatgtactggcaatgtcaatgccatgatctccgcttttgaatgtgttcatgatggttggggtgttgccgttcttgtgggtgtacctaataaagatgatgtgttcaagacccatcccatgaatttgttgaatgagaggacccttaagggtaccttcttcgggaactacaagcctaaatctgaccttccctctgttgtcgaaatgtacatgaacaaggaacttgatctggagaagttcatcacccatgaaatctcattgtcagagatcaataaggcttttgagtacatgttgggcggtgatggtctccgctgcatcatccgcatggattcataattggttgccgcacaggtgtggatttctactagttgtaaagcaagtgagacgtaaataaggagttggttggtttcaaagattgtattccatttaattactaagtttttataaaatatctttcgcaattga

SEQ ID NO: 2887 - DNA, 1410 bp, Theobroma cacao
atcctactacagaaagaaaaaacctataaaacagatcaagcgatctgataaagaaaatctttagctttgtcataagcgatcgtcagaggaaaacagccatgactactgctggtcaggtcatccgttgcaaagctgccgtggcatgggagtcagggaagccactgtcgatagaagatgtggaagtggcaccaccacagaaggatgaagtccgtattaagatactcttcacttctttatgtcacacggatgtctacttctgggatgctaagggacaagatcctctgtttcctcgcatacttggtcatgaagctggagggattgtggagagtgttggtgagggtgtgactgatctccaaccaggtgaccatgttctccccatctttactggagaatgcaaggagtgtcgccactgcttgtcagaagaaagtaacatgtgtgatctccttagaatcaacaccgataggggtacaatgattcatgatggaaaatctagattttccatcaatgggaagcctatctaccactttcttggcacctcaacttttagcgaatacactgttgtccatgttggccaggttgccaagattaatccatctgctccactcgataaagtgtgtgttttaagttgcggaatttccacaggttttggcgccactgtgaatgttgctaaacccaaaaatggtcagtctgttgcagtttttggactgggtgctgttggcctagctgctgcagaaggagcaagagtttctggtgcttctaggatcattggtgttgatttgaaccccaacagatttgaagaagctaagaagtttggtgttacagagtttgtgaatccaaaagatcacaacaaacctgttcaagaggtaattgctgagatgactggaggaggagttgatcgcagtgtcgaatgtacggggagcatccaggccatgatttctgcatttgaatgtgtccacgatggttggggtgtcgctgtgcttgtcggtgtgccaaacaaagatgatgcattcaaaactcatccaatgaatctactgaatgagaggactctcaagggtactttctttggcaactacaagcctcggtctcatattccaggcgttgttgaaaaatatatgaacaatgaacttgaactggataaattcatcactcactctgtccctttttctgagatcaacaaggcatttgaatacatgctccggggcgagggtttgagatgcataattcgcatggatgcttagggaacggctggattgacctgtggatgaagggcactagcttctttattttgaaagttctgtttattttgctgtctttcagttaccatgacttacattttgtgcagagcaaataaacaatctgtgctacatggtttgcagtttatgaaagtacatttttcctgttttgtcttta

SEQ ID NO: 2888 - DNA, 1465 bp, Theobroma cacao
  misc_feature (239)..(239): n is a, c, g, or t
gtacgcggggaccaagaacaaaaccgatcacggctccaaaacaaccttttagagtgaccttgaaactttaacttgtatattttcttaaatctttttacaaagggaagaagatcaaagatgtcgagcactgcctctcaggtgatacgctgcaaagctgctgtggcatgggagtccgggaaaccactggtgatacaagaagtagaggtggcaccaccgcaggcaagtgaagttcgtttganaattctttttacctctttgtgccatactgatgtctacttctgggaagccaagggtcagaacccattatttcctaggatttatggccatgaagcaggcgggattgtggagagtgttggtgaatgtgtgacagaactcaaacctggtgaccatgtcctgcctgtgttcacaggggaatgcatggattgtgctcactgcaaatcagaagagagcaacatgtgtgacttgctcagggttaacactgacaggggtgtaatgcttaacgatgagaaaacaagattttcaatcaatgggaagcctatttaccattttgttgggacttccactttcagtgagtacactgtggttcacgctggctgtgttgccaagatcaaccccttggcttctcttgacaaagtttgtgttctcagctgtggaatatccacaggactgggtgctactcttaatgttgcaaaacctcccaagggctcaacggtggctgtctttggattgggagccgtgggacttgcagctgctgaaggggccaggattgctggtgcttcaaggattattggtgttgatattaactcaaatagatttgaaggagcaaagaaatttggcgtgacagagtttgtgaacccaaaagactacaagaagccagttcaggaggtgattgctgagataaccgatggtggagtggacagaagcattgaatgtactggaaatgtggatgctatgatctctgcatttgaatgtgtccatgatggctggggtgttgctgttcttgtgggggtgccacacaaagatgctgtgttcaagactcaccccataaatttgttgaatgagaggactctcaaaggtacctttttcgggaactacaaaccccgttccgatcttccgtcagtggtggaaaagtacatgagcaaggaacttgaactagagaaattcataacacactcagtcccattttttgagatcaacaaggcttttgaatacatgcttaaaggcgaaggccttcgatgcatcatccgtatggagtagaggtagaacagcgagagcgtgaaaaggagtcaataaaacgtcgtcagtctttacgacatttgtgtgcttcaatatctcagtgtcaaatgtttgttatggcctttgagtagagcatgttaaaatcctggttttatgcacatggatgctaaatactacttaactattaataaatcccccctgcaagtatcatccattggttttggtttca

SEQ ID NO: 2889 - DNA, 1569 bp, Gossypium hirsutum
aaaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgacggaaaatccaggttttccattaatgggaagcctatctaccacttcctaggcacctctactttcagtgaatacactgttgtccatgtcggccaggttgccaagatcaatccggaggctccgcttgataaagtttgtgttctaagctgcggaatgtccacagggtttggtgccactgtgaatgtagctaaacccaaaaagggtcaatccgttgcaatatttggactaggtgctgtcggtcttgctgctgctgaaggagcaagagtttctggggcttccaggatcattggtgtcgatttgaaccctagcagattcgaactagccaagaacttcggtgttacggagtttgtgaatcccaaagatcacaacaaacctgttcaagaggtcattgctgagatgactggtggaggagtcgaccgcagtgttgaatgtaccgggagcatccaggccatgatttctgcatttgaatgtgtccacgatggttggggagttgcagtgcttgtgggggttcccaacaaagacgatgcattcaaaactcatccagtgaatctactgaatgaaaggactctcaagggtactttctttggcaactacaaacctcgaactgatattcctgctgtcgttgagagatacatgaacaaggaacttgaacttgataagttcatcactcactctgttcccttctctgagattaacaaggcatttgagtacatgcttgctggcgagggcctgaggtgcgtgattcgcatggatgcataaggattggctggccatggatgaagggctttttgtcaagtatatgtgcattttaagggaataaataatgtaatgtaatgctacatcgttttgctgtatttaatggcaaatttttatcttatcatgcatttctatgatcctctctagttgctttgctctgcatgcttcttgttggagatagaattttcaaaaaatcattttaatttgttttagaaaatggaacatattgctgagcaaggtttgatgggataatccctaataacatgaaaatgtcatatgtgtaagatgtctaaacgaaacaaatggatgacatgttggaattaaaatgaaagattatatctacatttttatcagatgttgatgttacagtgattgttg

SEQ ID NO: 2890 - DNA, 1283 bp, Populus trichocarpa
acccctcaagaacaagaggaagctaatcgaaaggaactatttgtgacgttaaaagaagctagaattttcattttaggacagaaagaatggcaagcactggtcaggtcatccgttgcaaagctgctgtggcatgggaagctggaaagccactggtgatcgaggaagtggaggtggctccacctcaagccatggaggttcgtttgaagatcctcttcacttccctctgccatactgatgtatacttctgggaagccaaggggcaaaccccattatttcctcgcatttttggtcatgaagctggagggattgttgagagtgttggtgaaggtgtgacagacctcgagcctggtgaccatgtgcttcctgtattcacaggagagtgtaaggaatgccgacattgcaaatcagaagagagtaatatgtgtgatcttcttcggattaacactgatagaggtgtgatgctgagtgatggcaagtctagattttcaattagagggcagcccatctaccattttgttggtacatcaaccttcagtgagtacactgtgattcatgttggctgtctggccaagatcaatcctgctgctccactggacaaagtttgtctcctcagctgtggaatctctacaggtcttggagccaccttgaatgttgcgaagccaaagccaggctcctccgtggccatttttggactgggagctgtaggccttgcagctgctgaaggtgctcggatttccggtgcttcaaggattattggtgttgatttgcattccagtagattcgatgaagccaagaaatttggcgtgacggagtttgtgaacccaaatgatcatgacaagcctgttcatgaggtgatagcggagatgactgatggaggagtggatagaagtgttgagtgtacaggaagtatcagtgccatgatttctgcattcgaatgcgtccatgatggttggggtgttgctgtgctagtcggcgtgccaagcaaagacgattctttcaaaaccaatccaatgaatttcttgagtgagaggactctcaagggtactttctttggaaattacaagccgcgctctgaccttccttcagttgtagagaagtacatgaacaaggagcttgagctagagaaatttatatcccatgaagtccctttttctgaaatcaacaaggctttcgagtacatgctcgctaaagctagcctcaggtgtattatccggatgggtgcataaaagaagaatcatctttgttgattttcaggtgtattgcctgagctagcctcaggcgta

SEQ ID NO: 2891 - DNA, 1626 bp, Oryza sativa
actcaagtgacatagctaacttagctagctagatcatcttagcttggagaagacagaagagcgttatcttggaaggacaacatggcaactgcagggaaagtgatcaagtgcaaagcggcggtggcttgggaggccgggaagccgctgtcaatcgaggaggtggaggttgcgccgccgcaagccatggaggttcgcctcaagatcctctacacggcgctctgccacaccgacgtctacttctgggaagccaaggggcaaactccggtgttccctcggatcttcggccacgaagctggagggattgtggagagtgtgggcgagggggtgacggagctttcccccggcgaccacgtgctgccggtgttcaccggcgagtgcggcgactgccggcactgcctgtcggaggagagcaacctgtgcgacctcctccgcatcaacaccgaccgtggcgccatgatcggcgacggccagaccaggttcaccgccaggggagggcagccggtgtaccacttcctcggcacctccacgttcagcgagtacaccgtcgtccatgtcggctgcgtcgccaagatccacccagcggcgccgctcgacaaggtctgcgtcctcagctgtggcatctccaccggatttggcgcgactgtgaacgtcgccaagccaccgaaggggtgcacagtagccatattcggcctgggtgcagttggtcttgctgccatggaaggtgcaaggatctctggtgcttcacggattattggcgtcgatttgaacccggccaaattcgaactagctaagaagtttgggtgcacagactttgtgaacccaaaagattacgacaagcccgttcagcaggtgatcatcgagatgaccaacggcggcgtggaccgcagcgtggagtgcaccggcaacgccgccgccatgatctccgccttcgagtgcgtccacgacgggtggggagtggccgtgctggtgggcgtcgccggcaaggacgcggcgttcaagacgcacccgaccaacttcctcaacgagaggacgctcaggggcacgttcttcggcaactacaagcctcgcaccgacctgcccggcgtcgtcgagatgtacatgaacaaggagctggagctggagaagttcatcacgcacagcgtgcccttctccgagatcaacacggcgttcgacctgatgctcagtggggagagcctccgctgcatcatcaggatggaggactagccatccagatcgatgtcgccgccggcgatcgacggcggcggcgactgtataaacggagaaaataagaggctaaaactacctatgctacagcaataagctagccacggttgcaggaatgcggtttcaggtttgttcatggagaacatgggtggacacaaattatatatactgtgaattttctgaaaatttacaagacaaatatgaaattgcgcaaattacgatagcggatagcctttggctcgatcaatttgagcctatatatgctggctccaccgctacactgtttgccgcctttctgtattgcgcatctgctctctctaatgtaatgtgcaatctatatataactaaattatgaaacataatgtgcaatctgtcaatctacattctggtatgaatttttgc

SEQ ID NO: 2892 - DNA, 1299 bp, Solanum phureja
caacaacaatgagtactgctggtcaggtcattcgctgcaaagctgcggttgcatgggaagcgggaaagccgttggtaattgaagaagtggatgtgtcacctccacagaaacatgaagttcgcctcaagattctcttcacctcattgtgccacactgatgtttacttctgggaagctaaggggcaaacacctctgtttcctcgaattttcggacatgaagctggaggaattgtggagagtgtaggtgaaggtgtaacagatctccaaccaggagatcatgttcttcctgtgttcaccggagaatgccagcaatgccgtcactgtaaatcatcagaaagcaacatgtgtgaactcctacgaataaatacagacagaggagttatgattagtgatggtcaaacaagattttccaaggatgggaagccgatataccattttgttggaacttccacttttagtgaatacaccgttgctcattctggttgcgtcaccaagatcgatccacaggcaccacttgacaaagtttgcgtcctgagttgcggaatctcaacaggacttggtgcaactctgaatgttgctaaacctactagaggttctactgtggctatttttggtttgggagctgttggccttgctgctgctgaaggagctaggctagctggggcttctaggatcattggcattgatttgaatcccagcagattcaatgatgccaagaaattcggtgtcacagagtttgtgaatccaaaagatcatgataagcctgtccaggaggtaatcgctgagatgaccgatggaggtgctgaccggagtgtagagtgtactggaaatgtcaatgctatgatctccgcttttgaatgtgttcatgatggttggggtgtggctgtgcttgttggcgtgccaaacaaagacgacgcattcaaaactcatcccatgaatctgttgaatgagaggacactcaagggcaccttctttggcaactacaaaccaaaaactgaccttccatctgtggtggccaagtacatgaataaggaactagagctggagaagtttatcacccatcaagtaccattttcagagataaacaaagcatttgacattatgctgaaaggggaaggcctgcgttgtatgatcactatgggacattgaaatatgctaaatagggagaataggacaatgtattatcccctattacctagtaaaaattatgttaagtagagtttgaaggcaaagtatgtgtgttctaaaaggcccgagtttgcttaacatattgtgtaataaactactaatatttgcatgt

SEQ ID NO: 2893 - DNA, 1558 bp, Fagopyrum esculentum
gggggggtttgaagttgaaatggtttttgttgtttatggagttatgaataccagcaccgcagtcctaaacaggaagcggtttcatatttcatggtgccactagatccttccttttaggttcaaacatggcgaacaatccacagactcactatccattattccttctcctataaattggatcatacataactccatttgaatcatcgtccaaaacacaaccaatttaatcacaaagagacaacaagaagaatcaatcatgtctgctactgccggtcaagtcatcaaatgcaaagccgctgttgcatgggaagctgggaagccactgtcgattgaagaggtggaggtggctcctcctcagaaagatgaagttcgtgtcaagatcctcttcacttccttgtgtcacactgatgtttacttctgggaagccaagggccaaacaccacttttccctaggatatttggtcatgaaggtgcaggaattgttgagagcgtaggcgaaggagtgacagagattcagcctggagaccatgttcttccggtgttcaccggggagtgtggtgactgtcgccattgtaaatcagaagagagcaacatgtgtgatctcctcaggatcaacaccgacagggtggtcatgctcagtgatggaaagtcgaggttcaagtacaatggaaagcccattcatcacttccttgggacctcaactttcagcgagtacactgttgtccacaaaggttgtcttgctaagatcaaccctgatgctccgcttgacaaaacttgtgtcatcagctgtggatttgctactggttttggtgcaactgtcaatgttgcaaaacccaagaagggttcaactgtggcaatattcggtctgggagctgtaggacttgctgctgctgaaggtgctcgagtttctggtgcttcaaggatcattggagttgatctgaacccaagcagatttgaaacagcaaggaagtttggatgcaccgagtttgttaacccgaaagatcacaacaagccggttcaggaggtgatagctgatatgactgatggaggtgtagatcgaagtgtggagtgtactggagcgattcaggccatgatatctgcattcgaatgcgttcatgatggctggggtgttgctgtgctagtcggcgtcccaagcaaagacgacgcattcaaaacgcacccagtgaacttcttaaacgagaggacactcaagggaaccttctacggcaacttcaagccgcgctctgacattcctaaagtcgtcgagaggtacctgaacaaggagctggaggtggagaagttcatcacccatgaagtgacctttgctgatatcaacaaggcgttcgacttgatgctcaagggggagagtattcgctgcatcatcaagatggagcactgaacaacaagatcttaagatatgagaatgaacaatctatgtttgttgctgtgtttatatctttagactaagtgcatgagatctttgcttgttttactgtctggtcaattatagtttggtgaagaaataaatttggctattgaactattttacaagtaaccg

SEQ ID NO: 2894 - DNA, 1459 bp, Fagopyrum esculentum
atatttcatggtgccactagatccttccttttaggttcaaacatggcgaacaatccacagactcactatccattattccttctcctataaattggatcatacataactccatttgaatcatcgtccaaaacacaaccaatttaatcacaaagagacaacaagaagaatcaatcatgtctgccactgccggtcaagtcatcaaatgcaaagccgctgttgcatgggaagctgggaagccactgtcgattgaagaggtggaggtggctcctcctcagaaagatgaagttcgtgtcaagatcctcttcacttccttgtgtcacactgatgtttacttctgggaagccaagggccaaacaccgcttttccctaggatatttggtcatgaaggtgcaggaattgttgagagtgtaggtgaaggggtgacagagattcagcccggagatcatgttcttccagtgttcaccggggagtgtggtgactgtcgccactgtaaatcagaagagagcaacatgtgtgatctcctcaggatcaacactgacagggtggtcatgctcagcgatggaaagtcaaggttcaagtacaatggaaagcccattcatcactttcttgggacctcaactttcagcgagtacactgttgtccacaaaggttgtcttgctaagatcaaccctgatgcaccgcttgacaaaacttgtgtcatccgctgtggatttgctactggttttggtgcaactgtcaatgttgcaaaacccaagaagggttcaactgtggcaatatttggtctgggagctgtaggacttgctgctgctgaaggtgctcgagtttctggtgcttcaaggatcattggggttgatctgaacccaagcagatttgaaacagcaaggaagtttggatgtaccgagtttgttaacccgaaagatcacaagaagccagttcaggaggtgatagctgatatgactgatggaggtgtagatcgaagtgtggagtgtactggagcgattcaagccatgatatctgcattcgaatgtgttcatgatggttggggagttgctgtgctagtcggcgttccaagcaaagacgacgcattcaaaactcacccagtgaacttcttaaacgagaggacactcaagggaaccttctacggaaacttcaagccgcgcaccgacattcctaaagtcgtcgagaggtacctgaacaaggagctagaggtggagaagttcatcacccatgaagtgacctttgctgaaatcaacaaggcgttcgacttgatgctcaagggagagagtattcgctgcatcatcaagatggagcactgaacaacaagatataagatatgagaacgaacaatctatgtttgtggctgtgtttatatctttagactatgtgcatgagatatttccctgttttactgcctggtggattatagtttggtgaagaaataaatttggcattgaacaag

SEQ ID NO: 2895 - DNA, 1311 bp, Trigonella foenum-graecum
cttactcatccattcgattcctttctattctattctattctattcatcatccactgttaactatgtccaacactgctggtcaggtcatcaagtgcagagctgcggttgcatgggaggctgggaagccactggtgatggaagaagtggaggtggcgccaccgcaggccggtgaagtccgtctcaagatactcttcacctccctttgtcatactgatgtttacttctgggaagctaagggtcagactccattgtttcctcgtatatttggtcatgaagctggagggattgtggagagcgtaggcgagggtgttactaatctgaaaccaggagatcatgccctccctgtattcacaggggaatgtggagaatgtccacattgtaactcagaggagagtaacatgtgtgatcttcttaggatcaacactgacagaggtgtcatgatcagtgacaacaagtctaggttctctattaagggacagcccatacaccatttcgttggtacttcgacattcagcgagtacactgtggttcatgctggatgtgttgcaaagatcaatcctgatgcaccacttgacaaagtttgtattctcagttgcggaatatgcacaggtcttggtgctactgtcaatgttgcaaaaccgaaacctggttcgtctgttgctatctttggacttggagccgttggccttgctgctgctgaaggggcaaggatgtctggtgcatcaagaatcattggagttgatttagtttccagccgatttgaattagctaagaagtttggagtaaatgagttcgtaaacccgaaggatcataaaaaacctgttcaacaagtaattgctgaaatgaccaacgggggtgtggatcgtgctgttgaatgtactgggagcatccaggccatgatctcagctttcgaatgtgtccacgatggttggggtgttgctgtacttgttggagtgccaaacaaagatgatgcatttgaaactcaccctatgaatttgttgaatgaaaggactcttaagggtaccttttatggtaactacaagcctcgcactgatcttcctaatgttgtagagaagtacatgaaaggggagctggaacttgagaaattcatcactcactcaattccattttcagagattaacaaagcttttgattatatgctgaaaggggagtccatcagatgtatcatccgaatggaggagtaaaaattcaaacactattgaaatagttccactgagttctctagttgtttatataaataaataccataaataatcccttttgattatggagtttgtgagaatttgtgat

SEQ ID NO: 2896 - DNA, 1428 bp, Trigonella foenum-graecum
ggtcactactataaataataaataaagatcgctgacaaacagcacacaacaccacaagaactactatttttcaaggagcaaagcaaagcaaatcaaacaactcactgttaactatgtccaacactgctggtcaggtcatcaagtgcagagctgcggttgcatgggaagctgggaagccacttgtgatggaagaagtagaggtggcgccaccgcaggccggtgaagtccgtctcaagatactcttcacctctctttgtcacactgatgtttacttctgggaagctaagggtcagactccattgtttcctcgtatatttggtcatgaagctggagggattgtggagagcgtaggcgaaggtgtgacacatctgaaaccaggggatcatgccctgcctgtgttcacaggggagtgtggggaatgcccacattgtaagtcagaagagagtaacatgtgtgatattcttaggatcaacacggataggggtgtcatgatcaatgacaacaagtccagattctctattaagggacaaccgattcaccatttcgtcggtacatctacattcagtgaatacactgtggttcatgctggatgtgttgcaaagatcaaccctgatgcaccacttgacaaagtttgtattctcagctgtggaatatgcacaggtcttggtgctactatcaatgttgctaaaccaaaacccggttcatctgttgctatctttggacttggagctgttggtcttgctgctgctgaaggggcaaggatgtctggtgcatcaagaatcattggagttgatttagtttccagccgatttgaattagctaagaagtttggagtaaatgagttcgtaaacccgaaggatcataaaaaacctgttcaacaagtaattgctgaaatgaccaacgggggtgtggatcgtgctgttgaatgtactgggagcatccaggccatgatctcagctttcgaatgtgtccacgatggttggggtgttgctgtacttgttggagtgccaaacaaagatgatgcatttgaaactcaccctatgaatttgttgaatgaaaggactcttaagggtaccttttatggtaactacaagcctcgcactgatcttcctaatgttgtagagaagtacatgaaaggggagctggaacttgagaaattcatcactcactcaatttcattttcagagattaacaaagcttttgattatatgctgaaaggggagtccatcagatgtatcatccgaatggaggagtaaaactcaaacactattgaaatagttcaactgagttctctacactagttgtttatataaataaataccataaataatcccttttgattatggagtttgtgagaatttgtgatctttgatgtaaagaattgggttgcttggattgtctaaatacaagataagttagattttgatt

SEQ ID NO: 2897 - DNA, 1446 bp, Malus domestica
ttctcaccacccaaaaaaattaaacacttcaaactgttcttccaaaaagctttgagatttcaatttcatcaagtttttattggattctaagcaagaatgtatgatactgctggtcaggtcatacgctgcagagctgctgtagcttgggaagcagggaagccactggtggttgaagaagttgaggtggcaccaccacaagcaaatgaagttcgcttgaagatcctttttacctctttgtgccacactgatgtctacttctgggaagccaagggacaaaaccctttatttcctagaatttatggtcatgaggcaggagggatcgtggagagtgttggtgagggcgtgacggatctgaaagctggcgaccatgtcctgccggtattcatgggggaatgcaaggactgcgctcactgcaaatcagaagagagcaacatgtgtgacctcctcaggataaacactgacaggggagtgatgctcggggatggcaaatcaagattttcaatcaaaggcaagcctatctaccactttgttgggacatccaccttcagtgagtacactgttgttcatgttggctgcgttgccaagatcaatccctcggcgcctctagacaaagtctgtctcctcagttgtggaatctccacaggtctcggagctactttaaatgttgcaaaaccgaaaaggggatcaactgtggctgttttcggattgggagctgtaggccttgcagctgccgaaggagccaggttgtctggtgcttcaagaattatcggtgttgatttgaattcaagcaaatttgaagaagcgaaaaagtttggtgtgacggaattcgtgaacccaaaagagcacaaaaaaccagttcaagaggtgattgctgagctgacgaatggaggagtggacagaagcattgaatgtacaggaagtgttgaagccatgatatctgcatttgaatgtgtccatgatggttggggtgttgccgttcttgtgggagtaccacacaaagaagccgtcttcaagacgcatccggttaactttctgaccgagaggactctcaagggtacattctacggaaactacaagcctcgaacggacattccctctgttgtggagaagtacatgaacaaggaactggagctagaaaaattcatcacccacgaagtcccgttctcagaaatcaacaaggcctttgagtacatggttaaaggggaaggtcttcgttgcctaatccacatggaggaatgaaaactaaaaaagcttcatcttttgatgttctgtgttcttaaattctaaattttcgatttcgtctttcggtgttctttgttttctctaagtttgatctgcatgtaatgaatatgaatctgcttgcttctgttggacagtttctatgaacatacatgtcaataaatacagaatataagtgaatataaaattgtatcctcagtttgtgga

SEQ ID NO: 2898 - DNA, 1482 bp, Cichorium intybus
ccaatcccttaaattcctgcttcacatcaagcaatcaataaacccaattgaagttgttttcaaattctccgtttcagcaatcaggtaacaagaaggaacaaaaaatgctgagtttaactaaccaggtgattcactgcaaagccgcggtggcgtggggagctgggcagccattagtgattgaacaagtggaagtggcgccaccccagaaaatggaagtccgaatcaaaatcctcttcacctctctatgccacaccgatgtctacttctgggaagccaagggtcagaatcctgtgttccctcgaattttaggacatgaggctggagcggttgtggagagtgttggggaaggtgtgaccgatcttcagccaggggaccatgttctccctattttcaccggagaatgtaaagaatgtgctcattgtaagtcggaagagagcaacatgtgcgacctactgaggatcaacaccgatagaggagtcatgattcacgatcaaaaatctcgattttccttgaacggaaaacccattttccatttcgtcggaacttcaactttcagtgagtacaccgtcgttcatgtcggctgtcttgccaaaatcaaccctcttgctcctcttgacaaagtttgcatcctcagctgtgggatctccacaggccttggtgctaccctgaacgttgcaaaacccaaaaaaggctcatctgtcgccatttttggactaggagctgtggggcttgctgctgctgaaggtgcgaggatggctggggcttcaaggatcattggtgttgatcttaatgccaacagatttgagcttgcaaagaaatttggggtgacggagtttgtgaacccgaaagactacaagaaaccagtacaagaagtgattgcagagatgacaaatggaggagttgacaggagtgttgaatgtaccggtcatattgatgctatgatttccgcctttgaatgtgttcatgatggttggggcgttgcggttctcgtgggtgttccacataaagatgctgtttttaagacaagtccattgaatctattgaatgaaaggactctgaagggaaccttttttggaaactataaacctcgatcggatattccttctgtggtcgagaagtatatgaataaggaacttgagttggagaagttcataacacatgaagtgccattttctgagataaataaggcgtttgatttgatgcttaaaggtgaaggtcttcgatgtatcattcggatggatgcataaatcgaagggaaatagtttcgaactgttgtagtttattaggcatgacgtgccttcttttatcttattatgtatgagtgttaaatacgttgaaattccgagtttatatttcagtgatcacttctcttcataattctgaatgttttttttgcatcatatcttttagtagaaagcttatttttgtcataggttaatcctctgtctaatgttttatcgtccctcaaactcaatatatacc

SEQ ID NO: 2899 - DNA, 1452 bp, Liriodendron tulipifera
  misc_feature (39)..(39): n is a, c, g, or t
  misc_feature (1425)..(1425): n is a, c, g, or t
atctcattctcttcttcacaagaattcatcttcttcgtntaatagtatctgtatcagaatgtcgagtacagcaggtcttgtgattccttgcaaagctgctgtagcatgggaagcagggaagcctttggtaatacagcaggtggaggtggccccaccccaggccatggaagtgaggatcaagatcaagtacacttctctttgtcacactgatctctttttctgggaggcaaagggtcagacgccattatttcctcgtatctttggccacgaagctgctgggatcgtagagagcttgggtgagggtgtaaccgaccttcaagttggagaccatgtgctccctgtattcactggggagtgcaaggagtgcgctcactgcaagtctgaggaaagcaatatgtgtgacctcctccgaataaacacagatagaggagtgatgcttaatgatggaaaatctaggttctcaattaatgggacccctattaatcactttgttggcacatcgaccttcagtgagtatacagttgtccatgttggttgcctcgcaaagattgatcctcttgctcctctcgacaaagtttgcatcctcagttgtggcatttcaacaggtttgggggctactttaaatgtagctaaaccgaagaagggttcttcagttgccatctttggattgggcgctgtaggcctcgctgctgctgaaggggcaaggattgctggtgcatcgagaattattggggtcgacatgaaccccaacaggttcgaggaagccaagaagtttggtgtcacggaattcgtgaaccctaaagatcacaacaaaccagtgcaagaggtgatcgcagaaatgactaatggaggagtggaccgtgcagtagagtgcacgggcaacgtcaatgtcatgatatccgcctttgaatgcgttcatgatggatggggtgtagctgttctggtgggagtccccagcaaggatgcagttttcatgaccaagcccataaatctgttgaatgagaggactcttaaaggaaccttctttggtaactacaagcctcggacagatctcccatccgtcgtcgatatgtacatgagaaaggaactggaaatagacaagttcatcacacataggatccctttctcggagataaacaaggcctttgattacatggttaagggagaaggtctgcgttgcattattaatatggaagagtaggtaaggggtatggactacagtagtacaagcaaccttgtctaaggtttcatgcacgtcttataatacagtagtacaccattttgggtggtactgcactcttgggtggtcactcatctggtttttttttttttttttctgaaaaatgtctgtttatttggtgttgtctgataaatgaaagagcagcatcacagaggcgtgaaatgctccacatgaaacatatatanaaatgtaggattcattgagttttctcc

SEQ ID NO: 2900 - DNA, 1143 bp, Pisum sativum
atgtcgaacacagttggtcagatcatcaagtgcagagctgcggttgcatgggaggctgggaagccgttggtgattgaagaagtagaggtggcgccaccgcaggcaggtgaagttcgtctcaagatactcttcacctccctttgccacactgatgtttacttctgggaagctaagggtcagactccattgtttcctcgtatatttggtcatgaagctggagggattgtggagagtgtaggtgagggtgtgacacatcttaaaccaggggatcatgctctgccggtattcacgggggaatgtggggaatgtccacattgtaagtcagaggaaagcaacatgtgtgatcttcttaggatcaacacagatagaggtgtaatgctcaatgacaacaagtccagattctctattaagggacaacctgtacaccatttcgtcggcacctccacgttcagcgaatacactgtggttcatgctggttgtgttgcaaagatcaatcctgatgcaccgcttgacaaagtttgtattctcagctgtggaatatgcactggtcttggtgctaccatcaatgttgcaaaaccaaaacctggctcttctgttgctatctttggacttggagctgttggtcttgctgctgctgaaggggcaagaatttctggtgcatcaagaatcattggagttgatttagtttccagccgatttgaattagctaagaagtttggggtaaatgagttcgtaaacccaaaagagcacgacaaacctgtgcaacaggtaattgctgaaatgacgaatggaggtgtagatcgagctgttgaatgtaccggtagcatccaggccatgatctcagcattcgaatgtgttcatgatggttggggtgttgctgtacttgttggagtgccaagcaaagatgatgccttcaaaactcatcctatgaatttcttgaatgagaggacgcttaagggtaccttctatggcaactacaagccccgcactgatcttcccaatgttgttgagaagtacatgaagggggagctggagctggagaaattcataactcacacagtaccattctcagagattaacaaagcttttgattacatgttgaaaggggagtccatcagatgtatcatcaaaatggaggagtaa

SEQ ID NO: 2901 - DNA, 1485 bp, Vigna unguiculata
gtcacagtcaacacaaattcatcaattctgctttgttctttcatcttttcttctcaccaactatcattagtcattatgagcacagctggtcaggtcatcaaatgcaaagccgcggtagcatgggaggcagggaagccactggtgatggaggaagtagaggtggcaccaccagaggctggtgaagtccgtttgaagatcctctacacctctctttgccacactgatgtttacttctgggaagccaagggccagacaccattgtttcctcgcatatttggtcatgaggctggagggattgtggagagcgtaggtgagggtgtgactcatctgaaacccggggaccatgctcttcctgtgtttacaggggagtgtggggaatgtgcacattgtaagtcagaggagagcaacatgtgtgatctgctgaggatcaacactgatcgcggtgtcatgatccatgatggtcaaacaagattttctataaagggacaacctatttaccattttgttggtacctctacgttcagtgaatacactgtggttcatgccggatgtgttgccaaagtcaaccctgctgccccacttgacaaaatttgtgttctcagttgtggaatatgcacaggtcttggggctactgtcaatgttgcaaaaccaaaacctggttcttctgttgccatttttggacttggagctgttggccttgctgctgctgaaggggcaaggatttccggtgcatcaagaatcattggggttgatttagtttcaagccgatttgaagaagctaagaagtttggggtcaatgaatttgtgaacccaaaagaccatgacaaacccgtacaacaggtaattgctgaaatgacaaatgggggtgtggatcgtgctgttgaatgtactggcagcattcaggccatggtgtcagcattcgaatgtgttcacgatggttggggtgttgctgtacttgttggagtgccaaacaaagatgatgcattcaaaactcatccagtgaattttttgaacgagaggactcttaagggtaccttctatggtaactacaaacctcgcactgatcttccttcagttgtggagaagtacatgaatggggaattggaactggagaaattcatcactcacaccgttccattctcagaaattaacaaagcttttgattacatgctgaaaggggagtccatcagatgcattatccgtatgggagagtagaactataaaatcaatgatgacatagttcctgcagagggactttgttctctttcttgttatcaaaagaagaaaataaagattatgtataattaatccctttggattattgaatctgtgagaatttgtctgtgtttgaatgtagagaacgataggaggctttgctgctgcaattgtctatttcatgataaataaaatgccgtttttggatgagttgttcttgtggtaattttattgagatttctttcttgaggaaagaaatatatttgtgga

SEQ ID NO: 2902 - DNA, 1360 bp, Aquilegia formosa
gaataatcattttcttgtctaccataccaagttgaaggaagttttaagaagaagaagaagaagaaaagaaatagatagatatggcaagcattagcaatactactggtcagatcattcgttgcaaagctgcggtagcatgggaagcaggaaagccacttgttatagaagaagtggaggtggcgcctccccaggcaatggaagttcgtgtgaagattctctttacctctctctgtcacaccgatgtctacttctgggaggccaagggacagaccccattgtttcctcgaatctttggccatgaagcaggagggattgttgagagtgttgggagtggagtgacagatcttaagccaggggaccatgtcctccccatgttcactggagagtgtaaggattgtgcacactgtaagtcagaagagagcaacatgtgtgacctactgaggattaatacggaccgaggtgttatgttaaatgatggacagtcgaggttctccatcaatggaaaacccatttatcactttgttggcacctccaccttcagtgaatatactgttgttcatgttggttgccttgccaaaatcaaccctgcagcgccattggacaaagtttgcattctcagttgtggaatctctacaggtcttggtgctgccttaaatgttgcaaaaccaaaacaggggtctacagtagctgtttttggattgggagctgttggtcttgctgcttgtgaaggagcaagaattgctggtgctaagaggatcattggtgttgacttgaactccaaccggttcaatgaagccaagaacttcggtgttacggactttgtgaaccctaaggaccatgacaaaccagttcaagaggtacttgctgaaatgacagatggcggagtcgaccgaagcattgaatgtacaggaagtgttgctgcgatgatctctgcatttgaatgtgtacatgatggttggggtgttgctgtactcgttggtgtgccaaacaaagatgatgcattcaagacacaccctatgaatcttctgaatgagaggactctcaagggtactttctttgggaactataaaccacgtagcgatattccatcagttgtggagaagtatatgaacaaggagcttgagctggagaagttcattactcatgaggtcccattctctgaaatcaacaaggctttcgagtacatgcttcagggaaagagcattaggtgcatcattcgcatggaggcatagaatggatgtagcggtgtacctattctgaatgataagattataggattaagtctttgctttagttttgatttatttcaattccagttagaatgtgtgaacttaccgcaaatctgttagtagtttgtctg

SEQ ID NO: 2903 - DNA, 1143 bp, Pisum sativum
atgtcgaacacagttggtcagatcatcaagtgcagagctgcggttgcatgggaggctgggaagccgttggtgattgaagaagtagaggtggcgccaccgcaggcaggtgaagttcgtctcaagatactcttcacctccctttgccacactgatgtttatttttgggaagctaagggtcagactccgttgtttcctcgaatatttggccatgaagctggagggattgtggagagtgtaggtgagggtgtgacacatcttaaaccaggggatcatgctctgccggtattcacgggggaatgtggggattgtccgcattgtaagtcagaagaaagcaacatgtgtgatcttcttaggatcaacacagatagaggtgtaatgctcaatgacaacaagtccagattctctattaagggacaacctgtacaccatttcgtcggcacctccacgttcagcgaatacactgtggttcatgctggttgtgttgcaaagatcaatcctgatgcaccgcttgacaaagtttgtattctcagctgtggaatatgcactggtcttggtgctaccatcaatgttgcaaaaccaaaacctggctcttctgttgctatctttggacttggagctgttggtcttgctgctgctgaaggggcaagaatttctggtgcatcaagaatcattggagttgatttagtttccagccgatttgaattagctaagaagtttggggtaaatgagttcgtaaacccaaaagagcacgacaaacctgtgcaacaggtaattgctgaaatgacgaatggaggtgtagatcgagctgttgaatgtaccggtagcatccaggccatgatctcagcattcgaatgtgttcatgatggttggggtgttgctgtacttgttggagtgccaagcaaagatgatgccttcaaaactcatcctatgaatttcttgaatgagaggacgcttaagggtaccttctatggcaactacaagccccgcactgatcttcccaatgttgttgagaagtacatgaagggggagctggagctggagaaattcataactcacacagtaccattctcagagattaacaaagcttttgattacatgttgaaaggggagtccatcagatgtatcatcaaaatggaggagtaa

SEQ ID NO: 2904 - DNA, 1427 bp, Lotus japonicus
acaaccacaatcattcttactcatcaatcaattctcagtttttcgtcataatcaattcattctcagttcatcttaatttctgaaagctatagctatgtcgaccacagctggtcaagtcatcaaatgcagagccgcggtttcatgggaggcagggaagccactagtgattgaagaagtggaggtggcgccgccgcaggccggtgaagtgcgtctgaagatactctacacctccctttgccacactgatgtttacttctgggaagctaagggtcagactccattgtttcctcggatatttggtcatgaagctggaggcattgtggagagcgtaggcgaaggtgtgactcatctgaaaccaggggaccatgctctcccagtattcacaggagaatgtggtgaatgcccacattgcaaatcagaggagagcaacatgtgtgatcttcttaggatcaacactgataggggtgtcatgatcagtgacaaccagagtagattctccataaaaggaaaacccatataccattttgttggtacctcaacattcagtgaatacacagttctccatgctggatgtgttgcaaagatcaaccctgctgccccacttgacaaagtttgtattctcagttgtggaatatgcacaggttttggtgctactgtcaatgttgcaaaaccaaaacctggttcttctgttgccatctttggacttggagctgttggccttgctgctgctgaaggggcaagggtttctggtgcatcaagaatcattggggttgatttagtttccagccgatttgaaggagccaagaagtttggagtcaatgagttcgtgaacccaaaagatcacgacaaacctgtacaagaggtaattgctgaaatgaccaatggaggtgtggatcgtgctgttgaatgcactggcagcatccaggccatgatctctgcatttgaatgtgtccatgatggttggggtgttgctgtacttgttggagtgccaaacaaagatgatgcattcaaaactcatcctgtgaatttcttgaatgagaggactcttaagggcaccttctatggcaactacaaaccccgcactgatcttcctaatgttgtagagatgtacatgagaggggaacttgaactggagaaattcatcacccacacagtttcgttctctgagattaacaaagcttttgattacatgctgaaaggagagtccatcagatgcatcatccgcatggaggagtaaaacccaaaaacaatgatgtgtgagtccctatttggggactgagttctctttctggttgtgaaagaaaaaaggcatatataaataatcccttaggaggattatgaaatttgtgatgtttgaatgtatagaatggcagggcctttgcttctgggcttgtctaatacagaataaataaaatgtggcttttttc

SEQ ID NO: 2905 - DNA, 1418 bp, Medicago truncatula
acacacaactcactcgttatcatcttttgttaattaaccatgtccaacactactgttcaggtcatcaagtgcagagctgcggttgcatgggaggcagggaagccactggtgatggaggaagtggaggtggcgccaccgcaggccggtgaagtccgtctcaagatactcttcacctctctttgtcacactgatgtttacttctgggaagctaagggtcaaactccattgtttcctcgtatctttggtcatgaagctggagggattgtggagagtgtaggtgagggtgtgactcatctgaaaccaggggatcatgccctgcctgtattcacaggggagtgtggggactgtccacattgtaagtcagaggaaagcaacatgtgtgatcttcttaggatcaacactgacaggggtgttatgatcaatgacaatcagtcaagattctctattaagggacagcccattcaccattttgtcggtacatcgacattcagtgaatacactgtggttcatgctggatgtgttgcaaagatcaaccctgatgcacctcttgataaagtttgtattctcagctgtggaatatgcacaggtcttggtgctaccatcaatgttgctaaaccgaaacccggttcttctgttgctatctttggacttggagctgttggccttgctgctgctgaaggagcaaggatatctggtgcatcaagaatcattggagtcgatttagtttccagccgtttcgaattagctaagaagtttggggtaaatgagtttgtgaacccaaaagatcatgacaaacctgtacaacaggtaattgctgaaatgacaaatggaggtgtagatcgtgctgttgaatgtaccggtagcatacaagctatgatatcggcatttgaatgtgtccatgatggttggggtgttgctgtacttgttggagtgccaaacaaagatgatgcattcaaaactcatcctatgaatttgttgaatgaaaggactcttaagggtaccttttatggaaactacaaaccccgcaccgatcttcctaatgttgtagaaaagtacatgaaaggggagctggaacttgagaaattcatcactcacacaattccattttcagagattaacaaagcttttgattacatgttgaaaggagagtccatcagatgtatcatccgaatggaggagtaaaactctagaacattgttgaagtagtccctactaggggactatgttctcaatctggtagttaaaaaataaataatgaaattgattcgttccatttctgtttattgaatttgcgcactttgtgaagtttgattggagagacagagactgtgacatttggtacctatagtatatgcaaatataatgtttgttttgttaacttcttgctactattcttgtaattttttaattgatacttt

SEQ ID NO: 2906 - DNA, 1714 bp, Cajanus cajan
accgattaccaactcactcatcaattctagtttcttcattctctttaactatcatctttttcctcatgtcgaacacagctggtcaagtcatcaaatgcaaagccgcggttgcatgggaggcagggaagccactggtgattgaagaagtagaggtggcaccaccacaggctggtgaagtgcgtttgaagatcctctacacctccctttgccacaccgatgtttacttctgggaagccaagggccagactccattgtttcctcgtatatttggtcatgaagctggagggattgtggagagcgtaggtgagggtgtgactcatctcaaaccaggggatcatgccctccctgtgtttaccggagagtgtggggattgttcacattgtaagtcagaggagagcaacatgtgtgatctgctcaggatcaacactgatcggggtgtcatgatccatgacagccaaacaagattttctattaaaggaaagcctatttaccattttgttggtacctctacattcagtgaatacactgttgtccatgctggatgtgttgccaaagtcaaccctgaagccccacttgacaaaatctgtgttctcagttgtggaatctgcacaggtcttggggccactgtcaatgttgcaaaaccaaaacctggttcttctgttgccatctttggacttggagctgttggccttgctgctgctgaaggggcaaggatttctggtgcatctagaattattggggttgatttagtttccagccgatttgaagaagctaagaagtttggggtcaatgaatttgtgaacccaaaagatcatgacaagcctgtacaacaggtgattgctgaaatgacaaatgggggtgtggatcgtgctgtggaatgtactggcagcattcaggccatgatctcagcattcgaatgtgtccacgatggttggggtgttgctgtacttgttggagttccaaacaaagatgatgcattcaaaactcatccaatgaatttcttgaatgagaggactctcaagggtaccttctatggtaactacaaaccccgcactgatctacctgctgttgtggagaagtacatgagtggggaattggaactggataaattcatcactcacacagttggattctcagagatcaacaaagcttttgattacatgctgaaaggggagtccatcagatgcatcattcgtatgggggagtaaaactatggaacaatgatgatggcatagtccctgttgagttctctttctggttgtgaaaagaagaaaataaatttcttatataaatctctttagggcttttgaatttgtgaacatttttgtaagtttgaatgtagaggatggtagtttctttgctgccgttattgtctaatgcatgttaaatataatgccgtttttgttgatttgttgttcttgtggtaatttaaatgagatttttttcttgaggaaaaatttcatatgcaccacaattgttcaacgcaggtccaatagtgtggttttggtgaaaaaagaaaatgttatttgtactctttgggcttagaagtttttacaatatcctctgcactctgcacttaacctttcatctaaaatgaagaatcacttaacttcgcaattggtttcgttagtagaagaatatattctttatttctgaagtaaatatcagaattgtttccctcacaaagagattcttttcacaatctaaaattata

SEQ ID NO: 2907 - DNA, 1613 bp, Phaseolus coccineus
ggtaattgatatctggaaggtgtctgaagaatctaaggcgccgcctgaatactaaacaacagcataaccagagtggtattgtccatttgttttccttcaatatcactctctcagactataaatatattctacactctcttcttccatgtcaaaatcaatcaatacaaattcatcaattcttgctttgttctaccatcttttcttctcagacatgtcgagcacagctggtcaggtcatcaaatgcaaagccgcggtggcatgggaggcagggaagccactggtgatggaggaagtagaggtggcaccaccagaggctggtgaagtgcgtttgaagatcctctacacctctctttgccacactgatgtttacttctgggaagccaagggccagactccattgtttcctcgtatatttggtcatgaggctggagggattgtggagagcgtaggtgagggtgtgactcatctgaaacccggggaccacgcccttcctgtgtttactggggagtgtggggagtgtgcacattgtaagtcagaagagagcaacatgtgtgatttgctgaggatcaacactgatcggggtgtcatgatccatgatagtcaaacaagattttctataaagggacaacctatttaccattttgttggtacctctacattcagtgaatacactgtggtccatgctggatgtgttgccaaagtcaaccctgctgccccacttgacaaaatttgtgttctcagttgtggaatatgcacaggtcttggggctactgtcaatgttgcaaaaccgaaacctggttcttctgttgctatttttggacttggagctgttggccttgctgctgctgaaggggcaaggatttctggtgcatcaagaatcattggggttgatttagtttcaagccgatttgaagaagctaagaagtttggggtcaatgaatttgtgaacccaaaagaccatgacaaacctgtacaagaggtaattgctgaaatgacaaatgggggcgtggatcgtgctgttgaatgtactggcagcatccaggctatgatctcagcattcgaatgtgttcatgatggttggggtgttgctgtacttgttggagtgccaaacaaagatgatgcattcaaaactcatccagtgaattttttgaacgagaggactcttaagggtaccttctatggaaactacaaacctcgcactgatcttccttcagttgtggagaagtacatgaatggggaattggaactggacaaattcatcactcacaccgttccattctcagaaattaacaaagcttttgattacatgctgaaaggggagtccatcagatgcattattcgtatgggagagtagaactataaaatcaatgatgacatagttcctgtggagggactttgttctctttctggttaagaaaagaagaaaataaatattatgtataattaatctcttcaggattattgaatctgtgagaatttgtccatgtttgaatgtaaagaacgatttgtgttatgtggatgagttgttcttgtggtaatttgattgagatttctttcttgaggaaagaaatatatgtgtagctcaatcaatctataaagctgaatacattgtt

SEQ ID NO: 2908 - DNA, 1487 bp, Prunus persica
gtactgattacacgtattgtatatacaaccacaccagactgagaactttaccttgtatacagtgtgttcatttctaaaagaaactgggaaacttttgcttcattaacccccatttctacaaaatgtcgtctactgctggccttgtgatcccctgcaaagctgcggttgcatgggaagcagggaagccattggtgatagagaaggtggaggttgctccaccccaggccatggaagtgagggtcaagataatgtatacctcactttgtcacactgatctctacttctgggaagccaagggtcagacaccactgttccctcgaatcttcggccatgaagcatctggaattattgagagtgttggggaaggagttgaaaacctccaggttggtgatcatgtgctaccagttttcacgggagaatgcggggactgtgcgcattgcaagtctgaggaaagcaatatgtgtgacctgttaagaattaatacagacagaggggtcatgcttagtgatgggaaaccaaggttttctatcaaagggactcccattaatcactttcttggcacatccaccttcagtgaatatactgttattcattcaggctgtcttgccaagatcaatcgcctggcacctttggataaagtttgcatccttagttgtggcatctcaacaggcttgggtgccaccctgaatgtagcaaaaccgaagaagggatcttcagttgctgtctttggacttggggctgttggcctggctgctgctgaaggtgcaagaatttctggggcatcacggattattgggatcgaccgaaatcccaagagatttgaggaagccaagaaatttggagtaaatgagtttgtgaatccaaaggaccatgacaaaccagtgcaagaggttattgctgagatgacaaacggtggagttgataggagcttagagtgcacaggcaatattaacgccatgatatcggcttttgaatgtgttcatgatggatggggtgtggctgtgcttgttggagttccgaacaaggatgcagtcttcatgactaagccgattaatgtgctgaatgaaaggacgcttaaaggaacattttttgggaactacaaacctaggacacaccttccctctgttgtggacatgtacatgaacaaggaactggaggtagagaagttcataactcatcgagttcctttctccgagatcaacaaagcctttgattatatggtgaagggggaaggattgcgatgcatcattagcatggaagaatagctgctatcagttcataattaaacttcaataagtttcgttgatgaacagctttaagtattcaacaaagggagcagtttcacactgcttaagcaatattttgtgtaacctgacatggaaactatgaacagctttaagtattcaacaaagtgagcagtttcacactgcttaagcaatattttgtgtaacctgacatggaaaccatcagcctccattcaaagtcaa

SEQ ID NO: 2909 - DNA, 1463 bp, Glycine max
aaatctacactatctatccttccacaacacaacacaattcaataccatttaccaaactcactcatcaattctcatctttcttctcactaactattaattcatcatgtcgagcacagctggccaagtcatcaaatgcaaagctgcggtttcatgggaggcagggaagccacttgtgattgaagaagtagaggttgcgccaccacaagctggtgaagtgcgtttgaagatcctctacacctctctttgccacactgatgtttacttctgggaagctaagggccaaactccattgtttcctcgtatatttggtcatgaagctggagggattgtggagagcgtaggtgagggtgtgactcatctgaaaccaggggaccatgccctccctgtgtttaccggggagtgtggggactgccctcattgcaagtcagaggagagcaacatgtgtgatcttctcaggatcaacactgataggggtgtcatgatccatgatagccaaacaaggttttctataaagggacaacctatttaccattttgttggtacctctacattcagtgaatacactgttgttcatgctggatgtgttgccaaagtcaaccctgctgccccacttgacaaaatctgtgttctcagttgtggaatttgcacaggtcttggggccactatcaatgttgcaaaaccaaaacctggttcttctgttgccatttttggacttggagctgttggccttgccgctgctgaaggggcaaggatttctggtgcatcaagaatcattggggttgatttagtttctagcagatttgaagaagctaagaagtttggggtcaatgaatttgtgaacccaaaagatcatgacaaacctgtacaagaggtgattgctgcaatgacaaatgggggtgtggatcgtgctgttgaatgtactggcagcatccaagccatgatctcagcattcgaatgcgtccacgatggttggggtgttgctgtacttgttggagtgccaaacaaagatgatgcattcaaaactcatccagtgaatttcttgaatgagaggactctaaagggtaccttctatggaaactacaaaccccgcactgaccttccttctgttgtggagaagtacatgaatggggaattggaactggagaaattcatcactcacacagttccattctctgagattaacaaggcttttgattacatgctgaaaggggagtccatcagatgcatcattcgtatgggggagtaaatctatcaaaccaatgatgacatggtccctgtgagggactgagttctctttctagttgtgaaagtgaaaagaagaaaataaatttcatatatatgatatatccctttagaattattgaattagtgaaaacttgtgtaagtttgaatgttgagaatgataggacctttgctgctgttattgtctaatgcatgataaataaaatgtggtttttttgtcg

SEQ ID NO: 2910 - DNA, 1526 bp, Glycine max
gcagaatctttcggtggtctctctttctctctctctcaccttctttgctttctcactaatcactataaataaaatcttcactctgtccttccaccacacaattcaataccatttatcaactcactcatcaatctcgtttgttctcactaactattacttcatcatgtcgtcgagcacagttggtcaagtcatcaaatgcaaagctgcggtttcatgggaggcagggaagccacttgtgattgaagaagtagaggtggcaccaccacaagctggtgaagtgcgtttgaagatcctctacacctctctttgccacactgatgtttacttctgggaagccaagggccaaactccattgtttcctcgtatatttggtcatgaagctggagggattgtggagagcgtaggtgagggtgtgactcatctcaaaccaggggaccatgccctcccagtgtttaccggggagtgtggagaatgccctcattgcaagtcagaggagagcaacatgtgtgatcttctcaggatcaacactgataggggtgtcatgatccatgacagccaaacaagattttctattaagggacaacctatttaccattttgttggtacctccacattcagtgaatacactgttgttcatgccggatgtgttgccaaagtcaaccctgctgccccacttgacaaaatttgtgttctcagttgtggaatttgcacaggtcttggggctactatcaatgttgcaaaaccaaaacctggttcttctgttgccatttttggacttggagctgttggccttgctgctgctgaaggggcaaggatttctggtgcatcaagaattattggggttgatttagtttctagcagatttgaagaagctaagaagtttggggtcaatgaatttgtgaacccaaaagaccatgacaagcctgtacaagaggtgattgctgcaatgacgaatgggggtgtggatcgtgctgttgaatgtactggcagcatccaagccatgatctcggcattcgaatgcgtccacgatggttggggtgttgctgtacttgttggagtgccaaacaaagatgatgcattcaaaactcatccagtgaatttcttgaacgagagaactctaaagggtaccttctacggaaactacaaaccccgcactgatcttccttctgttgtggagaagtacatgaatggggaattggaactggagaaattcatcactcacacagttccattctcagagattaacaaggcttttgattacatgctgaaaggggagtccatcagatgcatcattcgaatgggggagtaaatctatatcagaccaatgatgacatgacatggtccctgttgggggactgagttctctttctggttgtgaaaagaagaaaataaatttcatatatgatatatatccctttaggattattgaatttgtgaaaacttgtgagtttgagtgtagagaatgatagggcctttgctgctgttattgtctaatgcatgataaataaaatgtcgtttttttgtcg

SEQ ID NO: 2911 - DNA, 1472 bp, Glycine max
tttctcactaatcactataaataaaatcttcactctgtccttccaccacacaattcaataccatttatcaactcactcatcaatctcgtttgttctcactaactattacttcatcatgtcgtcgaccacagctggtcaagtcatcaaatgcagagctgcggtttcatgggaggcagggaagccacttgtgattgaagaagtagaggtggcaccaccacaagctggtgaagtgcgtttgaagatcctctacacctctctttgccacactgatgtttacttctgggaagccaagggccaaactccattgtttcctcgtatatttggtcatgaagctggagggattgtggagagcgtaggtgagggtgtgactcatctcaaaccaggggaccatgccctcccagtgtttaccggggagtgtggagaatgccctcattgcaagtcagaggagagcaacatgtgtgatcttctcaggatcaacactgataggggtgtcatgatccatgacagccaaacaagattttctattaagggacaacctatttaccattttgttggtacctccacattcagtgaatacactgttgttcatgccggatgtgttgccaaagtcaaccctgctgccccacttgacaaaatttgtgttctcagttgtggaatttgcacaggtcttggggctactatcaatgttgcaaaaccaaaacctggttcttctgttgccatttttggacttggagctgttggccttgctgctgctgaaggggcaaggatttctggtgcatcaagaattattggggttgatttagtttctagcagatttgaagaagctaagaagtttggggtcaatgaatttgtgaacccaaaagaccatgacaagcctgtacaagaggtgattgctgcaatgacgaatgggggtgtggatcgtgctgttgaatgtactggcagcatccaagccatgatctcggcattcgaatgcgtccacgatggttggggtgttgctgtacttgttggagtgccaaacaaagatgatgcattcaaaactcatccagtgaatttcttgaacgagagaactctaaagggtaccttctacggaaactacaaaccccgcactgatcttccttctgttgtggagaagtacatgaatggggaattggaactggagaaattcatcactcacacagttccattctcagagattaacaaggcttttgattacatgctgaaaggggagtccatcagatgcatcattcgaatgggggagtaaatctatatcagaccaatgatgacatgacatggtccctgttgggggactgagttctctttctggttgtgaaaagaagaaaataaatttcatatatgatatatatccctttaggattattgaatttgtgaaaacttgtgagtttgagtgtagagaatgatagggcctttgctgctgttattgtctaatgcatgataaataaaatgtcgttttt

SEQ ID NO: 2912 - DNA, 1452 bp, Glycine max
atctatccttccacaacacaacacaattcaataccatttaccaaactcactcatcaattctcatctttcttctcactaactattaattcatcatgtcgaccacagctggtcaagtcatcaaatgcagagctgcggtttcatgggaggcagggaagccacttgtgattgaagaagtagaggttgcgccaccacaagctggtgaagtgcgtttgaagatcctctacacctctctttgccacactgatgtttacttctgggaagctaagggccaaactccattgtttcctcgtatatttggtcatgaagctggagggattgtggagagcgtaggtgagggtgtgactcatctgaaaccaggggaccatgccctccctgtgtttaccggggagtgtggggactgccctcattgcaagtcagaggagagcaacatgtgtgatcttctcaggatcaacactgataggggtgtcatgatccatgatagccaaacaaggttttctataaagggacaacctatttaccattttgttggtacctctacattcagtgaatacactgttgttcatgctggatgtgttgccaaagtcaaccctgctgccccacttgacaaaatctgtgttctcagttgtggaatttgcacaggtcttggggccactatcaatgttgcaaaaccaaaacctggttcttctgttgccatttttggacttggagctgttggccttgccgctgctgaaggggcaaggatttctggtgcatcaagaatcattggggttgatttagtttctagcagatttgaagaagctaagaagtttggggtcaatgaatttgtgaacccaaaagatcatgacaaacctgtacaagaggtgattgctgcaatgacaaatgggggtgtggatcgtgctgttgaatgtactggcagcatccaagccatgatctcagcattcgaatgcgtccacgatggttggggtgttgctgtacttgttggagtgccaaacaaagatgatgcattcaaaactcatccagtgaatttcttgaatgagaggactctaaagggtaccttctatggaaactacaaaccccgcactgaccttccttctgttgtggagaagtacatgaatggggaattggaactggagaaattcatcactcacacagttccattctctgagattaacaaggcttttgattacatgctgaaaggggagtccatcagatgcatcattcgtatgggggagtaaaactataaaaccaatgatgacatggtccctgtgagggactgagttctctttctagttgtgaaagtgaaaagaagaaaataaatttcatatatatgatatatccctttagaattattgaattagtgaaaacttgtgtaagtttgaatgttgagaatgataggacctttgctgctgttattgtctaatgcatgataaataaaatgtggtttttttgtcg

SEQ ID NO: 2913 - DNA, 1365 bp, Manihot esculenta
aatgattatatggaattgtagctgctgtggcatgggaggctgggaagccacttgtgattgaagaagtagaggtggcaccgccacaggctaatgaagttcgtttgaagatcttgttcacctctttatgccacactgatgtttacttctgggaagctaagggacaagcacccttatttcctcgtatatttggtcatgaagctagtggaattgtggagagtgttggtcctggtgtgactgatctccaaccaggtgaccgtgtccttcctgtgttcaccggggaatgcaaggagtgtcgccactgtaaatcagaagaaagcaacatgtgtgacctccttagaatcaacactgataggggtcatatgcttgctgatgggaagacgaggttctctatcaatggaaaacccattcatcattttcttggcacctccacttttagtgaatacactgttgtccatgttggctgtgttgccaagatcaaccctgctgcccctcttgacaaagtttgtgtgctcagttgtggaatatccacaggtcttggtgccactttaaatgttgcaaaaccaaagaagggtcaatctgttgcaatttttggactaggtgctgttggtctagctgctgcagaaggggcaaggatagctggtgcttcgagaatcattggtgtcgatttgaatacgagtcgatttgaagaagccaagaagtttggtgttactgagtttgtgaatccaaaagatcatgataagcctgtacaacaggtaatcgctgagatgactgatggaggagttgatcggagcgttgaatgcactgggagtatccaagccatggtctcagcatttgaatgtgttcatgatggttggggagttgctgtactggttggcgtcccgagcaaggacgacgcattcaaaactcatcctgtgaacctgttgaatgagagaactatcaaaggaaccttctttggcaattacaagccccgcagcgatcttccatctgttgtggaaatgtacatgaaaaaggagctagaagtggagaaattcatcactcaccatgtttctttctcggagataaacaaagcatttgagttaatgctgaaaggagagtctctgaggtgtcttattaacatggagagctaggaaactacatgatccttatcatcaagatctttgtaagcttgtgatcggatgaataagttggttttttttgcagagagtttgtggctttgagcttatggacaaatttttatatttttaatatatttatgttcgataatttggtgttcttattcggctgaatattcaattagcccattttgaatttgtccaaattaactaaaaagtttcaattaaatttgattgagctcaattttttttc

SEQ ID NO: 2914 - DNA, 1614 bp, Quercus alba
tccatctattctcttaaaccaacagggtatatatactacatggtaccaccactaacagagcactcacaatcaaaacaaaagtgatctctaatttcactcagaaaaatcatccaagtttaagccatgtcaagcacagctggtcaggtcattaagtgcaaagccgcggtggcatgggaggctggaaagccattagtgattgaagaagtggaggtagcaccacctcaggcaaatgaagtccgcatgagaattctcttcaccgctctttgccacactgatgtttacttctgggaagccaaggggcagacaccgctttttcctcgtatatttggtcatgaagctgggggtattgtggagagtgtaggtgagggtgtgactgagctcaaaccaggagaccatgttctcccctgcttcactggagaatgcggggattgccaccactgtaaatcagaggagagcaatatgtgtgacctccttcggatcaatactgagaggggtgttatgctcaatgatggaaagacaagattctccaaaaatggacagcccatttaccactttgttggcacctccacatttagcgaatacactgttgttcatgttggctgcgttgccaagatcaaccctgcagctccacttgacaaagtttgtgtacttagttgtggaatatccacaggtatctttgaatgttgcaaaacccaaaaagggtcaatctgtagccgtatttggattgggtgctgttggccttgctgcttgtgaaggcgcaaggatggctggggcttcaagaatcattggtattgatctgcactctggtcgtttcgaagaagccaaaaagtttggtgttactgagtttgtgaatccaaaagatcatgacaagcctgttcaagaggtgattgctgagatgactgatggaggagtggatcgggctcttgaatgtactggaagtatccaggccatgatctcagcatttgaatgcgttcatgatggttggggtgttgcagtacttgttggggtaccaaataaagatgattcattccagactcatcctgtgaattttttgaatgagaggactcttaagggtaccttttttggcaattacaagccccgcactgatattccttctgtggtggaaaagtacatgaacaaggagttggaattggagaaatttattactcactcagtccctttctcagagatcaacaaagcatttgactacatgctgaaagggcagtctatccgatgcattatccgcatgggtgcttaaaacattactgatcaagatggtgtgtatcattgaagcccagagatcttgctagcaattttgaataagagtttatgaacttgatatgtaaagagaagcagtttatgttacttttttttttttttttgagtgaacagtttatgttacttgtttgtgttatcttaacaataaataaaaattttatttatgttctccttttgactaatctgtaatatcattattggatggatatctttatattgttgtcattatgaaatttgtttccgcatatgtatccacagggtttaaatcttggatgaaaaacttgggtttaaatccggtctataagagcaataattatgatgccaatgtcatgccat

SEQ ID NO: 2915 - DNA, 1394 bp, Brassica juncea
acaatcaaacacaaacaaaacccaaagaagatctaagttcatcatgtctacgaccggacaaatcattcgatgcaaagctgccgtttgctgggaagctggaaagccactagtgatggaggaagtggaggttgctccaccgcagaagcatgaagtccgtatcaagattctcttcacttctctctgtcacactgatgtttacttctgggaagctaagggacaaacgcctttgtttccacgtatcttcggacatgaagctggaggtattgtggagagtgttggagaaggagtgactgaccttcaaccaggagaccacgtcctccccatcttcaccggagaatgcggagactgccctcactgccactctgaagaatccaacatgtgcgaccttctcaggatcaacaccgagagaggagggatgatacacgacggcgaatcgagattctccatcaacggcaaaccgatctaccatttccttgggacctcaacgttcagcgagtacaccgtggtgcactctggtcaagtcgctaagatcaaccctgaagctccccttgacaaagtctgcatcgtcagctgtggcttgtccactgggctgggagctactttgaatgttgctaagcccaagaaaggtcagagcgttgcgattttcggtcttggtgccgttgggttggctgctgcggaaggtgctaggattgctggtgctggtaggatcattggtgttgatcttaaccccaagagattcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgcgttcacgatggctggggtgttgcggtgctggttggtgtgccgagcaaagacgacgctttcaagactcatccgatgaacctcctgaacgagaggacactcaagggtactttctttggcaactacaaacccaaaaccgacattcccggggtggtcgaaaagtacatgaacaaggagctggagcttgagaagttcatcactcacacagtgccgttctctgagatcaacaaggcctttgattacatgttgaagggagagagtatccgttgcatcatcaccatgggtgcttgaagaaactacatttctccttaccaataaacgtctacttcgagtgtttttagtaggcaaactcttattgcttttgtgttttttaaaagtccctactctattaccatatcgttgtaatagttttcattctatcaatgttttaatataaactaaaaaaaaatacattctctttttaaaccaatattttgcagagttgaaactgattcccgcgtac

SEQ ID NO: 2916 - DNA, 1305 bp, Brassica oleracea
  misc_feature (1213)..(1213): n is a, c, g, or t
ctaagttcatcatgtctaccaccggacagattattcgatgcaaagctgccgtttgctgggaagctggaaagccactagtgatggaggaagtggaggttgctccaccgcagaaacacgaagttcgtatcaagattctattcacttctctctgtcacaccgatgtttacttctgggaagcgaagggacaaacgcctttgtttccacgtatcttcggacatgaagctggaggtattgtggagagtgttggagaaggagtaactgatctccaaccaggagaccacgtcctccccatcttcaccggagaatgcggagactgccctcactgccactccgaggagtccaacatgtgcgaccttctcaggatcaacaccgagagaggagggatgatacacgacggcgaatcgagattctccatcaacggcaaaccgatccaccatttccttgggacctcaacgtttagcgagtacaccgtggtccactctggtcaagtcgctaagatcaaccctgaagctcctcttgacaaagtctgcatcgtcagctgtggcttgtccactggcctgggagctactttgaatgttgctaagcccaagaaaggtcagagtgttgctatcttcggtcttggcgctgttggattggctgctgcggaaggtgctaggattgctggtgctggtaggatcattggtgttgatcttaaccccaagagattcgaggaagctaagaagttcggtgtgacggagtttgtgaaccctaaggaacatgacaagccagttcaggaagtcatcgctgagatgactaacggcggtgtggacaggagtgtggagtgcactggaagcattcaagccatgattcaagcctttgaatgtgttcacgatggctggggtgtggcggtgctggttggtgtgccgagcaaagacgatgccttcaagactcatccgatgaacctcctgaacgagaggacactcaagggtactttctttggcaactacaaacccaaaaccgacattcccggggtggtcgaaaagtacatgaacaaggagctggagcttgagaagttcattactcacacagtgccattctctgagatcaacaaggcctttgactacatgttgaagggagagagtatccgttgcatcatcaccatgggtgcttgaagaaactacatttctcctttaccaataaatgtctacttcgagtgtttttagtagacaaactnttattgcttttgtgtttttaaaagtcccctactctattttaccatatcgttgtaatagttttcataaaaaaaagacattctctttctctttt

SEQ ID NO: 2917 - DNA, 1352 bp, Brassica rapa
acaatcaaacacaaacaaaacccaaagaagatctaagttcatcatgtctacgaccggacaaatcattcgatgcaaagctgccgtttgctgggaagctggaaagccactagtgatggaggaagtggaggttgctccaccgcagaagcatgaagtccgtatcaagattctcttcacttctctctgtcacaccgatgtttacttctgggaagctaagggacaaacgcctttgtttccacgtatcttcggacatgaagctggaggtattgtggagagtgttggagaaggagtgactgatcttcaaccaggagaccacgtcctccccatcttcaccggagaatgcggagactgccctcactgccactctgaagaatccaacatgtgcgaccttctcaggatcaacaccgagagaggagggatgatacacgacggcgaatcgagattctccatcaacggcaaaccgatctaccatttccttgggacctcaacgttcagcgagtacaccgtggttcactctggtcaagtcgctaagatcaaccctgaagctcctcttgacaaagtctgcatcgtcagctgcggcttgtccactgggctgggagctactttgaatgttgctaaacccaagaaaggtcagagcgttgctatcttcggtcttggcgctgttggtttggctgctgcggaaggtgctaggattgctggtgctggtaggatcattggtgttgatcttaaccccaagaggttcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgtgttcacgatggctggggtgttgcggtgctggttggtgtgccgagcaaagacgatgccttcaagactcatccgatgaacctcctgaacgagaggacactcaagggtactttctttggcaactacaaacccaaaaccgacattcccggggtggtcgaaaagtacatgaacaaggagctggagcttgagaagttcatcactcacacagtgccgttctctgagatcaacaaggcctttgattacatgttgaagggagagagtatccgttgcatcatcaccatgggtgcttgaagaaactacatttctctttaccaataaatgtctacttcgagtgtttttagtagacacactcttattgcttttgtgttttttaagttcctactctattttaccatatcgttgtaatagttttcattctatcaaggttttaatataaactaaaaaaaatacattctctttc

SEQ ID NO: 2918 - DNA, 1336 bp, Brassica napus
gaaacacaaacaaaacccaaagaagatctaagttcatcatgtctacgaccggacaaatcattcgatgcaaagctgccgtttgctgggaagctggaaagccactagtgatggaggaagtggaggttgctccaccgcagaagcatgaagtccgtatcaagattctcttcacttctctctgtcacaccgatgtttacttctgggaagctaagggacaaacgcctttgtttccacgtatcttcggacatgaagctggagggattgtggagagtgttggagaaggagtgactgatctccaaccaggagaccacgtcctccccatcttcaccggagaatgcggagactgccctcactgccactctgaggagtccaacatgtgcgaccttctcaggatcaacaccgagagaggagggatgatacacgacggcgaatcgagattctccatcaacggcaaaccgatctaccatttccttgggacctcaacgttcagcgagtacaccgtggttcactctggtcaagtcgctaagatcaaccctgaagctcctcttgacaaagtctgcatcgtcagctgtggcttgtccactgggctgggagctactttgaatgttgctaaacccaagaaaggtcagagcgttgctatctttggtcttggtgctgttgggttggctgctgcggaaggtgctaggattgctggtgctggtaggatcattggtgttgatcttaaccccaagagattcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgtgttcacgatggctggggtgttgcggtgctggttggtgtgccgagcaaagacgacgctttcaagactcatccgatgaacctcctgaacgagaggacactcaagggtactttctttggcaactacaaacccaaaaccgacattcccggggtggtcgaaaagtacatgaacaaggagctggagcttgagaagttcatcactcacacagtgccgttctctgagatcaacaaggcctttgattacatgttgaagggagaaagcatccgttgcatcatcaccatgggtgcttgaagaaactacatttctctttaccaataaatgtctacttcgagtgtttttagtagacacactcttattgcttttgtgttttttaagttcctactctattttaccatatcgttgtaatagttttcattctatcaagtttttaatataaactaaaaaaaaaa

SEQ ID NO: 2919 - DNA, 1342 bp, Brassica napus
atcaacgcagagtacgcggggaaacacaaacaaaacccaaagaagatctaagttcatcatgtctacgaccggacaaatcattcgatgcaaagctgccgtttgctgggaagctggaaagccactagtgatggaggaagtggaggttgctccaccgcagaaacacgaagttcgtatcaagattctattcacttctctctgtcacaccgatgtttacttctgggaagctaagggacaaacgcctttgtttccacgtatcttcggacatgaagctggaggtattgtggagagtgttggagaaggagtaactgatctccaaccaggagaccacgtcctccccatcttcaccggagaatgcggagactgccctcactgccactccgaggagtccaacatgtgcgaccttctcaggatcaacaccgagagaggagggatgatacacgacggcgaatcgagattctccatcaacggcaaaccgatccaccatttccttgggacctcaacgtttagcgagtacaccgtggttcactctggtcaagtcgctaagatcaaccctgaagctcctcttgacaaagtctgcatcgtcagctgtggcttgtccactgggctgggagctactttgaatgttgctaagcccaagaaaggtcagagtgttgctatcttcggtcttggcgctgttggattggctgctgcggaaggtgctaggattgctggtgctggtaggatcattggtgttgatcttaaccccaagagattcgaggaagctaagaagttcggtgtgacggagtttgtgaaccctaaggaacatgacaagccagttcagcaagtcatcgctgagatgactaacggcggtgtggacaggagtgtggagtgcactggaagcattcaagccatgattcaagcctttgaatgtgttcacgatggctggggtgtggcggtgctggttggtgtgccgagcaaagacgatgctttcaagactcatccaatgaacctcctgaacgagaggacactcaagggtactttctttgggaactacaaacccaaaaccgacatccccggggtggtcgaaaagtacatgaacaaggagctggagcttgagaagttcattactcacacagtgccattctctgagatcaacaaggcctttgattacatgttgaagggagagggtatccgttgcatcatcaccatgggtgcttgaagaaactacatttctcctttaccaataaatgtctacttcgagtgtttttagtagacaaactattatttgcttttgtgtttttaaaagtcccctactctattttaccatatcgttgtaatagttttcataaaaaaagacattctc

SEQ ID NO: 2920 - DNA, 1203 bp, Centaurea maculosa
  misc_feature (10)..(10): n is a, c, g, or t
  misc_feature (259)..(259): n is a, c, g, or t
  misc_feature (304)..(304): n is a, c, g, or t
  misc_feature (803)..(803): n is a, c, g, or t
  misc_feature (808)..(808): n is a, c, g, or t
  misc_feature (835)..(835): n is a, c, g, or t
  misc_feature (844)..(844): n is a, c, g, or t
  misc_feature (874)..(874): n is a, c, g, or t
  misc_feature (880)..(880): n is a, c, g, or t
aactacgacnatgtctggtaaagtaattcgatgcaaagctgcggtggcacgggaagccggaaagccgttggtaatagaagaagtggaggtggcgccgcctcagaaaatggaagtccgactgaagatcctcttcacctccttgtgccacaccgatgtttatttctgggacgctaagggacaaaaccccttgtttcctcgcatattaggccacgaagctggaggtattgttgagagtgttggtgagggtgtgacaaatctnaaaccaggagacaaagtcctcccgatatttaccggagaatgtggngagtgccgccattgtaagtcggaagagagcaatatgtgtgatcttctccggattaataccgataggggtgtcatgataaatgacggaaaaacaagattctctaaagacggccaaccaatttaccattttctcggcacctcaacattcagcgagtacactgttgttcatgccgggtgtgtggctaagatcaatcccgatgctccccttgacaaagtctgtgttcttagctgcggaatttccactggtatgggtgccactttgaatgttgccaaaccaaagaagggtatgagtgttgctgttttcgggttgggggctgtcggtctagctgctgcagaaggagctcggattgctggcgcatctaggatcatcggtattgatctgaatgcgagtaggttcaacgaagccaagaaatttggtgttaccgagtttgtgaatccaaaagatcacgacaaaccgattcaagaggtgattgctgcgatgaccgatggtggagttgacnggagngttgagtgtactggaaacgttagggcnatgatttcngctttcgaatgtgtccacgacggttggggngtagcngttcttgttggcgtgccgaataaagatgacgaattcaaaactcttcctgtcaattttttgaatgagaggactctcaagggcactttctttggcaactataaaccccgtacagatattcctggcgtcgttgagaaatacatgaagaaggaaatagaagtcgagaagttcataacacaccaggttggttttgcggatatcaacaaagcgttcgactacatgctcaagggagaaggtctacgttgcatcatccgtatggatgcataggtcacgataatgttggtttgtagtgaatagtactaataatgtatagaggaatggaataa

SEQ ID NO: 2921 - DNA, 1365 bp, Gossypium hirsutum
tgttaacagccattatgagtactgctggtcaggtcatccgttgcagagctgcggtggcatgggagtcgggaaagccactgtcaatagaggaagtggaagtggcaccaccgcagaaggatgaagtccgtattaagatactcttcacttctttatgtcacaccgatgtctacttctgggatgctaagggacaaaatcctctgtttcctcgcatacttggtcatgaagctggagggattgtggagagtgtaggagagggcgtgactgatctaaagccaggtgaccatgttctccccatcttcactggggaatgcaaggagtgtccccattgcttgtctgaagagagtaacatgtgtgatctcctccgaatcaacactgacagggttggaatgattaatgatggaaaatccaggttttccatcaatgggaagcctatctaccacttccttggcacctctactttcagcgaatacactgtcgtccatgtcggtcaggtcgccaagatcaatccacatgctccacttgataaagtttgtgttctgagctgcgggatgtccacaggttttggtgccactgtgaatgttgctaaacccaaaaagggtcaatctgttgcgatttttggactaggcgctgtcggtcttgctgctgccgaaggagcaagagtttccggtgcttcgaggatcattggcgttgatttgaaccccagcagattcgaacaagccaagaaattcggtgttacagagtttgtgaatccaaaagattacaacaaacctgtccaagaggtcattgttgagatgactggtggaggagtcgatcgcagtgttgaatgtacggggagtatccaggccatgatttctgcatttgaatgcgtccacgatgggtggggagttgcggtgcttgtgggtgttccaaacaaagacgatgaattcaaaactcacccagtgaatctgctgaatgagaagactctcaagggtactttctttggaaactacaaacctcgttctgacattcctgctgttgtggagaaatatatgaacaaggaacttgagctagataaattcatcacacacactgtgcctttctcagagatcaacaaggcatttgagttgatgctggcgggtgagggactgagatgtgtgattcgcatggatgcataaggagtggctggcctggatttttcatacaaggatgatggagttttcatttttatatttatatgtgcaaagagtgattaaggaaatgaataatgtattctacatgattttactgtttttcatagaattctcctacagtttgaatatcagattaaataagagactcaatcatgtattccaaacttttattaaataatgattgcatctttctttt

SEQ ID NO: 2922 - DNA, 1213 bp, Sorghum bicolor
cagtgggcagacacccgtgttccctcggatcttcggtcatgaggctggaggcattgtagaaagtgttggagagggtgtaactgaccttgcccctggtgaccatgtcctcccggtattcactggggagtgcaaggagtgtgcccactgcaagtcggcagagagcaacatgtgcgatctgctcaggatcaacactgaccggggtgtgatgattggtgatggcaaatcacggttttccatcaatgggaagccaatctaccattttgttgggacttccaccttcagtgagtacactgtcatgcatgttggttgtgttgcaaagatcaaccctgaggctcccctggacaaagtttgtgttcttagctgtggtatttctactggtcttggtgcatcaatcaatgttgcaaaaccaccaaagggttcgacagtcgctatttttggtctaggagctgttggccttgctgccgcagaaggtgcaaggattgctggagcatcaaggatcattggtattgacctgaacgccaacaggttcgaagaagctaagaagtttggttgcactgaatttgtgaacccaaaagaccacaacaagccagtgcaggaggtactcgctgagatgaccaatggaggggttgaccgtagtgtggagtgcactggtaacataaacgccatgatccaggcatttgaatgtgttcatgatgggtggggtgttgctgtgctggtgggtgtgccacacaaggacgccgaattcaagacgcacccgatgaacttcctgaacgagaggaccctaaagggaaccttcttcggcaactacaaaccgcgcactgacctgcccaatgtggttgagctgtacatgaagaaggagctggaggtggagaagttcatcacccatagcgtgccgttcacggagatcaacaaggccttcgacctaatggctaaaggagagggcatccgctgcatcatccgcatggagaactagattttgctttttttctctggttgtctggtctgggttgggttaaataaaaggggcagtgtcctctgtggatgtggagccacgcttgtgtgtatcacgtccagtttggccttgtccatcaggagaagtagcttgcactttttttttcgtaaatacgcaacagcgttgcgtatcattgtattataagaggatagaagttttaacattaataaaatacaagagtggccgttctcggcctgaccg

SEQ ID NO: 2923 - DNA, 1758 bp, Vitis vinifera
ccgccccccattcactggttttcgaggtttggaggagttactattatttacttattccacgccaaattcctgcattttctcggatctcgcatttctgttgggacgggttgagaaggtggcacgtagctttatgatcgtgtctcctcgttagagggaatttattcggagagagatagggtagtggagaccggtaaaaatgatgaaacaaaatggtattcttgtccattcgactggagggcggtcgactctcccccctttcttccaccataagtatcacccacaacatcttcattactccacgaaacgttctctcagagttgttaaagcagccatgtctaatacagctggtcaggtcattaaatgcaaggctgcggtttcatgggaggcagggaagcccctggtgattgaagaagtggagctggctccaccacaggcaaatgaagttcgtatcaagatccttttcacctctctctgtcacactgatgtttacttctgggaggccaagggacaaaaaccagcatttcctcggatatttggccatgaagctgcaggagtggttgagagcgtgggtgagggcgtaacggatctcaaaccaggagacactgtcctcccggtgttcaccggagagtgcaaggagtgccggcactgtaaatcagaagagagcaacatgtgtgacctccttaggataaatacggacaggactgttatgctgagtgatggcaaatcgaggttcagcgctaagggaaagcccatctaccatttccttgggacctccacgttcagcgaatacaccgttgcccatgttggcagtgtggccaaaatcaatcctgctgccccacttgacaaagtttgcgttcttagttgtggaatatctacaggtctgggtgctgctatcaatgttgcaaaacccaaaaagggctcatctgttgcagtttttggattgggggctgtaggccttgcagctgctgaaggggctaggatttctggggcatcaaggatcatcggtgtcgatttgaacgccagtagatttgaacaagccaagaagtttggtgtgaccgagttcgtgaaccccaaagatcatgacaaacctgttcaagaggtgattgctgagatgaccgatggaggagttgaccggagcatagagtgtactggaagcgttgccgccatgatctctgcatttgaatgtgttcatgatggttggggcgttgctgttcttgttggtgtgccaaacagagacgattcattcaaaactcaccccataaatctactgaatgagaggactctcaagggcacattttttggcaacttcaaaccccgcaccgatcttccccgtctcgtggagaaatacgtgaataaggagctggacctgcaactggagaaattcatcacccatgaagtctccttctctgatatcaacaaagcatttgactacatgctgaagggggaaggcctccggtgcatcatccgcatgggagcctagaacacactccatgagtgaagtctatgttagatgatgagaaaataagggaggaatgagcctgtgtgaatgcgtgtaacgcaagagaaatttggctgtgttgttatatggtgtagccttttagacacttcttgtgttgttgaggatgattcaaaagcaactcccactcgcttgtggaaattctggttatctttcttttcctctgaggttcaatacatgttagtaatatttccattgatatcataagaaatcttaatagggagaattggaaattacgggta

SEQ ID NO: 2924 - DNA, 1180 bp, Gossypium hirsutum
aagactttatttctgttaacagccattatgagtactgctggtcaggtcatccgttgcagagctgcggtggcatgggagtcggggaagccactgtcaatagaggaagtggaagtggcaccaccgcagaaggatgaagtccgtattaagatactcttcacttctttatgtcacaccgatgtctacttctgggatgctaagggacaaaatcctctgtttcctcgcatacttggtcacgaagctggagggattgtggagagtgtaggagagggcgtgactgatctaaagccaggtgaccatgttctccccatcttcactggggaatgcaaggagtgtccccattgcttgtctgaagagagtaacatgtgtgatctcctccgaatcaacactgacagggttggaatgattaatgatggaaaatccaggttttccatcaatgggaagcctatctaccacttccttggcacctctactttcagcgaatacactgtcgtccatgtcggtcaggtcgccaagatcaatccacatgctccacttgataaagtttgtgttctgagctgcgggatgtccacaggttttggtgccactgtgaatgttgctaaacccaaaaagggtcaatctgttgcgattttcggactaggcgctgtcggtcttgctgctgccgaaggagcaagagtttccggtgcttcgaggatcattggcgttgatttgaaccccagcagattcgaacaagccaagaaattcggtgttacagagtttgtgaatccaaaagattacaacaaacctgtccaagaggtcattgttgagatgactggtggaggagtcgatcgcagtgttgaatgtacggggagtatccaggccatgatttctgcatttgaatgcgtccacgatgggtggggagttgcggtgcttgtgggtgttccaaacaaagacgatgcattcaaaactcacccagtgaatctgctgaatgagaagactctcaagggtactttctttggaaactacaaacctcggtctgacattcctgctgttgtggagaaatatatgaacaaggaacttgagctagataaattcatcacacacactgtgcctttctcagagatcaacaaggcatttgagttgatgcttgcgggtgagggactgagatgtgtgattcgcatggatgcataaggagtggctggcc

SEQ ID NO: 2925 - DNA, 1282 bp, Coffea canephora
cggccggggattcggtgcaaagctgctgtggcatgggaggcgggaaagccgttggtggtggaagaagttgaggtggcacctccccagagaatggaagttcgtttgaggattctagttacttccctttgccatactgatgtttacttctgggaagctaagggccaaacaccactcttccctcggatatttggtcatgaagcaggaggaattgtggagagtgtaggtgaaggggtgacggatttgcagccaggagaccatgttcttcctatattcacaggagaatgcaaggattgccgccattgtaagtcagaggaaagcaatatgtgcgaccttctcaggataaataccgatagaggtgccatgttacatgatggccggacaaggttctccaaaaatgggcagccaatataccacttccttgggacttcaaccttcagcgagtatactgttgtccacgttggtagtgttgccaagatcaacccgcaagcaccactagataaagtttgcgttcttagctgtgggatatctacaggacttggtgcaactctaaatgttgcaaaaccaacaaagggatcaacagtcgccatttttggacttggggctgtaggccttgctgctgctgaaggagctcgcatttccggggcttcaaggatcatcggtgttgacctgaatgccaatagattcaatgacgcaaggaagttcggtgtcaccgagtttgtaaacccaaaagattatgacaagccagttcaacaggtgatcgctgaaatgactgatggaggagtggacagaagtgttgagtgcactggaaatgccaatgccatgatctctgcatttgaatgtgttcatgatggctggggtgtagctgtgcttgttggtgtgccaaacaaggatgatgcattcaaaacacatcctgtgaatctgctgaatgggaggactctcaagggcaccttcttcggcaactataagccccgtagtgacattccaggtgttgtagaaaaatacatgaaaaaggagctagagcttgagaagttcatcacccacgaagtccctttctcagagattaacaaggcatttgactacatgctacgaggagaaagtctccgctgcatcatccgaatggaagcctagagctcttgcctctaaaagatttgggaggactgaaagttttatggtggcaataaatagaagtctcgggaggtagtgatgttagaaagaatgttttgagcgcataccattgctagactcttttcaattactttagcaatacaagtaatgatattga

SEQ ID NO: 2926 - DNA, 1413 bp, Medicago truncatula
cacgagtactagtagcattgcaaagcaacaaacaacttactactcacccattcgattccattctaaattttctgttcattcatcatgtccaacactgctggtcagatcatcaagtgtagagctgcggttgcatgggaagcggggaagccgctggtgatggaagaagtagaggtggctccaccgcaggccggtgaagtccgtctcaagatactcttcacctccctttgtcacactgatgtttacttctgggaagctaagggtcagactccattgtttcctcgtatatttggtcatgaagctggagggattgtggagagcataggcgagggtgtgacacatctaaaaccaggcgatcatgccctgcctgtattcacaggggagtgtggggactgtccacattgtaagtcggaggaaagcaacatgtgtgatcttcttaggatcaacactgacaggggtgttatgatcaatgacaaccagtcaagattctctcttaagggacagcccattcaccatttcgtcggtacatctacattcagcgagtacactgtggttcatgccggatgtgttgcaaagatcaaccctgatgcaccacttgacaaagtttgtattcttagctgtggaatatgcacaggtcttggtgctactatcaatgttgctaaaccaaaacccggttcttctgtcgctatctttggacttggagctgttggccttgctgctgctgaaggggcaaggatttctggtgcatcaagaatcattggggttgatttagtttccagccgatttgaattagctaagaagtttggggtgaatgagtttgtaaaccctaaagatcatgacaaacctgttcaacaagtaattgctgaaatgaccaacggaggtgtggatcgtgctgttgaatgtaccgggagcatccaggccatgatctctgcattcgaatgtgtccacgatggttggggtgttgctgtacttgttggagtgccaaacaaagatgatgcatttcaaacacatcctatgaatttgttgaatgaaaggactcttaagggtacattttatggaaactacaaaccccgcactgatcttcctaatgttgtagaaaagtacatgaaaggggaactggaactagagaaattcattactcacacaattccattttcagagattaacaaagcttttgattacatgctgaaaggggagtccatcagatgtatcatacgaatgggggagtaaaactctagaacactgttgaaatatgccatactagtgtggactgagttatctttctagttttttatttatataaataattttcataaataatcccttttggattattgagtttgtgagaatttgtgaaatttgcatgtaaagaattatgctactgggattgtctaataaaagataagctagattttg

SEQ ID NO: 2927 - DNA, 1389 bp, Helianthus annuus
cggcttcccgagccaccgcagctttgcatcgaattacttcaccacacaaaatcaaatcaaaacaataacgagagtttacgacaatgtctggtgaagtaattcgatgcaaagctgcggtggctcgggaagccggaaagccgctggtgatggaggaagtggaggtggcgccgccgcagaagatggaggtccggttgaagatcctcttcacgtcgttgtgtcacaccgatgtttacttctgggaagctaagggacaaaaccccttgtttcctcgcatattgggccacgaagccggaggaattgtagaaagtgtaggtgagggtgtgaccgaactgaaaccgggggacaaagtcctcccgatattcacaggagaatgtggcgagtgccgccattgcaagtcagaagatagtaatatgtgtgatcttcttaggattaatacagataggggtgttatgatcaatgatggtaagtcaaggttttcaaaagacggtcaaccgatctaccatttccttgggacctcaacctttagcgagtacacggttgttcattctgggtgtgttgctaagatcaaccccgatgctccacttgataaagtctgtgttcttagctgtggcatttctacaggcatgggtgcaaccctgaatgtcgcaaaaccgaaaaagggtatgagtgttgctatatttgggctaggagctgtagggcttgctgctgctgaaggagctcgcattgccggggcttctagaatcatcggtatcgatttaaatccgagcagagccaatgaagccaagaagtttggtgttaccgaattcgtgaatccaaaagatcatgataaaccaatccatgaggtcattgctgagatgacggatggtggtgttgatagaagtgtcgagtgcactggaaatgtcaaggctatgatttccgcttttgaatgtgttcatgatggttggggtgtggctgtacttgttggggtcccgaacaaagacgacgagttcaaaactcttcctataaatttcctgaacgagaggactctgaagggtacatttttcggtaactataagccccgtaccgatattccaggtgttgtcgagaaatacatgaataaggaattagaagttgagaagtttataacacactctgttggtttctcggagatcaacaaagcattcgactacatgcttaaaggtgaaagtctccgttgcatcatccgaatggatgcataggcgggtcacgttgcgtatgttaataatatatggtttttagtatatgatatgcatgcatagaggaataaagcttggtacaatgggacttataattcccatggaagctagatatataacattatatggtatgtaaggtttcagttttaatgatgcaacttttttggtgttagta

SEQ ID NO: 2928 - DNA, 1285 bp, Thellungiella halophila
gacaaatcacaaatcacacaaacaaaactaaagatcaagttaataaccactgttgataatgtctacgaccggacagattattcgatgcaaagcggctgtggcatgggaagccggaaagccactggtgatggaggaagtagaggttgctccgccgcagaaacacgaagttcgtatcaagattctcttcacttctctctgccacaccgatgtttacttctgggaagcaaagggacaaacgccgttgtttccacgtattttcggccatgaagctggagggattgttgagagtgttggagaaggagtaactgatctttcaccaggtgaccacgtgttgcccatcttcaccggagaatgtggagattgccgtcactgccactcggaggaatcaaacatgtgtgatctcctcaggatcaacaccgagcgaggcgcgatgattcacgacggtgaatcgagattctccatcaaaggcaaaccgattcaccatttccttgggacatcaacgttcagtgagtacactgtggtgcactctggtcaggtcgctaagatcaatccggctgctcctcttgacaaagtctgcattgttagctgtggtgtatccactgggcttggagccactttgaatgtggctaaaccaaagaaaggccaaagtgttgccattttcggccttggtgctgttggtttagccgctgcagaaggagctagaatcgctggtgctgcgaggatcattggtgttgaccttaaccccaacagattcgaggaagctaagaaattcggtgtgactgagtttgtgaaccctagagagcatgacaaaccagttcagcaagtgatcgctgagatgacagacggtggtgtggaccggagtgtggagtgcactggaagcattcaggccatgattcaagcatttgaatgtgttcatgatggttggggtgttgccgtgctggtcggtgtgccaagcaaagacgatgccttcaagactcatccgatgaatttgctgaatgagaggactctcaaaggtactttctttggcaactacaaacccaaaactgacattcccggggtcgtcgagcagtacatgaacaaggagttggagcttgagaagttcatcactcattcagtgcccttctcagagatcaacaaggcgtttgattacatggcgaggggagagggtatccgttgcatcatcaccatgggggcttgaaatccattctcgtaccaatgatgtctacttttgtgttttagttgccttttgtgtactcacagcaataaactaaataaagatattcct

SEQ ID NO: 2929 - DNA, 1461 bp, Solanum lycopersicum
tatggtcttgtgattgtttttgtgtagctgcggttgcatgggaagctggaaaacctttggtaattgaagaagtggatgttgcacctccacagaaacatgaagttcgtctcaagattctcttcacctcattgtgccacactgatgtttacttctgggaagctaagggacaaacacctttgtttcctcgaattttcggacatgaagctggaggaattgtggagagtgtaggtgaaggtgttacagatcttcaaccaggagatcatgttcttcctgtgtttaccggagaatgtcagcaatgccgtcactgtaaatcatcagaaagcaacatgtgtgaactcctaagaataaatacagacaggggagttatgattagtgatggtcaaacaagattttccaaggatggaaagccgatataccactttgttggaacttccacttttagtgaatacactgttgctcattctggttgcgtcaccaagatcgatccacaggcaccacttgacaaagtttgtgtcctgagttgcggaatatcaacaggacttggtgcgactctgaatgttgccaaacctactagaggttcttatgtggctatttttggtttgggagctgttggccttgctgctgctgaaggagctaggctagctggggcttctaggatcattggtattgatttgaatcccagcagattcaatgatgccaagaaattcggtgtcacagagtttgtgaatccaaaagatcatgataagcctgttcaggaggtgatcgctgagatgaccaatggaggtgttgaccggagtgtcgagtgtactggaaatgttaacgctatgatctctgcttttgaatgtgttcatgatggttggggtgtggctgtgcttgttggcgtgccaaacaaagacgatgcattcaaaactcatcccatgaacctgttgaatgagaggacactcaagggcaccttctttggtaactacaagcccaaaactgatctcccatctgtggtggccaagtacatgaataaggaactagagctggagaagttcatcacccatcaagtaccattttcagagatcaacaaagcatttgacattatgctgaaaggggaaggcctccgttgcatgatcactatgggacgttgaaatatgctaaatagggaaaataggacagtatattacctagtaatatagagcttgaatgtaataaaacaaacggtattttaatgggtaaaataatgttaaaagtagagtttggaggcaaagtatatgttttctaaaaggcctcctgagtttgctcaacatattgtgtaataatatttgcatattttgaaagactttttgagttttggtcacttccatgttatattcgtactgttgtgctttagaacaaattttagactctaaatactactaacttagatcttttagactacaataggtcattgtaacaccatcaagactatgagaagtt

SEQ ID NO: 2930 - DNA, 1303 bp, Trigonella foenum-graecum
gccggggacacacaactcattcatcatcatcttttgtcaattaactatgtccaacactgctaataaggtcatcaagtgcagagctgcggttgcatgggaggctgggaagccacttgtgatggaagaagtagaggtggcgccaccgcaggccggtgaagtccgtctcaagatactcttcacctccctttgtcacactgatgtttacttctgggaagctaagggtcaaactccattatttcctcggatatatggtcatgaagctggagggatcgtagagagcataggtgagggtgttactaatctgaaaccaggagatcatgcccttcctgtattcacaggggaatgtggggaatgtccacattgtaagtcagaggagagtaacatgtgtaatcttcttaggatcaacactgacagaggtgtcatgatcagtgacaacaagtctaggttctctattaagggacagcccatacaccatttcgttggtacttcgacattcagcgaatacactgtggttcatgctggatgtgttgcaaagatcaaccctgatgcaccacttgacaaagtttgtattctcagctgtggaatatgcacaggtcttggtgctactatcaatgttgctaaaccaaaacccggttcatctgttgctatctttggacttggagctgttggtcttgctgctgctgaaggggcaaggatgtctggtgcatcaagaatcattggagttgatttagtttccagccgattcgaattagctaagaagtttggggtaaatgagtttgtcaacccaaaagatcatgacaaacctgtacaacaggtaattgctgaaatgacaaatggaggcgtagatcgtgctgttgaatgtaccggtagcgtacaagctatgatctcagcatttgaatgtgtgcatgatggttggggtgtggctgtacttgttggagtgccaaacaaagatgatgcattcaaaactcaccctatgaatttgctgaatgaaaggactcttaagggtaccttttatggtaactacaagccccgcactgatcttcctaatgttgttgagaagtacatgaaaggggagctggaacttgagaaattcatcactcactcaatcccattttcagagattacaagcttttgattacatgctgaaaggggcgtccatcagatgtatcatccgaatggaggaatgaaactaaatagtgatgtaataataataatctcttctagggggctcacttctctctttggttgttgcaaaaataatttcataataatttcctttgataattgagtttgagtgaatttg

SEQ ID NO: 2931 - DNA, 1484 bp, Amsonia hubrichtii
accctctgtaatctctgcgtgcgagtgacaagtggtttttgacatttctccgctctccaaaactgcatataagatcatccctgtaaaattgcctcacaaccaaaccgcaatacctctaagcttttttgtttttctagctataaatctcatctccttcactgcattgcgaaatacaagaaggttttaccatgtcaagtactgctggtttagtgatcccctgcaaagctgctgtttcatgggaggcagggaagccgctggtgatcgagcaagtggaggttgcaccacctcaagccttggaagtgagggtcaagattaaatacacatccctttgtcacactgatctctatttctgggaagctaaagggcaaacaccagtgtttccacgcatatttggtcatgaagcagccgggatagtagaaagtgttggagaaggggtgtcagatctccaagttggggatcatgttcttccagtattcaccggggaatgtggtcagtgtgctcattgcatgtccgaggaaagcaacatgtgcaatctgcttaggataaatacagacaggggcgtaatgcttagcgatgggaaatctaggttttcaatcgatgggaacccaataaaccattttctaggtacttcgacctttagtgaatacactgttgtccattcgggctgccttgcaaagctcaatccattggcaccactagataaagtatgtattctcagttgtggcatctcaacaggattgggtgcaaccctcaatgtggcgaagccgaaaaagggctcctcagttgccatctttgggctaggagcagttggcctggctgctgctgaaggtgcaagaattgccggggcctcaaggattataggggttgacttgaaccccaataggtttgagggagccaagaaattcggggtaacagattttgtaaatccgaaagaccatgaaagaccagttcaagaggtcattgcagagatgacaaatggcggagttgataggagtgtggaatgcactggaaacattaatgccatgatttctgcctttgaatgtgttcacgatggatggggtgtcgctgtacttgttggagtgcccaacaaggatgcagttttcatgactaagcctatcaatctgttaaatgagaggacactcaaaggaaccttcttcgggaactataaacctcgtaccgatcttccctctgttgttgatatgtatatgaacaagaaactggagctagaaaagttcattacccatcatgtcccattctctgaaatcaacaaggcttttgactacatgttgagaggggagggtctccgatgtatcatcaacatggaagagtagtcttttctgaagacgtctatgaagagagtatctagattaatatctagtcttcctaaagtagtcatatccttttgcattgtccctttgttgttcacttctgatttgcttgtttgattaaaccgctgagttcttcagctacgaaagtttaatgga

SEQ ID NO: 2932 - DNA, 1157 bp, Gossypium hirsutum
tgttaacagccattatgagtactgctggtcaggtcattcgttgcagagctgcggtggcgtgggagtcgggaaagccattgtcaatagaggaagtggaagtggcaccgccgcagaaggatgaagtccgtattaagatactcttcacttctttatgtcacaccgatgtctacttctgggatgctaagggacaaaatcctctgtttcctcgtatacttggtcatgaagctggagggattgtggagagtgtaggtgagggggtgactgatctcaagcctggcgatcatgttctccccatcttcaccggagaatgcaaggagtgtccccattgcttgtcagaagaaagtaacatgtgtgatctcctccgaatcaacactgataggggtgaaatgattaatgatggaaaatccaggttttccatcaatgggaagcctatctaccacttccttggcacctctactttcagtgaatacactgttgtccatgtcggccaggttgccaagatcaatccggaggctccgcttgataaagtttgtgttctaagctgcggaatgtccacaggttttggtgccactgtgaatgttgctaaacccaaaaagggtcaatctgttgcaattttcggactaggcgctgttggtcttgctgctgccgaaggagcaagagtttccggtgcttcgaggatcattggcgttgatttgaaccccagcagatttgaacaagccaagaaattcggtgttacagagtttgtgaatccaaaagattacaacaaacctgtccaagaggccattgttgagatgactggtggaggagtcgatcgcagtgttgaatgtacggggagtatccaggccatgatttctgcatttgaatgcgtccacgatgggtggggagttgcggtgcttgtgggtgttccaaacaaagacgatgcattcaaaactcacccggtgaatctgctgaatgagaagactgtcaagggtactttctttggaaactacaaacctcggtctgacattcctgctgttgtggagaaatatatgaacaaggaacttgagctggataaattcatcacacacactgtgcccttctcagagatcaacaaggcatttgagttgatgctggcgggtgagggactgagatgtgtgattcgcatggatgaataagga

SEQ ID NO: 2933 - DNA, 1665 bp, Arachis hypogaea
cgccggggtgcaacgttcaaggccttttctttcacaaagatttttctctcagttttcttgtgcatcttcgtcatcatcaccacctctcactaacaacatgtccaccacttctggtctcgtcattccctgcaaagctgctgttgcatgggaagcagggaaaccactggtgatagaaaaagtggaggtggctccgccacaggccatggaagtgaggatcaaggttaaatatacctcactctgccatactgatctctacttctgggaggccaagggacaaactccattgtttccccgaattttcggccatgaggctgctggaattgtggagagtgttggagaaggagtcacagacttgcaggttggggatcatgtgcttccagtattcaccggtgaatgtggtgaatgcgctcattgcaaatccgaggaaagcaacatgtgtgacctcctgagaatagatacagagagaggagtcatgcatagtgatggtaaaagcaggttttccattaatggtacgccaataaaccactttgttggcacgtccacgtttagtgagtacactgtgatacattctggatgcttggcaaagctcaatccactggcaccaatggataaagtatgtgtcctcagttgtggtatctcaacaggattgggagcaactttgaatgtagcaaaaccaaagaagggttctacagtggcagtgtttggtcttggagctgttggacttgctgctgctgagggtgcccgaattgctggtgcatctagaattattggaattgatttgaacccaaacaggtttgaagaagcaaaaaaatttggaataaccgattttgtgaatccacaggactatgataggccagttcaacaggtgattgcggaaatgaccaatggaggagttgatcgaagtatagagtgcactggaaacattaacgcaatgatatctgcttttgaatgtgttcatgacggatggggtgttgctgtgcttgttggagttccaactaaggatgcagttttcatgaccaagcccattaatttgctcaacgaaagaacactaaaaggaactttctttggaaattacaagcccaggaccgatcttccatctgtggtcgatatgtatatgaacaagaaattggaattggacaagtttataacccacagagttcctttctctgaaatcaacaaggcatttgatctaatgttgagaggggagggactaaggtgtatcattagtatggaagactaaagaatttgaaagaaaaaaaaatgatagatccatatgaataattttcagctatgtgtaattaataaatgtttcaatatcatccataataatgatattgagtaatcacttcacattcaaaatcattcctactattttctaaatgtaaaatggatgaaatatacattgtttcatgtggtatgttgcatattcctaccattgaagaacattagagaacaagacagaattcatactgttatagcttgcgactgggcttttctacttaacttgccccttagccttatgtttagagtggtgttttagtacctggagtcttcagtttttaatattagttaataatctatggtgatgtaatttttgttttccactgaaggcaagtttccttctgtttcttgggctttttctgttctttaagtgaataaggagca

SEQ ID NO: 2934 - DNA, 1485 bp, Castanea mollissima
tattttatttcactcagaagaatcatccaagtttaagctatgtcaagcacaactggtcaggtcattaagtgcaaagccgctgtggcatgggaggctggaaagccattagtgattgaagaagtggaggtagcaccacctcaggcaaatgaagtccgcataaagattctatttacctctctttgccacactgatgtttacttctgggaagccaaggggcagacaccgctttttcctcgcatatttggtcatgaagctgggggaattgtggagagtgtaggtgagggtgtgactgagctcaaaccaggagaccatgttctcccgtgcttcactggagaatgcggggattgccaccactgtaagtcagaggagagcaatatgtgtgaccttcttcggatcaatactgagaggggagttatgctcaatgatggaaagacaagattctccaaaaatggacagcccattttccactttgttggcacctccacatttagcgaatacactgttgttcacattggctgcgttgccaagatcaaccctgcagctccacttgacaaagtttgtgtacttagttgtggaatatccacaggtatgggtgccactttgaatgttgcaaaacccaaaaagggtcaatctgtagctgtatttggattgggtgctgttggccttgctgcttgtgaaggcgcaaggatggctggggcttcaagaatcattggtattgatctgcactctggtcgtttcgaagaagccaaaaagtttggtgttactgagtgtgtgaacccaaaagatcatgacaagcctattcaagaggtgattgctgagatgactgatggaggagtggatcgggctgttgaatgtactggaagtatccaggccatgatctcagcatttgaatgtgttcatgatggttggggtgttgcagttcttgttggggtaccaagtaaagatgattcattcaagacccatcctatgaattttttgaatgagaggactcttaagggtaccttttttggcaattacaagccccgcactgatattccttctgtggtggaaaagttcatgaacaaggagttggaattggataaatttattactcactcggtccctttctcggagatcaacaaagcatttgactacatgcgggatgggcactctatccgatgcattatctgcatggatgcttaaaacattactgatcaagatggtgtgcatcattgatgcccagagatctttgctagcaattttgaataaggtttatgaacttaatatgtagagagaagcagtttgtgttacttgtttgtgttatcttataaaaattttatttatgttcctattgactaatctgtaatatcattattggatggatatcttgatgttgttgttgtcattatgaaattttgtttctgcatatgtatccacagggtttaaatcttggatgaaaaacttgggtttaaatccggactataagagcgataattatgattgggt

SEQ ID NO: 2935 - DNA, 1645 bp, Mimulus guttatus
gagacaaatgggagggcttgtagagcaagaaagtgacacgttggttgaaggtaagaatgaatttgccaaatgtgagtgcttttctcttctcttctcttctcttctctggcggtggatggatggatggatatgttccactttgctctctatatatacatatatgtgtgtgtatgtatatgtatatgtatctcagctccacggtgtttatcaattacacacactgacacacaaatacacacaaagtgatcggtgagaaaatgtcgagcactgaaggtcaagttattcgctgcaaagcggcggtgtcatgggaggccgggaagcctctggtgattgaagaagtggaggtggcgccgccgcagaaaatggaagttcgtgtgaagatcctcttcacctccctctgccacaccgatgtttacttctgggaagctaagggacaaacccctctgtttcctcgtatattcggccatgaagctggaggaattgtggagagtgtaggagaaggtgtgacggatctgaaaccgggcgaccatgttcttccggtgttcaccggagagtgcaaggagtgccgccactgtaaatcgtcggaaagcaacatgtgcgatctcttgagaataaacacagagagaggtgccatgattgaagatggcaaaaccaggttctctaaagatggcaaaccaatccaccatttcttgggaacttcgactttcagcgaatacacagtcgtccacgttggctgtcttgccaagatcaatccatccgccccactcgacattgtttgtgtcctcagctgtggaatatcaaccggacttggtgccactttgaatgttgcgaaaccgactaagggatcgactgttgccattttcggattgggagctgttgggcttgctgctgcggaaggggctcgaatctcaggggcgacgaggattataggggttgatttaaacccgagtcgtttcaatgaagcaaagaaattcggtgtgacggagtttgtgaatccaaagaattatgacaagcctgttcaagaggtgattgctgagatgaccgatggtggagttgaccgtagcatcgagtgcacgggaaatgttaatgcaatgatatcggcattcgaatgtgttcatgatggttggggagtggcggtgcttgtgggagtgccgaacaaggacgatgcattcaagactcatccggtaaatttgctgaacgagaggactctcaaaggaacatttttcggcaattacaagccgaggagcgatatcccaaatgtcgtcgaaaagtatatgaacaagattttgggaatggcaggagctggagctggatcccattctcggagataaacaaagcttttgattacatgctcaaaggggagtctcttcgttgcattatcaccatggataataataataataataattaactcatcaaggaaggaacactttgttaattaattaattaatcatgtatgttagccctaatagtaatttgatctagtattttaataatagttcgaattttcatgttgttgttcaattataattactacttacctattttgttatatgattaattatttttcaagcagagctgaagagtagggtacattggattttttgtttatttttctattcttaattattaatatatgaatcat

SEQ ID NO: 2936 - DNA, 1486 bp, Arnica chamissonis
aatgtaattcgatgcaaagctgcggtggctcgagaagccggaaagccgctggtgatcgaagaagtggaggtggcgccgccgcagaaaatggaagtccgtttgaagatcctcttcacctccttgtgtcacaccgatgtctacttctgggaagcgaagggacaaaaccccttgtttcctcgcatcttaggccatgaagccggaggaattgtagagagtgtaggtgagggtgtgaccgaattgaaacccggcgacaaagtcctcccagtattcaccggagaatgtggcgagtgtcgccattgtaagtcggaagagagtaatatgtgtgatcttcttaggattaatacagataggggtactatgattaatgatggaaagacaaggttttcaaaagacggtcagccgatctaccattttcttgggacctcaacctttagtgagtacacggttgttcattccggctgtgttgctaagatcaaccccgatgctccacttgataaagtctgtgttcttagctgtggaatttctactggcatgggtgcaaccctgaatgtcgctaaaccaagaaagggtatgagtgttgctatattcgggctaggagctgtcgggcttgctgcagctgagggagctcgcattgctggggcttctagaatcattggtattgatctgaatgcgagtagggccaatgaagccaagaagtttggtgttactgaatttgtgaatccaaaagatcatgataaaccgatccacgaggtcattgctgcgatgacggatggtggtgttgatagaagtgttgagtgcactggaaatgtgaaggctatgatttcagcttttgaatgtgttcatgatggttggggtgtggctgttcttgttggggttccgaataaagatgatgaattcaaaactcttcctataaactttttgaacgagaggactctgaagggcacttttttcggtaactataaaccccgtaccgatattcccggtgtcgttgagaaatacatgaaaaaggagttagaagttgagaagtttataacacaccatgtcggtttctcggaaatcaacaaagcgtttgactacatgcttaaaggcgaaagtctccgttgcatcatccaaatggacgcgtaggtgatgttaatgatatggcttttagtgaataagatgcatgcatagatgaataaagcttggtgcaatgggacttataaatcccatgtaatctaagctagattaatatcactatatgttatctatggtttcttgattttaaatggtccagtattgtttttctcaacaaaatctatttttgtcagaaatgcaataggaaaacgttgtttcctacgctatttttctagttattagcgtatggaaatgacttagtttctagcactcagccatttcatgcatgaactcgtagatacgaaaaggagtcggatcgggtaaccccgtcaattcccacgagtttttcggtccctgtccgaccatatccttg

SEQ ID NO: 2937 - DNA, 1395 bp, Malus domestica
ataatcccattgctaaaaccatcctctgagttctaccaaatcaactgaaatcttacttctttaacccccaaatctttactacatgtcgtctacagccggccttgtgatcccctgcacagcggcggttgcatgggaggcagggaagccattggtgatggagagggtggaggttgctccacctcaggccatggaagttagggtcaagatcaaatatacttcactttgccacactgatctctacttctgggaagccaagggccagacacctttgttccctcgaattttcggccatgaagcatctggaatcgttgagagtgttggggaaggcgttgaaggcctcgaggttggtgatcatgtactacctgttttcactggggagtgtggggattgtgcgcattgcaagtctgaggaaagcaacatgtgtgacctgttaagaataaatacagatagaggggtcatgctaagtgatgagaaaccgaggttttctataaatgggactccgattaatcacttcgtcggcacatccaccttcagtgaatacactgttattcattccggctgccttgccaagatcaatcccctggctcctttggatatagtttgcatcctcagctgtggcatcacgacaggtttgggtgccactctgaatgtagcaaaaccgaaaaagggatcttcagttgctatctttggacttggggctgttgggctggctgctgctgaaggtgcaagaatttctggggcgtcgcggattattggggttgacaggaatcccaagaggtttgaggaagccaagaaatttggagtgaatgagtttgtgaatccaaaggaccatgacaaaccagtccaggaggttattgctgagatgaccaatggtggagctgacagaagcatagagtgcacgggcaatattaacgccatgatctcggcttttgaatgtgttcatgatggttggggtgtggctgtgcttgttggagttccgaacaaggatgcagtcttcatgactaagcccattaatttgcttaatgaaaggacgcttaaaggaactttttttgggaactacaaacctcggacagaccttccttctgttgtggaaatgtacatgaacaagaaattggaagtagagaagtttataacgcatcgggtgcctttctcagagatcaataaagcctttgattacatgataaggggagaaggcttgcggtgcatcgttagcatggaagagtagctatcagttcataaataaacttcaataagtttccaactttgatgaacaactttagtattgcccaaagtatgcagttttacactgcttaagcgatcttctatgtttaatctacaaattttatgtcaagttgggttcaattaagtactcatggactcgtttttttcgtaaaa

SEQ ID NO: 2938 - DNA, 1392 bp, Malus domestica
aataatcccattgctaaaaccatcctctgagttctaccaaatcaactgaaatcttacttctttaacccccaaatctttactacatgtcgtctacagccggccttgtgatcccctgcacagcggcggttgcatgggaggcagggaagccattggtgatggagagggtggaggttgctccacctcaggccatggaagttagggtcaagatcaaatatacttcactttgccacactgatctctacttctgggaagccaagggccagacacctttgttccctcgaattttcggccatgaagcatctggaatcgttgagagtgttggggaaggcgttgaaggcctcgaggttggtgatcatgtactacctgttttcactggggagtgtggggattgtgcgcattgcaagtctgaggaaagcaacatgtgtgacctgttaagaataaatacagatagaggggtcatgctaagtgatgagaaaccgaggttttctataaatgggactccgattaatcacttcgtcggcacatccaccttcagtgaatacactgttattcattccggctgccttgccaagatcaatcccctggctcctttggatatagtttgcatcctcagctgtggcatcacgacaggtttgggtgccactctgaatgtagcaaaaccgaaaaagggatcttcagttgctatctttggacttggggctgttgggctggctgctgctgaaggtgcaagaatttctggggcgtcgcggattattggggttgacaggaatcccaagaggtttgaggaagccaagaaatttggagtgaatgagtttgtgaatccaaaggaccatgacaaaccagtccaggaggttattgctgagatgaccaatggtggagctgacagaagcatagagtgcacgggcaatattaacgccatgatctcggcttttgaatgtgttcatgatggttggggtgtggctgtgcttgttggagttccgaacaaggatgcagtcttcatgactaagcccattaatttgcttaatgaaaggacgcttaaaggaactttttttgggaactacaaacctcggacagaccttccttctgttgtggaaatgtacatgagcaagaaattggaagtagagaagtttataacgcatcgggtgcctttctcagagatcaataaagcctttgattacatgataaggggagaaggcttgcggtgcatcgttagcatggaagagtagctatcagttcataaataaacttaaataagtttccaactttgatgaacaactttagtattgcccaaagtatgcagttttacactgcttaagcgatcttctatgtttaatctacaaattttatgtcaagttgggttcaattaagtactcatggactcgtttttttcgt

SEQ ID NO: 2939 - DNA, 1455 bp, Arabidopsis lyrata
acttcttccatttaccagctgctatataaatcccttctctgtttctctcttcttaccatcacaacagtcacacaaaactaataaaagatcaaaaagcaagttcttctctgttgataatgcctaccaccggacagattattcgatgcaaagctgctgtggcatgggaagccggaaagccactggttatggaggaagtggaggttgctccgccgcagaaacacgaagttcgtatcaagattctcttcacttctctctgtcacactgatgtttacttctgggaagctaagggacaaacaccgctgtttcctcgtatcttcggccatgaagctggagggattgttgagagtgttggagaaggagtgactgatcttcagccaggagatcatgtattgcccatcttcaccggagaatgtggagattgtcctcattgtcactcggaggaatcaaacatgtgtgatcttctcaggatcaacaccgagcgaggagggatgattcacgatggtgaatcaagattctccatcaatggcaaaccaattcatcatttccttgggacttccacatttagtgagtacactgtggttcactctggtcaggtcgctaagatcaatccggatgctcctcttgacaaagtttgcattgttagttgtggtttatccactgggttaggagcaactttgaatgtggctaaacccaagaaaggtcaaagtgttgccattttcggacttggtgctgttggtttagctgctgcagaaggtgctagaatcgctggtgcttctaggatcatcggtgttgatcttaactctcaaagattcgaccaagctaaggaattcggtgtgaccgagtttgtgaacccgagagaccatgacaaaccagttcaacaggtgatcgctgagatgacgaatggaggagtggacaggagtgtggagtgcactggaagtgttcaggccatgattcaagcatttgaatgtgttcatgatggttggggtgttgcggtgctggtcggtgtgccaagcaaagacgatgccttcaagactcatccgatgaatttcttgaatgagaggactcttaagggtactttcttcgggaactacaaacccaaaactgacattcccggggttgtagaaaagtacatgaacaaggagctggagcttgagaaattcatcacccatacattgccattctcggagatcaacaaggcctttgattacatgttgaagggagagagtattcgttgcatcatcaccatgggtgcttgaagccattctgttgccgatgatgtctactttgtgttttacttccctttatgcacccacagcaataaaagaagacatctctatcgcttctggctttcttgtctgtcttaagttagtcgttgtccagtctaatctattacgtatcgttgtaatatctcattctattgagattttaatataaagtaaaagacattccttttta

SEQ ID NO: 2940 - DNA, 1457 bp, Arabidopsis thaliana
tctacttcttccaattaccagctgctatataaatccccttctctgtttctcttttcttacatcacaatcacacaaaactaacaaaagatcaaaagcaagttcttcactgttgataatgtctaccaccggacagattattcgatgcaaagctgctgtggcatgggaagccggaaagccactggtgatcgaggaagtggaggttgctccaccgcagaaacacgaagttcgtatcaagattctcttcacttctctctgtcacaccgatgtttacttctgggaagctaagggacaaacaccgttgtttccacgtatcttcggccatgaagctggagggattgttgagagtgttggagaaggagtgactgatcttcagccaggagatcatgtgttgccgatctttaccggagaatgtggggagtgtcgtcattgccactcggaggaatcaaacatgtgtgatcttctcaggatcaacaccgagcgaggagggatgattcacgatggtgaatcaagattctccattaatggcaaaccaatttaccatttccttgggacttccacgttcagtgagtacacagtggttcactctggtcaggttgctaagatcaatccggatgctcctcttgacaaggtctgtattgtcagttgtggtttgtctactgggttaggagcaactttgaatgtggctaaacccaagaaaggtcaaagtgttgccatttttggtcttggtgctgttggtttaggcgctgcagaaggtgctagaatcgctggtgcttctaggatcatcggtgttgattttaactctaaaagattcgaccaagctaaggaattcggtgtgaccgagtgtgtgaacccgaaagaccatgacaagccaattcaacaggtgatcgctgagatgacggatggtggggtggacaggagtgtggaatgcaccggaagcgttcaggccatgattcaagcatttgaatgtgtccacgatggctggggtgttgcagtgctggtgggtgtgccaagcaaagacgatgccttcaagactcatccgatgaatttcttgaatgagaggactcttaagggtactttcttcgggaactacaaacccaaaactgacattcccggggttgtggaaaagtacatgaacaaggagctggagcttgagaaattcatcactcacacagtgccattctcggaaatcaacaaggcctttgattacatgctgaagggagagagtattcgttgcatcatcaccatgggtgcttgaagccattctctcgcagatgatgttcactttgtgttttacttcctttatgcattcacagcaataaaagaaagaaatctccatcgcttttggttttcttctctgtcttaagttagtcgttttcgtgtctaatctattacttatcattgtaatagactcttcttctattgagatttgaatataaactaaaacacattccatttta

SEQ ID NO: 2941 - DNA, 1764 bp, Castanea mollissima
attgaatccaaatcataagaaatttttggtttagcaatgctgtgtctggaaaggagcaaagtatttggtaatccacagaaagcaagcctacttattacgcagttttacagagaaagcaaatggaatatatgcctataaactttgcgtgctgccttcctaatcggagcggtttatatttttggctttgtaaatccatgggcagccaacagcaattagtgtttgagtttgactaaacattttcgcttcattcattctgaaattgaaccaaccatgtctactacttctggccttgtgattccctgcaaagccgccattgcgtgggaggcagggaagccactggtgatagagcaagtggaggtggctccgccacaggctatggaagtgaggatcaagatcaaatatacttcactttgccatactgatctctatttctgggaggccaagggccagaatccactgtttcctcgaatatttggccatgaagcagctggggttgtagaaagcgttggggaaggtgtatcagacctccaagttggggatcacgtgcttccggtgttcactggagagtgcggggactgcaggcactgcaagtctgaggaaagcaatatgtgtgaccttctgagaataaatacagacagaggagttatgcttaatgatggaaaatccaggttttctatcagtgggactcctataaatcactttcttggtacatccacattcagtgagtatactgttattcattcaggatgcctagctaaaattagtccgctagcacctttggataaggtctgcatcctcagttgtggcatctcaacaggattaggtgcaactttgaatgttgcaaaaccaaagaagggatctacagttgctgtttttggtcttggagctgttgggctggctgctgctgaaggtgcaagaattgctggggcatcaaggattattgggattgacttgaatcccaagaggtatgaggaagccaagaaatttggagtaactgagtttgtaaatccaaaggaccacgacagaccagttcaagaggttattgctgagatgacaaatggtggagttgacaggagtatagagtgcaccggcaacatcaatgccatgatctctgcttttgagtgtgttcatgatggatggggtgtagctgtgctcgtaggggtgcccaacaaggatgcggtgttcatgaccaagcccattaatgtgcttaatgagaggacactcaaaggaactttctttggaaactacaaacctcggactgaccttccctcagttgttgacatgtacatgaacaagaaattagaagtggagaaatttataacccaccgggtccctttctccgacatcaataaggccttcgagtacatgttgaagggagagggtttgcggtgtataattagtatggaagaatagagttttcgacagaattaagaaataactatgggtttttgaacccggattctcaggtttaatttatcttttatgaataaagctacaaacacatcattttcccaacaaacctaagtagaaattattaatagtaagctttgttgtgaaagtgttgtgggggtagtactttttacaggcactactaaaccaggatccttttatgtattatgggaatgggccatcctctggccgattaaatgtaatcatatagaaataatgggccccaaaagcccgggttgtactctctctttctgagacgcatatacgtacatcatatatgataggaacttgtgctttgagaattaattcaggtgc

SEQ ID NO: 2942 - DNA, 1365 bp, Zingiber officinale
  misc_feature (450)..(450): n is a, c, g, or t
  misc_feature (480)..(480): n is a, c, g, or t
agcactttatagccttcagagaaggaatagtgtgagttttcaagtgtctgagaaatgtcgagcaccgctggtcaagtcatcaaatgcagagctgctgtatcatgggaggcagggaaaccattgacgatagaagaggtggaggtagcacctcctcaggcaatggaagtcagaattaaggttctcttcacctcactttgccacactgatgtttacttttgggaagctaaagggcaaaaaccgatgtttcctcggatctttggccatgaagctgcagggattgtagagagtgttggagaaggtgtgactgatttggtaccaggagatcatgtcctccctgtcttcactggagaatgcaaggagtgtgcccattgcttatcctcagacagcaatatgtgcagtctcctaaggataaataccgacaggggagtgatgctcgctgatggtcaatcncgattctcaatcaatggccaacccatttancatttcctcggaacatcaacgttcagtgaatacaccgtagttcactcaggttgcgttgcaaagatcaatcctttggctcctctggacaaagtttgtattcttagctgtggcttctgcacaggtttcggcgcaactgttaacgttgccaaaccacccaagggatcagccgtggctattttcgggttgggtgctgtgggcctctcagctgctgaaggtgctagagtttcaggggcttcgaggataattggggtcgatatcaaccccaatagatttgaagaagccaagaactttggagtcaatgaatttgtgaacccaaaagattatgacaggcctgttcaagaggtgattgctgaaatgaccaatggtggagtggatcgaagtgttgaatgcactggaaacattgatgcgatgatatctgctttcgaatgcgttcacgatggatggggtgttgctgtgctggttggggtgcctcataaggatgctgttttcaagactcatcctgttaatttcttgaacgagagaaccctcaagggaactttctatggccactataaaccaagaactgatctccccggtgtagtcgaaaagtacttgaacaaggagattgagttggagaaatttatcacacatgaagttagcttttctgacatcaacaaggcatttgactacatgctgcaaggggccagcctgaggtgcatcatccgcatggttgattaagagaggcctcctctcaagaaacataacgcatagatcagttggaatgatctttagagttctctgaataaatatgtgattattgttctataaagcttttgatttctcgttctcttcttgtgtggtcgttgtcattgtaaaaactaaaaacctttcctgaatgcaaatttt

SEQ ID NO: 2943 - DNA, 1517 bp, Tropaeolum majus
atgcaccaccctgattttctgtgtgcaccaaacaaacaaaacaccaaattatttccggttctcaaacttgtgtgcgcgcgcttttatacacagcaaaggaaaaaaaaaggtgctgtctagaagcgcccatagaaatcaacaatgaagctttagatagaacacagtaataacagaaaaaaagttttgaagaagctatgtcgactgctggacaagtgattcgctgcaaagccgctgtggcatgggaggcagggaagccgttggtaatcgaggaagtagaggtgtcaccaccgcaggcaaatgaagttcgtgtgaagatcctttacacctctttgtgccacactgatgtctacttctgggaggctaagggacaaacaccaaggtttcctcgtatttttggccatgaagctggagggattgttgagagtgttggtgagggagtgactactctccaaccaggagaccatgttctcccaatcttcaccggagaatgcggggactgtcgccattgtcatcacgaagaaagcaacatgtgtgaacttctcaggatcaataccgagaggactgagatgctcactgatggaacatcaaggttttcaatcaagggacagcctattaaccactttgttggcacctctactttcagtgaatacactgttattcattatggctgtcttgctaagatcaaccctgctgctcctctcgacaaagtttgcgtcctcagttgcggattatccactggttttggtgctgctgttaatgttgctaagacaaagaagggtgagactgttgtcgtctttgggctgggtgctgttggccttgctgctgctgaaggggctagggtgtctggagcctccaggatcattggtgtggacctgaacccggctagattcgaaggagctaagaagtttggtgtcaccgagtttgtgaatcctaaagatcacaacaaacctgttcaagaagtcattgctgatatgaccaatggaggagctgataaaagtattgagtgcaccggtgctgtccaggctatgatatcagcatttgaatgtgttcatgatggttggggtgttgctgtcctagttggtgtaccaaacagagatgacgccttcaagactcatccaatgaacttgctgaacgagagaaccttgaagggtaccttcttcggaaacttcaaaccccgcactgatatccccaaagtcgtggagcgatacatgagcaaggagctggaggtggagaaattcatcactcacaccgtacctttctctgagatcaacaaagcgttcgagttgatggctcgcggtgagggtattaggtgcataattcgcatggaggagtagcgaactcaagtgtaacgattgtccgccggatgatttatttgagtggtgttaatttacttattcgagtggtgtaagttaaaagaacttatgtctttgtttcgaatgatttcttgttatctttccttgtaaatcaagtaaattataaattacaaagatttgaatgattttaaagatttcgatgac

SEQ ID NO: 2944 - DNA, 1479 bp, Quercus alba
attttcgcttcgttcattctgaaattgaaccaaccatgtctgctacttctggccttgtgattccctgcaaagctgccattgcgtgggaggcagggaagccactggtgatagagcaagtggaggtggctccaccacagactatggaagtgaggatcaagatcaaatatacttcactttgccataccgatctctacttctgggaggccaagggccagaatccactgtttcctcgaatatttggccatgaagcagctggggttgtagaaagcgttggggaaggtgtatcagacctccaagttggggatcatgtgcttccggtgttcactggagagtgtggggactgcaggcactgcaagtctgaggaaagcaatatgtgtgacctgctgagaataaatacagacagaggagttatgcttaatgatggaaaatccaggttttctatcaatgggactcctataaatcactttcttggtacatccacattcagtgagtatactgttgttcattcaggatgcctaactaagattagtccgctagcacctttggataaggtctgcatcctcagttgtggcatctcaacaggattaggtgcaactttgaatgttgcaaaaccaaagaagggatctacagttgctgtttttggtcttggagctgttgggctggctgctgctgaaggtgcaagaattgctggggcatcaaggattattgggattgacttcaaccctaagaggtttgaggaagccaagaaatttggagtaactgagtttgtaaatccaaaggaccatgacagaccagttcaagaggttattgctgagatgacaaatggtggagttgacaggagtctagagtgcaccggcaacatcaacgccatgatctctgcttttgagtgtgttcatgatggatggggtgtagctgtgctcgtaggagtgccgaacaaggatgcggtgttcatgaccaagcccattaatgtgcttaatgagaggacactcaaaggaactttctttggaaactacaaacctcggactgaccttccctcagttgttgacatgtacatgaacaagaaattggaagtggagaaatttataacccaccgcgtccctttctccgacatcaataaggccttcgagtacatgttgaagggagagggtttgcggtgtataattagtatggaagaatagagtttttgacagagttaagaaataaatacaggtttttgaatccggattctcaggtttaatttatctgttatgaataaagctacgaacacaacatttccacaacaaacctaagtagcaaattattaatagtaagctttattgtgaaattttcgtgtgtagtactttttacaggcactactaaaccaggattcttttatgtattatgggaatgggccatcctctggccgtttaaatgtaatcatacagaaataatgtgccccagaagcccgggttgtgctctctctttctgagacgcatgtac

SEQ ID NO: 2945 - DNA, 1686 bp, Quercus alba
ttaaaacttgatgtcttttctctatcgttatctttgagcctaacacactcttcttctctactcttctcttctcaaccaaatttcagcccttccttccttcgttcttgctttcggttggagagaaacattttcgcttcattcattctgaaattgaaccaaccatgtctgctacttctggccttgtgattccctgcaaagctgccattgcgtgggaggcagggaagccactggtgatagagcaagtcgaggtggctccaccacagactatggaagtgaggatcaagatcaaatatacttcactttgccataccgatctctacttctgggaggccaagggccagaatccactgtttcctcgaatatttggccatgaagcagctggggttgtagaaagcgttggggaaggtgtatcagacctccaagttggggatcatgtgcttccggtgttcactggagagtgtggggactgcaggcactgcaagtctgaggaaagcaatatgtgtgacctgctgagaataaatacagacagaggagttatgcttaatgatggaaaatccaggttttctatcaatgggactcctataaatcactttcttggtacatccacattcagtgagtatactgttgttcattcaggatgcctaactaagattagtccgctagcacctttggataaggtctgcatcctcagttgtggcatctcaacaggattaggtgcaactttgaatgttgcaaaaccaaagaagggatctacagttgctgtttttggtcttggagctgttgggctggctgctgctgaaggtgcaagaattgctggggcatcaaggattattgggattgacttcaaccccaagaggtttgaggaagccaagaaatttggagtaactgagtttgtaaatccaaaggaccatgacagaccagttcaagaggttattgctgagatgacaaatggtggagttgacaggagtttagagtgcaccggcaacatcaacgccatgatctctgcttttgagtgtgttcatgatggatggggtgtagctgtgctcgtaggagtgcccaacaaggatgcggtgttcatgaccaagcccattaatgtgcttaatgagaggacactcaaaggaactttctttggaaactacaaacctcggactgaccttccctcagttgttgacatgtacatgaacaagaaattggaagtggagaaatttataacccaccgggtccctttctccgacatcaataaggccttcgagtacatgttgaagggagagggtttgcggtgtataattagtatggaagaatagagttttcgacagaattaagaaataaatacaggtttttgaatctggattctcaggtttaatttatctcttatgaataaagttacgaaaaaaacattttcacaacaaacctaagtagcaaattattaatggtaagctttattgtgaaattgtcgtgggtgtaatagtgcctggattcttttatgtattatgggaatgggccatcctctgaccgtttaaatgtaatcatatagaaataatgtgccccaaaagcccgggttgtgctctctctttctgagacgcatatacatacatcgtatatgataggaacttgtgctttgagaattaattcaggtgctgaggtattgtatttttctggaatctaaatgaaagttgagttgtatag

SEQ ID NO: 2946 - DNA, 1162 bp, Cucurbita pepo
ttcgcatcaaatccttttcagttcatcaaagctttctttctacagatctctcttctactataatcaactatgtctagcactgccggtcaggtcatcaaatgcaaagctgctgtggcttgggaggctggaaagccactagtgattgaggaagtggaagtggcgccgccgcaagctaatgaagttagagtgaagatccttttcacagctctttgtcacaccgatgtttatttctgggaagcgaagggccaaactcctttgtttcctcgcatttttggacatgaagctggaggtgttgttgagagtgttggagaaggcgtgaaagatcttcaaccaggagatcatgttcttcctgttttcactggtgaatgtggcgattgtcgtcattgtaaatcagaagagagcaatatgtgcgatcttcttcgaatcaatactgatcgtggtgttatgatcagtgatggcaagaccagattctccaaaaatggacaaccaattcatcatttcgttggaacctccacttttagtgaatacactgttattcattttggctgtttggctaagatcaatcctgctgctcctctcgacaaagtctgcgtcttagctgcggaattccacaggctttggtgccactgtgaatgttgcaaagcctaaaaagggtcaatctgttgctatctttggccttggagctgttgggcttgctgctgctgaaggggcaagagtttccggggcatctaagatcattggtgttgatttgaacccggctcgattcgaagaagcaaagaaatttggttgcaatgaatttgttaacccaaaggatcacagcaagccagttcaagaggtgatagccgagatgacgaacggaggagttgaccgaagcgtcgaatgcaccggaagcatccaagcaatgatctcggcattcgaatgcgttcacgatgggtggggtgttgcagtactagtgggagtcccaaacaaagacgacgcattcaaaactcatcctatgaatttcctcaacgaaagaactctaaagggtacgttcttcggtaactacaagcctcgatccgacattcccggggtcgtcgagaagtacatgaagaaggagatggaattggagaaattcataactcattcagtgccgttctctgagatcaacaaggcgtttgattac

SEQ ID NO: 2947 - DNA, 1221 bp, Petunia hybrida
taccaagttcatcattcagtaaaacacacagtaacttattattagagcagttaaaaagaaaaaagatactagctagcaacaacaatgtcgagcaatactgctggtcaagtcattcgttgcaaagctgcggttgcatgggaagcggggaagccattggtaattgaagaagtggaggtggcacctccccagaaaatggaagttcgcctcaagattctgttcacctccctgtgccatactgatgtttacttttgggaagctaaggggcaaacacctctatttcctcgaatttttggacatgaagccggaggaattgtggagagtgtaggtgaaggtgtcactgatctcaaaccaggagaccatgttcttcctgtgttcactggtgagtgccagcagtgtcgacactgtaaatcagaggaaagcaacatgtgcgacctcttaaggataaacaccgacaggggagttatgatacatgatggtcaaacaagattctcaaagatgggaagccgatatacacttagttggaactcaccgttagtaatacccgttgcatctgagcgtcccaagattgatccacaggcaccgcttgacaaagtttgcgttctgagttgtggaatatcaacaggacttggagcaactctgaatgttgccaaacctactaaaggttctactgtggctatttttggcttgggagctgttggccttgctgctgctgaaggagctaggattgcaggggcttctaggattattggtgttgatttgaatcctagcagattcaatgatgccaagaagtttggagtcaccgagtttgtgaatccaaaagatcacggtgataagcctgttcagcaggtaattgctgagatgaccgatggaggtgttgatcggagtgtcgagtgcactggaaatgtcaatgccatgatctctgcttttgaatgtgttcatgatggttggggtgtggctgtgcttgttggtgttccaaacaaagatgatgcattcaaaactcatcccatgaatcttttgaatgagaggactctgaagggcaccttctttggcaattacaagcccaaatctgacattccatctgtggtggacaagtatatgaaaaaggaactagagctggagaaattcattactcaccaagttccattttcggagatcaacaaagcatttgattatatgctgaaaggggaaagtattcgttgcatgattactatggaacattga

SEQ ID NO: 2948 - DNA, 1625 bp, Quercus alba
cttccttccttcgttcttgctttcggttggagagaaacattttcgcttcgttcattctgaaattgaaccaaccatgtctgctacttctggccttgtgattccctgcaaagctgccattgcgtgggaggcagggaagccactggtgatagagcaagtggaggtggctccaccacagactatggaagtgaggatcaagatcaaatatacttcactttgccataccgatctctacttctgggaggccaagggccagactccactgtttcctcgaatatttggccatgaagcagctggggttgtagaaagcgttggggaaggtgtatcagacctccaagttggggatcatgtgcttccggtgttcactggagagtgcggggactgcaggcactgcaagtctgaggaaagcaatatgtgtgacctgctgagaataaatacagacagaggagttatgcttaatgatggaaaatccaggttttctatcaatgggactcctataaatcactttcttggtacatccacattcagtgagtatactgttgttcattcaggatgcctaactaagattagtccgctagcacctttggataaggtttgcatcctcagttgtggcatctcaacaggattaggtgcaactttgaatgttgcaaaaccaaagaagggatctacagttgctgtttttggtcttggcgctgttgggctggctgctgctgaaggtgcaagaattgctggggcatcaaggattattgggattgacttgagtcccaagaggtatgaggaagccaagaaatttggagtaactgagtttgtaaatccaaaggaccatgacagaccagttcaagaggttattgctgagatgacaaatggtggagttgacaggagtatagagtgcaccggcaacatcaattgcatgatctctgcttttgagtgtgttcatgatggatggggtgtagctgtgctcgtaggagtgcccaacaaggatgcggtgttcatgaccaagcccattaatgtgcttaatgagaggacactcaaaggaactttctttggaaactacaaacctcggactgaccttccctcagttgttgacatgtacatgaacaagaaattggaagtggagaaatttataacccaccgggtccctttctccgacatcaataaggccttcgagtacatgttgaagggagagggtttgcggtgtataattagtatggaagaatagagttttcgacagaattaagaaataaatacaggtttttgaatctggattctcaggtttaatttatctcttatgaataaagtcacgaaaaaaacattttcacaacaaacctaagtagcaaattattaatggtaagctttattgagaaattatcgtgggtgtaatagtgcctggattcttttatgtattatgggaatgggccatcctctgaccgtttaaatgtaatcatatagaaataatgtgccccaaaagcccgggttgtgctctctctttctgagacgcatatacatacatcgtatatgataggaacttgtgctttgagaattaattcaggtgctgaggtattgtatttttctggaatctaaatgaaagttgagttgtatagaactgccaaatttgtaccagccacttt

SEQ ID NO: 2949 - DNA, 1552 bp, Tropaeolum majus
ctttgaattcgaaaatcatctcataatttctctggtttttttggtctataaatttgatcattcatggattcattttctccatccttaaatttcaacaacattatctgtttctacttttttcagtactctactagaaccaaagaaaaaaaaattctccagtggtgtttagttttataaattaatcacagttttgaagaagatatgtcgactgctggtcaagtaattcgctgcaaagccgctgttgcatgggaggcagggaagccattggtgatcgaggaagtagaggtggcaccaccacaggctaatgaagttcgtgtgaagatcctttacacctctttgtgccacactgatgtctacttctgggaagctaagggacaaacgccaagatttcctcgcatttttggccatgaagccggagggattgtggagagtgttggtgagggggtgactactctgcagccaggagaccatgttctcccaatcttcactggagaatgtggggactgtcgccagtgtcatcacgaagagagcaacatgtgtgaactcctcaggatcaataccgagaggactgaaatgctctctgatgggaagtcaaggttttcaattaagggacagcctattaaccattttgttggcacctctacattcagtgaatacactgttgttcattatggatgtcttgctaagatcaaccctgctgctcctctcgacaaagtttgtgtcctaagttgtggattatccacaggttatggtgccgctgtcaatgttgctaagacatcgaagggtgaaactgttgtcgtttttggtctcggtgctgttggccttgctgctgctgaaggagcaagggtgtctggtgcctctaggatcattggtgtggacttgaacccggacagattcgaaccagcaaagaagtttggcgtcaccgagttcctgaatcctagagatcacaacaaacctgttcaagaagtcattgctgatatgaccaatggtggagctgataaaagtattgagtgtaccggttcggtccaggcaatgatatcagcatttgaatgtgttcatgatggttggggtgttgctgttctagttggtgtacctaacaaagacgacgccttcaaaactcatccaatgaactttctgaacgagaggaccttgaagggtaccttcttcggaaacttcaaaccccgaactgatattcccaaagtcgtggagaaatacatgaacaaggagctagaggtggagaaattcatcactcacaccattcctttctcggagatcaatacggcgttcgagttgatggctcggggagagggcattcggtgcatcattcgcatggaggagtagagataaagccatgttttcatagagcttattaaagtgaataataaacaagctttttccttcatggttgatttccaatgttaccaattttggttcatttataatataaccaaggaaaaacagtcttttaaattattttgtttatatggataaataatttcaaatatttatcatcctataaaataaaaagtgtgttctattacaaaaaaaaaaa

SEQ ID NO: 2950 - DNA, 1378 bp, Tropaeolum majus
aagaagctatgtcgactgctggacaagtgattcgctgcaaagccgctgtggcttgggaggcagggaagccattggtgatcgaggaagtagaggtagcaccaccacaggctaatgaagttcgtgtgaagatcctttacacctctttgtgccacactgatgtctacttctgggaagctaagggacaaacaccaaggtttcctcgtatttttggccatgaagctggagggattgttgagagtgttggtgagggagtgactactcttcaaccaggagaccatgttctcccaatcttcaccggagaatgcggtgactgtcggcagtgtcaccacgaagagagcaacatgtgtgaactcctcaggatcaataccgagaggactgagatgatcactgatggaacatcaaggttttcaatcaagggacagcctattaaccactttgttggcacctctactttcagtgaatacactgttattcattatggttgtcttgctaagatcaaccctgctgctcctcttgacaaagtttgtgtcctcagttgtggattatccaccggttttggtgctgctgtcaatgttgctaagacaaaggagggtgaaactgttgttgtttttggcttgggtgctgttggccttgctgctgctgaaggggctagggtgtctggagcctccaggatcattggtgtggacttgaacccggctaggtttgaaggagctaagaagtttggtgtcaccgagtttgtgaatcctaaagatcacaacaaacctgttcaagaagtcattgctgatatgaccaatggaggagctgataaaagtattgagtgcactggtgctgtccaggctatgatatcagcatttgaatgtgttcatgatggttggggtgtttgtgttctagttggtgtaccaaacagagatgattccttcaaaactcatccaatgaacctgcttaacgagaggaccttgaagggtaccttcttcggaaacttcaagccccgtactgatatccccaaagtcgtcgagcgatacatgaacaaggagctggaggtggagaaattcatcactcacaccgtacctttctcggagatcaacaaagcgttcgagttgatggctcgtggagagggtattaggtgcatcattcgcatggaggagtagagagattgagaattgcttagaaatctggcatcttggtttattataagttttcttgggctttagtataaaggatagccagtttcatacacagatttgttgttgctttttgcactgttgtaacgttttttcgtgttctttttatgaaaaagaaaagttcatttacagtttcactttggatgattttaagtgtcttgcctttgtttgttgatttagtttgtttcaattgaata

SEQ ID NO: 2951 - DNA, 2352 bp, Raphanus sativus
ggacacaatcaaacacaaacaaaaaccaaagaaagatctataagttcatcactgttgatcatgtctacgatcggacaaatcattcgatgcaaagctgctgtggcatgggaagctggaaagccactggtgatggaggaaatagaggttgctccaccgcagaaacacgaagtccgtatcaagattctcttcacttccctctgtcacaccgatgtttacttctgggaagctaagggacaaacgcctttgtttcctcgtatcttcggacatgaagctggaggcgttgtggagagtgttggagaaggagtgactgatcttcaaccaggagaccacgttctccccatcttcaccggagaatgcggagactgccctcactgccactcggaggagtcaaacatgtgcgaccttctgaggatcaacaccgagagaggagggatgatacacgacggccaatcaagattctccatcaacggcaaaccgatataccatttccttggaacctccacgttcagcgagtacaccgtggttcactccggtcaagtcgccaagatcaaccccgatgctcctctcgacaaagtctgcatcgtcagctgcggtttgtccaccgggatgggagctactttgaacgtggcgaaaccgaagaaaggtcagagcgttgcggttttcgggctcggtgctgttggtttggccgctgcggaaggtgctaggatggctggtgctggtaggatcattggtgttgatcttaaccccaagagattcgaggaagctaagaagtttggtgtgactgagtttgtgaaccctagagaacatgacaaaccggttcagcaagtcatcgctgagatgacagacggtggtgtggacaggagtgtggagtgcactggaagcgtccaagccatgattcaagcatttgaatgtgttcacgatggttggggtgttgcggtgctggttggtgtgccgagcaaagacgacgccttcaagacccatccgatgaacctgctgaacgagaggacactcaagggtactttctttggcaactacaaacccaaaaccgacattcccggggtcgtcgagaagtacatgaacaaggagctggagcttgagaagttcatcactcacacagtcccattctctgagatcaacaaggcctttgattacatgttaaaaggagagagcatccgttgcatcatcaccatgggtgcttaactaccaataaatgtctactttgtgtgtgtttagtagactatcatctcttattgcttttgtttttttttaaagtgtctctaaatctattaccatatcgttttgtaatagttttcattcaataaaaataatgttatgtgtttcaacattcagaatgcaaacgaactaaacgtagtgactcaaaagaagtttcaagacgccattctctttgcttcttgctcaaaggtctgcctttgcctgccttctcacggttcactctaatatcggctatcccccaaacgcagcttttggcttccacatcaaaagagacaagtctgaagataccatcaccttcattttcagcttcctcgttaacgtacctcacatacattgacctgtccttgtaccggtcaagatcctgaggaactcttactactctttcaacaccaggagatgacacctctaaggagatattgtctggtacggtcttggcgagttcagcttcagacagtttcgctctgtaagttgttgaatacgcttcaatgtcttccatcgtcggagaaccggacttgttagtgagccgttcgattctcacttgtatggttgagtttggcagagtcttgaacgcgtaaatgcctagctcaccgttaaaagactcgcaggctttctcagctaaggacaatgcttctttgtcccatgttgttccggcaagcttgatgcctccaccaccacctccatcaccagcatagagttcttcctcctcctcttcttcttcgaggtagaagtcgtcttcttcttcatcagttagtagctcgtctagaacatcttcgagaaggacttgctcatcttcttcttcgttttcttcaaagagtgattcgtcttcttctttgttcggtttaggttcgaagatagtcgtttttgaagtgtttttcttcttctttgcgtgagcctctattgaaaatttcggatactgaagaaacggcgtcgttgggattctaattcggacactcgttgtcgggaggaaacgattggcggcgggaaggctacttaagctggaagcagacgaaactgaaatcccccgacaagagtgatgcggtcggaaacaacagatgaaatccatcaaagagactgtgtcttcttcttcgcctggaggagccaaaactgcggctaagatcc

SEQ ID NO: 2952 - DNA, 1356 bp, Raphanus sativus
  misc_feature (25)..(25): n is a, c, g, or t
  misc_feature (46)..(46): n is a, c, g, or t
  misc_feature (50)..(50): n is a, c, g, or t
  misc_feature (340)..(340): n is a, c, g, or t
  misc_feature (907)..(907): n is a, c, g, or t
  misc_feature (1012)..(1012): n is a, c, g, or t
  misc_feature (1307)..(1307): n is a, c, g, or t
  misc_feature (1310)..(1310): n is a, c, g, or t
  misc_feature (1312)..(1312): n is a, c, g, or t
  misc_feature (1317)..(1319): n is a, c, g, or t
  misc_feature (1321)..(1321): n is a, c, g, or t
  misc_feature (1325)..(1325): n is a, c, g, or t
  misc_feature (1327)..(1328): n is a, c, g, or t
  misc_feature (1331)..(1331): n is a, c, g, or t
  misc_feature (1335)..(1335): n is a, c, g, or t
acaatcaaacacaaacaaaaaaaancataagaacagatctataagntcancactgttgatcatgtctacaaccggacagattattcgatgcaaagctgctgtggcatgggaagctggaaagccactggtgatggaggaagtagaggttgctccaccgcagaagcacgaagttcgtatcaagattctcttcacttctctctgtcacactgatgtttacttctgggaagcaaagggacaaacgcctttgtttccacgtatcttcggacatgaagctggagggattgtggagagtgttggagaaggagtgacagatcttcaaccaggagaccacgttctcccnatcttcaccggagaatgcggagactgccgtcactgccactcggaggaatccaacatgtgcgaccttctcaggatcaacacggagagaggagggatgatacacgacggcgagtctcgattctccatcaacggcaaaccggtccaccatttcctcggtacctccaccttcagcgagtacaccgtggtccactccggtcaagtggccaagatcaaccccgaagctcctctcgacaaagtctgcatcgtcagctgcggtttgtccaccgggatgggagcgactttgaacgtggcgaaaccgaagaaaggtcagagcgtcgccgttttcggtttaggtgctgttggtttagccgctgcggaaggtgctaggatggctggtgctggtaggatcatcggtgttgatcttaaccccaagagattcgaggaagctaagaagttcggtgtgacggagtttgtgaaccctagggaacatgataaaccggttcagcaagtcatagctgagatgacggacggtggtgtggacaggagtgtggagtgcactggaagcgttcaagctatgattcaagcattngaatgtgttcacgatgggtggggtgttgcggtgctggtaggtgtgccgagcaaagacgatgcgttcaagacacatccgatgaacttgctgaacgagaggacgctnaagggcactttctttgggaactacaaacccaaaactgacattcctggggtggtggagaagtacatgaacaaggagctggagcttgagaagttcatcactcacacagtgcccttctctgagatcaacaaggcctttgactacatgttgaagggagagagtatccgttgcatcatcaccatgggtgcttgaaaatgaaaaccaaaaacattctctttaccaataaaatgtcctacttattagtagactactatctcatctcttattgcttttggcttttctgcactgtgtttttttnaantntctannncnattntnnttntacnagtttcattctataaaaaaaa

SEQ ID NO: 2953 - DNA, 1292 bp, Hordeum vulgare
aagaagaaacagcaggggagatatcaaccgaagttcttggagtgaaatggcgaccgccgggaaggtgatcaagtgcaaagcggcggtggcctgggaggccgggaagccgctgtcgatggaggaggtggaggtggcgccgccgcaggccatggaggtgcgcgacaagatcctctacaccgccctctgccacaccgacgtctacttctgggaggcgaacggccaaactccggtcttccctaggatcttgggccatgaagctggaggcattgtggagagcgttggcgagggcgtgacggagctggtgccgggagaccatgtcctcccggtgttcaccggagagtgcaaggagtgtgcccactgcatgtcagaggagagcaacctctgtgacctcctcaggatcaatgtcgaccgtggcgtgatgattgacgatgggcagtcccgcttcaccatcgacgggaaacccatcttccacttcctcgggacgtccaccttcagcgagtacaccgtgatccatgtcgggtgcgtcgccaagatcgaccccgaggcgcccctcgacaaagtctgcctccttagctgtggtatctcaaccgggctcggtgcgacgctcaacgtcgcgaaaccgaagaagggtatgacggtggcgatttttggtcttggagctgtaggcctcgctgccatggaaggggccaggatgtccggcgcatcaaggattatcggcgtggacttgaaccctgcaaaacacgaacaagctaagaaatttggctgcaccgactttgtgaaccccaaagaccacaccaagccagtgcaagaggtgatcgtggagatgaccgatgggggagtcgaccgggcggtggagtgcacaggcaacgccgacgccatgatctccgcctttgaatgcgttcacgatgggtggggcgtggcgcacaaggaggcggtgttcaagacccaccccatgaacttcctcaaggagaggacgctcaggggcaccttcttcggcaattacaagccgcgcaccggcctccccggcgtcgtcgacatgtacgtgaggaaggagctggagctggacaagttcatcacccacagcgtgcccttctcgcagatcaacacggccttcgacctcatgctcaggggggaaggcctgcgctgcgtcatcaggatggaggagtagagtagagcacctggctgttcttcatccctcgctgctattgtacaacacacatgtatcagctcttatgcaaccccccctccctctgtctacttattcgaaatactatcagtgatttgtttctcat

SEQ ID NO: 2954 - DNA, 1319 bp, Cucumis sativus
aaccaacaatctcaatctcatcagatcaacatatcgatttcgttgaaataagaagtcttgtgtgttggataattgtgcatagaagtgatgatgtcaagcaccaaaggtcaagtcatcaaatgcaaagctgcagtggcatgggaagctggaaagccactggtgattgaatcaatctcatcagatcaacatatcgatttcgttgaagtgttaagatccttttcactgctctttgccacactgatgtttacttctgggaggccaagggccaaacacctatgttccctcgaatatttggacatgaagctggaggagttgtggagagcgtaggagaaggagtgaccgatttgaaagaaggcgaccatgtgctgccagtgttcacaggggaatgtggagaatgtcgtcactgtaagtcagaagagagcaacatgtgtgatcttcttcgaatcaacacagaccgtggagtgatgattagtgatgggaatacaagattctctaaaaatgggcaaccgatttaccactttgttggaacctcaacatttagtgaatacacagttgttcatgttgggtgtttggccaaaatcaacccttgtgcccctcttgacattgtgtgtgttcttagttgtgggatttcaaccggccttggcgccactttgaatgtggctaagccaactaagggttcttctgtagctatctttggattgggtgctgttggtcttgctgctgctgagggtgcaagaattgccggggcatctagaatcattggagttgatctcaatccaggtcgatttgaagaagctaaaaagtttggtgtcaatgaatttgtgaatccaaaggactatgacaaacctgtccagcaggtgattgctgagatgactaatggaggagttgatcgaagtgttgaatgtacaggaagcatccaagcaatgatctctgcctttgaatgtgttcatgatggttggggtgttgctgttcttgttggtgtcccaaacaaagacgattccttcaaaactcatccaatgcagtttcttaatgagaaaactctaaaaggtactttcttcggcaactacaggactcgatcagacattcccaatgttgtggagcagtacttgaacaaggagcttgaattggagaaattcatcactcactccgttccgttttctgaaatcaacaaggcttttgactatatgctaaatggagagtcaatccgatgcgtcattcgaatggaacatgactgatcttccgattatatatatgtgtaaatgtcatatctttgaagcaaatcaaataaactgtgtgctacaatgagtcaagtttgtttt

SEQ ID NO: 2955 - DNA, 1300 bp, Hordeum vulgare
gcgaagaagaagaagaaacagcaggggagatatcaaccgaagttcttggagtgaaatggcgaccgccgggaaggtgatcaagtgcaaagcggcggtggcctgggaggccgggaagccgctgtcgatggaggaggtggaggtggcgccgccgcaggccatggaggtgcgcgacaagatcctctacaccgccctctgccacaccgacgtctacttctgggaggcgaacggccaaactccggtcttccctaggatcttgggccatgaagctggaggcattgtggagagcgttggcgagggcgtgacggagctggtgccgggagaccatgtcctcccggtgttcaccggagagtgcaaggagtgtgcccactgcatgtcagaggagagcaacctctgtgacctcctcaggatcaatgtcgaccgtggcgtgatgattgacgatgggcagtcccgcttcaccatcgacgggaaacccatcttccacttcctcgggacgtccaccttcagcgagtacaccgtgatccatgtcgggtgcgtcgccaagatcgaccccgaggcgcccctcgacaaagtctgcctccttagctgtggtatctcaaccgggctcggtgcgacgctcaacgtcacgaaaccgaagaagggtatgacggtggcgatttttggtcttggagctgtaggcctcgctgccatggaaggggccaggatgtccggcgcatcaaggattatcggcgtggacttgaaccctgcaaaacacgaacaagctaagaaatttggctgcaccgactttgtgaaccccaaagaccacaccaagccagtgcaagaggtgatcgtggagatgaccgatggaggagtcaaccgggcggtggagtgcacgggcaacgccgacgccatgatatccgcctttgaatgcgtgcacgacgggtggggcgtggcgcacaaggaggcggtgttcaagacccaccccatgaacttcctcaacgagaggacgctcaggggcaccttcttcggcaactacaagccgcgcaccggcctccccggcgtcgtcgacatgtacatgaggaaggagctggagctggacaagttcatcacccacagcctgcccttctcgcagatcaacacagccttcgacctcatgctcaggggggaaggcctgcgctgcgtcatcaggatggaggagtagagtagagcacctggctgttcttcatccctcgctgctattgtacaacacacatgtatcagctcttatgcaacccccctccctctgtctacttattcgaaatactatcagtgatttgtttctcac

SEQ ID NO: 2956 - DNA, 1404 bp, Lactuca sativa
cggggatccatcaccatctcgttttcatatataaacacttgctccaatctgaaccaaaaataacgagaaaaatctacgacgatgtccggtgaagtcattcgatgcaaagctgcggtggcatgggaagccgggaagccactggtaatagaagaagtggaagtggcgccaccgcaaaaaatggaagtccgattgaagatcctcttcacctctttgagtcacaccgatgtctacttttgggaagctaagggacaaaatcccttgtttcctcgcatattaggccatgaagccggaggaattgtagagagcgtaggtgaaggtgtgacagagctgcaaccaggggacaaagtcctcccagtattcaccggagaatgtggggagtgtcgccattgtaagtctgaagagagcaatatgtgtgatcttctccggattaatactgataggggtacaatgataaacgatggaaaaacaagattctcaaaagatggaaacccgatttaccattttcttggaacctcaactttcagcgagtacacagttgttcattctggttgtgttgctaagatcaatcctgatgctccccttgacaaagtctgtgttcttagctgtgggatttccactggcatgggtgcaaccctgaatgttgctaaacctaaaaagggcatgactgttgctgtatttgggctaggagctgtagggcttgctgcagctgaaggagctcggattgctggggcttcaaggatcattggtattgacctaaatgagagtagagccgatgaagctaagaagtttggtgttaccgagtttgtgaatcctaaagatcatgacaaaccgatccaagaggtcattgttgcaatgactgatggtggagttgataggagtgtggagtgcaccggaaatgttagggcaatgatttcggcttttgaatgtgttcacgacggttggggtgtggcagttcttgttggtgtgccaagtaaagatgatgaattcaaaactcttcctataaatttcttgaatgagagggctctgaagggtacattcttttggcactataaaccccgaacagatattcctggtgttgttgaaaagtacatgaacaaagaaatagaagtggagaagtttataactcaccaggttggtttctcggacatcaacaaagcatttgacctcatgcttaaaggagaaagtctccgttgcatcatacaaatggatgcatagatccctttgttgggtgttttactatgttagcggtgttggtccaatcatgtaacaaagtttatagcgaataatgtatagaggaataaaagtaataacgaagtttatagcgaataatatatagaggaataaaagtaatgggacgtgtaatgcccttgaagcttaatgttgtttatgggaatgtgtaacctc

SEQ ID NO: 2957 - DNA, 1846 bp, Carica papaya
acggaaaatcttcacttaatcctttaatcttcattcattcctttacatcatcgtcgtcacaatcaacaagccatgtctgctgctggtcaggtcatttgttgcagagctgctgttgcatgggaggcggggaagccgctagtgatggaggaagtggaggtcgcaccaccacaacaaaatgaagttcgtttgaaaatccttttcacttccttgtgccatactgatgtttacttctgggaggccaaggggcaagcaccattgtttcctcgcatatttggtcatgaagctgcagggattgtagagagtattggtgagggcgtgactcatctccaacctggagaccatgttctccctatcttcacaggggaatgcggcgagggccgtcactgtcattcagaagagagcaacatgtgtgacctcctcaggatcaacactgaaaggggtgtaatgatttctgatggcaagtccaggttttctattgacggcaagcccatacaccactttcttggtacctctacatttagcgaatacactgttgtccatgccggctgtgttgctaagatcaatcctgctgctccccttgacaaagtttgcattgttagttgcgggttatccacaggttttggtgccactgtgaatgttgccaaacccaaaaagggtgacacagttgcaatctttggcttgggtgctgttggccttgctgctgctgaaggggcaagggtttccggggcatctaggatcattggtgttgatttgaaccccaacagatttgaggaagccaagaaatttggtgtaacagagttcgtgaatcctaaagactacaacaaacctgttcaagaggtgattgctgagatgaccgatggaggtgtggatcggagtatcgagtgcactgggagcatccaggccatgatatccgcatttgaatgcgttcatgatggttggggtgttgctgtacttgttggcgtgccaaacagagacgatgcgttcaaaactcatccagtgaacttcctgaacgagaggactctcaagggtactttcttcggcaactacaaaccccggactgatattcctggggttgttgaaaaatacatgaacaaggagctagaattggaaaagttcatcacccacaatatcgctttctcggagatcaacaaagcatttgattacatgctgaaaggcgagagcctgaggtgcatcatccacatggaagagtagagaactgctacctaagttggggaagcgagaatagagcattttgtttaaagttgtatggcatatgttaagaaactttgtaggtcttctccacagtgagctgcaagaactttgattttctactgaattctttttcacttggttttcccgtgcatggtggtgaatgctttggctcatgatgctaccctaatgtaagatgaagattgacaatccgaagggcaatgccttgtgtaattagccaatcgagcatattcacttaataatctatgtatgcagacaaagaatatgtttcttgtttttgatttcaaacttttgttatatgcaaaggagagccgacgaagggatgtcaaatcagaccgtactttttccattagggccaaatgtagtaaataaataatcttatttgaaacaatataaagatattaagaaaatttttgagtttcaaataagatggtactcaataaacgcaggaaagaggaagaatgaatgaaaaaccctatatattacaacattatgcgagtaatatcacataatctatttcaagcaatagaagcaggggatatctatatactcaaacaaagtaatactgctacaagccaatattaggtggtcagagttgtttggcttccatcacgca

SEQ ID NO: 2958 - DNA, 1376 bp, Gossypium hirsutum
aaaaaaacaagtgagcagataaattgaagacttttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgatggaaaatccaggtttcccatcaatgggaagcctatctaacacttcctaggcacctctactttcagtgaatacactgttgtccatgtcggccaggttgccaagatcaatccggaggctccgcttgataaagtttgtgttctaagctgcggaatgtccacagggtttggtgccactgtgaatgtagctaaacccaaaaagggtcaatccgttgcaatatttggactaggtgctgtcggtcttgctgctgctgaaggagcaagagtttctggggcttccaggatcattggtgtcgatttgaaccctagcagattcgaactagccaagaacttcggtgttacggagtttgtgaatccgaaagatcacaacaaacctgttcaagaggtcattgctgagatgacgggtggaggagtcgaccgcagtgttgaatgtacctgcccggagcagccagctaatcgaattcccgcggccatttgaatgtgtccacgatggttggggagttgcagtgcttgtgggggttcccaacaaagacgatgcattcaaaactcatccagtgaatctactgaatgaaaggactctcaagggtactttctttggcaactacaaacctcgaactgatattcctgctgtcgttgagagatacatgaacaaggaacttgaacttgacaagttcatcactcactcagttcccttctctgagattaacaaggcatttgagtacatgcttgctggcgagggcctgaggtgcatgattcacatggatgcataaggattggctggccatggatgaagggctttttgtcaagtatatgtgcattttaagggaataaataatgtaatgtaatgctacatcgttttgctgtatttaatggcaaatttttatcttatcatacaaaaaagaaaaaagtaccgactgcgactctgcgttgatacctgcgcgg

SEQ ID NO: 2959 - DNA, 1444 bp, Cajanus cajan
cgggggatctcaaaacaaactcactcatcatcattcgttcatcttcttttcaattaactagccacagccatgtctagcaccgctggtcaaaccataaagtgcaaagctgcggtttcatgggaggcagggaagccactggtgattgacgaagtagaggtggcgccaccacaagccggtgaagtccgtctcaagatcctctacacctctctttgccacactgatgtttacttctgggaagccaagggccagactccattgtttcctcgcatttttggccatgaagcttcagggattgtggagagtgtaggcgagggtgtaactcatttggaaccaggagaccatgccctccctgtgttcacaggagagtgcggggagtgtgtacattgtaagtcagaagagagcaacatgtgtgagctactcaggatcaacactgatagaggtgtcatgattaatgatgggaaatcaaggttctctaaggatggacaaccgatacaccatttcttgggaacctctactttcagtgaatacactgttatccatgctggatgtgttgcaaagatcaaccctgatgctccacttgacaaagtttgtgttctcagttgcggaatttgcacaggtcttggtgctactgtaaatgtagcaaaaccaaaacctggttcctctgttgccatttttggacttggagctgttggccttgcggctgctgaaggggcaaggatttcaggtgcttcaagaatcattggaattgatttagtttcagccagatttgaacaagctaagaagtttggggttaatgagtttgtgaacccaaaagaacatgataaaccagtacaacaggtaattgctgaaatgaccaatggaggtgtggatcgcgctgttgaatgcaccggcagcatccaagccatgatctcagcatttgaatgtgtccatgatggttggggtcttgctgtacttgttggtgtgcctagtaaagatgatgcattcaaaactgctcctattaatttcctgaacgagaggactcttaagggtaccttttatggtaactacaaaccacgcactgatcttccatctgttgtggaacagtacatgagggggagctagaagtggataagttcatcactcacaatgttccattctcagagattaacaaagcatttgattacatgctgaaaggagagtccattaggtgtctcatccgcatgcaagagtaacacctatgaaattggtcatgactctgttcgaggaaaataatttgtgaaaagagagagaataaaaattttgttggtaatacgtagtaggattttgattgtattttggagattgagtgttgggactgagagggcatttagccctttgttacttgattgcggtttatgttgtcaatttgtcgtttgattgttaccatgattttacttttacatgaaatgaaaaacaatgtaagata

SEQ ID NO: 2960 - DNA, 1414 bp, Manihot esculenta
aagggagttcgtttaatccattctcctactgagtcagccatgtccagcactacgggtcttgttattccttgcaaagctgctgtagcatgggaggcagggaagcctttggtgattgagcaagtggaggtagctccaccacaggccttggaagtgaggatcaaaatcaaatatacctcgctttgccatactgatctctacttctgggaagccaagggccagactccattgtttcctcgcatatttggacatgaagcagcaggagttgttgagagtgttggggaaggtatatcagatctcaaggttggggatcatgtccttcctgtatttacaggagaatgtggggaatgcaagcactgcgagtccgaggaaagtaacatgtgtgatctgctgagaataaacacagacaggggtgttatgcttagtgatggcaaatctaggttttcaattgatggggtaccaataaatcattttcttgggacatccaccttcagtgagtacacagttgtgcatagaggttgccttgcaaagatcaatccattagcaccgttggataaagtctgcattctcagttgtggcatctcaacaggactgggtgcaacattgaatgtggctaaaccgaagaaaggttcctcggttgctgttttcggattgggagctgtaggcctagcagctgcagaaggtgcaagaattgccggagcatctaggatcattggggtggatttgaaccccagtagattcgaagaagccaagaagtttggagtaactgacttcgtgaacccaaaggaacatgatagaccagttcaagaggtaattgcagagatgacaaatggcggagtcgacaggagtgtggagtgcacaggccacattgatgccatgatctcagcttttgaatgtgttcatgatgggtggggggtggcagtgctcgttggtgtgcccaacaaggaagcagttttcatgaccaagccaatcaatgtgctcaatgaaagaactcttaaaggaactttcttcgggaactacaaacctcggactgaccttccatctgttgttgacatgtacatgaaaaagaagttggaattggacaagtttataactcacaggctgtctttttctgatatcaataaggccttcgagttaatggtgaaggggcaaggcttgcgttgcattattaacatggaagagtaggatccagctggaaaaaactgaagctgaagcttttggttaaacttatgaaataaaggataaaggatatgaacaaatatcaccctatatctcttctgtaatctatctttttctgtgtgcctatgtaattgtatgacctgaatcatttgcactttgcaatgaaatttgcagattgcatatatttgtagaaagggtaagttataaattaaaagaaaaaggacatcccgtcaatcaa

SEQ ID NO: 2961 - DNA, 1564 bp, Glycine max
gtggcgcagtcgtgagtaacgtgcaataccacgggtaacgcggttttctggctcacctttccgcattttccttcttccctctcgcacccataagtacccctccctaaatcaacgctttcctcacaaaaaacaaaaactcacttctcatcattcattcatcttcgttctaagagccatgtctagcaccgttggccagaccatcaagtgcaaagctgcgattgcatgggaggctgggaagccgctggtgattgaagaagtggaggttgcgccaccgcaagccggtgaagtccgtttgaagatcctctacacctctctttgccacactgatgtttacttctgggatgcgaagggccagactccattgtttcctcgcatttttggccatgaagcttcggggattgtggagagcgtaggcgagggtgtgactcatctgaaaccaggtgaccatgccctccctgtgttcacaggagagtgtggagattgcgcccattgcaagtcagaggagagcaacatgtgtgagctactcaggatcaacaccgataggggtgtcatgatccatgatggccaatcaaggttctctaagaatggacaacccatacaccatttcttgggaacctctacattcagtgaatacactgttgtccatgctggatgtgttgcaaagatcaaccctgctgctccacttgacaaagtttgtgttctcagttgtggaatttgcacaggttttggtgctactgtaaatgtagcaaaaccaaaacctggttcctctgttgccatatttggacttggagctgttggccttgcggctgctgaaggtgcaagagtttcaggtgcttcaagaatcattggagttgatttagtttctgcccgatttgaagaagctaagaagtttggggttaatgagtttgtgaacccaaaggatcatgataaacctgtgcaacaggtaattgctgaaatgaccaatggaggtgtggatcgggctgttgaatgtactggcagcatccaagccatggtctcagcattcgaatgcgtccacgatggttggggtcttgctgtacttgttggtgtgcctagtaaagatgatgcattcaaaactgctcctattaatttcctgaacgagaggactcttaagggcaccttttatggcaactacaaaccacgcaccgatcttccatctgttgtcgagaagtacatgagtggggagctagaagtggacaaattcatcactcacacagttccattctcagagatcaacaaagcttttgatttaatgctgaagggacagtccattaggtgtatcatccgcatgcaagagtgagatggatatgaaaagtccatgactgtgttctgggacagactactcttatgtgatttatgaataaaaagagagaagagagaataaaaaatttattggtaaaatccccaattaggctattaggattatgattgtattgttgcacattgagtgttgggaatgacagggcatttagccctttgttacttgattgcggcttgtttcttgtcaatttgtcatttgatagtttccatgattttacttttacat

SEQ ID NO: 2962 - DNA, 1489 bp, Glycine max
caataccacgggtaacgcggttttctggctcacctttccgcattttccttcttccctctcgcacccataagtacccctccctaaatcaacgctttcctcacaaaaaacaaaaactcacttctcatcattcattcatcttcgttctaagagccatgtctagcaccgttggccagaccatcaagtgcaaagctgcgattgcatgggaggctgggaagccgctggtgattgaagaagtggaggttgcgccaccgcaagccggtgaagtccgtttgaagatcctctacacctctctttgccacactgatgtttacttctgggatgcgaagggccagactccattgtttcctcgcatttttggccatgaagcttcggggattgtggagagcgtaggcgagggtgtgactcatctgaaaccaggtgaccatgccctccctgtgttcacaggagagtgtggagattgcgcccattgcaagtcagaggagagcaacatgtgtgagctactcaggatcaacaccgataggggtgtcatgatccatgatggccaatcaaggttctctaagaatggacaacccatacaccatttcttgggaacctctacattcagtgaatacactgttgtccatgctggatgtgttgcaaagatcaaccctgctgctccacttgacaaagtttgtgttctcagttgtggaatttgcacaggttttggtgctactgtaaatgtagcaaaaccaaaacctggttcctctgttgccatatttggacttggagctgttggccttgcggctgctgaaggtgcaagagtttcaggtgcttcaagaatcattggagttgatttagtttctgcccgatttgaagaagctaagaagtttggggttaatgagtttgtgaacccaaaggatcatgataaacctgtgcaacaggtaattgctgaaatgaccaatggaggtgtggatcgggctgttgaatgtactggcagcatccaagccatggtctcagcattcgaatgcgtccacgatggttggggtcttgctgtacttgttggtgtgcctagtaaagatgatgcattcaaaactgctcctattaatttcctgaacgagaggactcttaagggcaccttttatggcaactacaaaccacgcaccgatcttccatctgttgtcgagaagtacatgagtggggagctagaagtggacaaattcatcactcacacagttccattctcagagatcaacaaagcttttgatttaatgctgaagggacagtccattaggtgtatcatccgcatgcaagagtgagatggatatgaaaagtccatgactgtgttctgggacagactactcttatgtgatttatgaataaaaagagagaagagagaataaaaaatttattggtaaaatccccaattaggctattaggattatgattgtattgttgcacattgagtgttgggaatgacagggcatttagccctttgttacttgattgcggc

SEQ ID NO: 2963 - DNA, 1594 bp, Nicotiana benthamiana
  misc_feature (1146)..(1146): n is a, c, g, or t
  misc_feature (1149)..(1149): n is a, c, g, or t
  misc_feature (1206)..(1206): n is a, c, g, or t
  misc_feature (1265)..(1265): n is a, c, g, or t
  misc_feature (1311)..(1311): n is a, c, g, or t
  misc_feature (1317)..(1317): n is a, c, g, or t
  misc_feature (1382)..(1382): n is a, c, g, or t
  misc_feature (1390)..(1390): n is a, c, g, or t
  misc_feature (1404)..(1404): n is a, c, g, or t
  misc_feature (1417)..(1417): n is a, c, g, or t
  misc_feature (1440)..(1440): n is a, c, g, or t
  misc_feature (1456)..(1456): n is a, c, g, or t
ccaaaatttacctcaccgtctccgccggccgaaaatcgccgccagcggcagcagagctctaaatgaacacaaaatcatactagacaaccgttgttcttccctaatctctatttcatgccttgaacccttcgaatctcactgagtctccacaaatttggaatctaaggttttcacagtccgggctagggattgagtattttctttaaaatcaatcgatttctgtttaatattattggtttactttcgttgaaataaacgtttaatattaatcagaagtcgatgttttctcatgaaagcttgaacaccactgcgattgcgtgggaagccgggaagccattggtgatagaagaagtggaggtggcaccaccacaaaaaagtgaagttcgcctcaagattcttttcacctccttgtgccatactgatgtttacttctgggaagctaaggggcaaacaccactatttcctcgtattttcggacatgaagctggaggaattgtggagagtgtaggcgaaggtgttacagatctccaaccaggagaccatgttcttcctgtgttcactggtgaatgccagcagtgtcgacactgtaaatcagaggaaagcaacatgtgtgacctccttagaataaacacagacaggggagttatgatccatgatggtcagacaagattctccaaagatggcaagccaatatatcactttgttggaacttccacctttagtgaatacaccgttgtccattctggatgcgtcgccaagattgatccacaggcaccacttgacaaagtttgcgttctgagttgtgggatatcaacaggacttggtgcaactctgaatgttgccaaacctaccaaaggttctactgtagctatttttggcttgggagctgttggccttgctgctgctgaaggagctaggattgctggggcttctaggatcattggcattgatttgaatcccagcaggttcaatgattccaagaagtttggtgtgactgagtttgtgaatccaaaagattatgataagcctgtccagcaggtcattgctgagatgacagatggaggtgttgaccgaagtgtcgagtgtaccggaaagtcaacgccatgatctctgcttttgaatgtgttcatgatggttggggcgtgncgntgcttgttggcgtgccaaacaaagacgatgcgttcaaaactcatccaatgaatctgntgaatgaaaggactctcaagggtaccttctttggcaactacaagcccaaaactgacctnccatctgtggtgggcaagtacatgaataaggagctagagctggagnagttcnttacccaccaagttccattttcagagatcaacaaagcatttgagtatatgctgaaaggggaaggnttacgttncatgatcaccatgngacattgaaacgntaactaggaagcaaagacctagnctttatagtctcatantaataaaacaattttttattagggtaatgatgtaagtagtgtttgaagccaaaacatatctgttgtcaaggctttatttaatttccatattatgtaataattttactactcatgtttcgaaagtatgatttacatgtt

SEQ ID NO: 2964 - DNA, 1427 bp, Vigna unguiculata
cacaattcaaaatctctcatcttcctttcgttcatcttccttcgtttttttagccatgtctactgttggccagacaatcaagtgcaaagctgccattgcatgggaggcagggaagccactggtgattgaagaagtagaggtggcgccaccccaaaccggagaagtccgtttgaagatccactacacctccctttgccacactgatgtttacttttgggaagccaagggccagactccattgtttcctcgtatttttggccatgaagcttcaggtattgttgagagcgttggcgagggtgtcactcatttgcaaccaggagaccatgccctccctgtgttcacaggagagtgtggggattgtgtgcattgtaagtcagaagagagcaacatgtgtgagctcctcaggatcaacaccgacaggggtgtcatgatcagtgatggtaaatcaaggttctctaaggatggaaaacccattcaccatttcttgggaacctccacattcagtgaatacacagttctccacgcaggatgtgttgcaaagatcaacccagctgctccacttgacaaagttactgttctcagttgtggaatttgcacaggtcttggtgctactgttaatgttgcaaaaccaaaacctggttcctctgttgccattttcggacttggagccgttggccttgcggctgcagaaggggcaaggatttgtggtgctaaaagaatcattggaattgatttagttccagaaagatttgaacaagctaagaagtttggttgtaacgagtttgtgaatccaaaggatcatgataagcctattcaacaggtaattgctgaaatgaccaatggaggtgtggaccgggctgttgaatgcactggcagcatccaggccatggtttcggcatttgaatgtgtccatgatggttggggtgttgctgtacttgttggtgtgcctagtaaagatgatgcattcaaaactgctcctattaatttcctgaatgagaggactcttaagggaaccttttatggcaactacaaaccacgtactgatcttcctggtgttgtggaaaagtacctcagcggggagctagaagtagataagttcatcactcactcagttcccttcacagagatcaacaaagcctttgattacatgctgaaaggagagtccattaggtgtcttattcgcatgcaagactaagatggatgatgaaatagttcatcactctgttgttcaggacagaggtctccatctgaatttacgagtgttaataaagttttgatagaaaatcctcttctaggattatgattctcatttttcagattgagtgttgagacagataccgcacttgatcctttgtttctttgttactgcttgtgtatttttgtaattttgctgtttaattgttaaataatatttgacttctacatta

SEQ ID NO: 2965 - DNA, 1349 bp, Manihot esculenta
atggcaactactgctaatcagattatacattgcaaagctgctgtttcatgggaagcagggaagccactggttatagaagaagtggaggtggcacctccacaggccatggaagtccgtatcaagatcctcttttacagctctctgtcacactgatgtctacttctgggaggccaagggacagagccctttgtttcctagaatttttggtcatgaggctggagggattgtggagagtgttggtgagggtgttaccgaactcaaaccaggcgatcacgtcctgcctatatttacaggggaatgcaaggattgcgcacactgcaaatcagaacagagcaatatgtgtgagctcctcaggattaatacagaaagaggtgtgatgattgaagatggaaaatcaagattttccatcaagggcaagcccatttaccattttcttgggacttccactttcagcgagtacactgttgttcattcaggctgtgtagccaagatcaacccttcagctcctcttgacacggtctttgttctcagctgcggattttgcacgggatttggtgctacggttaatgttgctaaacctccaaagggctcaacagtggctgtctttggactaggagctgtaggccttgccgctgctgaaggggccaggttttctggggcttctaggattattggcgttgatgtgaacccaaataaatttgaacaagcaaagaagtttggggtaaccgagtttgtgaatccaaaagattacgacaagccagttcaagaggtactggttgagatgacaaatggaggtgtagacagaagcatagagtgcacaggcaatgttcaggccatgatttctgcatttgaaagtgtccatgatgtatgcattttgtttttcttaggctggggtgtggctgttcttgtgggggtgcctagcaaagatgatgtcttcaagactcatcccctcaatttcttgacagaaaggactctcaagggtactttctacgggaacttcaagccccgcacagacatccccttggttgtggagaagtacatgaacaaggagatcgaactcgaaaagttcatcactcattcagtaccattctcagatatcaacacagcttttgatttaatgcttaaaggagaaggcattcgatgtctcattcgaatggaggagtagatccaatcttcaagcaattcagtctcttattgtaaaataataaaagttggtataatcgtagcctctgcaagacaaggccagccttcatgtgttcaacacatttggataacagaacatcttgtcagtgtgtttttattgcaagctttctctatgacaatactacagtgaagtatttaattaatgg

SEQ ID NO: 2966 - DNA, 1892 bp, Eucalyptus grandis
atggccgccaccgttgcgcgtgcaataagacagaggacctacgacgctgtgagcgtacggagaaggagcggtcgaccggttgattggtcaaccaagggggggaggctcccgaaaaccactggccatcccttacgtacgacggcccatggagaaaaccatgacgatgactgtcgtccaccgattcgcgtacctcgctctggtttttcttttgagttcgatagacgggtaaagagggagagagagacatcattcttttctcaactcaagtcgaaactgtttgagaaatcttcgttggtgcacatccttcttaagccgcattttcctctcgccgagccgaagaaccgggccatgtcgagcaccgccggattcatgatcccctgcaaagcggcggtcgcgtgggaagcggggaagccgctggtgatccagcaggtggaggtggctccgccgcaggccatggaagtgaggatgaaggtcaagtacacctcgctatgccacactgatctttacttctgggaggccaaggggcagacgccattatttcctcgtatttttggccatgaagctgctggggtggtggagagtgttggagaaggggtgtcagatgttgcagttggggatcatgtgcttccagtgttcacaggggagtgtggagaatgtaggcattgccagtctgaggaaagcaacatgtgtgatctgctaagaatcaacaccgagagaggggttatgcttagtgatgggaaatctaggttttccataaatggtacaccaataaatcactttctgggcacgtccactttcagtgaatatacagttgttcacgcaggctgtctagcaaagattaaccctcttgcacctttggataaagtctgtattgtcagttgcggcgtttctacgggattaggagccacattgaatgtcgcgaagccgaaacaaggttcttctgttgctatatttggtctgggagctgtcggcctagctgctgcagaaggtgctagaattgcgggtgcatcaagaataattggagttgatttgaacccgaacaggtttgaggaagccaagaagtttggagtgaccgaattcgttaacccaaaggattacgacagacctgttcaacaggttattgctgaaatgactgatggtggtgttgacaggagtgtggagtgcactggcaacatcaatgccatggtttcagcttttgaatgtgttcatgatggatggggtgtggctgtgctggtcggagtccccaacaaagatgccgttttcatgacaaagcccatcaacattctcaacgaaagaacgctcaaggggacattttttgggaactacaaacctcggagtgatatcccttctgttgttgatatgtacttgaacaagaaactggagttggataagttcatcactcaccgagtgcctttctccgaaatcaataaggctttcgatttgatggtgaagggagagggcttgaggtgcattatcaatatggaggactaggactggtgtcagatgctaataaataatctctactcatgttagtgctaataactcatctttgtccgttgtgagataatgacatttaaagaacgtgcagctatcttttccccttgtcatttcccaattctatgtcttaatacatcttgataacattacatcccagattatgtttgttgcgactgagactagaattattactgcttgactgtggggctttccaagttttaactgtactaatcagttggcctgcagtatcattttgtcaaactttcagagtgtgtttactaggaggtgcactggtttggcagtgcagtttggagtttttgcacttaatgtagtaacccaaatagagagattacaaatggtagttcaaccaatctgtctcagcgttgggcaaggtt

SEQ ID NO: 2967 - DNA, 2365 bp, Zea mays
ctctatctccgtgtccgtggaatggactggacagggactcggtgcagccgcatccgcccagcgctggggaccctgaagccaaagcgaacggccacgtggcgcctatccgcgcgaatgggacggatggatgaggttgcagcagcgtgtggccgccggccagttcatctgagcccaaagaacttcacaaaccagtccagggtcctttctgcaataacctgaagaagctacgattattatatttattcactggtaaagcccagtggagagcacacgcctcttctccccccccaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctccgccgctcaccggagcatcggccgtccatcaccaccaccaccacctcctcctcttcctcgtccgctcaccgcccgtccctgctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatattcttctcggttgctactcagctaggcagatatgttatcactatgatgagcagcggtgttgtacttggggttggattccagctgtcaggcggagacagccaaatgaacgaactaatttggtatagctggcttggtggggtgattatcggcacaatgataggtgcaaacagtgtcctagaggaacactgcaaagctggacctcgcaatgtcgtcataactggaagcacaagagggttaggaaaagcgcttgctcgtgagtttcttctttctggagaccgtgttgtaattacttcacgaagtcctgaatcagtccttcagactataaaagaacttgaagagaacatacaggaagggttatctgttgccaaaaagaagcagaggaatattctatcgcatgccaaggttgttggtacagattgtgatgtctgtaaacctgaagatgtgaaggagttagtgaattttgctattaatgagcttggttcagttgatatttggataaataacgctggcacaaataaaggttttaggccattggtaaccttttcagatgatgacatcactcagatcgtctcaacaaacctagttggttctctactgtgcaccagagaagccatgaatgtcatgcaataccaagagaagggaggccatatattcaacatggatggagcaggttctggaggatcaagcacaccactaacagctgtctatggttcaactaaatgtggactaaagcagttccaaggatcacttctgaacgaaagcagaagatcaaaagttggagtgcatactgcttcacctggtatggtcctcacagaccttctgttaagtggttcatcgctcagaaataaacagatgttcaatttaatatgtgaacttccagaaacagtagccagaactttggttccaaggatgagagttgtaaaaggaagtggaaaggcaatcaactacttaacaccaccaaggatcttgcttgctctggttactgcatgggttcgacggggtcgatggtttgacgacgagggaagagcggtgtatgcagctgaagctgatagaattcgcaactgggctgaaagtcgagcacgcttctcgttcaccgacgccatggagatgtacacggaaaacacatgggtttccgtattctcgctctcggtggtctgtgcgttcataatcctctctagctccggtggacctcttccaggcacatgatttccagagctgtcaaactactagtagacggccatgcatatgctcattttttaccccaccaaaggcattctactaccagaaaccatttgatacagcacttaatgaatggggaagaagagaaccccccacagatgtagatacattggtgcaagggagattagcagctgcctcctcgcaccatttaaagtttggctagctaacctatgtgctcatagaagggtaaatagaatttattgcgtgggcattccactgccgtacgtaagctggactatgatccgtgacttttttaaggacatgtatgcaaagttaggtgagcaggatcagagtcgacattgcctcgtgtacatgcatgtagttgtcattataatcactgtaacttctggtatcgcttgtacccttcaaaattcgaagacattatattgtgaagcgaagtggc

SEQ ID NO: 2968 - DNA, 2119 bp, Setaria italica
ggcgcggctgcatcagggacacaaggacgccaagcagccccaagcaaaaaggtgagaagcacacgcaacaaacacacgacacgagtgtgtgagcagacgaggtgagatcgccgaatccttatccacctcgccatggcggccgccgcccacctctccgtccacggcagcctccgccgctcggcggccgagctgccctccacctcctcccaccgcccgtccctcctgcggtgccgcgcgttcaagcaggaggcggacggcggggaccgcgacgacccgtccgcgtcgtcgtcgtcgccgccgaacgaggcgcggaagcgcaggaagaaggggccgctgtacaagctcaaggccgcgatccaggggctcgcgggctcccggtcggccgcggccgaggtgtatgggggagagtaccagcgcgccgtcgagaaggcggaggagatcttcttctcggttgctacacacctaggcaaatatgttatcactatgatgagcagtggtgttgtacttggggttggatttcagctatcaggtggagacagccaaatgaatgaactaatttggtatagctggcttggtggggtgattattggtacaatgataggtgcaaatagtgtcctagaggaacactgcaaagctggacctcgtaatgtcgtcataacgggaagcacaagaggtttaggaaaagcaattgctcgcgagtttcttctttctggagaccatgttgtgattacttcacggagtcctgaatcagttcttcagactattaaagaacttgaagagaacattcaggagggcttatcagttgccaaaaagaaagaaaggaaaattttatcaaatgccaaggttgttggtacagcttgtgatgtctgtaaacctgaagatgtgaagaagttagtgaattttgctattaatgagcttggctcagttgacatctggataaataatgctggcacgaataaaggatttaggccactggtaactttttctgatgatgacattactcagattgtatcgacaaacctagttggatcattgctgtgcaccagagaagctatgaatgtcatgcaataccaagagaagggaggccatatattcaacatggatggagcaggttctggaggatcaagtacaccactgacagctgtctatggttcaactaaatgtggactgaggcagttccaagcatcacttctgaaggaaagcagaagatcaaaagttggagtgcacactgcctctcctggtatggtccttaccgaccttcttttaagtggttcatccctgagaaataaacagatgttcaatttaatatgtgagcttccagaaacagtagctaggacattagttccaaggatgagagttgtaaaaggaagtggaaaggcaatcaactacttgacaccaccaaggatcttgcttgccttggttactgcatgggttcgacggggccgatggtttgatgacgagggacgagcagtgtatgcagccgaggctgatagaattcgcaactgggctgaaagtcgagcacgcttctctttcactgatgccatggagatgtacacagaaaacacgtgggtttccgtattctcgctctccgtggtctgtgcattcataattctttccagctcaggtggacctcttccaggcacatgatcaccagagctgccaaactagatactccatttgttttcaccaaaggcattctattatcagaaggcgtatgacacaacactatgaatgggaagaagataaacccacaaatgtagataggtgcaagggagatcagcagctgcttcctctcaacatttaaggcttggctaaccatgtgctcagaaaaagggtaaatagaatttgttttgtgggcattcccacttctgtaagctagtatgtgattattgacttttaagaacacgtatgggaagttaactaagcacgaacagagttcataaaagtttttacctggtgtacatgcttttagttatgataactattgtaactttctgatcgccgcttgttcccttaaaacctaaactatactcctatatagcaagggaagtagcctgcaccatgtatgtggtttatctattggttttgcatcagacgaaaccttgggtgttattgtgga

SEQ ID NO: 2969 - DNA, 2156 bp, Oryza sativa
acgccctctcctaaaaccaaggaacccaaccccacaaaaaagcgtaggacgccggagtgcgaaatccttatccgctcgcggcgacgccatggccgccgccgcggtggtccacctctccgtgcacggccgcctccgccgctcgccggagctccacgcccggccataccaccgcccgtcgctgctccggtgccgcgcgttcaagcaggaggccgataacggcggggaggaggcttcgtcgtcgccgccgccgccgacgacggccgaggcgcggaggcgcaggaagggcccgctgtacaagctgaaggcggcgattcaggggctcgccgggtcgcggtcggcggccgcggaggcgtacgggggcgagtaccagcgcgccgtcgagaaggccgaggagatcttcttctcggttgctacgcaagtaggccgatatgttatcactatgatgagcagcggtgttgtacttggagttggatttcagttatcaggcggagacagccaaatgaatacactaatttggtatagttggctcgggggagtaattattggcacgatgataggtgcaaacagtgtcctagaggaacactgcaaagctggacctcgcaatgttgtcataactggaagcacaagaggattagggaaagcacttgctcgggagttccttctttctggagatcgtgttgtaattgcttcacgcagccctgaatcagtccttcagaccatcaacgagcttgaagagaacatacaggagggcttgtcagttgcgaaaaagaaacagagagaaattttgctacatgccaaggttgttggtacatcatgtgatgtttgtaaaccagaagatgtgaaaaagttggtgaactttgccaaggatgagcttggatcaattgatatttggataaataacgctggcacaaacaaaggttttaggccactggtaaacttttcagatgaagatatttctcagattgtctcaacaaacctagttggctctttactgtgcaccagagaagccatgaatgtcatgcaacaccaacaaaagggaggtcacgtatttaacatggatggagcaggttctggaggatcaagtacaccattaacagctgtttatggttcaactaagtgtggccttagacagtttcaagcatcacttctgaaggaaagcagaagatcaaaagttggtgtacacactgcttctcctggaatggtccttacggacctccttttgagcggttcttctctgagaaataaacagatgttcaatttaatatgtgagcttccagaaacagttgcaaggacattggttccgaggatgcgagttgtgaaaggaagtggaaaggcgataaactacttgacaccaccaaggatcttgcttgccttggttactgcatgggttcgccgaggccgatggtttgatgaagagggaagagcagtatatgcagcagaggctgatagaatccgtaattgggctgaaagtcgagcacgcttctctttcacagatgccatggagatgtacacagaaaacacatgggtttctgtgttctcgctctctgtcgtctgcgcattcataattctttccagctcaggtggacctcttccaggcacatgatcccaggagttgccaaactagatggctacacacaccatttttcttcagtacggggattctattatgtactgatatatgacacacgaaacttatgaaggggggaaattgaacccagaaagcttactgcgtacatacgcccaacggtgagaagcatcagctgccactcaccatttaaggtcaagctaaccatgtgctcagtaaaaatgggtaaatagcatttgttgtgtgggcattccactgtttgtaagctgacttgtaaaaacgtgtatctgagctaaactgagcacgaacagattcgatggacaatgttatctgctgtacatgcatgtagtaatgtagttttgatgactgtaattctctggtcgtcgcttccagttgcacggttgcaccgtatgttgcaaccaccaatagaactgaaagtaagtgagagtaatcaagccagcatctgctatgtatatatatgactcatcagtctgttatatatcacaaggaaagcttcttcaaagctaaaagcaaagctatcagtaagacagtaatcctgtgtttttgtcca

SEQ ID NO: 2970 - DNA, 2166 bp, Brachypodium distachyon
ggagaaagggcacgaaatccttatcttctccccatggccgccgcggtcgtccacctctctgtccatggccgcctccgccgctcccctgacatcctttctcagacctgctaccgcccttccctcctacggtgccgcgcgttcaagcaggaaactggcggcgacgatgagaagccgtcgccgaccgaggcgcggaagcgcaagaaggggccactttacaagctgaaggcggcgattcaggggctcgcggggtctcggtcggcggcagcggaggtgtatggagggcagtacgagctcgccgtcgagaaggccgaggagatcttcttctcggttgctactcagttaggcagatatgttataacaatgatgagcagtggtgttgtacttggagttggatttcagttatcaggtggagacagccagatgaacactctaatttggtatagctggcttggcggagtaattattggaacaatgataggtgcaaacagtgttctagaggaacactgcaaagctggacctcgaaatgtggtgataactggaagcacaagaggtttagggaaagcacttgctcgggagtttcttctttctggagaccgtgttgtagttgcttcccgcagccctcaatctgttcttcagaccatcagtgaacttgaagagaacatacaggagggcttgtctgttgccaaaaagaaacaaagagaagctttattacaagccaaggtggttggtacatcttgtgatgtttgtaaaccagaggatgtgaaaaagctggtaaattttgctgttgatgagcttggttcaattgacatatggataaataatgctggaacaaacaaaggttttaggccactggtaaatttttcagatgaagatatcagccagatcgtatctacaaatctagttggttctttactttgtaccagagaagccatggatgtcatgcaaaaccaagagaagggaggtcatgtattcaacatggatggggcaggatccggaggatcaagcacgccattgacagctgtttatggttcaactaagtgtgggctaaggcagttccaagcatcacttatgactgaaagcaaaagatcaaaagttggagtgcacactgcctctcctggaatggtccttacagacctccttttaagcggttcatctcttcaaaataagcagatgttcaatataatatgcgagcttccagaaacagtagcaaggacgttggttccaaggatgcgagttgtgaaaggaagtggaaaggcaataaactacttgacaccaccaagaatcttgcttgccttggttactgcatgggttcgccgtggccgatggtttgatgaagaggggagagcagtatatgcagctgaggccgataggattcgcaactgggccgaaagccgaacacgcttctctttcacagatgcgatggagatgtatacggagaacacatgggtctcagtattctctctttctgttgtttgtgcattcataattctttccagctcaggtggaccttttccgggcacatgatccccgatacgtgaaacccagatggccacatatatactctattcttttccaccacaggaattctatcatctaacgacatatgacatggcacttgtgaagggtgcaaaggtgaacccagatgcgtatttaagcgcaaagagggatcagcatcagctgcctcaccatttaaggataagctaaccatgtgcccagattcagaaaggggcaaaacatcatttgttacgtgggcattccacttactgtaagttagtctgtaagttgtcttgtaagtacatgtgtctgaattaagcaatctgagcacgacgccgagccgaaggcgtactgatgtcttgaacatggatgtaggtgtgatccttctaaatttctcttgaacatggatgtaggtgttatccttgtaagtttctgatctttgtaattgtacgtacccttcaaaatagtatagcaagttaattagcaacatgacgaagactcgagagaagtgaatctagtctttgtatatgcctcatcatgtattcctccggatgagtgctctggtcaatctagcgtgtaaagttcaggacacgtacttgtatcccttttcttaagtttatgcccaagtaagacaaaaagttaaaggtaagcctgtgatgatgtgcatctttg

SEQ ID NO: 2971 - DNA, 2059 bp, Triticum aestivum
gtacgagcgagaacggaccggagcgagaggaagagcacaggatccttatctcctccgggggaaagcgcgccatggccgccgcagtcgtgcacctctccgtccacggccgcctccgccgctcgccggaggccgtcgtctctcaggcgtgccaccgcccttccctcctccgctgccgcgcgttcaagcaggaggccggcggcgacgacgagaagccgaacgagccgcggaagcgcaggaaggggccgctgtacacgctgaaggcagcgatgcaggggctcgcggggtcccggtcggcggctgcggaggtgtatggcgggcagtatgagctcgcggtggagaaggccgaggagatcttcttctcggttgctactcaggtagggagatacgttatcactatgatgagcagtggtgttgtactagcagttggatttcagttatcaggtggagacagccaaacggatgcactaatttggtatagctggcttggtggagtaattatcggcacaatgctaggtgcaaacagtgtcctagaggaacattgtaaagctggacctcgcaatgttgtcataacgggaagcacaagagggttaggaaaagcacttgctcgggagtttcttctttctggagatcatgttgtaattgcttcccgcagccctgaatcagttcttcagaccatcaatgagcttgaagagaacatacaggagggcctgtcagttgccaagaagaaacaaagagaaactttattacaagctaaggttgttggtacatcttgtgatgtatgcaaaccagaagacgtaaaaaagcttgtaaattttgctgttggtgaactgggttcaattgacatttggataaataatgctggcacaaacaaaggttttaggccactggtaaatttttcagatgaagatattacccagatcgtctcaacaaacctagttggttctttgctctgcaccagagaagctatggatgtcatgcaataccaagagaagggaggtcatgtattcaacatggatggagcaggatctggaggatcaagcacaccgttgacagctgtttatggctcaactaagtgtggactaaggcagttccaagcatcgcttatgaaggaaagcagaagatcaaaagttggagtgcacaccgcgtctcctggaatggtccttacagatctccttctaagtggttcatctctccaaaataaacagatgttcaatataatatgcgagcttccagaaacagtagcaaggacattggtcccaagaatgcgagttgtgaaaggaagtggaaaggcagtaaactacttgacaccaccaagaatcttgcttgccttggttactgcatgggttcgccgaggccgatggtttgacgaagaggggagagcagtatatgcagccgaggctgatagaattcgcaattgggctgaaagtcgaacacgcttctccttcacagatgccatggagatgtatacagagaatacatgggtttccgttttctcactctcggtcgtctgtgcattcataatgctttccagttcaggcggacctttccctggcacataatccctggagtcgccaaaccagacaattcttttttcaccactgggattctatcatccaatgacatatgttgcgaagggggcaaaggtgatcccagacgcgtaattacacgcaaataggatcatcatcagccgccttaccatttaaggataagctaaccgagccctcagattaagaaaagggtaaatagcatttgttatgtgggcattccacttactgtaagctagtgtgtaaagctgtcttgtaagaacatgtgtctgaagtaaccagagcacggaaagagtcgagtaagtcgacaggctttggtcgtctcttgtacatggatgtagtagttatgatccttatgaactcatggttcatcagtgtaaagttcaggatatgtatgtccctgttcttgtagatttatacatattgttgtatagaaagaaagcaagactcggaaacgtgaactaaagaagtggatctttgtacacatggagtaaatttccactgtggcttcttga

SEQ ID NO: 2972 - DNA, 2238 bp, Avena sativa
gcgaaacgatccccatccccacacaaaaaaggagcgcacgcggcacgcacacacacagtagcggcggaagtgagaagaaccgagaggggagaacggaagagcgcaaaatccttatctcctgccggggaagcgcgccatggccgccgcggtcgtccacctctccgtccacggccgcctccgccgctccccggagaccgtcccccagacgtgctaccgcccttccctcctccgctgccgcgcgttcaagcaggaagccggcggcgacgatgagaacaagccgtcgtcgccaccgccgaagcgcaggaaggggccgctgtacaagctgaaggcggcgatgcaggggctcgcggggtcccgatcggcggcggcggaggtgtatggcgggcagcacgagtacgagcgcgcggtcgagaaggccgaggagatcttcttctcggttgctactcaggtaggcagatacgttatcactatgataagcagtggtgttgtacttgcagttggatttcagttatcaggtggagacagccaaacggatgcgctaatttggtatagctggcttggtggagtaattattggcacaatgataggtgcaaacagtgtcctagaggaacactgcaaagctggacctcgcaatgttgtcataacgggaagcacaagagggttagggaaagcacttgctcgggagtttcttctttctggagatcgtgttgtagttgcttcccgcagccctgactcagttcttcagaccattgacgagcttgaagcgaacatacaggagggcttgtcagttgccaaaaagaaacaaagagaaactttattacaagctaaggttgttggtacgtcttgtgatgtttgcaaacctgaagatgtaaaaaagctggtaaattttgctgttgaagagctgggttcaattgacatttggataaataatgctggcacaaataaaggtttcaggccactcgtaaatttttctgatgaagatattacccagattgtttcaacaaacctagttggttctttgctctgcaccagagaagctatggatgtcatgcaataccaagaaaagggtggtcatgtattcaacatggatggtgcaggatctggaggatcaagcacgccattgacagctgtttatggttcaactaaatgtggactaaggcagttccaagcatcacttatgaaggaaagcagaagatcaaaagttggagttcacactgcctctcctggaatggtccttacagatctccttctaagtggttcatctctccaaaataaacagatgttcaatataatatgtgagcttccagaaacagtagcaaggacattggttcctagaatgcgagttgtgaaaggaagtggaaaggcagtaaactacttgacaccaccaagaatcttgcttgcgctggttactgcatgggttcgccggggccgatggtttgacgaagaggggagagcagtatatgctgcggaggctgatagaattcgcaactgggctgaaagccgagcacgcttctccttcacggatgccatggagatgtacactgagaatacctgggtatccgtgttctcactctctgtcgtctgtgcattcataatgctttccagttcaggtggacctttccctggctgatcctccctggactggagtcgccgaaccagagaattcttttttcaccagaggagttctatcatctaatgaacatatgacctgacagttgggaatggggcaaaggtgagcccaggcgcgcgattaagcgcaaagtggatcagcatcagccgcctcaccgttaaaggataatctaaccatgccctcagattcagaaaggggtaaataacatttgttatgtgggcattccacttacaccactgtaaagtagtctgtaagctgtctcgtaagaacatgtgtctgaagtaatcagagcacggacagaatcggcggggcgttcctgtctcttgtacatggatgtagttatgatctttgtaaattccttatagtcgctttgtactcttcaaacaagtatagcaagtttgcaacacagtgtagaactcataagaatcgatgctgagtcgccatacatggttcaccatctatattctagacggataaagtgtaaagttcaggatacacttatccctttcttatagatttgttataccagggaaagacaaaaaggttgtatataaaatcaaggttgcaatgaagtgtgcatctgtactatggagtaataattctcgaaa

SEQ ID NO: 2973 - DNA, 2135 bp, Triticum aestivum
gtacgagcgagaaccgaccggagcgagaggaagagcacaggatccttatctcctccgggaggaagcgcgccatggccgccgcggtcgtccacctctccgtccacggccgcctccgccgctcgccggaggccgtcgtctctcaggcatgccaccgcccttccctcctgcgctgccgcgcgttcaagcaggaggccggcggcgaccaccacaagccgtcgtcgccgccgaacgagccgcggaagcgcaggaaggggccgctgtacacgctgaaggcggcgatgcaggggctcgcggggtcccggtcggcggcggcggaggtgtatggcgggcagtacgagctcgcggccgagaaggccgaggagatcttcttctcggttgctactcaggtaggcagatacgttatcactatgatgagcagtggtgttgtactagcagttggatttcagttatcaggtggggacagccaaacggatgcactaatttggtatagctggcttggtggagtaattatcggcacaatgctaggtgcaaacagtgtcctagaggaacactgtaaagctggacctcgcaatgttgtcataacgggaagcacaagagggttaggaaaagcacttgctcgggagtttcttctttctggagatcatgttgtaattgcttcccgcagccctgattcagttcttcagaccatcaatgagcttgaagagaacatacaggagggcttgtcagttgccaagaagaaacaaagagaaactttattacaagctaaggttgttggtacatcttgtgatgtttgcaaaccagaagatgtaaaaaagcttgtaaattttgctgttggtgagctgggttcaattgacatttggataaataatgctggcacaaacaaaggttttaggccactggtaaatttttcagatgaagatattacccagatcgtctcaacaaacctagttggttctttgctctgcaccagagaagctatggatgtcatgcaataccaagagaagggaggtcatgtattcaacatggatggagcaggatctggaggatcaagcacaccgttgacagctgtttatggctcaactaagtgtggactaaggcagttccaagcatcgcttatgaaggaaagcagaagatcaaaagttggagtacacactgcgtctcctggaatggtccttacagatctccttctaagtggctcatctctccaaaataaacagatgttcaatataatatgcgagcttccagaaacagtagcaaggacattggttccaagaatgcgagttgtgaaaggaagtggaaaggcagtaaactacttgacaccaccaagaatcttgcttgccttggttactgcatgggttcgccgaggccgatggtttgacgaagaggggagagcagtatatgcagccgaggctgatagaattcgcaattgggctgaaagtcgaacacgcatctccttcacagatgccatggagatgtacacagagaatacatgggtttccgtgttctcactctctgtcgtctgtgcgttcataatgctttccagttcgggcggacctttccctggcacataatccctggagtcgccaaaccagataattcttttttcaccactgggattctatcatccaatgacatatgttgcgaatggggcaaaggtgatcccagacgcgtaattatgcgcaaagaggatcatcatcagccgccttaccatttaaggataagctaaccgagccctcagattaagaaaagggtaaatagcatttgttatgtgggcattccacttactgtaagctagtgtgtaaagctgtcttgcaagaacatgtgtctgaagtaaccagagcatggaaagagtcgactggcgttgctcgtctcttgtacatgtacatgtagtagttatgatccttgtaaattcccgggtgtcgcgttgtacccttcaaaaatgtatagcaactttagcaacacagtttagaactggaaggagttgccatacatggttcgtcagtgtaaagttcaagatatgtatgtccctgttcttgtagaatacataccatgggaggacaaaaaaggttgtatagaaagaagcaagactgggaaatgtgaactaatgaagtggatctttgtgtaaaaaaaaaaaa

SEQ ID NO: 2974 - DNA, 1819 bp, Pennisetum glaucum
cgacggcgacggcccgtcgtcgaccaagcgcaggaagaagggcccgctgtacaagctcaaggccgcgatccagggcctcgcgggctcgcggtcggcagcggccgaggtgtacggcggagagcaccagtaccagcgcgccgtcgagaaggccgaggagatcttcttctcggttgctacacagctaggcagatatgttatcactatgatgagcagtggtgtcgtacttggggtcggatttcagctatcaggcggagacagccaaatgaatgaactaatttggtatagctggcttggaggggtgattatcggtacaatgataggtgcaaacagtgtcctagaggaacactgcaaagctgggcctcgtaatgtcgtcataaccggaagcacaagaggattgggaaaagcaattgctcgtgagtttcttctttctggagaccgtgttgtgattacttcacggagtcctgaatcagttcttcagactatcaaagaacttgaagagaacattcaagagggcttatcagtggcaaaaaagaaagaaaggaaaactttatcacacgccaaggttgttggtacagcttgtgatgtctgcaaacctgaagatgtgaagcagttagtgaattttgctattgatgagcttggttcagttgacatttggataaataatgctggcacaaataaaggatttaggccgctggtaactttttctgatgatgatattactcagatcgtctcaacaaacctagttggatcattgctgtgcaccagagaagctatgaatgtcatgcaataccaagagaagggaggccatatattcaacatggatggagcaggttctggaggatcaagcacaccactgacagctgtctatggttcaaccaaatgtggactgaggcagttccaagcatcacttctgaaggaaagcagaagatcaaaagttggagtgcatactgcctctcctggtatggtccttaccgaccttcttttaagtggttcatccgtgagaaataaacagatgttcaatttaatatgtgagcttccagaaacagtagctaggacgttggttccaaggatgagagttgtaaaaggaagtggaaaggcaatcaactacctgacaccaccaaggatcttgctggccttggtaactgcatgggttcgacggggcagatggtttgatgatgagggaagagcggtgtatgcagccgaggctgatagaattcgcaactgggctgaaagtcgagcacgcttctctttcaccgacgccatggagatgtacacggaaaacacatgggtctccgtattctcgctctccgtggtctgcgcattcataattctttccagctcaggcggacctcttcccggcacatgatcacagcggagctgccgaagtaggcactccatttgttttcaccaaaggcactcaattatcggaaggcatacgacagacacaacactcgtgaatgggggaagaaggtaaaacccacaaatgtaggtaggtgcaagggagagatgagcagctgcttgcttcctctcatctcaccatttaaggcttggctaaccaggtgctcagtaaaagggtaaatatagaatctgttttgtgggcattccacttctgtaagctagtctctgtgactgttgactttttaagaacacgaatgggaagttaactaagcacgaacatatagttgatagaactttttaccccgtgtacgtgtgcctgcttttagtaacgaaaataactattgtaacttcctgatcggcgcttgcttgttcccttacaacgaaaataactattgtaacttcctgatcggcgcttgcttgt

SEQ ID NO: 2975 - DNA, 2003 bp, Triticum aestivum
  misc_feature (72)..(72): n is a, c, g, or t
  misc_feature (1160)..(1160): n is a, c, g, or t
  misc_feature (1166)..(1166): n is a, c, g, or t
cacagtacgacagtacgagcgagaaccgaccggagcgagaggaagagcacaggatccttatctcctccgggnggaagcgcgccatggccgccgcggtcgtccacctctccgtccacggccgcctccgccgctcgccggaggccgtcgtctctcaggcgtgccaccgcccttccctcctccgctgccgcgcgttcaagcaggaggccggcggcgacgacgagaagccgtcgtcgccgccgaacgagccgcggaagcgcaggaaggggccgctgtacacgctgaaggcagcgatgcaggggctcgcggggtcccggtcggcggctgcggaggtgtatggcgggcagtatgagctcgcggtggagaaggccgaggagatcttcttctcggttgctactcaggtaggcagatacgttatcactatgatgagcagtggtgttgtactagcagttggatttcagttatcaggtggagacagccaaacggatgcactaatttggtatagctggcttggtggagtaattatcggcacaatgctaggtgcaaacagtgtcctagaggaacattgtaaagctggacctcgcaatgttgtcataacgggaagcacaagagggttaggaaaagcacttgctcgggagtttcttctttctggagatcatgttgtaattgcttcccgcagccctgaatcagttcttcagaccatcaatgagcttgaagagaacatacaggagggcctgtcagttgccaagaagaaacaaagagaaactttattacaagctaaggttgttggtacatcttgtgatgtttgcaaaccagaagatgtaaaaaagcttgtaaattttgctgttggtgagctgggttcaattgacatttggataaataatgctggcacaaacaaaggttttaggccactggtaaatttttcagatgaagatattacccagatcgtctcaacaaacctagttggttctttgctctgcaccagagaagctatggatgtcatgcaataccaagagaagggaggtcatgtattcaacatggatggagcaggatctggaggatcaagcacaccgttgacagctgtttatggctcaactaagtgtggactaaggcagttccaagcatcgcttatgaaggaaagcagaagatcaaaagttggagtncacacngcgtctcctggaatggtccttacagatctccttctaagtggttcatctctccaaaataaacagatgttcaatataatatgcgagcttccagaaacagtagcaaggacattggtcccaagaatgcgagttgtgaaaggaagtggaaaggcagtaaactacttgacaccaccaagaatcttgcttgccttggttactgcatgggttcgccgaggccgatggtttgacgaagaggggagagcagtatatgcagccgaggctgatagaattcgcaattgggctgaaagtcgaacacgcttttccttcacagatgccatggagatgtatacagagaatacatgggtttccgtattctcactctcggtcgtctgtgcattcataatgctttccagttcaggcggacctttccctggcacataatccctggagtcgccaaaccagacaattcttttttcaccacagggattctatcatccaatgacatatgttgcgaagggggcaaatgtgatcccagacgcgtaattacatgcaaataggatcatcatcagccgccttaccatttaaggataagctaaccgagccctcagattcagaaaagggtaaatagcatttgttatgtgggcattccacttactgtaagctagtgtgtaaagctgtcctgtaagaacatgtgtctgaactctgaagtaaccagagcacggaaagagtcgacgggctttgctcctctcttgtacatggatgtactctagtagttatgatccttatgaactcccgggtgtcgctttgtacccttcaaaaatgtatagcaacttagcaacacggtttagaactggaaggagt

SEQ ID NO: 2976 - DNA, 2096 bp, Panicum virgatum
aaaatcattggacgccaacacaaacacgccaaaaggtgaggagcgcgcacctacgctacacgcaacgagtgagcaggcggcgcccagcgagacggggggagatcgccgaatccttccttatccacctcgccgcggcgccatggccgccgccgccgccgtcgtccacctctcctcccacgcccgcctccgcctccgccgctcgccgcccgacccgccctccacctcctcccgccgcccgaccctcctgcgctgccgcgcgttcaagcaggagcctgacggggggcagcggcaccgacccgaccgagtcgccgaaccgcaggaagaaggggccgctgtacaagctcaaggccgcgatccaggggctcgcgggctcccgctcggccgccgcggaggcgtacgggggagagtaccagcgcgccgtcgagaaggcggaggagatcttcttctcggttactactcagctaggaaaatatgttatcactatgatgagcagtggtgttgtactcggggttggatttcagctatcaggtggagacagccaaatgaatgaactaatttggtacagctggcttggtggggtgattatcggtacaatgataggtacaaacagtgttctagaggaacactgcaaagctggacctcgcaatgtcgtcataactggaagcacaagagggttaggaaaagcacttgctcgtgagtttcttctttcaggagaccgggttgttattacttcacgaagtcctgaatcagttcttcagactatcaaagaacttgaagagaacattcaggagggcttatcagtcgccaaaaagaaagaaaggaaaactttatctcatgccaaggttgttggtacagcttctgatgtctgtaaacctgaagatgtgaagaagttagtgaattttgctattaatgagcttggctcagttgacatttggatcaataatgcggggacaaataaaggttttaggccactggtaactttttctgatgatgacattactcagatcgtcgcaacaaacctagttgggtctctgctgtgcaccagagaagccatgaatgtcatgcaataccaagacaagggaggccatatattcaacatggatggagcaggttctggaggatcaagtacaccactgacagctgtctatggttcaactaaatgtggactgagacagttccaatcatcacttctgaaggaaagcagaagatcaaaagttggagtgcacactgcctctcctggtatggtcctcacagaccttcttttgagtggttcatccctcagaaataaacagatgttcaatttaatatgcgaacttccagaaacagtagctaggacattggttccaaggatgagagttgttaaaggaagtggaaaggcaatcaactacttgacaccaccaaggatcttgctggccttggttactgcatgggttcgaagggggcggtggtttgatgatgagggaagagcagtatatgcagccgaggctgatcgaatccgcaactgggctgaaagccgagcacgcttctctttcaccgatgccatggagatgtacacggaaaacacatgggtttccgtattctcgctctctgtggtctgtgcattcataattctttccagctcaggtggacctcttccaggcacatgatccccagagttgccaacctagatactccaaatttattttcaccaaaggcgttctattatcagaaggcatatgacacaacacttgtgaatggggaagaagatgaacccacaaatgtagataggtgcaagggagatcagcagctgcttcctctctcaccatttaaggcttggctaaccatgttctcagaaaaagggtaaatagaatttgttttgtgggcattcccacttctgtaagctagtctgtgatctgtgacttttaagaacatgtatgagaaagtgagcacgatcagagtcgataaaagttcttgcctgctcgggcatgcttatttaattattgtaactctctgatcgccacttgttcccttagcactagagtatatataacttgagtcatgggtcagaactcagaatcatgagatgtcaggtgtgtatgcatgtcatcttttacttt

SEQ ID NO: 2977 - DNA, 1631 bp, Zea mays
ccccccacatgcacttgctgcaggagcagccgtagtacacacgcacaccgcctcgactcgactcccacctcccctgttctcaccgtgcttgccctgtttcgacctctgcccatccgcgctcgcgtgcccgccgtacagtacaggccagacagccatggtggtgctcgccaaaccgcctgtcgtcgaccagatcccgctcctgcggtccccgggccccagggacagcttctcgggagtgccggtcgtcgacctgtccagccacggcgcggcgcgggcgatcgtcgacgcctgcgagcgcttcgggttcttcaaggtcgtcaaccacggcgtggccgcggccaccatggacagggccgagtccgaggccgtcaggttcttcgcgcaggcgcaggcggacaaggaccgcgcggggccggcgtacccgttcgggtacggcagcaagcggatcgggctcaatggcgacatggggtggctcgagtacctcctcctcgccgtcgacgccgcgtcgctctccgacgcctgccccgtgccctccagcgccgcgttccggagcgcgctgaacgagtacgtcgcggccgtgcggaaggtggcggcgcgtgtgctggaggcgatggcggagggcctgggcattgcggacgcggacgcgctgagctccatggtgagcggcgccgggagcgaccaggtgttccgcgtgaaccactacccgccctgccccgcgctgcagggcctgggctgcagcaccacgggcttcggcgagcacaccgacccgcagatcatctccgtgctccgctccaacggcacctccggcctgcagatcgcgctccgcgacggcgcgcagtgggtctccgtgccctccgaccgcgacgccttcttcgttaacgtcggcgactcgttgcaggtgctgaccaacgggaggttcaggagcgtgaagcaccgggtggtgaccaacagcctcaagtccagagtttccttcatctacttcgcggggccgccgctggggcagcggatcgcgccgctgccgcaggtgctggcggagggagaggagagcctgtacaaggagttcacgtggggcgagtacaagaaggccgcgtacaagacgaggctcggcgacaacaggctggcccagtttgagaagcgtagcaacatctagctaagctagcaaggcgcgcggcccgggcatgcacgccgcgtcttcacaggacaacaataacaaccaccatgacgagcgagttacttgcaagaaatgatgacaaggaagaagaagaagaagaaggtgaagacgatgatgtgaacagccagggagcgtagtgactactccagtagctagatttttttgtgtggtgggtgcagggtttccgcaaagttgctaatggcctgttctggtgcttgcggtggggttagttgcctatttcggtatgctggagctggacgggcgatgagccgccgcctgtaattagggttaaccatgatagcatgcagcgaagcgaaggggacgatcctctctggctccgtagcttcccacgtttgcttgcttgtgctttccctttcctggtttatatatattttcgtatatttaagcatcaattcgcgcgtatgtattgtggtgtaaatggaggtctgtgtgtgcgcct

SEQ ID NO: 2978 - DNA, 1057 bp, Setaria italica
cagagacagccatggtggtgctcgccaacccgcctgtcgtcgaccagatcccgctcctgcggtccccggggcccagggatagcttcgccgccgtgccggtcgtcgacctgtccggccccggcgcggcgcgggcgatcgtcgacgcctgcgagcgcttcgggttcttcaaggtcgtcaaccacggcgtcgccgcggccaccatggacagggccgagaccgaggccatcaggtttttcgcgcaggcgcaggccgacaaggaccgcgccggcccggcctacccgttcgggtacggcagcaagcggatcggcctcaatggcgacatgggctggctcgagtacctcctcctcgccgtcgactccgcgtcgctctccgacgcctgctccgtgccctcgaacgccgcgttccgggccgcgctgaacgagtacatcgcggcggtgcggaaggtggcggtgcgcgtgctggaggcgatggcggagggcctgggcattgcgcccttggacgcgctgagcgcgatggtgacggagcaggggagcgaccaggtgttccgcgtgaaccactacccgccctgccccgcgctccagggcctgggctgcagcgccacgggtttcggtgagcacaccgacccgcagctcgtctccgtgctccgctccaacggcacgtccggcctccagatcgcgcttcgcgacggcgcgcagtgggtgtccgtgccctccgaccgcgacgccttcttcgtcaacgtcggcgactccctgcaggtgctgaccaacgggaggttcaagagcgtgaagcaccgggtggtgaccaacagcctcaagtctagggtttccttcatctacttcggcgggccgccgctggcgcagcggatcgagccgctgccggagctgctgggggagggcgaggagagcctgtacaaggagttcacgtggggcgagtacaagaaggccgcgtacaagacgaggctcggcgacaacaggctggcccagtttgagaagaagtagcaggctagcagccgcgcgcgcgcagggccgggccggtcaagcaccagctttactggaca

SEQ ID NO: 2979 - DNA, 1744 bp, Zea mays
cccacatgcacttgctgcagcagccgtaggacacacgcacaccgcctcgacctcgagtccaccactgactccaccacctccccctgttttttttcgacctcgctctgctcatccgcacggccagacagccatggtggtggtgctcgccaacccgcctgtcgtggaccagatcccgctcctgcggtccccgggccccagggacagcttctcgtgcgtgccggtcgtcgacctgtccggccccggcgcggcgcgcgcgatcgtcgacgcctgcgagcgcttcggcttcttcaaggtcgtcaaccacggcgtgcccgcggccaccatggacgtggccgagtccgaggccgtcggcttcttcgcgcaggcgcaggccgacaaggaccgcgcgggcccccgcgcgtcgtacccgttcggctacggcagcaagcggatcggcctcaatggcgacatggggtggctcgagtacctcctcctcgccgtcgactccgcgtcgctctccgacgcctgccccgtcccatccggcgccgcgttccggagcgcgctgaacgagtacgtcgcggccgtgcgggacgtcgcggcgcgcgtgctggaggcgatggcggagggcctgggcatcgcggacgcggccgcgctcagctcgatggtgaccggcgccggcagcgaccaggtgttccgcgtcaaccactacccgccctgccccgcgctgcagggcctgggctgcaccgccaccgccacgggcttcggcgagcacaccgacccgcagatcatctccgtgctccgctccaacggcacgtccggcctgcaggtcgcgctccgcgacgccgcgcaggcgcagcagtgggtgtccgtgccctccgaccgcgacgccttcttcgttaacgtcggcgactcgttgcaggtgctgaccaacgggaggttcgagagcgtgaagcaccgggtggtgaccaacagcctcaagtccagggtttccttcatctacttcgcgggaccggcgctggagcagcggatcgcgccgctggcgcagctgctggcggagggcgaggagagcctgtacagggagttcacgtggggcgagtacaagacggccgcgtacaagacgaggctcggcgacaacaggctggcccagtttcagaggtgtagcatctaagctagctgcttagctagcactctagcagggcggcccccggccggtcaagcacacaccagctttacaggacgacaacagcaacaaccatgacgaacgaggacgagcgagtctgcttgcgagaaatgatggcgaagaagaagaagaagaacaaggtagagacgagacgatgatgatgtgtacagctggggagcgaccactctagtagctagatttttttttgtggtggtggtgggtagctgggtgcagggagcagggtttccgcaagttgctaatatggcctgttttggtgcatgcggtggggttacttgcctatttcggtaatgctggagctggacgggcaatgagccgcgcgccactagttagcgttaaccgaagtgggaggagtacttagcttagcagcgaagggccgatcgatcctctctggctcctccccagcagcttcccaagttagcttgcttctgcttcgccttcctagtttttttttggtgtgtgtgtgtgtgtttttaagcaccaagtcgcgtgtatgtattatcgtcgtgtacatggaggtttgtgtgtgcgctaatgtagacctcctgtttaccttttactcgacct

SEQ ID NO: 2980 - DNA, 1723 bp, Panicum virgatum
cacttctcccccacatgcacttgctgcgagcagccgtagtacacacacccacgcacaccacttcgactcgacctcccctgttctcgtcgtgcctgccctgtttcgagctctgctccagctcgcccgcgctccgtgcagaccagacttgaccagacagccatggtggtgctcgccaacccgcctgtcgtcgaccagatcccgctcctgcggtccccggggcccagggacagcttcgccgccgtgccggtcgtcgacctgtccagccccggcgcggcgcgggcgatcgtcgatgcctgcgagcgcttcgggttcttcaaggtcgtcaaccacggcgtcgccgcgggcaccatggaccgcgccgagaccgaggccgtcaagttcttcgcgcagacccaggccgacaagggaccgcgcgggcccggcctacccgttcgggtacggcagcaagcgcatcggcatcaatggcgacatggggtggctcgagtacctcctcctcgccgtcgactccgcgtctctctccgacgcctgcaccgtccccgccgccgccgcgttccgggctgcgttgaacgagtacatcgcggcggtgcggaaggtggcggtgcgcgtgctggaggcgatggcggatggcctgggcattgcgcccgcggacgcgctgagcgccatggtgacggagcaggggagcgaccaggtgttccgcgtgaaccactacccgccctgccccgcgctccagggcctgggctgtagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgtcaacgtcggcgactcccttcaggtgctgaccaacgggaggttcaggagcgtgaagcaccgggtggtgaccaacagcctcaagtccagggtttccttcatctacttcggcgggccgccgctggcgcagcggatcgcgccgctgccggagctgctgggggagggcgaggagagcctgtacagggagttcacgtgggccgagtacaagaaggcagcgtacaaaacgaggctcggcgacaacaggctggcccagtttgagaagaagtagcggcagccgcgcgcgccgctggggcgggccggtcaagcaccagcaggcagcagcttttttacgagacagccagccaggcagactagcagctccagtgccggccggcatcagcatatgccgcgcaccatgggcatggagatgacgaggaagttacctgcactgcaggttcggaatgatggcgaggtagactggtagacgaagataaaagatgcggatgtgtacagctggggatcggccagtagtagctagtacagtagtagatctttgtggtgggtgcagggtttccgctaacgacctgtgttggtgaggtggggctacttgcctgtttcggcatctgctggatggccagggcgggcgatgggcagccgccggtagctagcgctaaccgaaatggcatggagctaagggacgaggacgtctcgaacatctctgtctcaacagctttcatattagcttgctgctttttattgtgtgtttcgtgtttttttgttatattttcttttgtacttgggccggtggtgcgtgtatcgtggtgtaaagcgctgtaaatggaaggatctgtgtgcgcctatgtgg

SEQ ID NO: 2981 - DNA, 1384 bp, Triticum aestivum
tcggcacgaggctcccctgtttcgcccgcccgctcgctcgcctctgtttcttttctttctttcccagcggctctgctccgctcctcacctccctcgatcgcacataccatatgccatggtggttctcgccagcacgcccgccgtcgatcacatcccgctcctcaggtcgcccgaccccggggactacttctccggcatgccggtggtcgacctctccagccctggcgcgccgcgggccatcgccgacgcgtgcgagcgcttcgggttcttcaagctcgtcaaccacggggtgcccgcggacacgatggacaggctcgagtcggaggccgtcaggttcttctcgctgccgcaggccgacaaggaccgctccggcccggcctacccgttcggctacggcagcaagcgcatcgggctcaatggcgacatggggtggctcgagtacctgctcctcgccgtcgactccgcgtcgctctccggcgcctgcgccgtcccgtcctgcgcgctcttccgggcggcgctgaacgagtacatcgcggcggtgcggaaggtggcggtgcgggtgatggaggcgatggcggaggggctgggcattgcggccgtggacgcgctgagcgggatggtgacggcggaggggagcgaccaggtgttccgggtgaaccactacccgccgtgccacgcgctgcaggggctgggctgcagcgccaccggcttcggcgagcacacggacccgcagctcatctcggtgctgcgctccaacggcacgtccggcctgcagatcgcgctccagaacgggcagtgggtgtccgtgccctcggaccgcgacgccttcttcgtcaacgtcggcgactcgttgcaggtgctgaccaacgggaggttcaagagcgtgaagcacagggtggtggccaacagcctaaagtctagggtttccatgatctactttggagggccagcgatgacacagaggattgcaccattgccgcagctgctgggcgcgggagagcagagcctgtacaaggacttcacatggggcgagtacaagaaggctgcctacaactccaggctcggggacaacaggctggctcagttccacaggtagcctcgcctgccgcctgggcccgctcaaggagcagcttttaccaagccagccagctactagcttagctagctctgccgtggcttgtatttcccacacgatcgatgaagatgaagaggggggaagctactactgtactagaaaagaaaaagaaacagggctaaaagaagatgatttcaagattcacatgcagcagtagagctgcggaggtagctagtaagtagtagatcctttttgcgtgcgtgtgcgtgtacgtgtgacgtgtgtgttcatagttgctaaaacccgcct

SEQ ID NO: 2982 - DNA, 1656 bp, Oryza sativa
cacatgcacttgcagtcagtggtacaacaccacagcaacgcaccaccggccatcaacctcctctcccctgcttctcgctcgctctcctgccctgtttcttggagaagtgagcttaagtgagagcctctgtccctcgcacacgctattggccatggtggttctcgctggcccgcccgccgtcgatcacatcccgctgctgaggtcgccggaccccggcgacgtcttctccggcgtgccggtcgtcgacctcggcagccccggcgcggcgagggccgtggtggacgcctgcgagcggtacgggttcttcaaggtcgtcaaccacggcgtggccacggacacgatggacaaggccgagtcggaggccgtcaggttcttctcccagacgcagcccgacaaggaccgctccggcccggcctacccgttcgggtacggcagcaagcggatcgggttcaatggcgacatggggtggctcgagtacctcctcctcgccctcgacgacgcgtcgctcgccgacgcctgcaccgtcccgtcctgcgcggtcttccgggccgctctgaacgagtacatctcgggggtgcggaaggtggcggtgcgggtgatggaggcgatgtcggaggggctgggcattgcgcaggcggacgcgctgagcgcgctggtgacggcggaagggagcgaccaggtgttccgcgtgaaccactacccgccgtgccgcgcgctgcaggggctcggctgcagcgtcaccggcttcggcgagcacaccgacccgcagctcgtctccgtgctccgctcaaacggcacgtccggcctgcagatcgcgctccgcgacggccagtgggtgtccgtgccctccgaccgcgactccttcttcgtcaacgtcggcgactcgttgcaggttctgaccaatgggaggttcaagagcgtgaagcacagggtggtggccaacagcctaaagtctagggtttccttcatctactttggagggccaccgttagcacagaggattgcaccattgccacagctgctgggggagggagagcagagcctgtacaaggagttcacatgggatgagtacaagaaggctgcctacaaatcaaggcttggagacaacaggctggcccagtttgagaagaagtagctagctagatgcctagcaacagaactggccggtcaagcaacaacgactttactgcatggcagctagctaccttagctatgtctcacgcacacgtacggtacaccatgaccacgagaagatgaagctgcttaagagagaaaaagaaaagaaaataaaaacaggaagaagataataacttcaagatgcacaatgtacagccaggttggatggatagctagatttttctcgtgtggctaatcaccgtgtgtggtgaggtgggctcctttcctgtttcggaatactgatcgatggatgaacagcctccaatagttaatgttaaccaaatatagcacaacaaaggggttcttttcttcctttggttgtttcttttttcctcttgcctttgattttctcgtcatgctttctgagcattaattatgtgtgcgtgtatttcggtatacgtaacgtacttttacctatgtgtgtatagtacgtggcttgtgttaacaagtaaatattatagtctctctctttcgttatgc

SEQ ID NO: 2983 - DNA, 1457 bp, Triticum aestivum
gcacgagagcatctcccctgttccgcccgctcgcctctgcttctttagttctttccagagcggctctgctctgctcctcgcctctctcgatcgcgcatacgtaccatatttggcagcccagccatggtggttctcgccagcacgcccgccgtcgatcacatcccgctcctcaggtcgcccgaccccggggactacttctccggcatgccggtggtcgacctctccagccctggcgcgccgcgggccatcgccgacgcgtgcgagcgcttcgggttcttcaagctcgtcaaccacggggtgcccgcggacacgatggacaggctcgagtcggaggccgtcaggttcttctcgctgccgcaggccgacaaggaccgctccggcccggcctacccgttcggctacggcagcaagcgcatcgggctcaatggcgacatgggctggctcgagtacctcctcctcgccgtcgactccgcgtcgctctccggcgcctgcaccgtcccgtcctgcgcgctcttccgggcggcgctgaacgagtacatcgcggcggtgcggaaggtggcggtgcgggtgatggaggcgatggcggaggggctgggcattgcgcccgttgacgcgctgagcgcgatggtgacggcggaggggagcgaccaggtgttccgggtgaaccactacccgccgtgccacgcgctgcaggggctgggctgcagcgccaccggcttcggcgagcacacggacccgcagctcatctcggtgctgcgctccaacggcacgtccggcctgcagatcgcgctccagaacgggcagtgggtgtccgtgccctcggaccgcgacgccttcttcgtcaacgtcggcgactcgttgcaggtgctgacgaacgggaggttcaagagcgtgaagcacagggtggtggccaacagcctaaagtctagggtttccatgatctactttggagggccagcgatgacacagaggattgcaccattgccgcagctgctgggcgcgggcgagcagagcctgtacaaggacttcacatggggcgagtacaagaaggctgcctacaactccaggctcggggacaacatgctggctcacttccacaggtagcctcgcctgccgcctgggcccgctcaacgagcagcttttaccaacccagccagctacctagcttagctagctctgccgtggcttgtagtatttcccacatgatcgatgaagatgaagagggcggaagctactactgtactagaaaagaaaaagaaacagggctaaaagaagatgatttcaagattcacatgcagcagtagagctgcggaggtagctagtaagtagtagatcctttttgcgtgcgtgtgcgtgtacgtgtgacgtgtgtgttcatagttgctaaaacccgcctttcctattcgggaatgccggacgaaccatgaacagataagttaacttgatgaatagttagt

SEQ ID NO: 2984 - DNA, 1401 bp, Brachypodium distachyon
actagtgtactcctacaaacgcaacgcaggcagcgcgcacacacatctcctcctctgtttcgcccgcccgcttgccgtgccggcccctgtttcttcctctctctcgatcacacataccatatttgttagcgcagcacaggacaggcgcgagccatggtggttctcgccagcccgcccgcggccgatcacatcccgctcctgaggtccccggacccgggggactacttctcgggcatgcctgtcatcgacctctgcagcccgggcgcgccgcgtgccatcgcggacgcgtgcgagcggttcgggttcttcaagctcgtcaaccacggcgtggccacggacgccatggaccggctcgagtcagaagccgtgacgttcttctcgcagccgcaggccgacaaggaccggtccggcccggcgtacccgttcggctacggcagcaagcgcatcgggctcaatggcgacatggggtggctcgagtacctgctcctggccgtcgacgactccgcctcgctctccggcgccgtcccgtccggctccgccttcaggcgcgcgctgaacgagtacatcggggccgtgcggaaggtggccgtccgggtgatggaggccatggcggaagggctgggcattgcgccgctcgacgcgctgagcaagatggtgaccgcggcagggagcgaccaggtgttccgggtgaaccactacccgccctgcgccgcgctgcaggggctcggctgcagcgccacggggttcggcgagcacaccgacccgcagctcgtctccgtgctccgctccaacggcacctccggcctgcagatcgcgctccaggacggcggccagtgggtctccgtgccttccgaccgcgacgcgctcttcgtcaacgttggcgattcgttgcaggtgctgaccaatgggaggttcaagagcgtgaagcatagggtggtggccaacagcctaaagtctagggtttccttgatctactttggagggccacctttgacacagaggattgcaccattgccacagctgctgggggagggcgagcagagcctgtacacggagttcacatggagcgagtacaagaaggctgcctacaaatcaaggctcggtgacaacaggctggcccagtttcagaagtagcagcaggtagatacccagggtcggttcaaggaacagctgttacaagccagctaccgtagctaatatttcacgcacgatgaagaggaggaagctactaaggaagaaaagagtgaaaaaacagagcaaaaaaagaagaccatgataatttcaagatgcacatgtacagctaggcagctagcaagatcttttttgtgaggttggtgtgtctgtgcgcatagttgctaaaaattgcttatggcatgtggggtgaggtgggctcctttccta

SEQ ID NO: 2985 - DNA, 1601 bp, Hordeum vulgare
cccctgcttccgcctctgtttctttcctcttctcctctcctcgcctctcctctctcgatcgcacacactttaccatacttggtagcagcagcctctgcaaccatggtggttctcgccggcacgcctgccgtcgatcacatcccgctcctcaggtcccccgaccccggggacaacttctccggcatgccggtcgtggacctgtccagacctggcgcgccgcgggccatcgccgacgcgtgcgagcgcttcggcttcttcaagctcgtcaaccacggggtggccctggacgcgatggaccggctcgagtcggaggccgtgaggttcttctcgctgccgcaggccgacaaggaccgctccggcccggcctacccgttcggctacggcagcaagcgcatcgggctcaatggcgacatggggtggctcgagtacctcctcctcgccgtcgactccgcctcgctccccgccgcctccgccgtcccgtcctgcgcgctcttccgggcggcgctgaacgagtacatcgcggcggtgaggaagggggcggtgcgggtgatggaggcgatggcggaggggctgggcattgcgcaggcggacgcgctgagcgcgatggtggcggcggagggcagcgaccaggtgttcagggtgaaccactacccgccgtgccacgcgctgcaggggctcggctgcagcgccaccggcttcggcgagcacaccgacccgcagctcatctccgtgctgcgctccaacggcacgtccggcctgcagatcgcgctccagagcggccactgggtgtccgtgccctccgaccgcgacgccttcttcgtcaacgtcggcgactccttgcaggtgctgaccaacgggaggttcaagagcgtgaagcacagggtggtggccaacagcctaaagtctagggtttccatgatctactttggagggccagcattgacacagaggattgcaccattgccgcagctgctgagagagggagagcagagcctgtacaaggacttcacatggggcgagtacaagaaggctgcctacaactccaggctcggggacaacaggctggctcacttccacaggtagccacgcctgccgcctgggcccgctcaaagaacagcctttaccaagacagccagccagctagagctagctttagctagctgctgcggtttcccacacgatgaagatgaagatcaagatcaagataaagacgaggaaagctactaagaaagaaaaagaaacagggctaaaagaagataacttcaagattcacatgcagagctgcggaggtagctacatctttttttgcgttcgtgcgtgcgtgtgtgtgttcatagttgctaaggctcgcctttcctattcgggaaggccggacgaatgatgaacagacaagttaacttcagtagttagtagtgtgaaccaaatagtagtataggagtacagcagaggatgacatgagagtgctcttctggtctttcttttttcaaattcatgagtagagtatagctggcctggatcttgtttcagtatttctgatgataactgtaatcgtggtgtataacgtagtcgtgtgtgcgcgtcgaccttctgtttaacctgcc

SEQ ID NO: 2986 - DNA, 1224 bp, Triticum aestivum
taccggtccggaattttccggtcgacccacgcgtccggagatttgcacaaaatttaccatgaatgattcaaacaaggagatagtgaaggatattggacttattggatcaaatggagttccgtcttttgtcccttcacctgcatcttatcttgagcctccagttattctgaataaaaacaaaaaagatgacatcccaaatgattgggtttcctccttggaggaatgccaggcaatgtctgcacaaaagttagggcaggaggggtccaattctggtcaaaattgttctggtagcacgggtgatgaaaatgtgtcaaaatctaagaagcccgcctctgatagtacttcctgtgaggaagcatcttctgcaacagataagccaacgagattgctagctgttaatggtggcttggttccggagtcatcattgaggcctgttataggaagaaactctcatatcctaaagcagcaaaagataaatttgcttgatatagatgcagcgttgcctgaggaagctttgagagcctcaaagtctcaacaaataagaaggcgttcatggcgcacttttgtgaagcatgcagaatcaatatccgagatggtactggcgaccagtgtgttggagagtatgataaaatccgagttcctgaagaatgattggtggtactggtcctccttcacagtagctatgaagacctcaactgtatcctcgctcgctctcaggatctacactcttgacgactgtatcatgtacaccaaggagcctaacaccatgctggctgacagtataaaggttgtaaacaaggggaagaggaggaaagagccagaaccatcagcgtcgtaatctgcgccgctctattgcataccccaaacttagaagttccgtggacggtgcaacaatgtgacgctgtggtcacagagatggtatagacagagtctttggttatgtggtcccttagtggttgagcctttaggctagctttgattctggtgttcctgcaagggtgcaaccttgaccgttcaatttaataagtcatatttaccagactatagttgtgcgccttagatatgttagggccagcgaagaaggaaaatgcgttgtttcaaggatggcagccgcaatagctggcgttcaaattttctgccgggagcggctgcatgcgagcgtagtttttccttttgggctaacctggctttcagggatacatatcattcatgttagctcccggt

SEQ ID NO: 2987 - DNA, 1224 bp, Triticum aestivum
  misc_feature (499)..(499): n is a, c, g, or t
  misc_feature (505)..(505): n is a, c, g, or t
  misc_feature (550)..(550): n is a, c, g, or t
  misc_feature (559)..(560): n is a, c, g, or t
  misc_feature (589)..(589): n is a, c, g, or t
  misc_feature (948)..(948): n is a, c, g, or t
taccggtccggaattttccggtcgacccacgcgtccggagatttgcacaaaatttaccatgaatgattcaaacaaggagatagtgaaggatattggacttattggatcaaatggagttccgtcttttgtcccttcacctgcatcttatcttgagcctccagttattctgaataaaaacaaaaaagatgacatcccaaatgattgggtttcctccttggaggaatgccaggcaatgtctgcacaaaagttagggcaggaggggtccaattctggtcaaaattgttctggtagcacgggtgatgaaaatgtgtcaaaatctaagaagcccgcctctgatagtacttcctgtgaggaagcatcttctgcaacagataagccaacgagattgctagctgttaatggtggcttggttccggagtcatcattgaggcctgttataggaagaaattctcatatcctaaagcagcaaaagataaatttgcttgatatagatgcagcnttgccngaggaagctttgagagcctcaaagtctcaacaaataagaaggcgntcatggcgnncttttgtgaagcatgcagaatcaatatcngagatggtactggcgaccagtgtgttggagagtatgataaaatccgagttcctgaagaatgattggtggtactggtcctccttcacagtagctatgaagacctcaactgtatcctcgctcgctctcaggatctacactcttgacgactgtatcatgtacaccaaggagcctaacaccatgctggctgacagtataaaggttgtaaacaaggggaagaggaggaaagagccagaaccatcagcgtcgtaatctgcgccgctctattgcataccccaaacttagaagttccgtggacggtgcaacaatgtgacgctgtggtcacagagatggtatagacagagtctttggttatgtggtcncttagtggttgagcctttaggctagctttgattctggtgttcctgcaagggtgcaaccttgaccgttcaatttaataagtcatatttaccagactatagttgtgcgccttagatatgttagggccagcgaagaaggaaaatgcgttgtttcaaggatggcagccgcaatagctggcgttcaaattttctgccgggagcggctgcatgcgagcgtagtttttccttttgggctaacctggctttcagggatacatatcattcatgttagctcccggt

SEQ ID NO: 2988 - DNA, 1022 bp, Triticum aestivum
ccacgcgtccgcaaggattcaaacaaggagatagtgaaggatattggacttattggatcaaacggagtccgtcttttgtcccttcacgtgcagcttttattgatcctccagtcattctgaataaaaacaaaaagcaagatgacatcccaaatgatgattgtgtttccagctccctagaggaatgccaggcaatgtctgcacacaagttaggacaggaggggtccaattctgctcaagattgtcctgcagctagttcttcctgtgatgaaaatgtgtcaaaaactaaggagccagcccctgctactgatactacttcctgtgaggaagcagcatcttctgcaacagacaagccaacaagattgctggctgttaacggtggcttggttccggagtcatcactgaggccggttacaggaagaaactctcatatcctcaagcaacaaaagataaatttgcttgacatagaagcagcgttgcctgaggaagctttcagagcctcaaagtctcaacaaatgagaaggcattcatggcgttctttcgtgaagcgtgcagaatcaatctccgagatggtagtggcgaccagcatgttggagaaagtgataaaatccgagttcttgaagaatgattggtggtactggtcctccttcacagtagctatcaagacctcaactctatcctcgctcgctctcaggatctacactcttgacgactgtatcatctacaccaaggagcctaacaccatgccgccggctgacagtacaaaggttgtgaacaaggggggaaaggggaaagagccagaaccatcagcgtcataatttgcgccgctcgatccattgtataccccaaacttagatgctccgctttgttatgtgcaacaatgtgatgctttggtgatagacagtgtctttggttattatgtggtcccttgaggctttagagctagctttaattctggtgttcctgcaaagctgcaaacttgaccgttcattctaataagacatactatttaccagactccaaac

SEQ ID NO: 2989 - DNA, 1004 bp, Triticum aestivum
aaggattcaaacaaggagatagtgaaggatattggacttattggatcaaacggagtccgtcttttgtcccttcacgtgcagcttttattgatcctccagtcattctgaataaaaacaaaaagcaagatgacatcccaaatgatgattgtgtttccagctccctagaggaatgccaggcaatgtctgcacacaagttaggacaggaggggtccaattctgctcaagattgtcctgcagctagttcttcctgtgatgaaaatgtgtcaaaaactaaggagccagcccctgctactgatactacttcctgtgaggaagcagcatcttctgcaacagacaagccaacaagattgctggctgttaacggtggcttggttccggagtcatcactgaggccggttacaggaagaaactctcatatcctcaagcaacaaaagataaatttgcttgacatagaagcagcgttgcctgaggaagctttcagagcctcaaagtctcaacaaatgagaaggcattcatggcgttctttcgtgaagcgtgcagaatcaatctccgagatggtagtggcgaccagcatgttggagaaagtgataaaatccgagttcttgaagaatgattggtggtactggtcctccttcacagtagctatcaagacctcaactctatcctcgctcgctctcaggatctacactcttgacgactgtatcatctacaccaaggagcctaacaccatgccgccggctgacagtacaaaggttgtgaacaaggggggaaaggggaaagagccagaaccatcagcgtcataatttgcgccgctcgatccattgtataccccaaacttagatgctccgctttgttatgtgcaacaatgtgatgctttggtgatagacagtgtctttggttattatgtggtcccttgaggctttagagctagctttaattctggtgttcctgcaaagctgcaaacttgaccgttcattctaataagacatactatttaccagact

SEQ ID NO: 2990 - DNA, 5721 bp, Brachypodium distachyon
atgaagcttaatactgatctgaagatcccaggaaactggaaaatgagatttagaattgatcctgatggagctcatttgactgagttgccacattttgagggccttcacttaaagaatacaactctttatgacgcgaatcagtttatgccagcatttggttttagcatgagacaaccattggcttccacggaccgagactttgttgccgatggaaatgtagcacaaagttcaaatcatatacgcagaaggagaagagattttccacaagcatcaacttttcccatgtttgctgagaagcacgagtttggaagtgctaacatttttatggatccatcggtttttactaaagcaaccgagccgagtcctagtgaagacagaaatgcaccaatggctccaaaatttctattggaaagtaataaccgccgattaaatcattgcactgttggcctaccagttcaatatcaagatttctttattactagcttgggggaaattgataaacgggcaagctaccacaatcaacaccagatatggccagtgggttttacatcttactggcatgatagagttactggctcactgtttgagtgtgaggtgcaagatggagggagttttggacctttgtttaaggtgagaagattaccatgttcggtgttcccactaccagaagcatcaaccattctatctcaaaatggtgcaagaaaggccgatacatctgaaacgaaggaaagtagtagtttcattggagatgctgcttactatatggatgataatatatcaagtctcctatcagatccctctgagaccaatcaatattacttatcatttctagcaaatgatatggtgggtaaaaggacctctttgaattgcaatgatggacatagttcaaatatgacggcaccaatactaccttcacattctgataatgttagtttggcaccaagtaaagaagccaatattcatgacagaattggtgactttacatttgagggaacatcatcttcctcagtatggaggatgatttcttgtgctatgatggaagcttgtgaaaaaatgtacaaggaacatggccatttgatgttcttgtgctcacatagcagtgaaaatcattcattaaacaaagggagtggatgtcagaactttgatggtccttgcgctcccttaactagattttgttcatccaatgggcccactataccacgacttatagagaagaagaatgatgtggaatcttcttgtacattactgaaagaatggttataccaagacagaattgggcttgatctggattttgtgcaagaaattttggaatctcttcctggatccttggcttgtttaaactatcagttcttatgtgatagggctaaatctgtctcttgtgttacggttgcaagtggttcacttgtggctgtgcacaaggatggtcaaagtaatggagataccatgtcatatggtagacatggatctgcggtgactgggctacaggatcatgttcagcctagtggttctagcatccgtgagctacctccaggacatcttattagctgtaagctttcaccagagttggcgggagatgttttccagatatgggaattcctggggcgcttcgctgaaataattggcctcaaagaagttccttcatatgagcaattagaagacgaacttattgacccatggccaatttgtgcaaatcagaatgaattattgtcaaatgctgaaacgggtctgaccaataatgaagagattgtgtctgtatttattcctgtgaaacatcctctatgaaggaagctgatcaagataaattggcagcccaaacacttgggagatacagtggtgtagtattgcctggggtccaccttacactctttaaggttctttttggggagctattatcaaaggttgcgatttttgtagacccaaacatcgatcccaaagaatcaaagcccagacgcggaagaaagagggacactgagagtctcaattcagcaaaagaattaaactttgatatgctgactgctaacaagctgacatggccagagttggccagaaggtatctattagctgtttcttccataagtggatgcatggatttgtctgatatttccagcagagaaggagtgaagttgtttcgctgcctacaaggtgatggtggtatcctgtgcggagcactacctggggttgctggcatggagaaggatgcctcgctgcttgtggaggcggagagtttgatatgcaattcttcatcaaatgaaggaaacaaggtttttatgatggattacaaggatactgatatgatagattctgctgaggtccctgttgctgataataaaaaattgccagattgggcagaaccgctggagcctgtgagaaaattaccaacaaatgtgggaacaagaattagaaagtgtgtttatgaagctttggagagaaaacctccggaatgggcaaggaaaattttggagcaatcaataagtaaagaggtctacaagggtaatgcttccggacctaccaagaaagctgttttatccgtgttggcacaggcatgtcgtgtgattgtgccacaaaatcccgaaaactcacggaaagaaaaaaaatctatatccatctcagatgctatcttgagaaagtgtcgtattgccctgcgacgtgctatttcctcagatgaatctaagttttttggaaatttgcttggaactactctaatgaattctaatgagaacgaggatgaggggatccttggatttcctggcatggtgtctcgccctttggacttccgcacaattgatataaggctggctgtgggtgcttactgtggatcttgggagacttttcatgaggatgtgcaagaagtaatccgcaatctgcacaccgcatttggtgatcgacctgatgtactggacatggttgtttcattgtctcagggttttgaatcattatataagacagaggtgctcgacattgtacagaaatttgatttttacctgtctaatggaaatgctggttcagaaatccacgatgagctacatgatattctgagtgcggcaaccaatttacccaaagctccatgggaggatggtgtttgcaaagtatgtggcattgatagggacgatgatagtgttctgctttgtgataaatgtgactcagaataccatacttactgcttgaatccaccactagctcgtataccacaaggaaattggtactgtccttcatgtatgtcaggtcaaaagaaatcacatcttgatcagggtgttaaggatttgaaacgacaacaaaagaagcatgttggagaggaatttcatgcctttcatgaggtactcagtaagttagctgcagcaatggaagagaaggagtactgggagcttagcatatatgagagaatagatttgctcaaatttctttgtgatgaaatgctcaacacagctctaattagagaacatctagatcaatgtccagataagttgagtgatctccagcagaagttccgtgctttgaattttgaattgaaagatttgaaacataaagaagaaataaggacttcatatgctagacaaagcagaattagcaaaattgaacagcacctaagcaatagttccggacttgtgcaaaataaacagaatgatgtgcccactgtatcaggccatcttgaagaggctgaagtgaacctgaaccgcccagctgaaggtgctcctcctgggcaattgaatgtagacaaaccttgcagcagtggcaatgacatgtctacgattgaagaatataaatctttgggacattctgggcaaccatcagagacagttagtgactggattgaagggggcaccattgatgaacggtcccaaagttgcgagaagaggttactagatggtacaatcagtacgtgtgaaaacttaaatttgagaggaactcctattgcagaaagagcaccagtagctccacctctgattcctggaggggagttacctgacgaaaatgctagcacatcattccaagataatctgaaaacatcatcagctagatcacttgagcgcgatgctgataatgatgaaatggatagtttatctgatgatgtttcaaaattgcaggattcagttagcatagtggagtcacagcttaatatggcatctctcagaagagattgtctcggaaaagattctttgggtcgactgtactgggttttaggaagacctggtaaacgtcctttgctgattgctgatggaagcatgcttatacgcaaggagagaaacattagcatggttaacaactacgatgcgtctctttttcataaaggttggaattcagcatctatctttatttatgaatctgatgaagaaattcggtatcttgttgactggttaaaggactatgatcctagggacaaggaactgaaagatgctatccttcagtggcaaagacatcataatcaccaaggtggttatctccgtgatcctccagtgtccatattgtcaaagaatgagcagcttatggaccttccaagtaccaaggctgcagtaacctatttcacatcatcggagtatgaagggcataattctggaaaatgcaatagaaacagtcattctcctagtgaaagcaaagaaaatgatgagctaaaagtgaagagtgccaagtctgatatcaaggaaaaagattcccttgaccgtagctctgccattgagtcatctagtagcagaaagttgaactcatgcccatatgactttgaagagatttgcagaaagtttgtcacaaatgattcaaacaaggagatagtgaaggatatcggacttattggatcaaatggagttccttcttttgtcccttcacctgcattttttcttgaacctgcaattattctgaataaagacaaaaaagatgtcccagatgattggacttcctccctagaggaatgccagtcaatgtccgcacaacagttagggcaggaagagtccaagtctggtcaaaattgtcctgataatacttgcgatgaaaatgtgccaaaatctaggaagcccacccctgatagtacttgtgaggcatcatcttccgtaacacacaagccaacaagtttgttggctgttaatggaggcttggttccagagtcatcattgaggcctgttgtaggaaaaaactctcatatcctaaagcagcaaaagataaatttgcttgatatagatgcagcattgcctgaggaagctttaagagcctcaaagtctcaacaaataaaaagacggtcatggcgcacttttgtcaaggatgcagaatcaatatgcgagatggtattggccaccagcttgttggagagtatgatacgaactgagttcctgaagaacgactggtggtactggtcctccttcacagttgctatgaagacttcaactgtatcttcgctcgcactcaggatctacacccttgatgactgcatcatctacgccaaggatccaaacgttgagccagccgacaatacaaaagtcataaacagggggaagaggaggaaagagccagaaccatcggcgtcgtaatctctgacgctctgttgtatactccagatttagaagttctgctagcgcagcaacattgttgcactgccgtccaatatttagatgatagagtctttggttatgtggtaccttcagatagtgggtagctttgattctggtgtccctgtaagggtgcaaccgtgaccgttcattttaataagtcattatacagactatcgtagtttgcctt

SEQ ID NO: 2991 - DNA, 1571 bp, Avena sativa
acagtagagtcccagcttaatatggcatccctgagaagagattgcctggaaaggattccttgggtcgactttactgggttttaggacgacctggtaaacgtcctttgctgatcgctgatggaagcatgctgatacgcaaggagagagatattagtatgattaacagctatcctctgtctacttttgattgtaaaggatggaattcagcatctgtttttatctatgaatctgatgaagaaatccagggtcttgttgactggttaagggagtatgatccaagagagaaggaactgaaagatgctatcctgcagtggcaaagacatctttatcaccaaggtagttttcctctgagtgatccgtcagtgcacaagctgtcaaagagtgatcagtttatggaccttccaaataccaaggctgcagtaattttggagcaaaagtatggcctacgagttgatcaggacaggagtgatctctcgagaaggcaaggaaggaaaacaaagtcgggttctgaagaaagagcgtaccgatgtgactgtttagaacctgtatggcctgctcgccaccactgtttaacatgtcatgagacttatttcacatcaacagactatgaacggcataattctgggaagtgcaatacagacaatcattctcctagtgaaagcaaagaaaacgatgagccaaaagtgaagggccccaagtctgatataaaggaaaaagattccactgtagttgagtcatctagtagcacgaaattgaagtcgtgcccatatgacttcgaagagatatgcagaaaatttgtcacaaatgattccaacaaggagatggtggacgatattggacttattggatcaaatggagttccgtcttttgtcccttcacctgcattttttcttgaacctgcagttattctgaataaaaacaaaaaagatgatatcccaaatgatttgacttcctccttagaggaatgccaggcaatgtcagcacaaaggttggtgcaggaggggtccaagtctggtcaaaattgttctggtaatacaggtgatgaaaacgtgtcaaaatctacgaagcccactccagatagtacttcttgtgaagaagcatcttctgccacagacaagccaacaagactgctagctgttaatgggggcttggttccggagtcatcattgatgcctgttataggaagaaacactcatatcctaaatcggcaaaagataaatttgctcgatatagatgcagcgttgcctgaggaagcattgagagcctcaaagtctcaacaaataagaagacgctcatgacgtactcttgtcaaggacgcagaatcaatatctgagatggttgttgcgaccagcttgctggagagtatgataaaagccgagttcctgaagaatgattggtggtactggtcctccttcacagtagctatgaagacatcaaccgtatctgcgctcgcgctcaggatatacactcttgacgactgcatcatctacgcgaaggatcctaacactgaggcagctgacagtacaaaggttgtaaacaaggggaggaggaggaaagagccagaaccatcg

SEQ ID NO: 2992 - DNA, 2027 bp, Triticum aestivum
tataggacggacggaggaagaatcaacagctccacccgcaggtacaaggagagcccatgattcaagggggcaccaggcttgctgcttgctcttgattctgattctgattctgaatccccgaagagatagagacagagacggatggaggagttcatcagtctcggcggcgacgaacctgagcctcgcgcctcggaagatctcgaccaaccccaagtccaagcccaagtcgatttgaatctgaatctgaatcacgcaccaccaccaaagacggagacggagcctctgccatcccaccaccagccacaagacagcggcgtcgtcgtcctcgaggaaggccagatcgcctgccaagaatcttcttcttctgctgctgtccaagatgcgcaggccaaggcccaagaagaagccctgctgcgagcaaatggagtggggcctcctcccccatcccgccaacaaccgcaggccacaaaggccgccgcttgtgatgacatcatcgatctcgaagaaggccaggttgaggacatggacctctccgacgacaatgccgtagtcgtcgtcgttacaaagcagcatggtgctgtttcagctgaaacacccaagggcaacaatgttgggccttccctttcgacaccgagcagcgcctttatcgaccaaagccccacaagaggagttaaaagagcccgtgccgaatcaaccgagccctctgtccgtgtagtctacaacaacttgacaagggaaagcaaaaggaagctcatggaactgatgcaacaatggtccgagtggcaagctagaaagcagcacgcctcgacggaaactgtggaacaagtcttggactgtggtgaagagacttattatccagcattacatgttggttcagagagatcctgtgctgtgtcattctgggtggatagccaagcacgaggaaatgctgctgtggatgatggtgcggtgccactgtatgatcgagaatttacattgggttcaactcctatgggtgattcatcaaacgctgaaggcaagaaagataaggatgattctcgctgtttcaactgtggttcgtatagccatgctctgaaggattgcccaaagcctcgtgaccatgttgcaattagcaatgcccgcaagcagcacaacttgaaaaggaacctatctaatgttggtaatcgtggacaaaatcggtactaccagaagacgccaggcaaatttgatgatctgaaggcaggagtcctgggatctgagactagagaatgcttgggactcagggaaaatgacccgccgccgtggctgcacaggatgcgcgaattgggttatcctccaggttacctagatgaggtggaagatgaagacaaaccatctggcatcaccatatttggggacggggaggtgaaggaagagcagcagcatgaggagggagagcttccggagaagggtgaaccatccccgcctcgcaagaggatgacggtggagttccctggaataaacgcgcccgtcccagagaacggcgacccttggctgtggggcagcgctccgccgccccctcttcagtcctcctctggccgtcaccagcactcgtcatcagattcgagggatagagctcctcctgcccctccaggcgtcgagcattactcgtcatcgaggtatcactcgtacgactatggaccggcgatccctggtgccggaagaagaagctcatctggttatgacgatggtgcctggaccccgagccccgcgttttcgagcaggcagcactcgggctcgggctcgggctcgagggaaagggaaagggaaagggagagggagagggagagggaaagggagagagagagggacaggcactactacagcaacaggaggtgaatggaatggaacatgtttgtgtagctgagagacctcaattttgtttagtacgtaccaaatttaccagcagtcgaagcctttacctatcatgtcattgttggtatactagacatggctgtggtttataacaaacaaacaaaaaaaaaaacaagcctctcagaatgaatatt

SEQ ID NO: 2993 - DNA, 1146 bp, Leymus cinereus x Leymus triticoides
  misc_feature (9)..(11): n is a, c, g, or t
ggatagccnnncacgagaaaatgctgctgtggatgatggtgcggtgccgctgtatgatcgagaatttacattgggttcaactcctatgggtgattcatcaaatgctgaaggcaagaaagataaggatgattctcgctgtttcaactgtggttcgtatagtcatgctctgaaggattgcccaaagcctcgtgaccatgttgcaattagcaatgcccgcaagcagcacaacttgaaaaggaacctatctaatgttagtaatcgtggacaaaatcggtactaccagaaaacgccaggcaaatttgatgatctgaaggcaggagtcctgggatctgagactagagaatgcttggggctcagggaaaatgacccgcctccatggctgcacaggatgcgtgaattgggttatcctccaggttacctagatgaggtggaagatgaagataaaccatctggcatcaccatatttggggatggggaggcgaaggcagagcagcagcacgaggagggagaacttccggagaagggcgaaccatctccgcctcgcaagaggatgacggtggagttccctggaataaacacgcccgtccctgagaacggcgacccttggctatggggcagtgctccaccgcctcctctgtcctcctccttgggccgtcaccagcattcatcatcggattcgagggatagaggccctccagcccctccaggcgtcgagcattactcgtcatcgaggcaccactcacacgactatggaccggcgacccctggtgccggaagaagaagctcctctgggtacgaggatggcgcctggacccctcacgcggcgtattcgagcagacattactcggggtcgggatcgagggaaagggaaagggaaagggagagggagagggaaagagagagggagaggcatgacaggcactattacagcagcaacaggaggtgaatggaatggaacatctttgtgtagctgaaagacctcaattttgtgcatcaaatcaaatttactgttgaagaatccctccctagtctgtcatgtcgttgttgttgacatagtagagtacattattacatatggctgtggtttaacaaacaagcagcctcagaatatcagtcagcacttgcaatatgactgttgaagcttca

SEQ ID NO: 2994 - DNA, 2199 bp, Triticum aestivum
  misc_feature (36)..(36): n is a, c, g, or t
  misc_feature (1483)..(1483): n is a, c, g, or t
  misc_feature (1485)..(1485): n is a, c, g, or t
  misc_feature (1505)..(1505): n is a, c, g, or t
  misc_feature (1530)..(1530): n is a, c, g, or t
  misc_feature (2147)..(2147): n is a, c, g, or t
  misc_feature (2150)..(2151): n is a, c, g, or t
ctcgtgccgaattcggcaccagggactctcgggtantgtacgactgtactaccgagcgtaccgagcgtagatagatagaagagttggggacggagacggagacggagacggacagctccccgccgccgccgccgcctcctcctctcctctttctctccttataggcagaagaggaagaaggaagccgaccgcccgcaatccacagctccaccaggtaagccctcccctgctccaagacaagagattgagacagatggaggagttcatcagcctcggcgcatccgagcctggcgcctcggaaggcatcatagatctcgaccatgccctccaagtcgatgccgtcgatttgaatctgaatctcaatgcacaaccacaaggcaagcctagtactagtactagttccctcctcgacatcatcgacctcgaggaagggcaggtcgcctcccaagaagccagtgcccaacatgcgcaggggacagcagcagacaacccccaccaggccaagccccaacaagaagccctgggtgccaatggaggagtggggccgcctccttctgatggggtcatcgatctcgaagaaggtcaggttgaggacatggacctctccgacgacaatgccctagtcgttgttacaaagcagcatggtcgtgtttcagctgctcaaacacccaaggccaacaatgatgggcctcccctttcgacacttatcgaccaaagccccacaagaggagttaaaagagcccgtgctgaatcaacagagccttctgtccgtgtagtctacaacaacttgacaagggaaagcaaaaagaagctcatggaactgatgcaacaatggtctgagtggcaagctagaaagcagcacgcctcgacggaaactgtagaagaagtcttggactgcggtgaagagacttattatccagcattacatgttggttcagagcgatcctgtgctgtgtcattctgggtggatagccaagcacgaggaaatgctgctgtggatgatggtgcggtgccgctgtatgatcgagaattcacattgggttcaactcctatgggtgattcatcaaatgctgaaggcaagaaagataaggatgattctcgctgtttcaactgtggttcgtacagtcatgctctgaaggattgcccaaagcctcgtgaccatgttgcaattagcaatgcccgcaagcagcacaacttgaaaaggaacctatctaatgttggtaatcgtggacaaaatcggtactaccagaagacgccaggcaaatttgatgatctgaaggcaggagtcctgggatctgagactagagaatgcttggggctcagggaaaatgacccgccgccgtggctgcacaggatgcgtgaattgggttatcctccaggttacctagatgaggtggaagatgaagacaaaccatctggcatcaccatatttggggacggggaggtgaaggaagagcagcagcagcaggaggagggagagctncnggagaagggtgaagcatccncgcctcgcaagaggatgacggtggngttccctggaataaacgcgcccgtcccagagaacggcgacccttggctgtggggcagcgctcctccgccccctcttcagtcctcctcgggccgtcacaaccagcactcgtcatcagattcgagggatagagctcctcctgctcctccaggcgttgagcattactcgtcatcgaggtatcactcgtacgactacggaccggcgatccctggtgcgggaagaagaagctcatctggctatgacgatggtgcctggaccccgagcccttcgttttcgagcaggcagcactcgggctcgggttcgggctcgagggaaagggaaagggactgggagagggagagggagagggagagggaaagggacagagagagggacaggcactactacagcaacaggaggtgaatggaatgcaaatttaccagcagttgaagaagcctttacctatctatcatgtcattgttggtatagtagacatttggctgtggtttataacaaacaaacaaaaaaacagcctctcagaatggatattagttagcacttgcaatctcactgtttaagcctctcatgtggatgttattttgtcaaggacagtagtaatgagcaaagaaagatcaaactngtnntacatgtgggcccttttaccatgttatcactgtttgttcatttggaaa

SEQ ID NO: 2995 - DNA, 1371 bp, Pseudoroegneria spicata
  misc_feature (1339)..(1342): n is a, c, g, or t
gggagcaccgcagctcgctgcgccacctgcggcacctcctctcctcgctctcctcccgcgtcatcctctccctcgtcccgcccgtctccgccttcaccgccttcgccgccgccgtcgccacctacaacacgctcgccccggactacgcgctcactgcctcctccctcccataccagctcacggcccccgccctcgcgctcctcctcgtcttccgcaccgaggcctcctacgcgcgcttcgacgagggccgcaaggcctggatgcgcgtcctcgccggcgccaccgagctcgccggcatggtcatgcattcctgcggcggcggtggtgaacgcggggacaacgagaccggcaggggcgccctcgtcaactacatcctcgccttccccgtcgcgctcaagtgtcatataaccagcaactccgacatcagaaaggaccttcagggcttactcgcagaggacgacctgaatgttatcatgagctcaaaacatcggcctcgttgcatcatcgagttcatttcgcagagtctccagatattggatttcgaggaacataagcggagcatcatggagtctaaactgtcttgtttccttgaaggaatttgtgtgtgcgagcagatcatcgggattcctgttcctctgtcatacactaggcttacttcgcggtttcttgtcctgtggcatcttacacttccaatcatactatgggcagaatgtaaatggatagtcgttccagctacttttgtcagtgctgcctccttattctgcatcgaggaagtgggggttctcatcgaggagccgttcccgatgctagccctcgacgcgcagtgccagcagctccacgacagcatgcgcgacatgatgtcggtgcaaggcctggtccgaaagcaactggttgccaagaccaagggccgcggcagaggcggtaggctcccgcagaacggttggcccgtctccagctccaggagcgagcaggtgaaggtcgactgattgagctggcggcaaatcattcaagaacagcggcagttggaagcaaccgtagtgtctgtctgcagtttgtgatgtgcagtcccacttccagatagatgctgctgctgttgcaacgaacaatagcttcccaggtccactgtgtgagagttaacacaagctggtccattgatttgctgtggctgagcagagttcctggattgagtgagtaagctcagtgaagcagtagaataaagtggtgaggatgtagtgtagtgtagccccggcctcacttgagtaggtaagtagtagaaatgaaactggatcctgtgccagccagagagatgtatagtagcttctcctccgaaaatgtaccnnnnctttgtatatagtcctggtgagctattta

SEQ ID NO: 2996 - DNA, 1233 bp, Triticum aestivum
atgcgcgtcctcgccggcgccaccgagctcgccggcatggtcatgcattcctgcggcgccggtgagcgcggggacaacgacaccggcaccggcgcgctcgtcaactacatcctcgccttccccgtcgcgctcaagtgtcatataaccagcaactccgacatcagaaaggaccttcagggcttgctcgcagaggacgacctgaatgttatcatgagctcaaaacaccggcctcgttgcatcatcgagttcatttcgcagagtctccagatgttggatttcgaggaacataagcggagcatcatggagtctaaactgtcttgtttccttgaaggaatttgtgtgtgcgagcagatcatcgggattcccgttcctctgtcgtacacgaggcttacttcgcggtttcttgtcctgtggcatcttacacttccaatcatactatgggcagaatgtaaatggatagtggttccagctacttttgtcagtgctgcctccttattctgcatcgaggaagtgggtgttctcatcgaggagccattcccgatgctagcgctcgacgcgcagtgccagcagctccacgacagcatgcgcgacatgatgtcggtgcaaggcctggtcagaaagcaactggtcgccaagaccaagggccacggcagaggcggtaggctcccgcagaacggctggcccgtctccagctccaggggcgagcaggtgaaggtcgactgatcgagctggctggcggcgaatcatgcacaaagcggcggttggaagcaaccgaagtgtctgtctggggtttctggtgtgcggtcccacttccaggtagatgatgctgctgttgcaacgaacagcagcttcccaggtccaccgtgtgagagttagcaccagatggtccattgatttggtgtggctgagcagggttcctgggttgagtgagctgagtgaagcagtagaataaagtggtgaggatgtagtgtagtgtagccccggcctcacttgagtaggcaagtaaggtgtaccactagcagcagcagcagcagcatctagtgcatgcatgtagtagaaatgaaactggatcctgtgccagccagagagatggtggcagcttctgttctcctctatgtaccccagctttgtatatagtcctggcgagctatttatttgtctgtaagagtacaattagagtactgatcatatgaatgcatatcggttgctatttatttgtctgtaaaaaaaaaa

SEQ ID NO: 2997 - DNA, 671 bp, Guizotia abyssinica
  misc_feature (657)..(657): n is a, c, g, or t
agctcatgaatagaaagcctttgtttgctggtaaagattatgtgcatcagatgagactattaacagagcttttaggcactccttctgcatctgatcttgggtttatcaagaatgaggatgcaataagatttattggtcagcttccctgacatccccggaaatcactgccaaagacatttccgcatgttcatccattagccattgatcttgttgagaaaatgttaacatttgatccagccaaacgtatcacagttgaagaagcactcgggcaccctatctcgaaagattgcatgacattgatgatgaaccaatctgttcaaatccattttcatttgattttgagcaacaagtctaaggagaagaacaaatcaaagacttgatcttccaggaggcattagcacacaatccagagtatgcttaaagaaaacataaaaccataaacctcaacttataccactcaatatatgcactaaataaaaatatgctaattttttccctatgcaactggaactgcaattatgttgtgtaactaattaatattcttgattttttttttggttcattgaagaagactgtcttctttaataacttttgtgttgtgggaatgagtttgtaaactatattataggatgttgtaatagtagaagtcttgaactnaaaaaaaaaaaaga

SEQ ID NO: 2998 - DNA, 538 bp, Tragopogon dubius
tgtctggtctgttggttgcatcttcatggagctcatgaacagaaagcctttgttccctggtaaagatcatgtgcatcaaatgcgactattaacagagcttttaggcacaccttctgaatctgatcttgggtttatcaagaacgaagatgcgagaagatatatctgtcagcttccacgtcatccccgcaaatcattactaaatactttcccacatgttcatccttcagccattgatcttgttgagaagatgttaacttttgatcctgccaaacgtatcacagttgaagaggcactagaacacccgtatctagaaagattacatgacgtggaagacgaaccaatttgtgaaaatccattctcatttgattttgagcaaaaagttttaggagaagaacagatcaaggagttgatctacgaagaggcattagcacacaatctggaccatgcttaaaagggtaaaatcgtacttagactttatatatgtactatttttttacagttatccgaaacttgcaaatctgttaattgcagtctctga

SEQ ID NO: 2999 - DNA, 655 bp, Zinnia violacea
aaaccttgttcgctggtaaagatcatgtacatcaaatgagactattaacagagcttttagggacgccttctgaatctgatgttgggtttatcaaaaacaaagacgcaataagatttatttctcagcttcctcgacatcccagaaaatcattaccgaaaacatttccacatgttcatccattagccattgatctagttgagaaaatgttaacatttgatccagccaaacgtataacagtggaagaggcgttggcgcacccgtatcttgaaagattgcatgacattgaagatgaaccgacgtgtccaaatccattttcatttgattttgagcaacaagttttaggtgaagaacagatcaaagacttgatataccaggaggcattagcacacaatccagagtatgcttaaataaaaaaaattacaaaaaaccatatattttaacttatgccactcaataaatgcactagaagaagaatagactcaattttttccatactcatcagaaatatgcaactcagttgcaattatgttgtataactaatcagtatttttttttaattttaagattttttttggcttatcgaaaaagtgactcttgttcgatatagcttttgtgttgctgtaacaagtagtactgtaagttttgagtcaagcaa

SEQ ID NO: 3000 - DNA, 1371 bp, Pennisetum glaucum
cgcagttacgctcacttcagctgaaaccggtcctccactcgtgcagagatgcaaaaagattgattctctgagggcaatcaatggggcgccgccatgcattccagtgtccgacaggtcaccgttggctcccgtaaccttgccagttttccaggatccaggcatgagaaacgacaacacaaggctgcgcatcttctcgggcacagccaacccttccctttcccaggagatagcaagttacttgggtctagaacttgggaagattaacataaaaaggttcgcagatggcgaaatatatgttcagttgcaagaaagtgtacggggctgtgatgttttccttgtgcaaccgacgtgtcctccagcaaacgaaaatctcatggaacttctgatcatgatcgatgcctgtaggagagcatctgctaagaatattactgcagtcatcccttattttggttatgcaagggccgacaggaagtctcaaggccgggaatctatagctgcaaagcttgtagctaatatgattacagaagctggtgctaaccgcgtccttgtttgtgatcttcattccagtcaagcaatgggatacttcgacatcccagtagatcatgtttatggtcagcctgtcattcttgattatctcgccagcaagacaatatgttcaaatgacttggtggttgtatctcctgatgttggaggtgttgccagggcacgtgcttttgccaaaaagctttcagatgcacctctagctatcgtagataaaagaaggcatggacacaatatcgctgaggtaatgaatcttattggagatgttaggggaaaggtagctgttatgatggatgatatgattgacacagcaggaactattgccaaaggagctgagctactgcatcaggaaggcgctcgagaagtatatgcttgctgtacacatgctgtttttagcccgcctgccattgaaaggttatcaagtggtttgtttcaagaagtaatcatcacaaacactatccctcttaaggaggagaagagttttccgcagctgaccattctctcagtcgcgaatctcttaggcgaaacaatctggcgtgttcatgacgactgctcggttggtcatgagccatactccagcttggatatcgactgatcctcaaggcgtcttactcacgctgcgcccttcatgcctaggaatagttgtggcagcttgcgatattcccccgcttctttctttgggccacggtttttgcctgtgtaataaactaataagcagctctatgttatgtggaattctgttagcaaagaagtcctcaaccatgtatttgaattgcagtacataagatggaattttggattgcagtgcagttttcaagctatcctcagcgc

SEQ ID NO: 3001 - DNA, 1572 bp, Fragaria vesca
gaaacaaagaaatataaattgctctcgtagactagactagagttggttggtaccaaattgacgggcgacgcctgtcttccctgcaactccacccccacatcaacactcctcaaaaccttccctaaaaccccaaaacacaaacccaagatggcctcactgctccactcaccgcctctctcctctcgcactctccttcctccatactcatctccctctccctcattcccaacacgcttcaggtgtagtgtgggggagcctctgaaatacgcgaatgggaagccgagcattcccctcctccgcagcgatgagatggtccctaatttcctcaccagacatgcgctcactacagctaccaaggatgacaccaggctccgcatattctccggtaccgctaatccgtccctctctcaggaaattgcatgctacatgggtcttgaacttggaaagattaagataaagcgctttgctgatggagagatatatgttcagttgcaagaaagtgtcagagggtgtgatgtatatctcgtgcaaccgacatgtcctcctgcaaatgagaatctaatggagcttctaataatgattgatgcatgtcgaagggcgtcagccaagaacattactgctgtgattccatattttggatatgccagggctgacagaaagactcaagggcgtgaatctattgctgccaaacttgttgcaaatttgatcaccgaagctggtgcaaatcgtgttcttgcgtgtgatcttcattccggtcaatcgatgggatactttgatattcctgtggatcatgtatatggtcagcctgtgatacttgattacctcgccagcaagactatctgttctgatgatttggtagtggtctcaccagatgttgggggtgttgctcgagcccgtgcttttgcaaaaaagttatctgatgctcctttggcaattgttgataaaaggcgtcatgggcacaatgtggcagaggtgatgaatttgataggtgacgtgaagggaaaagtagccgtcatggttgatgacatgattgatacagccgggactatttctaaaggtgcagaattactacatcaagagggggccagggaagtctatgcgtgcagtacacatgctgtttttagtcctcctgctatagagaggctgtcaagcggtttgttccaagaggtgatcataacaaatactattccagtatctgagcagaactattttccccagctaactgtcctgtcagttgcaaatcttctgggagagaccatatggcgtgtacatgatgactgttctggtggctttgaaccctattccaccttgggcattgattgatcaattcatgttcgccatctcccctccagcttccgttactgttgcagagctaccttcccagcgcatgtttgttaatagcaaaactaattttttcattgaggaacagcatagcttcattgtttgtttgatgttgggtgtttttttccctcaaaactatgcacaatctaaatttgatgtggtcaaaagtagtggtgtactatagtgtatcataaacagcacagttggtattctgattttccaatttcccta

SEQ ID NO: 3002 - DNA, 1733 bp, Gossypium hirsutum
ggttaaaataactttttcataaacgcacattaggaaatccatggcctaaattgaataaaattttccagttaaaatgaaaaggctcctcgaagaacaaaaatatccagttctggggtcgacaagtagttatgccaagcacatagcactagaacactcacaccagctcaactccacggttgaattattagtatagtacgaagaagatgagcatttgaatccctaaaccctaaaaatattttattagaaaaacaaaacaaataaaaagtgaatgaatggcgtcgtcgtctctgctttggctctgctcttccaatccactaatctcccccgctactcaccttaaggctcaccctcgcttccctatccggcaccgcttcaggtgtagcttggtggagcccttgaagttcgaaaatggaaagcctcactttcctctcctcacctctgatcctgcgtttccaaccttcttgtcccctaattcccatttccaaaacgatatcaacaaacacgatactaggctccgtatattttctggcactgctaatcctgctcttgctcaggaaatcgcatgctatatgggtctggagcttgggaaaatcaagataaagcgttttgctgatggtgagatttatgttcagttgcaagagagtgtgagagggtgcgacgtgttccttgtgcaacccacttgtccccctgccaatgagaatcttatggagcttctcattatgatcgatgcttgtcgaagggcttctgctaagaacattactgccgtcattccctattttggctatgccagggctgacagaaagactcaggggcgtgaatctattgctgctaaacttgtagcaaatttgattactgaagcaggtgcaaatcgtgttcttgcttgtgatcttcattcagggcaatccatgggttactttgatatcccagtagatcatgtttatgggcagcctgtgattcttgattatcttgccagcaagacaatatgttctgatgatttggtggtagtctcgccagatgttggtggtgttgctagagcacgtgcttttgcaaaaaaattatctgatgcacctcttgctattgttgataaaaggcgtcatgggcataatgttgcagaggtcatgaatttgataggtgatgtgaaaggaaaggttgcagttatggtggatgacatgattgacactgctggaacaatcgcaaaaggtgcagctcttttgcatcaagagggggctcgggaagtgtatgcgtgtagtacacatgctgtttttagtcctcctgcaatagaaagattgtcaagtggtcttttccaagaggtaatcataacaaacaccatcccagtgtcagagcaaaactattttcctcagttgactgtcctctctgtggcaaaccttctgggagagaccatatggcgtgttcatgatgattgctctggaggggtttgacccctatgcaaccttgggcattgattgatttctccacatgctatgagaattttgttatggaactgcagatcattatctatgctacattgggcagttaggtggtcttcttttattaacaaaagtttgttgaatgaatgtaatgcaacaattgaatgctattattttttatcttctcttctttgggttatatgtattctgtatatggttgtattttttttccatcaaatatatgggttaaatatgtaagaggttcctgcttcttcttcttcttaaaaagaaaaagtaccgactgcg

SEQ ID NO: 3003 - DNA, 1645 bp, Malus domestica
cgctaccaacagcagctgagaaacaaccaacaaacctcccacgctacccccactctttccctgaaaaccaactccctaaaaccctaaccctaactctctctctctctctctctctctctagaactgattgctacctccaactccaagaaatggcgtcgctgcttcacacagtgtccccgtcccctctcgcttctcgcaactctttacacactcgcgcttacatccccaacttctctcgctctcgagtcccggtcccaaacgccgtcaggtgtggtgtgggagagcctctcaagtatgcaaatggaaagccgtgcgttccactcctcaggagtgaagatttggtgccgactttttcggacacgaaaacacatttggtgaatgaaattagcaagaatgataccaggctcaggatcttttccggcactgcgaaccctgcgctgtctcaggaaattgcttgctgcatgggcctggaacttggaaggattaagatcaaacgctttgctgatggagagatatatgttcagttgcaagagagtgtaagggggtgtgatgtatatcttgtgcaacccacatgtcctcctgcaaatgaaaatcttatggagcttcttgtcatgattgatgcttgtcggagggcttcagccaagaatatcactgctgtgattccatattttggctatgccagggctgatagaaagactcaagggcgtgaatctattgcagccaaacttgttgcaaatttgattacagaagcaggtgcaaatcgtgttcttgcatgtgatcttcattctgggcagtctatgggatattttgatattcctgtggatcatgtatatggtcagcctgtgatacttgattatctcgccagcaagactatatactctgatgatttggtagtggtctcacccgatgttgggggtgttgctagagctcgtgccttcgcgaaaaaattatctgatgctcctttagccattgttgataaaagacgtcacgggcacaatgtggcggaggtgatgaatttgataggtgatgtcaagggaaaagtagcagttatggtggatgacatgattgacacagctgggaccattacaaaaggtgctgctttactacaccaagagggtgccagggaagtctatgcatgttgtacgcatgcggtttttagccctcctgctatagagaggctgtcgagcggtttgtttcaagaggtgatcataacaaacaccattccagtgtcggagcagaattattttccccagctaactgtcttgtcagtagcgaatcttctgggcgagaccatatggcgtgttcatgatgactgctctggtggctatgaaccctattccaccttgggcattgattgatcgaattcatggcggtgtgccctcccagcttctgttactgtcgtatagctagccacctcgtcggaaacaggattgtcaatagaaaaataaaggttttctagagagagacgcctgcttcagagattgttgtttcggaactttatacgaccgaaggttgatgattttgtgatagataatcagcattacaatgctgattatatatcactgtttgaccctgtaagttgccattttgttgggtaatcagtcatattccgcttaccttacatataatatactcgagtttctgc

SEQ ID NO: 3004 - DNA, 1334 bp, Manihot esculenta
atgctaagcttagcgggagctgctcctcccttctcaaggaaaatgagaagcgtctgaaaccataaccttgtgggtctggtctggtctgatcaattctctctctcgctcactcggcgctcgctttattaataacaatggcatctctgcttcacttatccaccacaatatccacttcttttcatcgttcttccagtttcttctccaaagagcctcgcttcccactcggacacggcgtcaggtgtaatctggtagagccgctcaagtttgagaatggtaaaccatgcatccaactcctcagtcctagcgaacaatcattcccaagttttttagcttccaaaagccatttgggaaacgctattcctagtagacatgacaccaggctccgcatcttctctggcactgccaatcctgcactctctcaggaaatcgcaagctatatgggtttggaacttggaaagattaaaataaagcggttcgctgatggtgagatttatgttcaattgcaagaaagtgtaagaggctgtgatgtttatcttgtgcaacctacgtgccctcctgcaaatgagaatctcatggagcttttgataatgattgatgcttgccggagggcatcagccaaaaatattactgcagtaattccatattttgggtatgccagagctgataggaagactcaagggcgagaatccattgcagccaaacttgttgcaaatttgatcacagaagcaggtgcaaaccgtgttcttgcttgtgatcttcattctgggcagtcaatgggctattttgatattcccgtggatcatgtgtatggtcagcctgtgatacttgattaccttgcaagcaagaccatatgttctgatgacttggtggtagtctcccctgatgttggtggtgtagcaagagcacgtgcttttgccaagaaattatcagatgcacctctagccattgtagataaaaggagacacgggcacaatgttgcagaggtgatgaatttgataggggatgtgaagggaaaagttgctgttatggttgatgacatgattgacacagctgggactatcactaaaggtgcagctttattgcatcaggagggagcaagggaggtctatgcatgcagtacacatgctgttttcagtcctcctgctatagagagattatcaagtggtctttttcaagaagtgatcataaccaacacaataccagtgtcggagcagaactacttccctcagctcactgtcttgtcagtggcaaatctcctgggcgagaccatatggcgcgttcatgatgactgctctggtggctttgaaccctgttcgagcttgggcattgactga

SEQ ID NO: 3005 - DNA, 1467 bp, Phaseolus coccineus
aagacttcgaaacgccatgtccactctgcaccttcactccgctcccactccttcaccttccttcgctccgatcacttcttctcgcttcttctaacctctcgcatctcgcttccaaacgccgtctgctgcaaggcgatagaagcagtgcagttggagaacgggaggccgagcgccagagagtttgccgccagaggaaacgcgattccgagctacgtcgaggcgccgaacgcgcggattcggaatttggttaaccggaacgacacgcgtctgaggatattctccggcaccgccaatcccgcgctttctcaggaaattgcgtgctacctgggtctggagctcggaaaaattaagataaagcgctttgctgatggtgagatatatgtccagctccaagagagtgtgagggggtgtgatgtgtttcttgtgcagcccacatgtcctcctgcaaatgagaatcttatggagcttctcataatgattgacgcttgcaggagagcttcagccaaaaatattactgctgtcattccgtattttggatatgccagagctgatagaaagactcaagggcgtgaatcaattgctgcaaagcttgtagcaaatttaattacagaagcgggtgcaaatcgtgtacttgcctgtgatcttcattctgggcaatcaatgggctattttgatattccagttgatcatgtgtatggacagcctgtcattcttgattaccttgccagcaaaactatttgctcagatgatttggtagttgtctcgccagatgttggtggggttgccagagcacgtgcttttgccaaaaagttatctgatgcccccttagctattgttgataaaaggcgtcatgggcataatgttgcagaggtgatgaatttgataggtgatgtaaggggaaaggtagcagttatggtagatgacatgattgatactgctgggactattgccaaaggtgcagctctgttgcatcaagaaggggcaagggaagtctatgcatgtaccacgcatgctgttttcagtcctcctgctatagagaggttatcaagcggtttgtttcaagaagttatcataactaacacaattccagtggcagaacagaactatttcccccaattaactgtactgtcggtggcaaaccttctgggcgagactgtatggcgagttcatgatgattgctcaggtggaattgaaccttattcaagtttgggcattgattgaacaatttgtatcattggtgtgcacgttccagcttatgacactgtggtaacaagcggcagaattgtaaagtcctattatagtgaaagctttatgtttaaggatacccttatagagagctgtttcttgagttttttgtacgtacaaaatacattataggtgtattggaaatccacactggaagtcgcatggcgtctttctttttcgttgagtacagatttttaagtaaaaaatggtgaattttacccc

SEQ ID NO: 3006 - DNA, 1577 bp, Quercus alba
aaaaaatgtcatctctgcttcatcactcttattgctcatcatcacctctcacttctcgttcctatttgaaactgaatttcttcccaagctctcgaatccctgcctcccaaaacggcgtcagatgtaatttggtggagccgttgaagttcgagaacggaaagccgtacactccatatctcagtagcagcactaccactgaccaagcaacagcaacaacgccttccatttcaaacgcaccgtattcggagaatgcacacgacaccaggctccgtatattttccggcaccgccaatcccgctctctctcaggaaatagcatgctacatgggtctggagcttggaaaaattaagattaaacgttttgctgatggcgagatatatgtccagttgcaagagagtgtcagagggtgtgatgtttatcttgtgcaacctacgtgtcctcctgcaaatgagaatcttatggagcttctgataatgattgatgcttgtcggagggcttcagccaaaaatattactgcagtgattccatatttcggatatgccagggctgatagaaagactcaagggcgtgaatcaattgcagccaaacttgtagcaaatttgattacggaagcaggtgcaaaccgtgttcttgcttgtgatcttcattcagggcagtccatgggctattttgatattccagtggatcacgtgtatggtcagcctgtgatacttgactacctcgccagcaaatatatatgttctgatgatttggtagtggtctcaccagatgttggcggtgtagccagagcccgtgcttttgccaaaaagttatctgatgcccctctagccattgtcgataaaaggcgtcatggacacaatgttgcagaggtgatgaatctgattggcgatgtgaagggaaaagtagcagttatggtggatgatatgattgacactgctgggactatttcaaaaggtgcagtgcttttacaccaagagggtgctagggaagtgtatgcatgcagtacacatgctgtttttagtcctcctgctatagagcggttgtcgagtggtttgtttcaagaggtgatcataacaaataccattccagtgtcagagcaaaactattttcctcaattgacaatcttgtcagtagcaaacctccttggggagaccatatggcgggttcatgacgactgctctggcggctttgaaccctattccagcttgggtattgactgagcaattttcatcggttgtacactctctttagttccattacggtatcatagttgccttgttggaaacagaaattaataatgaaatcaaaatgtattagccacataatccttggttttcagtcggttttttgtttaaagctttgtacacttgcaggatcatggaatagattcttttcaagagctccaattaaacgattctcagttccccctaatattttttatttcttttgagagagtgattgatgaaagtaaaaaaagaaagtatactcgaataatgacaattgatatatgatgtatatttcacctagtctggtttaaatttccataaagtaaatgtctaataatatacttcttgcct

SEQ ID NO: 3007 - DNA, 1467 bp, Vigna unguiculata
  misc_feature (100)..(101): n is a, c, g, or t
  misc_feature (103)..(103): n is a, c, g, or t
  misc_feature (142)..(142): n is a, c, g, or t
  misc_feature (417)..(417): n is a, c, g, or t
aacgccatgtccactccgtaccttcactccgctcccactccttccccttctttctctccgatcaccacttctcgcttcttccaaacctctcgcgtcgcgnncngaaacgccgtccgctgcaaggcgatagaagcagtgcagntggagaacggtaggccgagcgctagcgaggtcgctggcggaaacgcgattccgagctacgtcgtagcgccgaacgcgcggattcgggatttggttcaccggaacgacacgcgtctgagaatattctccggcaccgccaatcccgcgctttctcaggaaattgcgtgctacttgggtctggagcttggaaaaattaagataaagcgttttgctgatggcgagatatatgttcagctccaagagagtgtcagggggtgtgatgtgtttcttgtgcancccacatgtcctcctgcaaatgagaatcttatggagcttctcataatgattgacgcttgcagaagagcttcagccaaaaatattactgctgtcattccatattttggatatgccagagctgatagaaagactcaagggcgtgaatccattgctgcaaagcttgtagcaaatttaattacagaagcgggtgcaaatcgtgtacttgcttgtgatctccattctgggcagtccatgggttattttgatattccagttgatcatgtgtatggacagcctgtcatacttgattaccttgccagcaaaactatttgttcagacgatttggtagttgtctcaccagatgttggtggtgttgccagagcacgtgcttttgccaaaaaattatctgatgctcccttggctattgttgataaaaggcgtcatgggcataatgtagcagaggtgatgaatttgataggtgatgtcaggggaaaggtagcagttatggtagatgacatgattgatactgctgggactattgccaaaggtgcagctctgttgcatcaagaaggggcaagggaagtctatgcatgcactacgcatgctgttttcagtcctcctgctatagagaggttatcaagcggtttgtttcaagaagttatcataactaacacaattccagtggcagaacaaaactatttcccccaattaactgtcctgtcggtggcaaaccttctgggcgagactgtatggcgagttcatgatgattgctcaggtggaattgaaccttattcaagtttgggcattgattgaacaatttgtatcattggtatgcacgttccagcttatgacactgcggtaacaagcggcaaaattgtaaagttctattatagtgaaagctttatgtttacggatacccttatagagagctgtttatggagatttttgtacgtacaaaacatattataggtattggaaatccacactggaagtcgcgtggcttctttgtttttcgttttagtacagatttttaagtaaaaaatggtgaattttattcgactattggtatga

SEQ ID NO: 3008 - DNA, 1644 bp, Malus domestica
cgctaccaacagcagctgagaaacaaccaacaaacctcccacgctacccccactctttcccatggcgaccaactctctaaaaccctaaccctaacctctctctctctctctctctcactgattgctaactccaactccaagaaatggcgtcgctgctccacacagcgtcccggtcctctctcgcttctcgcgactctctacgccatcgcacttacctccccaactactctcgctctcaaatccccatcctgaattccgtgaggtgtggtgtgggagagcctctcaagtatgcaaatggaaagccgtgcgttccactcctcaggagtgaagatttggtgccgactttttcggacacgaaaacacatttggtgaatgaaattagcaagaatgataccaggctcaggatcttttccggcactgcgaaccctgcgctgtctcaggaaattgcttgctgcatgggcctggaacttggaaggattaagatcaaacgctttgctgatggagagatatatgttcagttgcaagagagtgtaagggggtgtgatgtatatcttgtgcaacccacatgtcctcctgcaaatgaaaatcttatggagcttcttgtcatgattgatgcttgtcggagggcttcagccaagaatatcactgctgtgattccatattttggctatgccagggctgatagaaagactcaagggcgtgaatctattgcagccaaacttgttgcaaatttgattacagaagcaggtgcaaatcgtgttcttgcatgtgatcttcattctgggcagtctatgggatattttgatattcctgtggatcatgtatatggtcagcctgtgatacttgattatctcgccagcaagactatatactctgatgatttggtagtggtctcacccgatgttgggggtgttgctagagctcgtgcattcgcaaaaaaattatctgatgctcctttagccattgttgataaaagacgtcacgggcacaatgtggcagaggtgatgaatttgataggtgatgtcaagggaaaagtagcagttatggtggatgacatgattgacacagctgggaccattacaaaaggtgctgctttactacaccaagagggtgccagggaagtctatgcatgttgtacgcatgcggtttttagccctcctgctatagagaggctgtcgagcggtttgtttcaagaggtgatcataacaaacaccattccagtgtcggagcagaattattttccccagctaactgtcttgtcagtagcgaatcttctgggcgagaccatatggcgtgttcatgatgactgctctggtggctatgaaccctattccaccttgggcattgattgatcgaattcatggcggtgtgccctcccagcttctgttactgtcgtatagctagccacctcgtcggaaacaggattgtcaatagaaaaataaaggttttctagagagagacgcctgcttcagagattgttgtttcggaactttatacgaccgaaggttgatgattttgtgatagataatcagcattgttgttgttgttgttgtatgatatcactgtttgaccctgtaagttgccattttgttgggtaatcagtcatattccgcttaccttacatataatatactcgagtttctg

SEQ ID NO: 3009 - DNA, 1533 bp, Triphysaria pusilla
gggaacccacgcctgtggaagaaactgagctgattaacttcgtagcagaggaaaaatggcgtctctggccgtgtccagaagctggctaacaaatcccctcaagacctatcatcatgccactccaaatatcacaccaatcactctatgtaacaatatgtctttggagacattgaaggggaaggaaaatgggagaccgataaccgctagccgtgattatagcagacaagcgactgccgcttttcccagcttcctgaccagtcccaaccaaatcttagacgggatttcaatcccccaaaactgcactcgtcttcgtatcttctccggcactgccaatccttctctatctcaggaaattgcttgttatatgggtctggagcttggtaagattaagataaaacgttttgctgatggggaaatttacgttcagttacaagagagtgttcgagggtgtgatgtgtaccttgtgcaacctacatgtcctccagcaaacgaaaaccttatggagctcttgataatgattgatgcttgccgtcgggcatcagccaaaaatattactgctgttattccttattttgggtatgcacgggccgatcggaagactcaagggcgtgaatcaattgccgccaaacttgtggcaaacttgattacagaagcaggtgctgacagggttctagcatgtgacctccattctgggcagtccatgggatattttgacattccagtggaccacgtgcatggccaacctgtcatacttgattaccttgccagtaagacgatcagaacagatgatttggtagtggtgtcacctgatgtgggtggggttgctagagcaagggcttttgccaaaaagttatccgatgctcctctggccattgtggataaaaggcgtcatggccataatgttgccgaggtaatgaatttgattggcgatgttcggggtaaagtggcagtgatggtggacgacatgattgatactgctggaactattgcgaaaggggctgctctattacatcaagaaggggctagagaggtttatgcttgcagcacacatgctgttttcagtcctccagcaatagagagattgtcaagtggactatttcaagaagttatcataacaaacacaattccagtggcagagcacaactactttccacagcttactatcttatctgtcgctaaccttttaggcgaaactatatggcgcgtgcatgatgattgtgctggtgggtttgaaccttattcaagcttgggcatagactaatgaatttctctattatcgtggcaactcactacttttagttgcagttttgcaaaacactcgaaatggaagtcttatggattgaaatttccatcaaccccaactgttatccttgtagaaatttgttacgctacaggaaaaaaaaattgtttcctcttagggcacgtttggttggtggaagaaaaatgttaacggaatgaagtatagggggaatgaaacaaatatttttaccaaccacgttttatttattttaaattaatgaatggagtgattac

SEQ ID NO: 3010 - DNA, 1658 bp, Populus trichocarpa
acgcatatacacctggaaagaaagagaggaaaaaaagaaagaaaaaaagaaggcttccgcaaataatggcatcactgcttcagtgtcctacttcaccatttccttcttctttctcctccaacaacccccgctcccccttcctccgctttcacttccctctccgtcacgccgtcaggtgtaatctggtggagcccatcaagtttgccaacggcaagccttacatcccgctcctcaacacctcggctcatcatttatcctccactgccacttcccatttagataacactcttccacctttcaacaaacatgacaccaggctccgcattttctctggcactgctaatcctgctctctctcaggaaattgcttgctacatgggtttggagcttggcaagattaaaattaagcgttttgcggacggggagatttatgtccaattgcaagaaagtgtcagaggctgtgatgtttttcttgtccaacccacctgtcctcctgccaatgagaacctcatggagctgctgattatgattgatgcttgtcgcagggcgtctgctaagaatattactgctgttattccttatttcggctacgccagggccgatagaaagactcaagggcgagaatctattgctgccaagcttgttgcgaatttgattactgaagcaggtgcaaatcgtgttcttgcctgtgatcttcattccgggcagtccatggggtattttgacattcctgtggatcatgtgtatggtcagcctgtgatactcgattaccttgctagcaagactatatgttctgatgacttggtggtggtctcccctgacgttggaggtgtagcaagagctcgtgcttttgccaagaaattatcagatgcacctctagccattgttgataaaagacgtcatggacacaatgttgcagaggtgatgaatttgattggtgatgtgaaggggaaagttgcagttatggtagatgacatgattgacacagctggaactattaccaaaggtgcagctctattacatcaagagggggcaagggaggtctatgcatgcacgacacatgctgttttcagccctcctgccattgagaggttatcgagtggtctttttcaagaggttatcataacaaacacgattccagtgtcagagcagaactattttccccagctcacagtcttgtcagtagcaaacctcttgggcgagaccatatggcgtgtccatgatgactgctctggtggcattgaaccctattccagcttgggcattgattgatcaatttacatggtgtgtctcccagcttgaactactgccaaatttagattcgtcctcgggaagtgttactggattgtagaaaactcaaacaactttacgtttagagaagtcatatctttagttttgtatggaggacatggggttgattggcagatttttggtagcttgaattagattccttgtttaggttttttcaatgtttcttatactcctgaatgttttgactcccgaatgttttgatgagagacttttggaagagttttctgctttataaatgatgtatgcataaaggtatatcaatgttgagttgatttcgtatcaatggaagctccagctccaccattgttatctatatttaacatggattggtttcttgctcggggaaaa

SEQ ID NO: 3011 - DNA, 2309 bp, Eucalyptus grandis
attttcacaatatttctgaccaaaagcgccacatcccctccaacgctactgcaaaactcgcaaaccctctccccctcccctgctcctcctccctcctccgcctccggcggctctcgagctcgaaagcttccggctttccggcgccgcctcaaccgccctcccctttccgtccgacccttttgatcccggttactttcatggcctctttaatctgctcgcccttgaagtcttctctctcctgcggctcctccgtccggttcccctgtttctcctccagcgagcccgcctctcgcttgctggtccacaatggcatcaggtgtaatttggtggaaccgctgaagctccataatggcaaaccctgccttccggtcatcaacaacgagggctcgctaccgagttttttgacttcgacgcatccccaaaactcgatcaacaagaatgacacacggctccggatattttccggcactgcgaaccctgctctttctcaggaaatagcttgctatatggggttagagcttggaaagataaagataaagcgatttgctgatggagaaatctacgttcaattgcaagagagtgtcagaggatgtgatgtgtttctagtgcagcctacttgtcctcctgccaatgagaatctcatggagcttctgataatgattgatgcttgtcggagggcatcagcaaagaacattactgcagtgattccttactttggatatgcaagggctgatagaaagactcaagggcgcgaatccattgcagcaaagcttgttgcaaatttgattacggaagcaggtgcaaatcgtgttttggcttgtgatctgcattctggccaatccatgggctattttgatatcccagtggatcatgtgtatggtcagcctgtcattcttgattatcttgccagtaagaccatctgctcagatgatttggttgtggtctcgcctgacgttggtggagtagctagagctcgtgcctttgcaaaaaaattatctgatgcaccgcttgccattgtggataaaaggcgtcaagctcataatgttgcagaggtgatgaatttgattggtgatgtcaaggggaaggtggcagttatggtggatgacatgatagatacagcagggactattgccaaaggcgcagctctgttgcatcaagagggagccagagaagtttatgcatgcactacacatgctgttttcagtcctccagcaattgagagattgtcaagtggtttatttcaagaagtgatcataaccaacaccatcccagtgtctgaacagaactattttcctcagttgacagtattgtctgtggcaaaccttttgggggagacaatatggcgtgttcatgatgactgctccgtgagtagcatcttccagtagtactgattcataaaaataaataaaattaaaatagctcttttttcctttctccacctttgggatatgccatgtggctttttggctattcttaatttagtcgacagtgcattcttagaggcttgggagttgggatcatcatattaggcataaacatagcataagaaatccgaaacggtgaagcaatggaattgtgacatgggaaggggagtcatcaaagctaagagccattttcttttcaatcgatctgtttaattttagtagttgaatgtagaccctgctcaatgtcgtccttgccacctttttttgtttcctccttgccgctgttgatatagattgtttctcattttggttttaaacaagcattaatcggatacagatgtatttggggtaggagagcttttcatactttcagcaaatcacttttaaaggcaatgattctaagatcagactctctatgcggtttttcctgattgtcagggtggctatgaaccctattccagcttgggcattgattgatcatatttcatcagtggtcgtcttgtttcaagcttcattactgccatttattaccatcttcaaactggataatgtgggacaagacaaaactaggattgctaagctgttctactgcgaaatcaattgatttttaagttgtaatagggaaatctatggtattttggggtggttggtaagcgtcaattttggttagatgagatctgatctcgtggattttgcggagagctcatatgctcttatctagtacatatagttggcatgtactgactcgaatatgtcacacgatgactgagatgtaattcttctatatttaagtgtatgttgaatggatctgagaactgcttgtttgttgaaatgttcagttcctctcagacatatttgtcttagttgctgagatttttgctcctt

SEQ ID NO: 3012 - DNA, 1569 bp, Prunus persica
aaatgacttcgctgcttcacccagcttcgccattctctctcgcttctcgcgaatctctacgcactcgcacttttctccctaaccgttcttgctctcgaatcgcagccccaaacggcgtgaggtgtaatgtgggagatcctttgaaatatgcaaatggtaagccatcaactccactattgaagactgaagaaatggcgcccaactttttggccacggaaacgcatttggtgaatgcaactaccaagaacgatacaagactcaggatattttccggcactgcaaaccctgcgctttctcaggaaattgcttgcaacatgggtctggaacttggaaagattaagataaaacgctttgctgatggagagatatatgttcagttgcaagaaagtgtgagagggtgtgatgtatatcttgtgcaacccacatgccctcctgcaaatgaaaaccttatggagcttctgataatgattgatgcctgtcggagggcgtcagccaagaatattaccgctgtgattccatattttggatatgccagggctgatagaaagactcaagggcgtgaatctattgcagccaaacttgttgcaaatttaattacagaagcaggtgcaaatcgtgttcttgcatgtgatcttcattctgggcagtctatgggatattttgatattcctgtggatcatgtatatggccagcctgtgatccttgattacctcgccagcaagactatatgctctgatgatttggtagtggtctcacctgatgttgggggtgttgctagagctcgtgcgtttgcaaaaaaattatctgatgctcctctagccattgttgataaaagacgccatgggcacaatgtggcagaggtgatgaatttgataggtgacgtgaagggaaaagtagcagttatggtggatgacatgattgacacagctgggactatcacgaagggtgcagctttactacatcaagagggcgccagggaagtctatgcatgcagtacacatgcggtttttagccctcctgctatagagaggctgtctagtggtttgtttcaagaggtgatcataacaaataccattccagtgtcagagcagaattattttccccagctaactgtcttgtcagtagcaaatcttctgggcgagaccatatggcgtgttcatgatgactgctctggtgtccttgaacccttttccaccttgggcattgattgatcaaattcatgtcggcggtgcgcttcccagcttctgttagactgttactgccaaatagctaccttgtcggaaacaagattgtcaatagaaaaataaaagaattttttttccagatagaggccctgctttataggttgttgtttcgaaactttgtacaatcggaggttgattggaagatacttatcagcacttgaattgaaccccacctagggcatcattgaatcgcatttcccttttttctccctttagaggaaaatggttggtgaactatattacataatcagcattgttgtatgatatcaccgttttgtccttgtaagctcccattttgtcaagtaatcaatcatattattgcttg

SEQ ID NO: 3013 - DNA, 1338 bp, Tripterygium wilfordii
tcaggcatccagctcggcattcacttgttttcccacaagtcttttctcgaaagatcatttctttcgctttcgacaacactcacacccactcgtcgtcaggtgttgtaatttggtggagccactcaagtttgagaatggaaagccacagctacctcttcttgattctcaaccagcgtttccaagtttcttgctttcatctacccatttacacagttctgaaaacaagcatgacacaagactccgcatcttctctggcactgcaaatcttgctctttcccaggaaattgcctgctacatgggcctggaacttggaaaaattaagataaaacgttttgcggatggtgagatttatgttcagttgcaagaaagtgttagggggtgtgatgtgtatcttgtgcaacccacatgcccacctgcaaatgagaatcttatggagcttctgataatgattgatgcctgtaggcgggcatcagccaagactataactgcagtaattccgtattttgggtatgctagggctgataggaagactcaggggcgtgaatcaattgctgccaaacttgtggcaaatttgattactgaagcaggtgcaaaccgtgttcttgcttgcgatcttcattctgggcagtccatgggttattttgatatcccagtggatcatgtgtatggtcagcctgtgatacttgattaccttgccagcaagactatatgctctgacgatttggtagtggtctcacctgatgttggaggtgttgctagagcacgtgcttttgccaaaaaactatctgatgcacctttagctattgtggataaaagacgtcatgtgcacaatgttgcagaggtaatgaatttgattggtgatgtgaaaggtaaagttgctgtcatggtggatgacatgattgacacagctgggactattgccaaaggtgcagctctattacaccaagagggggccagggaagtctatgcatgtactacccatgctgttttcagtcctcctgcaatagagaggttgtcaagcggtctgtttcaagaagtgatcataacaaacaccatccctgtgtcagagaagaactattttccacagctgacagtcttatcagtagcaaacctccttggcgagaccatatggcgcattcatgatgactgctcgggtgggtttgaaccctattcaagcttgggcatcgactgaccatatccgcatcaacagatttccctcccagctttccttacagccgttcagaaacagaattttccatataaaagttgagatcttatgtagataaatgcaaattgtttgttgtcaatggttgttaaccgtcaaccaattataagttg

SEQ ID NO: 3014 - DNA, 2620 bp, Triticum aestivum
ggggaccgggacttgtatggctactcgtggttccccgccaccgtggccaaggtcattgataggctgagttacctcgtggagtactccgatctggaggaagaggtgggtggggggaaggccatggagtacctgcattgcctcttcatcagaccagacgtggagcactctccgcgggagagcgagttccgcctcggtcctggtgccgcagtggaggtgtactgtgacggcgcttggtcaccaggggtggtgcaaagggctgttggcgagggtgagtacgaggttagcattgacggaaaggagggagagctgttgctgaagaaggtgccagagttgctcaagcctcaatacaagtggaatggcaagcattggaggattgtaagtcctaagagacaaggtaataggcggcagtctgtatctggaaaacgtccaagctcagctgttgaggtggcatccaatgatgatgaaaatagccatcatacacaatctccagccacaaaaaggtcaaggatagaactgccacgaaaaaaacttgaagagttaactgaaggttctgaacatgtgttggagtccgagatggacactagtttatctgcactacgcaagtcactagcaagcaatttttctccaaaaacctgttctccgcgatctagaaaaaataactttcaagcgatttcacgaaggatagtggattcttgtacagtgccgatgaaggggcttggggtttatcatgcttcctcagaaaatccaacacctcagaatgaatcaagagcagatggtattgtggaagttgttgttcaagaagccccgctcgacatgatgctttcaaatggtcagcttaattcacctgtctgtggaacaattgctgatgaagcccatgatatgcttttgactgcaggattaagaaaacagaaaatggattcctcttgcataaataatgctgtccagaaaccacaggaaagcccgcttgatgtccagccactccaggtaaagaaatttagtgccaagcataaaggtggggaaaaagcggggaaacacaccctattcaagcacttgagggaaacagtgacacttttgattacattcagttgaaaggtaacagcaatagctcttgtaaggaaattatttgtgctttgactgcttcgacgtgcaatgccccttcacccctggataagcagatgagagcacgtgatgcagtgtcaagaggggctgatagtagctcaaacacaaaggtttttgcctccaagaaatcagctgaaaagaaaggcttcaaaggtttgtctaacccagatagctcagggcatggaactaggactgtccagaagagaagtgcaaagaaagtggcagggcgacagaaagaatgcttcgtggaaagacaagtggacagcagaggacctcatactcatcagcagcagcagctcaacagggaggaaaaagttaacgtaaatgacggaacaaatcaggaactgtttcctttaatacccccaggcttcaaatcaatctgtaacgggcaaggtttaccacccccaggcttcaaatcaatctgtaacgggcaaggtttactcgatggggaaaaagtggatgagagaccaaatcaactacatattcaggatgctgggagctcacagtgcaccatggaaaacactgcattaaggagctgctcagctgttgggacttctctgcacccaccttttctttcatgtcagatctctggtgagcgttttccgttcatcaagacctcatccatatggcatcaaattgaaccaatggaagtgtttcggaaggtaccacaggaaccccatttccttccacttcagcaatttatgccggaactgcgtgaaggaatggctataggtctaatggtgacatatgccagcttagttgaaagtgtcaagcgatcatgcatagaagataatattgagttatttgaaagaaagatcaacgcacttgcccatttagaggaaaatggatttgatgttaagttgctgcagcacagtctgatgaaattgcttgaggccaaatgggagcacaccaagcatcttggacatctggacgagttgaaagaattggtaccgcggaaggagtctgccatgtctcataagcatgcattacttgttgaaaaggaaggagctatatttcaacttgagcagaaacttgagtgccttcgtggtgaagcagagcagattgcaagggagacaaaagatgaagatgcagagctcttgaggctgaaagagggagttaacatagctcaggaagcatgtgttaatgttgaagtgcggtttcacgacattctagccgacatgcgttcgagactgcagctttctgagtgatacgatgttcagaaatcatttcggtctcccaacttaattgttcccgtagcttatgctcccgtgtgttgcaccttttatctaggattatcaccaaactttgatgagggttccaattgtcattcgacaccttttatgcatgtagcagatgtatggatcttcaactctgtcaagtttagacccatttttctatgctagttggacgatatttatggctgtgtaaactggttgtctcgtgttgtcattcattccccgaatcctgtgatgactgctatgcagtgggtcaatctgaaaac

SEQ ID NO: 3015 - DNA, 2623 bp, Triticum aestivum
  misc_feature (570)..(570): n is a, c, g, or t
  misc_feature (1033)..(1033): n is a, c, g, or t
  misc_feature (1279)..(1279): n is a, c, g, or t
  misc_feature (1518)..(1518): n is a, c, g, or t
  misc_feature (1544)..(1544): n is a, c, g, or t
  misc_feature (1546)..(1546): n is a, c, g, or t
  misc_feature (1616)..(1616): n is a, c, g, or t
  misc_feature (1651)..(1651): n is a, c, g, or t
  misc_feature (2563)..(2563): n is a, c, g, or t
ggggaccgggacttgtatggctactcgtggttccccgccaccgtggccaaggtcattgataggctgagttacctcgtggagtactccgatctggaggaagaggtgggtggggggaaggccatggagtacctgcattgcctcttcatcagaccagacgtggagcactctccgcgggagagcgagttccgcctcggtcctggtgccgcagtggaggtgtactgtgacggcgcttggtcaccaggggtggtgcaaagggctgttggcgagggtgagtacgaggttagcattgacggaaaggagggagagctgttgctgaagaaggtgccagagttgctcaagcctcaatacaagtggaatggcaagcattggaggattgtaagtcctaagagacaaggtaataggcggcagtctgtatctggaaaacgtccaagctcagctgttgaggtggcatccaatgatgatgaaaatagccatcatacacaatctccagccacaaaaaggtcaaggatagaactgccacgaaaaaaacttgaagagttaactgaaggttctgaacatgtgttggagtcngagatggacactagtttatctgcactacgcaagtcactagcaagcaatttttctccaaaaacctgttctccgcgatctagaaaaaataactttcaagcgatttcacgaaggatagtggattcttgtacagtgccgatgaaggggcttggggtttatcatgcttcctcagaaaatccaacacctcagaatgaatcaagagcagatggtattgtggaagttgttgttcaagaagccccgctcgacatgatgctttcaaatggtcagcttaattcacctgtctgtggaacaattgctgatgaagcccatgatatgcttttgactgcaggattaagaaaacagaaaatggattcctcttgcataaataatgctgtccagaaaccacaggaaagcccgcttgatgtccagccactccaggtaaagaaatttagtgccaagcataaagtggggaaaaagcggggaaacncaccctattcaagcacttgagggaaacagtgacacttttgattacattcagttgaaaggtaacagcaatagctcttgtaaggaaattatttgtgctttgactgcttcgacgtgcaatgccccttcacccctggataagcagatgagagcacgtgatgcagtgtcaagaggggctgatagtagctcaaacacaaaggtttttgcctccaagaaatcagctgaaaagaaaggcttcaaaggtttgtcnaacccagatagctcagggcatggaactaggactgtccagaagagaagtgcaaagaaagtggcagggcgacagaaagaatgcttcgtggaaagacaagtggacagcagaggacctcatactcatcagcagcagcagctcaacagggaggaaaaagttaacgtaaatgacggaacaaatcaggaactgtttcctttaatacccccaggcttcaaatcaatctgtaacgggcaaggtttacnacccccaggcttcaaatcaatctgtnangggcaaggtttactcgatggggaaaaagtggatgagagaccaaatcaactacatattcaggatgctgggngctcacagtgcaccatggaaaacactgcattaagnagctgctcagctgttgggacttctctgcacccaccttttctttcatgtcagatctctggtgagcgttttccgttcatcaagacctcatccatatggcatcaaattgaaccaatggaagtgtttcggaaggtaccacaggaaccccatttccttccacttcagcaatttatgccggaactgcgtgaaggaatggctataggtctaatggtgacatatgccagcttagttgaaagtgtcaagcgatcatgcatagaagataatattgagttatttgaaagaaagatcaacgcacttgcccatttagaggaaaatggatttgatgttaagttgctgcagcacagtctgatgaaattacttgaggccaaatgggagcacaccaagcatcttggacatctggacgagttgaaagaattggtaccacggaaggagtctgccatgtcccacaagcatgcattacttgttgaaaaggaaggagctatatttcagcttgagcagaaacttttgtgccttcgtggtgaagcagagcagattgcaaaggagacaaaagatgaagatgcagagctcttgaggctgaaagagggagttaacatagctcaggaagcatgtgttaatgttgaagtgcggtttcatgacatcctagccgatatgcgttcgagactgcagctttccgagtgatacgatattcagaaatcatttcagtctcccaacttaattgttcccgtagcttatgctcccgtgagttgcaccttttatctaggattatcaccaaacttggatgagggttccaattgtcattcgacaccttttatgcaagcagcagatgtatggatcttcaactctgtcaagtttagacccatttttctatgctagttggacgatatttatggctgtgtaaactggttgtctcgtgtngtcattcattccccgaatcctgttgatgaactgctatgcagtgggtcaatctgaaaacat

SEQ ID NO: 3016 - DNA, 2082 bp, Zea mays
agcattttgtttttttcagaataatgatgattcatgccttgcctatgtattaggagccatttctaatctattatcaaagataggcatctcaaacacagttggaataatcagttctccatattcacttgggaccaatattggactaggcacaccattatccattcagcaacagttacttgttcttttaaagcgatcactcaagagagctgatgcattgaaacttccaagtttactatcctttgatcacctttcgcttgcaaaatttgatctgaagcatgtccaaaggccactagtctctttcggccctaatgcatctacaaagcttagaacatgtcctgcagatgtctgtaagaatctaaggttaggttcccgtgtgttgactgactttggagcagatgttctatctacttcaaatgataatggtagttttagcacttcttggcttaggaatctatccgccacttctgattcatggcgtagcagttcaaagaacaccaaaaaaatacatattaatgacttcgacaatttccattatcatgcacaaccaagtccagtacctgcatcaatattgcaattagctggctcagcatatttgctgagagctaccgcttgggagcactatgggagtgctccaatggtacgaatgaatgttctagtttatgcaacctgctttgcggatgctgcaagttcatcagagttatcactagcatatgttaagctaattcaacaactggcggtgttcaaaggatattcagctgcattctgtgctctaaagcttgctgaaaagaagttcccatcctcaacaagtttacacatccagcttctaggaatgcagattctacatgagcgcgcacttcatcgagggcatctaaaagtcgcgcaacaaatctgtgatgagtttggggtgttatcatcttctgtttctggagtagacattgagctaaagacagaatttagtgtacggcgtgctcgcactctccttgccgcaaaacagtttagccaggccgcagctgtggccaattctcttttctctacgtgctacaagtacaacatgcaggttgagaatgcaagtgttcttttattacttgctgaaatacataaaaaatctgacaatgcggtacttgggcttccttatgcgttggccagccaatcattctgcaaatcattcaacttggatctgcttgaagcctcagctacacttactctcgctgagttgtggctggatcttggatcaagccatgcaaagaaggcactgagtcttgtctaccagagccttcccatgattcttggtcatggtgggcttgagctgcgtgctcgagctcacgttgttttagcaaagtgccatttatccgatctgaaattctcagttctcgaagatcctgaagctgttttggatcctctgaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaccccgcataacgaagaggactcgcttaagtactgagacccaagaccatttgttattggcaagcatgccccactgccagagactaaagagggcgtggtggccttctggacccgcatggtggcactggcaggctacaatgctacactgaggcgaatggcgtttgctgccatgcggaggcactgccactgactgtgggcggaccggcggacggcggtgactgaaggagacgggcagccggtgaggtcaatgtgctagttgggtcagcgtggtatggtctcatccatggaccatggtgttcattagagcgagacgaagacatcagattgagacttgatgttcttactctgttcttatcgacttctctgctctgttactggggagttccgaattgctaactcagacagacagtgctgacaatgtgtttgtgtttgaatgtaaacagaacaagaacagaaaaatagaagattgatctgtattttcccttgactgatgctggatatttatagatggtgaatacacactaagaa

SEQ ID NO: 3017 - DNA, 1734 bp, Panicum virgatum
atcagttcgccatattacactcgggaccaatattggactgggcacaccattatcaattcagcaacagttacttgttcttttaaagagatcactcaagagagctgatatattgaaacttgctagcttactatcctttgatcacctttctctggcaaaattcgacctgaagcatgtccaaaggccactagtctcctttggtcccaatgcatctacaaagctcagaacatgtcctgcagatgtctgtaagaatttgagattaagtacccgtgtgttgactgactttggaacagatgctttatctacctcaaatgataatggtagttttagcacttcgtggcttaggaatctgtctgctgcttctgactcatggcatagcagttctatgaaatctacaaagttacataatgactttgacaatttccattatcatgcacaaccaagtctggtacctgcaccagtattgcaattagctggctcgggatatttgttgagagccaccgcatgggagcactatgggagtgctccgatggtacgaatgaatgctctggtctatgcaacttgctttgctgatgctgcaagttcatcagagttgtcactagcttatgtcaagctaattcaacaattggcagtgttcaaaggatattctgctgcattttgtgctctaaagcttgctgaaaagaagttcccatcctcaacaagtttgcacatccagcttcttagaatgcagatactacatgagcgtgcacttcatcgagggcatctaaaagttgcacagcaaatctgtgatgagtttggggtgttgtcatcttctgtctctggagtagacatcgagctaaagatagaagctagtgtacgacgtgcacgcactctacttgctgcaaagcagtatagccaggctgcagctgtggccaattctcttttctctacgtgctacaagtacaatatgcaagttgagaatgcaagtgttcttttattacttgctgaaatacatagaaaatctgacaatgctgtccttgggctcccttatgcattagccacccaatcattctgcaaatcattcaacctggatcttcttgaggcctcagccacacttactcttgctgagttgtggctggctcttggatcaagccacgcaaagagggccttgagtcttgcccaccagagccttcccatgattcttggtcatggtgggcttgagctgtgtgctagagctcacattgttttagcaaagtgccatttatctgatccggaattctcagtttttgaaaaacctgaagctgtcctggatcctttgaaccaagccacccaagatctgcaagttttggagtaccgtgagatggcagcagaggcatactatctgaaggcaatggcatacaaccatctcggcaagctcgacgagagggaggaagccgcgggttgtttcaaggagcacatcactgccctcgaaaacccgcacaacgaagaggactcgcttgcgtactgagattgcatgaccagcggcttccgcggcaataccatgtcgtggtaggaaggcgcacccgtggacgggtggtatcctcgccttgtgaaaagtctgactgttgtatattgtaaaatcgatgcgtctgttgtaaaatggactccctgatcggccatgttcttgaggcattgttgcagagcattttacacatgatacatgagactctccaatatgaagttgaaacaaaatggatgagagccaaactgaacttcact

SEQ ID NO: 3018 - DNA, 1577 bp, Triticum aestivum
agttttggatgttggatgcggtgttgccagcttctctgcttatcttcttcccctagatattcatactatgtcattcgcaccaaaagatggccatgagaatcaaatccagtttgctttagagcgtgggattggtgcaatgatctctgtgttggccacaaagcaattaccgtatcctggaaattcatttgaaatggttcattgctcccgatgtcgtgttgactggcatgaaaatgatggaatattgctcaaagaggtcgatcgtcttttgcgacctaatggatattttgtatattctgctccaccagcttatagaaaagataaagatttccctattatttgggagaggctaattaatatcacatcagcaatgtgttggaagcttattgctaagcatgttcagactgctatatggatcaaacctgaagatgaatcttgccgacagaaaaattctgatacggggatcctgaatatctgtgaccccagtgacacttcttcatggcaagctccattaatgaactgtattcggttgaacacggaccaatcaaaaattcagaaactgccttccagacctgaacgcctgttattttattcgaggagtttggaaataataggagttactccagagaagtttgagaataataaccagttctggcgggaccaggttcgcaagtactggtcatttcttggtgttgaaaagactagcatacggaatatcatggacatgaatgctaattatggtggatttgctatggcactaagcactgaccctgtctggattatgaatatagtaccctatacaaccatcaacacactgcctgctatctatgaccgggggttaattggttcctaccatgactggtgtcagccattctcaacatatcctaggtcatatgatttgctacatgctttccacctcttttcacattatcaaggtcatgtaggaggttgcttattggaagatatcatgctagaaatagatcgcatcattcgtccacagggttttatcattatcagagatgagaataccactctctcaagaatcagtgatctcgcaccaaagttcctatgggatgtcaccactcacacgttggaaaatgaggaaaacaggccggagcaggtgttgatttgtaggaagaaattctgggctatagtttgactggtgcttgtgcctgaagattttatttatgtcctatctcaccatcctgtatcttgctgacacaacatgagaaagattttcgggtgtacaaaaaaggtttcaagatgttcctccagtatgcacaagacattttgtcgcggattctttccagctgaggtcaccgcatcacagaaaaaaaacagaggacatgactgagatttccttcaggaaatcttcagcctgcttttcagtgcttgtgatttaatgccaacttcttatctcagaatgacgaatcggcaggtgtaggacaagataaccaatgactgttctagattttcatgtaatttgctaattttgtaaactagtttagtttagctttttcctcttcttctggagaaccttggttacgacatacagttatgcagcaaatgatgaggcatag

SEQ ID NO: 3019 - DNA, 1591 bp, Triticum aestivum
  misc_feature (469)..(469): n is a, c, g, or t
  misc_feature (503)..(503): n is a, c, g, or t
  misc_feature (521)..(521): n is a, c, g, or t
  misc_feature (542)..(542): n is a, c, g, or t
  misc_feature (559)..(559): n is a, c, g, or t
agttttggatgttggatgcggtgttgccagcttctctgcttatcttcttcccctagatattcatactatgtcattcgcaccaaaagatggccatgagaatcaaatccagtttgctttagagcgtgggattggtgcaatgatctctgtgttggccacaaagcaattaccgtatcctggaaattcatttgaaatggttcattgctcccgatgtcgtgttgactggcatgaaaatgatggaatattgctcaaagaggtcgatcgtcttttgcgacctaatggatattttgtatattctgctccaccagcttatagaaaagataaagatttccctattatttgggagaggctaattaatatcacatcagcaatgtgttggaagcttattgctaagcatgttcagactgctatatggatcaaacctgaagatgaatcttgccgacagaaaaattctgatacggggatcctgaanatctgtgaccccagtgacacttcttcatggcaanctccattaatgaactgtnttcggttgaacacggaccaancaaaaattcagaaactnccttccagacctgaacgcctgttattttattcgaggagtttggaaataataggagttactccagagaagtttgagaataataaccagttctggcgggaccaggttcgcaagtactggtcatttcttggtgttgaaaagactagcatacggaatatcatggacatgaatgctaattatggtggatttgctatggcactaagcactgaccctgtctggattatgaatatagtaccctatacaaccatcaacacactgcctgctatctatgaccgggggttaattggttcctaccatgactggtgtcagccattctcaacatatcctaggtcatatgatttgctacatgctttccacctcttttcacattatcaaggtcatgtaggaggttgcttattggaagatatcatgctagaaatagatcgcatcattcgtccacagggttttatcattatcagagatgagaataccactctctcaagaatcagtgatctcgcaccaaagttcctatgggatgtcaccactcacacgttggaaaatgaggaaaacaggccggagcaggtgttgatttgtaggaagaaattctgggctatagtttgactggtgcttgtgcctgaagattttatttatgtcctatctcaccatcctgtatcttgctgacacaacatgagaaagattttcgggtgtacaaaaaaggtttcaagatgttcctccagtatgcacaagacattttgtcgcggattctttccagctgaggtcaccgcattacagaaaaaaaaaacagaggacatgactgagatttccttcaggaaatcttcggcctgcttttcagtgcttgtgatttaatgccaactccttatctcagaatgacgaatcggcaggtgtaggacaagataaccaaatgactgttccagattttcatgtaatttgctaattttgtaaactagtttagtttagctttttcctcttcttctggagaaccttggttacgacatacagttatgcagcaaatgatgaggcatagttttttcgtta

SEQ ID NO: 3020 - DNA, 1812 bp, Saccharum officinarum
cctagacattcaaaccatgtcatttgctccaaaagatggccatgagaatcaaatccagtttgctttagaacgtgggattggtgcaatgatctctgtgttggccacaaaacaattaccttatcctgaaagttcatttgaaatggttcactgttcaaggtgtcgtgttgattggcatgaaaatgatggaatattgctcaaagaggtagaccgtcttttgcgacctaatggatattttgtatactctgctccaccggcttatagaaaagataaagactttcctgttatctgggagaagctagttaatattacaacagcattgtgttggaagcttattgctaagcatgttcaaacagctatttgggttaaacctgaagatgaatcctgccggcagagaaaggctgatatgaagctactgaatatttgtgaatccaatgacaacgtttcaccatcatggaaaattccattaatgaattgtgtgaagctcaacaaggacaaatccaatattcagaaattgccttccagatctgatcgcctatcattttatttcaagagtttggagatgataggagtcacaccagagaggtttgagaagaataaccagttctggaagaaccaggttcacaagtattggtcatttcttggtattgaaaagactagcattcgaaacgtcatggacatgaatgctaattatggcggatttgctgcagcactaagcagtgaccctgtctggattatgaatatagtaccccataccatgacgaacacattgccaattatctacgaccgtgggttacttggttcttaccatgactggtgtgagccattctcaacatatcctagatcctatgacttgttgcatgctttccacctcttttctcattatgaaggtcacaaggaagattgtttgttggaggatatcatgttagaaatggatcgcatcattcgaccccagggttttgtcattattagagatgagaatcacactctctcaagaatcatcgatctagcaccgaagttcctttgggatgttactgtgcacatgctgaaaaatgaggaaagcgggacagatcaagttctgttttgcaggaagaaattctgggctattgtttgagttatacttgggtgggaactgggaagctgccatcttgtatcctacctttggttgccgtttgtatcagtgacagaacggaacgtaaggagagctttttggcatgatggatgttccagtgaaacataatatttcgttgcacgttctttgcagttgagagtagtgcatttttgagaaagcatatggtacggtggtgccgttgagaggtttattcagaaactagctcggatcattttgcttttgagctgtactgtttgtatatgaaggccatgggtgagccggtaaggtgtagtcttactgacagtgttttgtagtttctctcataaggaatagcagttaatttgtttggtatcctatattcactaatggctgattaggtttaggttctcaacaatatgttgatagtgttgtttctgttattccaatcggggatcatctgtagtactccctccgtccggttgattatgtaattatgggaaacgtgccgttcaaactgtgtcaactttgaccaaatttatagaactacatgatatgcacaacaaaaaaaaacaataacaattataaatccttatatttatttatctatatatgttatttaatttctctcttctctgcattctctttgtttctctccctttcctcctcccctttttcttttattttctccctactctattacaattattttcttctctccctctcac

SEQ ID NO: 3021 - DNA, 1263 bp, Panicum virgatum
  misc_feature (3)..(3): n is a, c, g, or t
  misc_feature (213)..(213): n is a, c, g, or t
  misc_feature (262)..(262): n is a, c, g, or t
  misc_feature (270)..(270): n is a, c, g, or t
  misc_feature (336)..(336): n is a, c, g, or t
  misc_feature (396)..(396): n is a, c, g, or t
  misc_feature (399)..(399): n is a, c, g, or t
  misc_feature (928)..(928): n is a, c, g, or t
  misc_feature (1041)..(1041): n is a, c, g, or t
  misc_feature (1081)..(1081): n is a, c, g, or t
  misc_feature (1102)..(1102): n is a, c, g, or t
  misc_feature (1110)..(1110): n is a, c, g, or t
  misc_feature (1133)..(1133): n is a, c, g, or t
  misc_feature (1141)..(1141): n is a, c, g, or t
  misc_feature (1148)..(1148): n is a, c, g, or t
  misc_feature (1175)..(1175): n is a, c, g, or t
gangatgaatcctgccgacagaaaaatgctgatatgaagctactgaatatttgtgaatctaatgacaatgtttcgccatcatggaaaatcccattaatgaactgtgtgaggcttaacaaggacaaatcagagattcagaaattgcattcaaggcctgatcgcctgtcattttatttcaagagtttggagatgataggagttacaccagcgagntttgagaagaataatgagttttggaagaaacaggttcacaagtattggncacttctngatgttgaaaagaacagcgtccgaaatgtcatggatatgaatgctaattatggtggatttgctgcngcactaagcaatgaccctgtctggattatgaatgtagtaccttataccatgagcaacacnttnccagttatctacgaccgtggattacttggttcttaccatgactggtgtgagccattctcaacatatcctaggtcctatgacttgctgcatgctttccacctcatcactcattatgaaagtcgcaatgaagattgttcgttggaagatatcatgttagaaatggaccgcatcattaggccccagggtttgatcatcattagagatgataagaacactctttcaagaatcattgatcttgcaccgaagttcctttgggatgttagcacacatatgttggaaaatgaggaaaacgggaccgagctagttctgatttgcaggaagaaattctgggctattgtttaagttactcttgggctggaagctgccagatcctaccatggggtgtcctttgtgtcagtacagaacagaaagtaaggacaacttttcagcatgttgtagtttgagatgtcgctccagtgaacttagtatttcatcgacctttctctgcagctgagagtattgcattgttgagaaagcatatggtaccatngggaggtttcttcacaaactatcaaactaacttggctccttttctttttttggtgcttttgagctgtactggttgtaaaggacatgcgcaaggtgtaaagagagattttgatntgtgcagtcttactaatagctaacgttttgtagtttctcnaaagaaagccatttgtagccngctactcnattagttaattctctgctagtantttagggnttgacanttttttttcttagtgttgtttgttgtnccaatatgggatcatctcaactaccatagatgaacctgatgtaaggtaccctgctctgtgtccttaaatttatcagtctcttggttgc

SEQ ID NO: 3022 - DNA, 2498 bp, Oryza sativa
ccccctccagctcagcggattagcgactctaacactaagtccatttcgcctcctcctctccccttccccttctccttccccttcgcttcctcttcttcgcagcggtagcagcaacctcctcgacgtcgcgctcgggctcgatcccaaccggagaggaggatggcggcggcgccgccgggagggcaggagaaggtgatcgcggcggcgcagcacatcgtcaagtcgctcgccaactccaagaacgccgccgacgacatgatccggatactctccgggttcgacgaccgcctcaccttcatgtccgacctcttcccgcctccccctcccgccgccgccgccgtgagggagccctccgtcgtggaggaggaggaggccggccccgatgacgcgcgggaggacgaggtggaggaggcggcggagttggtggagcggtgggattctccggaggagggggataggctggtgttcgattcggcgaaggacgcgggggattacctgggcgctgcaggcggcgatggcgcggctggaggacgagttccgccacctgctggcccgcgggatgtcgccgctcgccggggaggacctgcacgcctccctcctccgccgcctctcgctcacggtgccgtccttcgcctcctccgcctctgacctcgattgcccctccttcgccagccacaccggcgacggggacgagtccggcggcgcgggcggcagggcctccgtctccgacgaagagatctccccgtacctcatctccccggacaccgtcggcgccctcaggggcatcgcggacgtcatgctgcgcgcaggctacgggccggagctgtgccaggtctacggcgagatgcgccgcgacacgctcatggagtgcctcgccgtgcttggcgtcgacaagatgagcctggaggaggtgcagcgcgtggaatggggcgtcctcgacggcaagatgaagaagtggatccaggcgctcaaggtcgtcgtcagggggcttgttgctgaggagcgccgcatctgcaaccagatctttgccgccgatgccgaagccgaggaggattgcttcactgaggcagccaaggggtgtgtcctgcagctgctcaactttggtgacgcaattgcaatcgggaagagatcgtccgagaagctgttccgcattcttggcatgtatgaggcgctggatgaggtgttgccggagctcgagggcttgttctcaggtgatgcaagggatttcatcaaggaagaggctgtggggatactcatgaggcttggggatgcggtgcgtggcaccgttgcagagtttgcaaatgcaatacagggggagacatctcggagagcgttgcccggtggggagattcacccactcacgcggtatgtcatgaactatgtccgactgcttgcagactatagccgctcactgaaccaacttctcaaggactgggatactgagctagaaaatggaggtgacaacgtgaatatgactccactggggcagtgtgtgctcatactgatcacacatctacaggccaagatcgaggagaaatcaaagctgtatgaggatgaggcacttcagaacatatttttgatgaacaatctgctgtacattgtacagaaggtgaaggattcagagctgaagaccttgcttggcgataattggatccgccagcgtcgtggtcagataagacggtactctacagggtaccttaggtcctcatggacgagggtattagcttgtctgagagatgatggattgccacagacaatgggttcatcaagtgcactcaaggcttcactcaaggaaaggttcaagaactttaacttggcattcgaggagttatacaagacacagacaacatggaaggttgtggaccctcaattaagagaggagttgaagatttcaatctcagagaaagtccttccagcatatcgttcttttgttggaaggttccgaggtcagctagagggtggaaggaattccgcaaggtatataaagtacaaccctgaagatttggagaatcaggtctcagatttttttgaaggcagaagaccaaatgcttgatcgattagtcatgtttgatggttaagggatgtttatatcaatgattttagttacaactccctcatgaatttcattggtggcgctatattggtagcttgatctgcaaagacctttgataatccgaagatggaaagaaaaatcagttttgcctgtagaagaagcagtgtgaactgcaagcaaacagaattttttggtattgcgaagcaatcggaattggatacctagcttttgatctatcaaggtgctgactatatcaaggttcgacatgaaatttaggacactggacactaccatgagctgtgtaattcttacatttttttttctcatcttttgttgattgtaacatctcgtgacttgtttgacatcgaaagaatggttggtgcttggcattttttatgtacaattcataccagtagttatatcaatacagccatttgttatgtgc

SEQ ID NO: 3023 - DNA, 2584 bp, Sorghum bicolor
ttcccttccccgttcaagaagctcgcagcagccgccgaaatccagcggcagtcgaggatggcggcggcgccgccgccggacgggcaggagaaggtgatcgcggcggcgcagcacatcgtcaagtcgctcgccagctccaagaacgccgctgacgacatgatccgcatcctctccggcttcgacaaccgcctctcgctcatgtccgacctcttcccccctcctcccccttccgccgcccccgtcgattccatcctggaggcggacgaggggacctcccagggggacggggacgaccccgacgaggacgacgccgtggcccgggccgaggcgaggtgggacgcggcggccgatgtgatcgagcgctgggagtcccccgccgctggggacgcgctggtgttcgactcgcgtgaggatgccgaggagtacctcgccgcggccgcctgcgtcgcgggcgcgccgggcccgcgcgccgatgccgcgctgcaggccgccatggcacggctcgaggacgagttccgccacctgctcgtccgcggggcgccaccgctcgccgccgaggacctccaggcctcgctcctccgccggctctcgctcacggtgccctccttcaactcctccgccgtagacctagactgcccctccttcgcccagcaccacgcttccgccgccgaggggggagacgagcagcagggcggcaggagctccgcctccgacgacgagatctcgccctacctcatcgccccggacaccgtcagcgccctcagggacatcgccgacgtcatgctgcgcgcgggctacgcgcccgagctgtgccaggtctacggggaggtgcgccgggacacgctcatggaatgcctcgccgtgctcggggtcgacaagatgagcctcgaggaggtgcagcgggtggagtggggcgtgcttgacggcaagatgaagaagtggatccaggcgctcaaggttgttgtccggggcctccttgctgaggagcgccgcatctgcagccagatccttgcggccgaccctaacgccgaggaggagtgcttcactgaggcggccaagggctgtgtcctgcagatgctcaactttggtgacgccattgcgattgggaagaggtccacagagaagctgttccgcatccttggtatgtatgaggcgctagctgaggtgctaccagagcttgagggtttgttctccggtgaggcaaaggatttcatcaaggaggaggctgagggaatactcgcgcggctcggggatgcagtgcgaggcacgattgaagagtttgctaatgccatacagggagagacttctcggagaccactgcctggtggggagatccatccccttacccgctacgtcatgaactacgtgcggctgcttgcggattacaatgcctcgttaaataagcttctggaatgttgggatactgagttgactggggttgataatccaaacatgactccattggggcactgtgtgctcatgctgatcacacacctacagtgcaagattgatgagaaatcgaggctgtatgaggatgaggcgctgcagaacatatttttgatgaacaatctgctgtatattgtacagaaggtgaaggattcagagctcaagacattgcttggtgataactggattcgcaagcgtcgtggtcagataaggcaatactctacagggtatctccggtcgtcatggactagggttttagcttgcctgagagacgatgggcttccacacacaatgggttcatcaagccaactcaaggctgcactgaaggatagattcaaaaacttcaacttggccttcgaggagttgtacaggacacaaacatcatggagggttgtggatcctcagttaagagaagagctgaagatttccatctccgagaaggttcttccagcataccgttcatttgttggaagatttcggggacaactagagggagggaggggttctgcaaggtatataaagtacaaccctgatgatttggagaaccaggtctcagatttttttgaagggagaaagccgaatgcttgatggtcaagggatgtccatatcaactatgcaacctcaagacccatgcaaattttgatgatgctagttccaagtccccctccaaatttcttggcactatactgtacagggaacttgaccttcaaacatcttttgacggtctgaagatggaaatataagcttctcctgaactgacagaaactgtgtgaactgcaaagcaacctgaattgaatactttagcttagcttgtcatccttgatcctgtcagggtgaatggtgacatcattgaggcttgcacatggaattatgacaactgcatctgccatgagctgtgtaattgcaattcttacattttacccttcttttgtcgattgtaacatctcatggctattgtttgacttcaaaatgttgatgcttggcacttctatgtacaatcctaccagcagttatgttcacatttaccttataatgtgttgtagccttctgttatattcattcgttaatgataaacaaaacatatagtttatgtgaatgctattggtcctgttgtcttgtcaatctctgatcgtaaaag

SEQ ID NO: 3024 - DNA, 2530 bp, Triticum aestivum
acccacgctcccggcctctgccccccttctaccgccgcgactccgctgccccctttcacaactgcctcctccgatcggagaggctcaggcggcgcggcgcggcgcgggggacgggatggcggcggcgccgcccgacgggcaggagaaggtgatcgcggcggcgcagcagatcgtcaagtcgctcgccaactccaagaacgccgcggacgacatgatccgcatcctctccggcttcgacaaccgcttctccctcatgtccgacctcttcccggccgccggggcggggggggccgcggtcgcctccgagcccctcccggagggggattacgcgcgggaggggcttcccggccccggcggcggcgacggcttcggcgacgacgacgacctggaggacgagagggacgcggcggtggaggacgcgctgcggctggtggagcagtgggactcccccgcggccggcgaccggctggtcttcgagtcgcccgaggacgccgaggagtacctcgccgccgccgcctgcctcatgggcgaggccggcccgcgcgtcgaggcggcgctgcaggtcgccatggcgcgcctcgaggaggagttccgccagctgctcatccgcgggaccgcctcgctcgccggcgaggacctgcacgcgtccctcctcggcggcctgtcgctcacggtgcccaccttccactccgcctcctcggtcgacctcgactgcccctccttcggcagccacgccgacgagggcgaagagtccggttccggggccagatggagctccgcctccgacggcgagatctcgccctacctcatttcccccgacaccgttcagcaccctcaaggacatcgcggacgtcatgctgcgcgccggctatgggccggagctctgccaggtctacagcgaggtgcgccgggacacgctcatggagtgcctcgccgtgcttggggtcgacaagatgagcctggaggaggtgcagcgcgtggagtggggcgtcctcgatggcaagatgaagaagtggatccaggctctcagggtcgtcgtccagggccttctcgccgaggagcgccgcatctgtggccagatccttgcggccgatgcagatgccgaggaggagtgctttactgaggcggccaaggggtgtgtcctgcagctgctcaacttcggtgatgccattgcgattggcaagaggtcatccgagaagctgttccgcattcttggtatgtacgaggcgctagctgagttgctgccagagctcgaggccttgttctcaggcgatgcaagggatttcatcaaggaagaggcagaggggatactggtcaggctaggggatgcggtgcgtggcacggtcgctgagtttgccaatgcgatacgtggggagacttctcgcagatcactgccagggggcgagatccacccgcttacgcgttatgtcatgaattatgtgcgactgcttgcagattacagccgctggctgaatcatcttcttgatggttgcgagactgagctggaaaatgggggtgacaatgcggatatgactccactgggtcactgtctgctcatactgatcacacatctattggacaagattgaggataaagcgaagctgtatgatgatgaggcactgcagaacatatttttgatgaacaatctgtggtatgttgtgcagaagatcaaggattcagagcttaagagtttgcttggggataactggatccgtaagcgccgtggtcagataaggaggtactctacagggtacctccgatcctcatggaccagggtattagcttgcctgagggatgatgggttgccacagacaacaggttcatcgagtgcactcaaggctgccctgaaggaaaggttcaagagcttcaacttggcttacgaggagttatacaggacacagacagcatggaaggttgtggatcctcagttaagagaagagttgaagatttccatctcggagaaggtccttccagcataccgttcgtttgttggaaggttccgagggcagctagaggggggaaggaatttcgcaaagtatataaagtacaaccctgaggatgtggagaaccaggtctcagatttctttgaagggaaaaaattgaatgcttgatcaaactgtctatgtttgaagggatgttcatatcaatgttggtggttacaaatccctggcaaaatttattcaggcagtgtgctagtaacctgccctaccatcatgcttgtggggttcgaagatggagaaatcaattttgactgctgctggagcagaaatattgtgaatgcaaggcaccctggctggaatactttgcgtgtcatctttgactctttttaaggggagtgctgacattggcgcttccacatgggatttaggacactgcggtgagctgtgtaactgtcattattacagtttacccttcttttgttgattattgactattgttggatggtcggtggttggcatcttatgtacaatttatacagcggttatgttcactttccccttgttgcaaaaaaacctcggccgcgaccacg

SEQ ID NO: 3025 - DNA, 1288 bp, Leymus cinereus x Leymus triticoides
  misc_feature (405)..(405): n is a, c, g, or t
  misc_feature (423)..(423): n is a, c, g, or t
  misc_feature (457)..(457): n is a, c, g, or t
  misc_feature (546)..(546): n is a, c, g, or t
  misc_feature (557)..(557): n is a, c, g, or t
  misc_feature (562)..(562): n is a, c, g, or t
  misc_feature (627)..(628): n is a, c, g, or t
  misc_feature (854)..(855): n is a, c, g, or t
  misc_feature (950)..(950): n is a, c, g, or t
  misc_feature (953)..(953): n is a, c, g, or t
  misc_feature (1038)..(1038): n is a, c, g, or t
  misc_feature (1045)..(1045): n is a, c, g, or t
  misc_feature (1053)..(1053): n is a, c, g, or t
  misc_feature (1081)..(1081): n is a, c, g, or t
  misc_feature (1084)..(1084): n is a, c, g, or t
  misc_feature (1087)..(1087): n is a, c, g, or t
  misc_feature (1101)..(1101): n is a, c, g, or t
ataacggatattcttatagaatggggaatgccagtaacgatgcgttcaatacatcctatatactttgccaagtgtttgacaaaggctgttaatgataatcacggggagaagatcgttaatccatcaaacagggtctctattttaggatacctgagacctgcttttatagaagaagaatcttatttgaggagtttatttcattctgaatgcaatgccgatggttattcatctgattggagagaggaatacaacagagaaccccggccagcttctggaaccaatggcctaattgatggtgataaatcgagattggacatcaatgatgtgggaagtagcattgattcaaccatctacaagctggaaatgatgacaattgagctgttctccatctatgggaagcagttnatgattgatccacaagantttcaagatgcagaaccagatcttctttcaaatnatgcttcggacattataaaacgcatcaaagaaaacagtgatcagtgtactacagctctaaggtccctctgtagcaggaaaaaaggcctnacagtagaggnggcangcttgataggcgttgatagtcttggtatcgacgtaagagccttttctggcttggaagctcggacnnttcgattttcattcaatgcccaggcgttatctgaacgttcggccgaaaagaagatcaagcgaatgctttttccacgttatcgcaagaccgtgaaagcttccgctgaagatgaatgttagccaacttatttattttagcttcgaacgcctaacagtaagctggtgaggagacaaagggtgtgcagggaactcaacaaaagatctgcacccagtcagctcccaattcnntaggagaagctaacacccgtcgacatgaaatgacctcaaggctagagtgctgatcgaggtttcggcttcgtcggctatagaaggccgaccacccntgntttctgacaaataaggtggtggccatgtatagaggagcatccttggacgggatgcgaggcgattcggtgtcggtgcaatctgcanctgaccncaggtttnatcagccatagccataagtttccctctnaanaanataaggtgcagganacacaggatacaaagtgacaactctttggcctgaataaacaacgtcttcttagtttactgcaaacatgtaactaactccatctcattcgtttcctttccatcctgaataaaatgcaattatattttgccagcatgccgctgtcgaaacctcgatggtgtcgcggcaataaatattactttgccgtta

SEQ ID NO: 3026 - DNA, 2542 bp, Triticum aestivum
atatgtcagctatacagtcttacactagacctgtttctattggaactcaaggttatgaatcagtagggcaaggaactgctgtgggacaaccaatggttcatatgtcagctattcttcaggtcactggtgaggcagaatatgttgatgacacaccaacacccccgaatatcttacatgctgctctggtgctgagtaagaaggctcatgctcgcattttgtctatcgacgattcagttgccaaatgttcccctgggtttgctggtctctttctttcaaaagatgtgcctggttctaaccatattgggccaattatccatgacgaggaggtttttgcatctgatgttgttacttgtgttggccagattattggaattgttgtggcagatacccatgataacgcaaaagctgctgcaaataaagtaaatattgagtattctgagctgccagcaatcctctcaatatcggaagctgtcaaagctggtagctttcatcccaataccacaagatgcctttcaaatggggatgttgaacaatgttttgcatccaatacatgcgataaaattatagaaggagaaattcgagtcgggggtcaagagcacttctacatggaacctcaatgcacttttgtctggccagttgattctggaaatgaaattcatatgatctcatctacgcaagctccccagaagcatcagaagtatgtcgctaatgctcttggtcttccactatcaaaagttgtttgcaagactaagcgtattggtggcggatttggtggaaaagaaactagatcagcaatatttgctgccgcggcatctgtagcttcctattgtctaagaaggccagtaaagattgttttggacagggacgttgacatgataacgactggacagaggcacagtttcctagggaaatataagcttggatttaccaatgacgggaagatacaggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatttcccaagcaatactgcttttagaggttttggtggtccacaaggcatgttgattgcagagaattggattcatcacatggctacagaactcaagcggagtccagaggagataaaagaacttaatttccaaagtgagggaactgagctttattatggccagttgctcaagaattgtacaatgcattcggtttgggatgaactgaaggcatcttgtaatattttggaggctcgcaaagctgtaaatgtttttaacagtgaaaatcgttggaggaagcgaggaattgctatggttcccacaaaatttggcatatccttcactgcaaaatttatgaatcaggctggtgctcttgtgcaagtttacactgatggcactgtcctggtaacgcatggcggggttgagatgggacagggtttacacacaaagatagcccaagttgccgcctcatcactagatatccctctaagctgtgtatttatctcagagacaagtaccgataaggttccaaatgcttcaccaacagcagcctctgccagttcggatttgtatggtgctgcagttttggatgcttgtcagcaaataaaggctcggatggaacccattgctagtagggggaatcataagtccttcgctgagttagctcaagcatgctacatggaacgggtagatctctctgctcatgggttttatatcacccctgatatcgggtttgactggattgctggcaaggggagtccatttaattatttcacctatggagccgcatttgcagaagttgagattgacaccctaactggggatttccacacaaggacagctgatattgtcatggatcttggctattcgattaatccagcaattgatattggccagattgaaggagctttcatccaaggtttgggttgggctgccatggaagagctaaaatggggggatgacaaccacaagtggattcgacctggataccttttcacttgtggtcctggctcttacaaaataccctctgtaaatgatatacctctcaatttcaaggtttcactattgaagggtgttccaaatccaagggctatacactcatccaaggctgtaggagagccaccgttcttcctcgcttccgccatcttgtttgcgataaaagacgcgatcgcggcagctagggcggaggagggtcatctcgactggttccctctcgacaacccggcaacgcctgaaagaataagaatggcgtgtgttgactcaattacgaagaaatttgcgtgtgtgtattaccgtcccaagcttagtgtatagtggttactgccagagtagccgatacattcaacgtaaatgtgtacctgttatgtggttgtactatactgtacagtacggacacgctgtgtgcaagataaaagtacagatgaagtgttgatataggattacgaataccacatacttcaaataacctctgaaatatgagc

SEQ ID NO: 3027 - DNA, 2572 bp, Triticum aestivum
  misc_feature (169)..(169): n is a, c, g, or t
  misc_feature (179)..(179): n is a, c, g, or t
atatgtcagctatacagtcttacactagacctgtttctattggagctcaaggttatgaatcagtagggcaaggaactgctgtgggacaaccaatggttcatatgtcagctattcttcaggtcactggtgaggcagaatatgttgatgacacaccaacacccccgaatancttacatgcngctctggtgctgagtaagaaggctcatgctcgcattttgtctatcgacgattcagttgccaaatgttcccctgggtttgctggtgtctttctttcaaaagatgtgcctggttctaaccatattgggccaattatccatgacgaggaggtttttgcatctgatgttgttacttgtgttggccagattattggaattgttgtggcagatacccatgataacgcaaaagctgctgcaaataaagtaaatattgagtattctgagctgccagcaatcctctcaatatcggaagctgtcaaagctggtagctttcatcccaataccacaagatgcctttcaaatggggatgttgaacaatgttttgcatccaatacatgcgataaaattatagaaggagaaattcgagtcgggggtcaagagcacttctacatggaacctcaatgcacttttgtctggccagttgattctggaaatgaaattcatatgatctcatctacgcaagctccccagaagcatcagaagtatgtcgctaatgctcttggtcttccactatcaaaagttgtttgcaagactaagcgtattggtggcggatttggtggaaaagaaactagatcagcaatatttgctgccgcggcatctgtagcttcctattgtctaagaaggccagtaaagattgttttggacagggacgttgacatgataacgactggacagaggcacagtttcctagggaaatataagcttggatttaccaatgacgggaagatacaggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatttcccaagcaatactgcttttagaggttttggtggtccacaaggcatgttgattgcagagaattggattcatcacatggctacagaactcaagcggagtccagaggagataaaagaacttaatttccaaagtgagggaactgagctttattatggccagttgctccagaattgtacaatgcattcggtttgggatgaactgaaggcatcttgtaatattttggaggctcgcaaagctgtaaatgtttttaacagtgaaaatcgttggaggaagcgaggaattgctatggttcccacaaaatttggcatatccttcactgcaaaatttatgaatcaggctggtgctcttgtgcaagtttacactgatggcactgtcctggtaacgcatggcggggttgagatgggacagggtttacacacaaagatagcccaagttgccgcctcatcactagatatccctctaagctgtgtatttatctcagagacaagtaccgataaggttccaaatgcttcaccaacagcagcctctgccagttcggatttgtatggtgctgcagttttggatgcttgtcagcaaataaaggctcggatggaacccattgctagtagggggaatcataagtccttcgctgagttagctcaagcatgctacatggaacgggtagatctctctgctcatgggttttatatcacccctgatatcgggtttgactggattgctggcaaggggagtccatttaattatttcacctatggagccgcatttgcagaagttgagattgacaccctaactggggatttccacacaaggacagctgatattgtcatggatcttggctattcgattaatccagcaattgatattggccagattgaaggagctttcatccaaggtttgggttgggctgccatggaagagctaaaatggggggatgacaaccacaagtggattcgacctggataccttttcacttgtggtcctggctcttacaaaataccctctgtaaatgatatacctctcaatttcaaggtttcactattgaagggtgttccaaatccaagggctatacactcatccaaggctgtaggagagccaccgttcttcctcgcttccgccatcttgtttgcgataaaagacgcgatcgcggcagctagggcggaggagggtcatctcgactggttccctctcgacaacccggcaacgcctgaaagaataagaatggcgtgtgttgactcaattacgaagaaatttgcgtgtgtgtattaccgtcccaagcttagtgtatagtggttactgccagagtagccgatacattcaacgtaaatgtgtacctgttatgtggttgtactatactgtacagtacggacacgctgtgtgcaagataaaagtacagatgaagtgttgatataggattacgaataccacatacttcaaataacctctgaaatatgagcaaaaacaaataatttgatttaaaaaaaaaa

SEQ ID NO: 3028 - DNA, 2142 bp, Setaria italica
cagaattatatcaggagaagtgcaagttggaggtcaagagcatttttacatggaacctcaaggcactcttgtctggccagttgattcaggaaatgaaattcatatggtctcatctactcaagctccccagaagcatcagaagtatgttgctaatgttcttggtcttccactatcaaaagtagtctgcaagactaagcgtattggtggtggatttggtggaaaagaaaccagatcagcaacatttgctgcggcagtatctgtaccgtcatatcgtctaagaaggccagtaaagcttattttggacagagatgttgacatgatatcatctgggcagcggcacagtttcctagggagatacaaggtggggtttaccaacgacgggaaagtactggccctagacctggaactttataacaatggtggtaattcacttgatctgtcccgtgcagtcctggagcgtgctatgtttcattcagaaaatgtctatgacatacctaacatcagaatcagtgggcaagtatgcttgacaaactttccaagtaacactgctttccgaggttttggtggtccacaaggcatgctgattacagaaaattggattcatcacatagcttcagaactccagcgaagtcctgaggacataaaagagcttaatttccacgatgatggaactgtgctgcattatggccagttgctccagaattgtagaattaggtcagtgtgggatgaactaaaggcatcttgtaattttgtggaagctcgcaaagccgttagaagttttaatagtaataatcgatggaggaagcggggaattgccatggttcccacaaaatttggcatatccttcacttcgaaattcatgaatcaggctggtgcacttgttcaagtttacactgatggcactgtcttggtaacacatggtggggttgagatgggacagggtttgcatactaaggttgcccaagttgctgcttcgtcattcaatatccctctcagctctgtatttatctcagagacaagtactgataaggttccaaatgcatcacctacagcagcctctgccagttcagatttgtatggagctgcagttttggatgcctgtcagcaaatcaaggctcggatggaacccattgctagcaggggaacccacaactcctttgctgagttggctcagacatgctacatggaacgcgtggatctctctgctcatggattttatgccacacctgatattgggtttgactggacgaatggcaagggaaccccattcctttatttcacctatggggctgcttttgcagaagttgagattgacacactaactggggattttcacacaaggacagctgatattgttatggacctcggcttttcaatcaatccagcaattgatatcggccagattgaaggagctttcatccaaggtttgggttgggtagctatggaagagctaaaatggggtgataataaccacaagtggattcgacctgggcacctcttcacctgtggacctggcgcttacaaaataccttctgtaaatgacatacctctgaacttcaaggtttcactgctaaagggggcaccaaatccaaaggtcattcattcttccaaagccgtaggagagccgccgtttttcctgggctccgctgtcctgtttgcgataaaggacgcgatctttgctgcgagggctgatgagggccactcggaatggttcccgctggacaacccggcgacacctgaaagaataagaatggcgtgtgtcgattccatcacaaagaaatttgccgatgcagattaccggcccaagcttagtgtatagagcggctgctgcgccgatgcgggggcacacaaattccgggcagaagcctgcacttgtaaagtctcaagccatcgtgaaggactggtgtagtgtcataggatcgctgaacattaatcagtggctgcaaataagtaaaggtagaaaatctgtgtaatgtaactgttttgatttgcctcacatgtacaggacataaaagcagtacagtaaagtgattacctcaggtataaaaaagatcatatgtgccgcttgaaaacatggcattgacctctagtttgggtatcaatcaacatgttcagtatcgcgaccggtgctcgcggtacgcg

SEQ ID NO: 3029 - DNA, 2884 bp, Pennisetum glaucum
aaaatgggtaatatctgatgtctcaattgtctatggaggggtagctgcagttccacttagtgcttcaaagactgaaaatttccttatcggaaagaagtggaactctgagttgttggatgataccttcaatctattaaaagaagacatccctctatcagagaatgcacctggtggaatggtcgaatttcgcagatcattaacattgagtttccttttcaaattttttctttctgttactcatgatatgaacatgaaaggattcctagaagatgggttgcatgctgatcatgtatctgctatacagccatacagtaggcctgttactgttggaactcaaggttatgaaatggtgaggcaaggaacctcagtaggccagccaatggttcatatgtcagctatgcttcaggtcactggtgaagctgaatatactgatgacactccaacaccccctaatactttgcatgctgctctggtgctgagtagaaaggcccatgctcgcatattgtctattgatgattcaattgccaaatcttcacctggctttgttgggctgttcctttcaaaagacattcccggtactaaccacactggaccaattatccatgatgaggaggtttttgcatcagatgttgttacttgtgttggtcagatcatcggaattgttgtagctgatactcatgataatgccaaaaatgccgccaacaaagtacatattgaatattccgagctaccagcaattttatcaatagaggatgctgtcaagagtggaagctttcatccaaataccaaacgatgccttggaaaaggtgacgttgaacaatgtttcatgtctggggcatgtgacagaattatatcaggagaagtgcaagttggaggtcaagagcatttttacatggaacctcaaggcactcttgtctggccagttgattctggaaatgaaattcatatggtctcatctactcaagctccccagaagcatcagaagtatgttgctaatgttctcggtcttccactatcgaaagttgtttgcaagactaagcgtattggtggtggatttggtggaaaagaaaccagatcagcaatatttgctgcggcagtatctgtaccgtcatatcatctaagaaggccagtaaagcttattttggacagagatgttgacatgatatcatctgggcagaggcacagtttcctagggagatacaaggtaggatttaccaatgacgggaagatactggctctagacctggaactttataacaatggtgggaattcacttgatctgtcccttgcagtcctggagcgtgctatgtttcattcagaaaatgtctatgacatacctaatatcagaatcagtgggcaagtatgctttacaaactttccaagtaacactgctttccgaggttttggtggtccacaaggcatgctgattacagaaaattggattcatcatatagcttcagaactccagcaaagtccagaggacataaaagagcttaatttccacaatgatggaactgtgctgcattatggccagttgctccagaattgtagaattaggtcagtgtgggatgaactaaaggcatcttgtaattttgtggaagcccgcaaaggtattagaagttttaatagtaataatcgatggaggaagcggggaattgctatggttcccacaaaatttggaatatccttcacttcgaagttcatgaatcaggctggtgcacttgttcaagtttacactgatggcactgtcttggtaacacatggtggggttgagatgggacagggtttgcatactaaggttgcccaagttgctgcttcgtcattcaatatccctctcagctctgtatttatctcagagacaagtactgataaggttccaaatgcatcaccaacagcagcctctgccagttcagatttgtatggagctgcagttttggatgcctgtcagcaaattaaggcccggatggaacccattgctagcaggggaacccacaactcctttgctgagttggctcagacatgctacatggaacgtgtggatctctctgctcatggattttatgccacacctgatattgggtttgactggaaggagggcaagggaactcctttcctttatttcacctatggagctgcatttgcagaagttgagattgacacactaactggggattttcacacaaggacagctgatattgttatggacctcggcttttcaatcaatccagcaattgatatcggccagattgaaggagctttcatccaaggtttgggttgggtagctatggaagagctaaaatggggtgataataaccacaagtggattcgacctggacacctcttcacctgtggacctggcgcttacaaaataccttctgtaaatgacatacctctgaacttcaaggtttcactattaaaggatgctccaaatccaaaggtcattcattcttccaaagccgtaggagagccaccgtttttcctgggctccgctgtcctgtttgcgataaaggacgcaatctttgctgcgagggctgatgagggtcactcggaatggttcccgctggacaacccggcgacacctgaaagaataagaatggcgtgtgtcgattccatcacaaaaaaatttgccgatgcagattaccggcccaagcttagtgtatagagcggccgcctgcacttgtaaagtctcaagccatcgtgaagaacttgatagtggtatagggtcgctgaacattaatcagtggctgcgaataagtaaaggtggaaaatctgtgtaatgcaaccgtagggatttgcctcacgtgtacatgacatgattacatgaagcagtacagtaaagtgattacctcatgtataaaaagggggcgatatgtgcccgcttcaa

SEQ ID NO: 3030 - DNA, 1980 bp, Saccharum officinarum
ctggaaatgaaattcatatggtctcatctactcaagctccgcagaagcatcagaaatatgttgctagcattcttggtcttccacaatcaaaagttgtttgcaagactaagcgtattggtggcggatttggtggaaaagaaagcagatcagcaatatttgctgcagcagcatctgtaccctctttctgtctgagaaggccagtaaagcttgttttggacagagacgttgacatgatatcaactggacagaggcacagtttccttgggaaatataaggtgggatttaccaatgaagggaagatactggccctagacctggaaatttataacaacggtggtcattcacttgatctgtcccttgcagtactggagcgtgctatgtttcattcagaaaatgtctatgacatagcaaacatcagaatcaatgggcaagtatgccttacaaacttcccaagtaacactgctttccgaggttttggtggtacacaaggcttgttgattgcagagaattggattcaccatatagctacagaactccaacgaagtcctgaggagataaaagaacttaattctcacaatgatggagttgtgctgcattatggccagttgctccagaattgtacaataggtccagtttgggatcaactaaaagcatcttgtaattttgtggaagctcgcaaagctgtgaatagttttaacagtaataaccgctggaggaagcgaggaattgccatgattcccacacaatttggcatatccttcactacaaaattcatgaatcaggctggcgctcttgtgcaagtttacactgatggcactgtcctggtaacacatggtggggttgagatgggacagggtttgcacacaaagatagcccaagttgctgcttcatcgttcaatatccctcttagctctgtatttatatcagagacaagtactgataaggtcccaaatgcatcaccaacagcagcctctgctagttcagatctgtatggagctgcagttttggatgcttgtcagcaaatcaaagttcgaatggaacccattgctagcaaaggaacccacaactcgtttgcagagttggctcaagcatgctacatggaacgtgtggatctgtctgctcatgggttttatgctacacctaatattgggtttgactggacgattggcaagggaactccattcaattatttcacatatggagctgcatttgcagaagttgagatcgacaccctaactggggatttttacacaaggacagctgatattgttatggatctcggctttccaattaatccagcaattgacattggccagattgaaggatcttttatccaaggattgggctgggctaccatggaagagctaaaatgggggatgataacataagtggattcgacctgacacctcttcacctgtggtcctggttcttacaaaataccctctgtaaatgatatacctctaaatttcaaggtttctctattaaagggggttccaaatccgaaggctattcattcttccaaagccgtgggagagccaccatttttcctaggctccgctgtcttatttgcgataaaggacgcgatctttgcggcaagggctgaggaggggcacttgggctggttcccactcgacaacccggcgacaccagaaagaataagaatggcgtgtgtggattccattacaaagaaatttgccggcatagattaccggcccaagcttagtctatagcggctgctgggctgattatgggagaataaattgtgaatagaaaagcccgcgcttgtaaagtttcatgcccttgtgctagaaagatggattactgaacatcgttcagtgcctgaaaatataggtggaaaaacaatatactctcctgtatattgtaactgttcggatttccctcagatttatagggcacacagcagtacagcaaaatgcttaccttcagtataaaatggtggtgcgttttattatcttcggc

SEQ ID NO: 3031 - DNA, 2227 bp, Panicum virgatum
gtcaagagcatttttacatggaacctcaaggcactctggtctggccagttgattctggaaatgaaatgcatatggtctcgtctactcaagctcctcagaagcatcagaagtatgttgctaatgttcttggtcttccactatcaaaagtagtatgcaagactaagcgtattggtggcggatttggtggaaaagaaactagatcagcagtattcgctgcagcagtatctgtaccatcatattgtctaagaaggccagtaaagcttattttggacagagatgttgacatgatatcatctgggcagaggcacagtttcctagggagatacaaggtgggatttaccaacgatggaaagatactggccctagacctggaaatttataacaacggtggtaattcacttgatctgtcccttgcagtcctggagcgtgctatgtttcatgcagaaaatgtctatgacatatctaacatcagagtcagtgggcaagtatgctttacaaacttcccaagtaacactgctttcagaggttttggtggtccacaaggcatgttgattgcagaaaattggattcaccatatagcttcagaactccaacgaagtcctgaggacataaaagagcttaatttccacaatgatggaactatgctgcattatggccagttgctccagaactgtaaaataaggtcagtatgggatgagctaaaggcatcttgtaagtttatggaagctcgcaaagccgttagaagttttaacagtaataatcgatggcggaagcggggaattgccatggttccaacaaaatttggcatatccttcactgccaaattcatgaatcaggctggtgcgcttgttcaagtttacactgatggcactgtcttggtaacccatggtggggttgagatgggacagggtttgcacactaaggttgcccaagttgctgcttcgtcattcaatatccctcttagctctgtatttatctcagagacaagtaccgataaggttccaaatgcatcaccaacagcagcctctgccagttcagatttatatggagctgcagttttggatgcctgtcagcaaatcaaggctcggatggaacccattgctagcaggggaacccacaactcctttgctgagttggctcaaacatgctacatggaacgtgtggatctctctgctcatggattttatgccacacctgatattgggtttgactgggatgatggcaagggaactccattcctttatttcacttatggggctgcatttgccgaagttgagattgacactctaactggggattttcacacaagaacagccgatattgttatggacctcggcttttcaattaatccagcaattgatattggccagattgaaggagctttcatacaaggtttgggttgggtagccttggaagagttaaaatggggtgatcaaaaccacaagtggattcgacctggacacctcttcacctgtggacctggcgcttacaaaataccatctgtaaatgacatacctctgaacttcaaggtttcactattaaagggggctccaaatccaaaggtcatacattcttccaaagccgtaggagagccaccgttcttcctcggctctgctgttctctttgcgataaaggacgcgatcttcgctgcgagggctgatgagggccacaaggagtggttccccctggacaacccggcgacacctgaaaggataagaatggcgtgtgtcgattccatcacgaagaaattcgccaacgcagattatcggcccaagcttagtgtataatggctgctgcgcggatgcgggagcagatcgtggacagaagcagccggcgcttgtaaagttcgaagccattgtaaagggggccgtgtagggtcgctgaacattgatctgtgcctgcaaataaaggtggaaaatctgtgtaatgtgtttttgaagaagtaaaatcagtgtaatgtaatgtcaggtgtacaggatataaagcagtacagcaagtgcttacctcagctataaaaaaggtgacgcgtcatatactcatgtgccgcttcaaaacatggagttgacgggttgacccctagttttcgtgtcaatcaacgagtctagcgaccggggggcatgcggtatgtgccgcaagaccccttttatcttaataggttggtagctggtgctaatttgttgtaaaaaaaaagtactactggctgatggttgatactaatttgatgtga

SEQ ID NO: 3032 - DNA, 945 bp, Pennisetum glaucum
caagagaaagtaagaaagcaatgatgtatagtgatgttggtaggctcaattgcagtgtgagctatacgacatttgccactccagtacgtgggcagggaggggataacaaagagtactcatcaatgcttcataaagctttggaaggcgcagtaatgctacacacttttccaaagaccactgttgatgtttttgccttggttcttgagtctggtggcagtgatctacccatcattatatcgtgtgctagtcttgcactggcagatgctgggatcatgatgtatgatctcgttacgtctgtatccgtgtcctgttttggaaagaacatcatcatcgatccaacctcggatgaggaagcatggcaagacggaagcctcatggtagctttcatgccagcccgcaaggagataactcaactcacactcactggagagtggagtgatggcagaatcaccaatgctgttgagctctgcatggatgcttgcagtaaacttggtgagatactgcgggatcgcttgaaagaagccaccttgacgagcgaatgaaatttgcagaggcaacacttgcaacatgtatccttagctgtacaaaaaaatctgtaggcaagggaggctgctgggcctgatgtttgagtgaacatacatagttatggtgattgactgattatttccatcattgcaaaagagtgaactgttaagccgggaagaagttgcagggtggcgggtctgtcatgtgatgtgctcctgacttctgtctgacctttggcttcatggagcggctgcattttttcacctctgcactccaagactgttgctgtactgattctctggattctctgtataccgaccttttattttagattcggtcgtattccatgtggtttaagtctgacttggatgtggtaacgccacataatttacaatgtgaattatattatgctattaaaaa

SEQ ID NO: 3033 - DNA, 677 bp, Avena sativa
ctggtatacgtggacagggattggacaacaaagagtattcaggaatgcttcataaagcccttgaaggcgcagtaatgctacatacttttccgaagacaactgttgatgttttcgcgttggtccttgagtctggtggcagtgatcttcccatcattatatcttgtgctagtcttgcattagcagatgctgggatcatgatgtatgaccttgttacatctgtatctgtgtctgttaggaaaacgttatcatcgatccaagctcagacgaggaggcatggcaagatggaggccttatgatatcttatatgccatcccgcaaggagatcacacaacttacgctgaccggggagtggtctgatggcaaaatcaccaatgcagtggagctttgtatggatgcttgcagtaagctctgcgagatattgcgcgggtgcttgaaagatactgctgtctcggagaacgaatgacatttgagcagacacatgtttttcagaattgcaactgatatccttagctgtagaaattttgtaggaaagggaggccaggcctgatgtttgcaggagcacattttacagggtggtggtgattgtttctttttggcaaaagagcgaattgttaagtcaagagaagatacttgtaggtgtgtgccatgtcttgtaccgagttgagatttcagaacag

SEQ ID NO: 3034 - DNA, 655 bp, Triticum aestivum
attcggcacgaggcactgttgatgtttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatgatgtggcagagacaacacttgcaacaacagatatccttagctgtacaaaatctgtaggcaagggaggcttgttggcctgatgtttgagtaagcatgcatggttgtctccttcatggcaaaagggtgaactgtcaagctggggagaaattgcagggcagtgtgtatttgccatgtaacatctcctgacttctgacctttagcttcatgtagcatctgtatcttgcttttttctgcttactgtaatattccttgctctacgaatgacctgcattc

SEQ ID NO: 3035 - DNA, 660 bp, Triticum aestivum
attcggcacgaggcactgttgatgtttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatgatgtggcagagacaacacttgcaacaacagatatccttagctgtacaaaatctgtaggcaagggaggcttgttggcctgatgtttgagtaagcatgcatggttgtctccttcatggcaaaagggtgaactgtcaagctggggagaaattgcagggcagtgtgtatttgccatgtaacatctcctgacttctgacctttagcttcatgtagcatctgtatcttgcttttttctgcttactgtaatattccttgctctacgaatgacctgcattctttta

SEQ ID NO: 3036 - DNA, 668 bp, Saccharum officinarum
gccagttgtttctttcaggtgatcttcccatcattatatcatgcactagtcttgcactggcagatgctgaaatcatgatgtacgaccttgttacatctgtatctgtgtcatgttttggtaagaacatcatcatcgatccaacctcagacgaggaagcatggcaagatggaagccttgtggtggctttcatgccagcccggaaggaggtcacacaactcacgctcactggagagtggagtgatggcagaataaccaatgcagtagagctctgtatggatgcttgcagtaagctcggtgacatattgcgtgaccgcttgaaagataccgccaccttgattagtgaatgacgtggcagagaccacacttgcaacaacatatatccttagctgtacaaattctgtaggcaagggaggcttgtaggcctgacgtttgagtaagcatgcatggttgtctccttcaagggcgaactgtcaagctgggaagaaattgcagggcagtgtgtatttgccatgtaacgtactcctgacttctgacctttggcttcatgtagcatcttatctttctttttctgcttactgtaatactccttgcactacggtgacttggattctattgatactgcccttaatttttggttcgggcgagaaaaacattttcccacgcgtccg

SEQ ID NO: 3037 - DNA, 1122 bp, Triticum aestivum
gacttcgagatgaggtctctaattgttgatgtggagaactgcttgcaggcatttgtcggtgtagctcacaatctaaatgccataatagttgcaatcagagggactcaagagaacagtgtgcagaattggatcaaggacttggtatggaagcagcttgatctaagctatccagacatgccaaatgcaaaggtgcacagtggatttttctcctcctataataatacaattttgcgtctagctatcacaagtgctgtgcacaaggcaagaaagacatatggggatatcggcgtcatagtcacagggcactcaatgggaggagccatggctgccttctgtgcactcgatcttgctatcaagctcggaagcgacaatgttcaactcatgactttcggacagcctcgtgttggcaatgctgttttcgcctcctactttgccaaatatgtgccaaacacaattcgactggtacacggacatgatatcgtgccgcatttgccaccttatttctcctttctttccaaactgacgtaccaccacttcccaagagaggtatggatcgatgattctgacgacaacacaaccgaacagatttgtgatgccagcggcgaagacccaaactgctgcaggtgcctctccatactgagtttgagcattcaggaccatttcacatacctgggagtcgatatggaatcagatgactggagcacctgcagaatcatcacagcacaaagtgttgagcgactacggaaggatctcgccagcaacatcatcatgacaaagcacggcgtcgaggtctccattgtcgagaatagcgtgcagacagactggagcagttccatatagcatacaacatcctgttaacatcaaaatttatagcagaaggtggtgccttttctttctcttgaagatggggggttcagttggggaatttcattcaaattgggttgtacattgttctttcatagcctgtgaatatgtaggaatgtagacacgaattataggctctagagtgtaaactcttgtcggatgcacgaaagatccgtctctgtgtttgcatcttgtaaaaaatacaatacccatgcagatatctatacagatgtctccaatctgggaaataaagcagaa

SEQ ID NO: 3038 - DNA, 1120 bp, Triticum aestivum
gtgaacaatgtgacaggcatttgtcggtgtagctcacaatctaaatgccataatagttgcaatcagagggactcaagagaacagtgtgcagaattggatcaaggacttggtatggaagcagcttgatctaagctatccagacatgccaaatgcaaaggtgcacagtggatttttctcctcctataataatacaattttgcgtctagctatcacaagtgctgtgcacaaggcaagaaagacatatggggatatcggcgtcatagtcacagggcactcaatgggaggagccatggctgccttctgtgcactcgatcttgctatcaagctcggaagcgacaatgttcaactcatgactttcggacagcctcgtgttggcaatgctgttttcgcctcctactttgccaaatatgtgccaaacacaattcgactggtacacggacatgatatcgtgccgcatttgccaccttatttctcctttctttccaaactgacgtaccaccacttcccaagagaggtatggatcgatgattctgacgacaacacaaccgaacagatttgtgatgccagcggcgaagacccaaactgctgcaggtgcctctccatactgagtttgagcattcaggaccatttcacatacctgggagtcgatatggaatcagatgactggagcacctgcagaatcatcacagcacaaagtgttgagcgactacggaaggatctcgccagcaacatcatcatgacaaagcacggcgtcgaggtctccattgtcgagaatagcgtgcagacagactggagcagttccatatagcatacaacatcctgttaacatcaaaatttatagcagaaggtggtgccttttctttctcttgaagatggggggttcagttggggaatttcattcaaattgggttgtacattgttctttcatagcctgtgaatatgtaggaatgtagacacgaattataggctctagagtgtaaactcttgtcggatgcacgaaagatccgtctctgtgtttgcatcttgtaaaaaatacaatacccatgcagatatctatacagatgtctccaatctgggaaataaagcagaataaattgagaacattgccctgaaaaaaaaa

SEQ ID NO: 3039 - DNA, 1218 bp, Triticum aestivum
gacttcgagatgaggtctctaattgttgatgtggagaactgcttgcaggcatttgtcggtgtagatcacaatctaaatgccataatagttgcaatcagagggactcaagagaacagtgtgcagaattggatcaaggacttggtatggaagcagcttgatctaagctatccagacatgccaaatgcaaaggttattgccaataagctgtttatactttcttaaaagagaaaaaaaggaaaggcagatgcacctttttgctaaaagactttctactactctggttaaaggtgcacagtggatttttctcctcctataataatacaattttgcgtctagctatcacaagtgctgtgcacaaggcaagaaagacatatggggatatcggcgtcatagtcacagggcactcaatgggaggagctatggctgccttctgtgcactcgatcttgctatcaagctcggaagcgacaatgttcaactcatgactttcggacagcctcgtgttggcaatgctgttttcgcctcctactttgccaaatatgtaccaaacacaattcgactggtacacggacatgatattgtgccgcatttgccaccttatttctcctttctttccaaactgacgtaccaccacttcccaagagaggtatggatcgacgaatctgatggcaacacaacggaacagatatgtgatgccagcggcgaagacccaaactgctgcaggtgcctctccatattgagcctgagcattcaggaccatttcacatacctgggagtagacatggaatcagatgactggagcacctgcagaatcatcacagcacaaagcgttgagcgattacgtaaggatctcagcagcaacatcatcatgacaaagcacggcatcgaggtctccattgtcgagaatagcatgcagacagactggagcagttccagatagcatacagcatcttgttaacaccaatttagtgcagaagatggcgccttttctttctcttgaagaaggggggcttcagttggggaatttcattcagattgggttgtacattgttctttcatagcctgtgaatatgtaggaatgtagacacgaattataggctctagagtgtaaactcttgtcggatgcacgaaagatccgtctctgtgtttgcatcttgtaaaaaatacaatagccatgcagatatctatacagatgtcgcgaatctggaaataaagcagaa

SEQ ID NO: 3040 - DNA, 653 bp, Festuca arundinacea
  misc_feature (190)..(190): n is a, c, g, or t
  misc_feature (218)..(218): n is a, c, g, or t
  misc_feature (298)..(298): n is a, c, g, or t
  misc_feature (326)..(326): n is a, c, g, or t
  misc_feature (367)..(367): n is a, c, g, or t
  misc_feature (370)..(370): n is a, c, g, or t
  misc_feature (408)..(408): n is a, c, g, or t
  misc_feature (423)..(423): n is a, c, g, or t
  misc_feature (427)..(427): n is a, c, g, or t
  misc_feature (463)..(463): n is a, c, g, or t
  misc_feature (468)..(468): n is a, c, g, or t
  misc_feature (470)..(470): n is a, c, g, or t
  misc_feature (530)..(530): n is a, c, g, or t
  misc_feature (544)..(544): n is a, c, g, or t
ggcacgaggtgaatatgtaccgaacacaattcgactggtacacgcacatgatattgtgccacatttgccaccgtatttctcgtttctttccaaactgacgtaccaccatttcccaagagaggtctggatcaatgactctgaagacaacacaaccgaacagatatgtgattccagcggggaagacccaaantgctgcaggtgcctttccatattgagtntgagcatccaggaccatttcacatacctgggagtcgatatggaagcagacgactggagcacctgcagaatcatcagagcncaaagtgtcgagcaattacgaaaggatnttgccagcaacattatcatggcaaagcacaatgttgatgtntcnattgtcgagaatggtgtgcagacagactggagcagttntagatagcctacaanattntgtaaacaccagtttagagtaaaagatggcgccttnttttntnttgaagacggatgcttcagctggggaaccccattcagattggggtgtacattgattattntttcatagcctgtnaatatgtagaaatgtagatacgaattataggtttttagaccttgattcccatcagatgcacgaaagatcgtcaatgtgtgaattttgtgaaatacaataccatggggat

SEQ ID NO: 3041 - DNA, 1020 bp, Setaria italica
cagaattggatcgaggacttgatatggaagcagcttgatctaagctatccaaacatgccgaatgcaaagaggatttttctcctcctataataatacaattttgcgtctagctatcacaagtgctgttcacaaggcaagaaaatcatatggggatatcaatgtcatagtgacaggccactcaatgggaggagccatggcttctttttgtgcactcgatcttgctatgaaactgggaagtgacagtgtgcaactcatgacgttcgggcagcctcgtgttggcaatgctgcatttgcctcatgctttgccaaatatgtacccaacaccattcgagtgacacacggacatgatatcgtgccacatttgccaccttatttctcctttcttccccagttgacatatcaccacttcccaagagaggtatgggtccaggattctaaaggcaacacaaccgagcagatttgtgacaacagtggtgaagacccagactgctgcaggtcggtctccatgttcagcttgagcattcaggaccatttcacctacctgggagtcgatatgcaagcagatgactggagcacctgtagaatcattgcagctcaaagcgttaagcaattccgaaaggagcttaccagcaatattatcacgacaaagcacaatgccgacatctccattgttgaacctagcgtacagacagattggagcagttctagatagccacagcattccgtagaatatgcaaattcagagcgaaaagcaaagccctgcttttctctggaagatgaagaccaaagtagttcagctggaggatttcgttcagattgggatgcaagcaatgctcttgatgtcttgtaaatgtgtaggccgtagatatgtacataagcaagatagattcatagcgttataggccatcgcttctgttgcctgttggatgatgatgatgatagaatgctctgtaaatgcacgctgtaaacttgcaataaagttaagagtaatcccattcgtacatggtatgtgtatttgca

SEQ ID NO: 3042 - DNA, 2445 bp, Setaria italica
ggtaactccatctaaaaggcgggctatatatttatctactgccaaaactttggctgctatacacaaagttgacgttaatgccattggattgcaaaagtatgggagaagagataactattgcaaaagacaagtagaaagatgggagaagcaatatcttgcatccactggtgaagggaagcctgcacgttatcagaggatgctcaacctagctcgttggttgaaagaacatgtaccacaagaagattcctcagcaggatctggaacaggtcttgttcatggtgattaccgtgctgacaatctagtttttcacccaacagaggatcgagtaattggtgttattgattgggaactatctaccttggggaatcagatgtgtgatgttgcttatagttgcttgccatatattattgatgcaacacccggtgaaaggacttcttacggagggttccaacatgctggcattccagatggggttcctcaactggaagagtacctttccgtatactgctctttctctgcaagaacctggcctgctgcaaattggaaattctacgttgctttttctctgtttcgtggggcatctatctatgctggagtgtatcacagatggactatgggtaatgcttcaggtggtgagcgtgctaaatttgctggcaggattgctaacactatggttgactgtgcctgggacttcataaatagaaaaaatgtgttgcaagaacagccttctagaggttttcaagtctcagaagctccatggcaagaatttggcagagagcaggaaggttcaacttctacaaaggatcaaggcaaatttgttcctagcgaaaaggttatgcagcttcgaaagaaattgatgaagtttattgaagatcacatatacccaatggagggtgagttctacaaacatgcacaatcaacctcaagatggacaattcatccagaagaagaaaatcttaaagcattggcaaagaaggagggcctatggaacatgtttattccgctagacagtgcagctagagctagaaagctactatttgaggaccgctctctcgtttcccctggaagttcaaatgaccttctgctgggtgcgggtctcactaatcttgagtatgggtatctgtgtgagattatgggacgttcagtttgggctcctcaaatatttaactgtggtgcacctgatacaggtaacatggaggtcctgttgaggtacggcaccaaggagcaacagaagcaatggttggttcctctattggaagggaaaattcgttctggatttgccatgacagaaccacaagttgcatcttcagatgcaactaatatagaatgctcaatatcgaggcagggagatttctacgtgataaatggaaggaaatggtggaccagtggggctatggaccctagatgcaaaattctgattttaatggggaaaacagatttttctgcacctaagcataaacaacagtcaatgattttagtggacatcgacactcctggggtgcacgtaaagagaccgttgttagtattcggttttgatgacgcacctcatggacacgcggagattacttttgagaatgtgcgtgtcccagtaaaaaatatcctgcttggggaaggacggggttttgagattgctcaaggaaggctcggtcctggaagactacatcattgcatgaggctaataggggcagcagaacgtgggatggatctgatggtcgagagggccttaaataggactgcatttggaaagaggattgcacagcatggttcctttttatcagatcttgcgaagtgtcgggttgatctggagcaggctagacttttggtcctagaagcagcagatcaactagaccgacatgggaacaagaaagcccggggtatccttgcaatggccaaggtggcagctccaaatatggccctgaaggtgcttgacatggcaatgcaagttcacggtgcggctggtctctcatctgataccgtcttatcccacctatgggcaaccgccaggacactgcggattgcagatggccctgatgaagtccatctggggacaattgcgaagctggagctgcaaagagcaaggttgtaacttcagggtgaagtgaagtttcgagaataaacgaatgaacagcaacctgcgcacagggctagggaatggcagcatcaccggtagatagactatgaagtaaataatggcgttaatattcgtccatgtatgttgtacacttgtactccgactgttacccattttagtggcattgtgtcgactatccacgaaactggatgactgttcaatctttgtggtgtcgtacagagatcagcagcagatgtgaacatcagctgtaacagaatgtgtttttttgtacaggagagacaatcagacaaatctgaaggaatggttagccttcggctattactgattttaatgaagaagaatcatatggaaac

SEQ ID NO: 3043 - DNA, 2313 bp, Avena sativa
atactttgctgctgccaaaactttggctgatgtacacaaagtagatgtgtctgcagttggattgcagaagtacgggagaagagacaattattgcaaaagacaagtagaaagatgggaaaggcagtatcttcagtcaactggcgaagggaagcctgctcgttatcagaagatgcttgatctaattcattggttgaaggaaaatgtacccaaagaagattcatcgacaggattgggtactggccttgttcacggtgattatcgtattgataaccttgtatttcatccaacagaggatcgagtaatcggtgtacttgattgggaactatctactttggggaatcagatgagtgatgttgcttacaactgcatgacctatattattgattcaacgcccactgaaatatttcctttggaggacttatgcgtcctgtcatttcagatggcattcctcaactggaagagtacctatctgtatactgctctatgtctgcaagaccctggcctgcaacaaattggaagttctatattgccttttcactgtttcgaggggcatctatctatgcaggagtatatcacagatggactatgggtaatgcttcaggtggcgagcgtgctaaatttgctggcaaggctggtaatgttatggttgactgtgcctgggattacataaacagagaaaatgtcctgccagaacgacctgctacagttacggatttctcgagagctccaaggcaagagttgcacagtgagcaggaaggttcaactttgacaaatggtcaaggcagatttgttcctagtgaaaaagttatgctgctacgggaaaaaataatgaagtttatgaaagatcatatataccccaaggaggatgagttatacaagcatgcacaatcagcctcacggtggacaattcatccagaagaagaaaatttgaaagcattagcaaaacagcagggactgtggaacttgtttattccgcttgatagtgcagctagagcaagagaactactacttgaggaccgatctcatatttctcctggaagttcagatgatcttttgctaggtgcgggtctcacaaatctagagtatggatatttatgcgagattatgggtcgctcagtttgggctccacaaatatttaactgcggtgcacctgatacgggtaatatggaggtcttgctgagatatggtactaaggagcaacaaaagcagtggcttgttcctttactggaagggaaaattcgttcaggatttgcaatgacagaaccacaagttgcatcttcggatgcaacaaatatagaatgtgcaatatcaaggcagggagatttctatgtgataaatggcaagaaatggtggaccagtggggctatggacccaaggtgcaaaatcctgatattaatgggaaaaacagatttttctgcacctaaacataagcagcagtcgatgattttagtggatatcaacactcctggagtgcagataaggagacccctgctagtctttggattcgatgacgcaccacatggacatgcagagattacttttgataacgtgcgtgttccggccacaaatatcctcctaggggaaggacggggttttgagattgctcaaggaagactaggtccaggaagattacatcattgcatgagactaataggagcagcagaacgtggcatgaacatgatggttgagagggccttaagtaggacggtatttggaaagaggattgcacagcatgggtcatttcaatcagaccttgcaaagtgtcgaatagaactggaacaaactaggcttttggtgcttgaagcagcggaccaactcgaccggcatgggaacaagaaagcccgtggaatcctcgcaatggccaaggttgcagctccaaacatggccctcaaagtgctcgacatggcaatgcaagtccatggcgctgctggcgtctcatccgacacagccctatctcatctatgggcaaccgctaggacactgcggatcgcggacggccccgatgaagtccatctcggcacgatcgcgaagctggagctgcaaagggcaaggctgtaagatcaggatggtgtccaggttcaataaaagggggacaaggaacatctggaaaaggtccggaaagcagccagaggtagatagaatggtgaaataagtggtgttagattcctggatgtacacttcctgctttccttgtgatattccatcgtttatttgtccataagagactatatatatgcacacataaatgttcgtcctgttgtgaagggaccaaccctaccagtacagtacagttacatgagagtattattacca

SEQ ID NO: 3044 - DNA, 2462 bp, Setaria italica
tgccgctgccgccgtctacgatggcgaagctgacctccgagctgctgcggccggtggacccggcgcacgcgctcgacgaggccgcgctgctgcgcttcgcggccgccaacgtcccggggttcccgggccccgcgccggcgctggcgctcacccagttcggccacggccagtccaaccccacctactgcatccaggcctccgcgcccgggggaggccggaccacccgctacgtgctgcggaagaagccgcccggggccatcctccagtccgcccacgccgtcgagcgcgagtaccaggttctcaaagctcttggtgctcacacagatgttcctgtcccaaaggtttattgcctttgcacagatgcaagtgtaattggaactcctttctacataatggagtatctggaaggaataatatctgataacgcgttgccgggggtaactccatctaaaaggcgggctatatatttatctactgccaaaactttggctgctatacacaaagttgacgttaatgccattggattgcaaaagtatgggagaagagataactattgcaaaagacaagtagaaagatgggagaagcaatatcttgcatccactggtgaagggaagcctgcacgttatcagaggatgctcaacctagctcgttggttgaaagaacatgtaccacaagaagattcctcagcaggatctgttgttcatggtgattaccgtgctgacaatctagtttttcacccaacagaggatcgagtaattggtgttattgattgggaactatctaccttggggaatcagatgtgtgatgttgcttatagttgcttgccatatattattgatgcaacacccggtgaaaggacttcttacggagggttccaacatgctggcattccagatggggttcctcaactggaagagtacctttccgtatactgctctttctctgcaagaacctggcctgctgcaaattggaaattctacgttgctttttctctgtttcgtggggcatctatctatgctggagtgtatcacagatggactatgggtaatgcttcaggtggtgagcgtgctaaatttgctggcaggattgctaacactatggttgactgtgcctgggacttcataaatagaaaaaatgtgttgcaagaacagccttctagaggttttcaagtctcagaagctccatggcaagaatttggcagagagcaggaaggttcaacttggcaaatttgttcctagcgaaaaggttatgcagcttcgaaagaaattgatgaagtttattgaagatcacatatacccaatggagggtgagttctacaaacatgcacaatcaacctcaagatggacaattcatccagaagaagaaaatcttaaagcattggcaaagaaggagggcctatggaacatgtttattccgctagacagtgcagctagagctagaaagctactatttgaggaccgctctctcgtttcccctggaagttcaaatgaccttctgctgggtgcgggtctcactaatcttgagtatgggtatctgtgtgagattatgggacgttcagtttgggctcctcaaatatttaactgtggtgcacctgatacagggaggtcctgttgaggtacggcaccaaggagcaacagaagcaatggttggttcctctattggaagggaaaattcgttctggatttgccatgacagaaccacaagttgcatcttcagatgcagtaataaaagtggtgaaaatgcagggagatttctacgtgataaatggaaggaaatggtggaccagtggggctatggaccctagatgcaaaattctgattttaatggggaaaacagatttttctgcacctaagcataaacaacagtcaatgattttagtggacatcgacactcctggggacgtaaagagaccgttgttagtattcggttttgatgacgcacctcatggacacgcggagattacttttgagaatgtgcgtgtcccagtaaaaaatatcctgcttggggaaggacggggttttgagattgctcaaggaaggctcggtcctggaagactacatcattgcatgaggctaataggggcagcagaacgtgggatggatctgatggtcgagagggccttaaataggactgcatttggaaagaggattgcacagcatggttcctttttatcagatcttgcgaagtgtcgggttgatctggagcaggctagactttagcagcagatcaactagaccgacatgggaacaagaaagcccggggtatccttgcaatggccaaggtggcagctccaaatatggccctgaaggtgcttgacatggcaatgcaagttcacggtgcggctggtctcttatcccacctatgggcaaccgccaggacactgcggattgcagatggccctgatgaagtccatctggggacaattgcgaagctggagctgcaaagagcaaggttgtaacttc

SEQ ID NO: 3045 - DNA, 1051 bp, Pseudoroegneria spicata
tgacgccgaaaagccccaggcagccgcgacgccagagcagagcaagaggcccgtggtcagctactggggcatcgagccgcggaagctcgtcaaggacgacggcacggagtggccgtggttctgcttcaggccgtgggacacgtacaggccggacacgtccatcgacgtggccaagcaccacgagcccagggcgctggcggacaaggtggcctacttcgtggtgcggtcgctgcgcgtgccccgggacctcttcttccagcgccggcacgccagccacgcgctgctgctggagacggtggccgcggtgccgcccatggtgggcggcgtgctgctgcacctgcgctcgctccgccgattcgagcacagcggcggctggatccgggcgctcatggaggaggccgagaacgagcgcatgcacctcatgaccttcatggaagtgacgcagccgcggtggtgggagcgcgcgctcgtgctcgccgcgcagggcgtcttcttcaacgcctacttcgtcggctacctcatctcccccaagttcgcgcaccgcttcgtcggctacctcgaggaggaggccgtggagtcttacactgagtacctcaaggacctcgaggccggcttgatcgagaacacgcccgccccggccatcgccatcgactactggcgcctccccgccgacgccaggctcaaggacgtcgtcaccgccgtgcgcgccgatgaggcgcatcaccgcgacgccaaccactacgcatcggacatccattaccagggaatgacgctgaatcagactcctgcgccgctcgggtaccactaatcaatggtttgatcgatcgatatgccttctcggtggttcatgatgcctgctcagtccaccgctgttacgtaccaccactgtcgccgatgtttgtcctgttaatttgggatccacagtatgtcgatttatgtctatgagttcttttgtgtcactttgcaccaaaagatatgtttatgtaagccggtaatgcttgtacatatgatttgattactttttttgaaaaatatatatgtgatattatta

SEQ ID NO: 3046 - DNA, 1364 bp, Sorghum bicolor
gcacgtataaaacccaccccaactgaaagcgccaccattccatgctaacagcaacaaccaacaacacaaatcatcagtcgtctgtcgcaggagaaaaaaaaaaaaggctttcttgtcccacaggccacaggaaaggagactgggagaaaagtcgattgtgattagttgatcaccgtccacaccatgagctctcgcatggccggggcagcggttctgcgccacctaggcccgcgcctgttcgccgccgagcaggcggccgtgtccgggctcaccgcgaggggcgtcatgcccgcggctgcgaggcttctccccgcgcggatggccagcaccgccgccgaggctgccagagaagatgccggcgcaaaacagcatggcggcaccgggaagcaagaggaggcagcaggcggcgggcagagcaagaaggccatcgtcagctactggggcatcgaggcgcccaagctcgtgaaggaggacggcacggagtggaagtggacgtccttccggccgtgggacgcgtacacgtcggacacgtccatcgacgtgaagaagcaccacgcgccgacgacgctgccggacaaggcggcgtacctgatcgtcaagtcgctgcgggtgcccatggacctcttcttccagcgccggcacgccagccacgcgctgctgctggagacggtggcggccgtgccgggcatggtgggcggcatgctcctccacctgcgctcgctccgccgcttcgagcacagcggcggctggatccgcgcgctgctggaggaggccgagaacgagcggatgcacctcatgacgttcctggaggtcacgcagcccaagtggtgggagcgcgcgctcgtgctcgccacgcagggcgtcttcttcaacgcctacttcgtcggctaccttctctctcccaagttcgcgcaccgcgtcgtcggctacctcgaggaggaggccgtgtactcctacaccgagtacctcaaggacctcgaggctggcatcatagagaacacgccggcgcccgccatcgccatcgactactggcgcctccccgccgacgccaagctcaaggacgtcgtcaccgtcgtgcgcgccgacgaggcgcaccaccgtgatgtcaaccacttcgcgtcggacatccattaccaagggatgaagctcagggacacgcctgcgccgctcggttatcactaacaagtcgacgtggcctgctgctcagttcagcatttttacacaattattaccctatcgttaatcttatacgttgtgctagccaaagttgctcagcagatcgatcaggacgggtttgctactcggagtagcttgtatactttgtacatatactattaaagatattttaaataacaatacatgag

SEQ ID NO: 3047 - DNA, 1130 bp, Pennisetum glaucum
gcgcggatggcgagcacggccgccgccaaagaggacgccggtgctaaacaccacgggagctcaggcggcggcggcggcgccgagaagcaggaggagccagccggcgggcagagcaagaaggccatcgtcagctactggggcatcgacacgccgaagctcgtgaaggccgacggcactgagtggacatgggcctgcttcaggccgtgggacacgtacacgtcggacacgtccatcgacgtgaagaagcaccacgagccgacgacgctgccggacaaggcggcgtacctgatggtcaagtcgctgcggatgcccatggacctcttcttccagcgccggcacgccagccacgcgctgctgctggagacggtggcggccgtgccgggcatggtggggggcatgctcctccacctgcgctcgctccgccgcttcgagcaaagcggcggctggatccgggcgctgctggaggaggccgagaacgagcggatgcacctcatgacgttcctggaggtggcgcagccacggtggtgggagcgcgcgctcgtgctcgcagcgcagggcgtctacttcaacgcctacttcgtcgcctacctcgcgtcgcccaagttcgcgcaccgcttcgtcggctacctcgaggaggaggccgtgcactcgtacaccgagtacctcaaggacctcgaggcaggcctcatcgagaacacgccggcgccggccatcgccatcgactactggcgcctccccgccgacgccaggctcaaggacgtcgtcaccgttgtgcgcgccgacgaggcgcaccaccgcgacgtcaatcacttcgcgtcggacatccattaccaggggatgaagctcaaggacacgcccgcaccacttgggtaccactgatcagtcgacatggcttcctcgattctgcaatgctgttacctgttaccccatcggacaccttgtctgcatgatttacgcgtaaatgatcggtattttcatagcttgtgccacgcattgaagtctgatttggctttgttctgtctatgtaatctgtcactctgtcagtctgtacatattaagaattattgttcagtacgggctttgcaaccagcactgggttaatgagctcccacctgcgacctccagggctc

SEQ ID NO: 3048 - DNA, 1061 bp, Saccharum officinarum
gaggcttctccccgcgcggatggccagcaccgccgcggaggccgccagagaggatgccggtgcaaaacaacacggcggcaccgggaagcgggaggaggcagcaaacgggcagagcaagaaggccatcgtcagctactggggcatcgagccgcccaagctcgtgaaggaggacggcacggagtggaagtggccctgcttccggccgtgggacgcgtacacgtcggacacgtccatcgacgtgaagaagcaccacgcgccgacgacgctgcccgacaaggcggcgtacctgatcgtcaagtcgctgcgcgtgcccatggacctcttcttccagcgccggcacgccagccacgcgctgctgctcgagacggtggcggccgtgccgggcatggtgggcggcatgctcctccacctgcgctcgctccgccgcttcgagcacagcggcggctgggtccgcgcgctgctcgaggaggccgagaacgagcgcatgcacctcatgacgttccttgaggtcacgcagccgcgctggtgggagcgcgcgctcgtgctcgccacgcagggtgtcttcttcaacgcctacttcgtcggctaccttctctctcccaagttcgcgcaccgcgtcgtgggctacctggaggaggaggccgtgcactcgtacacggagtacctcaaggacctcgaggccggcatcatcgagaactcgccggcgccggccatcgccatcgactactggcgcctccccgccgacgccaagctcaaggacgttgtcaccgtcgtgcgcgccgacgaggcgcaccaccgcgacgtcaaccacttcgcgtcggacatccattaccaggggatgaagctcagggacacacctgcgccgctcggttatcactaacaagtcgacgtggcctgctgctcaattcagcatttttacacaattattaccctatcgttaatcttaatatgttgtgctagccaaagttgcttagcagatcgatcaggactggtttgctactcggatcgagtagcttgtataatttgtacatactactattgaagatatttgaaataacaat

SEQ ID NO: 3049 - DNA, 1302 bp, Panicum virgatum
ccacgcgtccgcaacaacacaaatcattagttcgtacctcgcggacaaaaaataattgtcccacagggaaattgaaggagtcggttgtgatcgcaagccatgagctctcgcatggccggggcagcgctcctgcggcacctgggcccgcgcctgttcgcggccgagccggccgtgtccgagctcgccgcgaggggcggcatgcccgcggccgcgaggatcctccccgcgcggatggccagcacggccgcggaggcggccagagaagatgccggtgcgaagcagcacggcagctcaggcggcggcaccgagaagcaggaggaggcagccggcgggcagagcaagaaggccatcgtcagctactggggcatcgagccgccgaagctcgtcaaggcggacggcacggagtggaggtggccctgcttcaggccgtgggacagctacacgtcggacacgtcgatcgacgtgaagaagcaccacgagccgacgacgctgccggacaaggcggcgtacctgctggtcaagtcgctgcgggtgcccatggacctcttcttccagcgccggcacgccagccacgcgctgctgctggagacggtggccgccgtgccgggcatggtgggcggcatgctcctccacctgcgctcgctgcgccgcttcgagcacagcggggggtggatccgcgcgctgctggaggaggccgagaacgagcggatgcacctcatgacgttcctcgaggtgacgcagccgcgctggtgggagcgcgcgctcgtgctcgccgcgcagggcaccttcttcaacgcctacttcgtcggctacctcctctcccccaagttcgcgcaccgcgtcgtcggctacctcgaggaggaggcggtgcactcgtacaccgagtacctcaaggacctggaggccggcgtcatcgagaacacgccggcgccggccatcgccatcgactactggggcctccccgccgacgccaggctcaaggacgtcgtcaccgtcgtgcgcgccgacgaggcgcaccatcgcgacgtcaaccacttcgcctcggacatccattaccaggggatgaagctcaaggacacgcccgcgccgctcgggtaccattaatcaatcagtcgttgtgtggcctgcccagttcagcattttacactgtaccggtcgtcgtaatattttgtgctagccaagttggttagcagatcagactgatttgctacttgtttagtgatgaccagttggctatgtattactttgtacagattatcgaatgtatttgaaataaaaatacagaaatacagaaggctgtgc

SEQ ID NO: 3050 - DNA, 1325 bp, Sorghum bicolor
ccaaaagcactactcctaagccatctgatctccactcctgcgaagtgagcacgtccaccaaatatttcgcgccacttgccggctctaacgacggtttagttaattagttccacatcaaccatgagctccaggatggccggagcagcggtcctgcgccacctaggcccccgcctcttcgccgccgagccgttgaccgtgcccgcggccgcgaggatcctccccgcacggatgtccagcacggccgccgcgccagaacagcgccaaaagcccgaggccccggcgccggaggggcaggacaagatcaaggccgtcgtcagctactggggcatccagccgcggaagctcgtgaaggaggacggcacggagtggaggtggttctgcttcaggccatgggacacgtacagagcggacacgtcgatcgacatgaagaagcaccacgagccgaaggcgctgcccgacaagctggcctactggctggtgaagtcgctgatcgtgcccaaacagctcttcttccagcgccggcacgcgagccacgcgctgctgctggagacggtggcggccgtgccggggatggtgggcggcatgctcctgcacctgggctcgctgcgccgcttcgagcacagcggcggctggatccgcgcgctgctggaggaggccgagaacgagcggatgcacctcatgacgttcctggaggtggcgcagcccaagtggtgggagcgcgcgctcgtgctcgccgcgcagggcgtcttcttcaacgcctacttcgtcgcctacctcgcctcgcccaagttcgcgcaccgcttcgtcggctacctcgaggaggaggccgtgcactcgtacaccgagtacctcaaggacctggaggccggcgtcatcgagaacaccccggcgcccgccatcgccatcgactactggcgcctccccgccgacgccaagctcaaggacgtcgtcaccgtcgtgcgcgccgacgaggcgcaccaccgcgatgtcaaccacttcgcatcggacatccattaccaggggatgaagctgaaggacacgcctgcgcctctcgggtaccactaattagtcaacgtggcctgcttcatgattgttaataattaacctactgccttgtttgtgatctgcattatttatgtcacatgctataatcgagtctgatttgcgggacacgcctgcgccactcgggtaccactaatttagtcaacgtggcccgctagtttatcaatgtcgcttgtattacgggccggtcatgatgttaattgacctactgccttgtttgtgataaatttgtctgcattatttgtgtaaataactaccaaata

SEQ ID NO: 3051 - DNA, 1427 bp, Zea mays
cttcggtcccgatcacatcatgttcctgctgtcctgcacgcgcccgtataaaacccaccccaacggaaaagccccattgttcagcaacaacaacaacacaaatcatcggttccgttccgtcgcagaaatagaaaaaaggctttcttgtcccacagggcagggagaccgagagagcagtctagtgattagttgatcaccagacgtccagacaccatgagctcccgcatggctggagcagcgcttctgcgccacctaggcccgcgcctgttcgcggccgggcctgcggtgtccgggctcaccgcgaggggcggcatgcccgcggccgcgaggcttctccccgcgcggatggccagcaccgccgcggaggctgccagagaggacgccggtgcaaataaacggcacggcggcaccgagaagcatgaggaggaggcagcaggcgggcagagcaagaaggccgtcgtcagctactggggcatcgacacgcccaagctcgtgaaggaagacggcacggagtggaagtggaccagcttccggccgtgggacgcgtacacgtcggacacgtccatcgacatagggaagcaccacgcgccgacgacgctgcccgacaaggcggcgtacctgatcgtcaagtcgctgcgcgtgcccatggacctcttcttccagcgccggcacgccagccacgcgctgctgctcgagacggtggcggccgtgccgggcatggtgggcggcatgctcctccacctgcgctcgctccgccgcttcgagcacagcggcggctggatccgcgcgctgctcgaggaggccgagaacgagcgcatgcacctcatgacgttcctcgaggtcacgcagccgcgctggtgggagcgcgcgctcgtgctcaccgcgcagggcgtcttcttcaacgcctacttcgtcggctacctcctctcccccaagttcgcgcaccgcgtcgtcggctacctcgaggaggaggcagtgcactcgtacaccgagtacctcaaggacctcgaggccggcatcatcgacaacaccccggcgccggccatcgccatcgactactggcgcctccccgccgacgccaagctcaaggacgtcgtcaccgtcgtgcgcgccgacgaggcgcaccaccgcgacgtcaaccacttcgcgtcggacatccattaccaggggatgaagctcaaggacacgcccgcaccgctcagttatcactgacaagtaggcgttgcctgcctgctgctcaattcagagttcttacacgttagactgtcattggtcttaatatgttgttgtgctagccaaagttgcttagcagatcaagactggtttgctactcggaggtgaactagttgcctatatggtttgtacgtaccagtatattgtagatatttgaaataacaaatataagaatccggtgtgatgttacttat

SEQ ID NO: 3052 - DNA, 1259 bp, Zea mays
gtaccagaacaccaaaagccatctgatctccactcctgcgaagagatctagcacatcgccacatccacacacacttccagctcctccaaatatttcgcgccacttgcgggctctgacggtttagctccactccagccatgagctcccgaatggccggagcagcgctcctgcgccacctaggcccccgcctcttcgcggccgagccggtgaccgggctcgcggcgaggggcgtcatgcccgcggccgcgaggattctccccgcacggatgtccagcacggccgcggaggccgccaaagaagctgccgcgccacaacagcgccaaaagcccgaggccgcggccgcggcgccggaggggcaggacaagaaggccgtcgtcagctactggggcatcgagccgcgaaagctcgtgaaggaggacggcacggagtggaggtggttctgcttcaggccatgggacacgtacagagcggacacgtcgatcgacatgaagaagcaccacgagccgaaggcgctgccggacaagctggcctactggctggtcaagtcgctggtcgtgcccaagcagctcttcttccagcgccggcacgccagccacgcgctgctgctggagacggtggcggccgtgccgggcatggtgggcggcatgctgctccacctgcgctcgctgcgccgcttcgagcacagcggcggctggatccgcgcgctgctggaggaggccgagaacgagcggatgcacctcatgacgttcctggaggtggcgcagcccaagtggtgggagcgcgcgctcgtgctcgccgcgcagggcgtctacttcaacgcctacttcgtcgcctacctcgcctcgcccaagttcgcccaccgcttcgtcggctacctcgaggaggaggccgtgcactcctacacggagtacctcaaggacctcgaggccggcatcatcgacaacacgccggcgccggccatcgctatcgactactggcgcctccccgccgatgccaggctcaaggacgtcgtcgccgtcgtgcgcgccgacgaggcgcaccaccgcgatgtcaatcacttcgcatcggacatccattaccagggcatgaagctgagggacacgcctgcgcctctcggctaccactaattagtcaacgtggcctgctagtttagcaatgtcgcctgtattacgggtcggtcatgatgttaattaacctactgccttatttgtgatcaatttgtctgcattatttgtgtataaataaataatatagttgtg

SEQ ID NO: 3053 - DNA, 1361 bp, Oryza sativa
cacaccacctatcacagcaacacaagccaaccacaaagaattctcatttccggtaacttttctcaagccttttgggcgctctgagaatcatcacacggaagtcaagcctttgttgttgtcgtgattagtttagtttagtcaccgagatgagctcccgaatggccggagcgacgctgctgcgccacctgggcccccgcctgttcgccgccgagcctgtgtactccgggctcgccgcgagcgccaggggcgtcatgcccgccgccgcgaggattttccccgcgcggatggccagcaccagcagcgccggcgcggacgtcaaagaaggcgcagccgagaagctgccggagccggcggcaacggcggcggcggcggcgaccgacccgcagaacaagaaggccgtcgtgagctactggggcatccagccgccgaagctcgtgaaggaggacggcacggaatggaagtggctcagttttaggccatgggacacgtacacgtcggacacgtcgatcgacgtgacgaagcaccacgagccgaagggcctcccggacaagctggcgtactggacggtgaggtcgctggcggtgcccagggacctcttcttccagcggcggcacgcgagccacgcgctgctgctggagacggtggccggggtgcccgggatggtgggcggcatgctgctccacctgcgctccctccgccgcttcgagcagagcggcggctggatccgcgcgctgctggaggaggccgagaacgagcggatgcacctgatgaccttcctggaggtgatgcagccacggtggtgggagcgcgccctcgtgctcgccgcgcagggcgtcttcttcaacgcctacttcgtcggctacctcgtctcccccaagttcgcgcaccgcttcgtcggctacctcgaggaggaggccgtgagctcgtacaccgagtacctcaaggacctcgaggccggcaagatcgagaacacgccggcgccggccatcgccatcgactactggcgcctccccgccgacgccacgctcaaggacgtcgtcaccgtcatccgcgccgacgaggcgcaccaccgcgacctcaaccatttcgcatcggacatccagcaacaggggatgaagctgaaggatacgcctgcgcctatcgggtatcactgatcatcattcatcaacgggcgatgcctgctcagttcatcaccatcactgctactacatgcgtattttacatcctatttgggataaactttgttctgtgtatatatgtaaataagctattgtcactccgttttatgcctgtacctatatgcatgctgagattatgcaaattgtgaataacaatatagtaagattttttttggagtagaa

SEQ ID NO: 3054 - DNA, 967 bp, Saccharum officinarum
gaggattctccccgcacggatgtccagcacggccgtggaggccgccaaagaagctgccgcgccagaagaacagcgccaaaagctcgaggccccggcgccggaggggcaggacaagaaggccgtcgtcagctactggggcatccagccgcggaagcttgtgaaggaggacggcacggagtggaggtggttctgcttcaggccatgggacacgtacagagctgacacgtcgatcgacatgaagaagcaccacgagccgaaggcgctgctcgacaagctggcctactggctggtcaagtcgctggtcgtgcccaagcagctcttcttccagcgccggcacgccagccacgcgctgctgctggagacggtggcggccgtgccgggcatggtgggcggcatgctcctccacctgcggtcgctgcgccgcttcgagcacagcgatgggtggatccgcgcgctgctggaggaggccgagaacgagcggatgcacctcatgacgttcctggaggtggcgcagcccaagtggtgggagcgcgcgctcgtgctcgccgcgcagggcgtctacttcaacgcctactttgtcgcctacctcgcctcgcccaagttcgcgcaccgcttcgtcggctacctcgaggaagaggccgtgcactcctacacggagtacctcaaggacctcgaggccggcatcatcgacaacaccccggtcccggccatcgccatcgactactggcgcctccccgccgacgccaagctcaaggacgtcgtcaccatcgtgcgcgccgacgaggcgcaccaccgcgatgtcaaccacttcgcatcggacattcattaccaggggatgaagctgaaggacacgcctgcgcctctcgggtaccactaattagtcaacgtggcctgctagcttagcaatgtcgcctgtattttacgggtccgtcatgatgtcaataattaacctactaccttgtttgtg

SEQ ID NO: 3055 - DNA, 1676 bp, Curcuma longa
gcacgaggttctcgctctgctgatgacgatgggctctcgtatggccggatcggcgctgtttcgacacctcggccctcgcctcttctccgccgcctctgcatcccgctcctccgccgctctggaaccgtcgttttcgctgctccagtcctcctcgctttccccctccccggtgcttttgcgcctcttccctgtccgaatggccagcacttcggcgtctccggctctcggcggcgaggcgcataaggaggatgaggcgaagtctgctgccgccgtccatcctagcgaaggcaagcacgtttcgagttattggggcatcgagcggtacaagatcacaaaggaggacggcactccttggaggtggtcttgcttcacgccatgggaggcgtacaagtccgatacctcgatcgatctgaacaaacaccacgtccccaccaccttcctcgacaagatcgcctactggactgtcaaagtcctgcgattccccaccgatatcttcttccagaggaggtacggatgccgcgcgatgatgttggagacggtggcggcggtccctgggatggtgggcggcatgtttctccacttgcggtcgcttcgccgcttcgagcacagcggcggttggatccgcgcgctgctggaggaggcggagaatgagcggatgcacctgatgaccttcatggaagtggcgcagccacggtggtacgagcgggcgctggtgcttgcggtgcagggcgtcttcttcaacgcctacttcctgggctacctggtgtcgcccaagttcgcccaccgtgtggtcggttacctggaggaggaggccatccactcctacaccgagtaccttaaggatctggaagcgggcaagatcgagaacgtccccgcccctgccattgccatcgactattggtgcctcccgcccgacgccacgctcaaggacgtcgtcactgtcgtccgcgccgatgaggctcaccaccgcgatgtcaaccacttcgcttcggatattcattaccagggaatggagctgaaaaatacacctgcgccgctgggttatcactgaaatgctgctctccttgtacgctatattctgcccggcagtagtagaagtcgtagaggtattatgaacaaatagatcgactgtaaaacctggaataatttgttttgtttgatggtgatcccgtattgtacatatcaaatgatatgtaaaccctataattgtgcgtaacaattgcagtgtcatctttcaccagttttttgtttttactaaaaagagaaaccatcttcgacgggctctggagcatcaccgtgatcgttcgtatttgctgcagcttgtttgataatgtctatcacgttctcatctcttgtttgcgttaaggtctgtggagcatcagttttattcacatgacggagcttttcttggtcacggctgcgaaaagacttttgtagctccaaactcgtgattttgtaggtcaagaggacaacaaaatctttggtagctcagaactcgttttcttcttcttcttctttggtttttttggtcaaaagaactcgtaacacgtttaggcatatattaacgtcgttgaaatatacttgtcttaattcgatgctttgttccttcgcagttcatattagaatgtagtaggaagctttttaagtgtaacacagacgagtagtaattattattg

SEQ ID NO: 3056 - DNA, 848 bp, Zingiber officinale
  misc_feature (210)..(210): n is a, c, g, or t
gaggcgtacagtccgatacctcgatcgatctgaataagcaccacgtccccaccaccttcctcgacaagatcgcctactggactgtcaaaatcctacgattccccaccgatatcttcttccagaggaggtacggatgccgcgcgatgatgttggagacggtggcggcggtccctgggatggtgggcggcatgtttctccacttgcggtcgnttcgccgcttcgagcacagcggcggttggatccgcgcgctgctggaggaggcggagaatgagcggatgcacctgatgaccttcatggaagtggcgcagccgcggtggtacgaacgggccctggtgcttgcggtgcagggcgtcttcttcaacgcctacttcctgggctacctggtatcgcccaagttcgcccatcgggtggtcggttacctggaggaggaggccatccactcctacaccgagtaccttaaggacctggaggcgggcaagatcgagaacgtccccgcccctgccattgccatcgactattggtgcctcccgcccgacgccacgctcaaggacgtcgtcactgtcgtccgcgccgacgaggctcaccaccgcgatgtcaaccacttcgcttcggatattcattaccagggaatggagctgaaaagtacacctgcgccgctgggctatcactgaaatgctgttctccttgttgctcatcactagtagaaattgtagaggtattatgaaaaaaaaataatttgtttgtttgattgtgatcccgtattatacagacatatcaaatgatatgtaaaccctatttgagagtcacaattgcagtgccatctttcaccggtattttttctaaaaggc

SEQ ID NO: 3057 - DNA, 604 bp, Setaria italica
tcaagtcactgcgcttccccaccggcgtcttcttccagaggcggtatggctgccgggcgatgatgctagagaccgtggccgcggtgccggggatggtgggcggcatgctgctgcacctgcgctcgctccgccgcttcgagcacagcggcggctggatccgggcgctgatggaggaggccgagaacgagcgcatgcacctcatgaccttcatggaggtggccaagcccaggtggtacgagcgcgcgctcgtcctcgccgtgcagggggtcttcttcaacgcctattttctcggctacctcgtctcccccaagttcgcgcaccgcgtcgtcggctacctcgaggaggaggccatccactcgtacaccgagtacctcaaggacctggaggccggcaagatcgacaacgtccccgccccggccatcgccatcgactactggcgcctccccgccaacgccacgctcaaggacgtcgtgaccgtggtgcgcgctgacgaggctcaccaccgtgatgtcaaccacttcgcatcggacatccactgccagggcatgcagctgaaggagtcccctgcgccgatcggataccactgaggctgattgcgctctgc

SEQ ID NO: 3058 - DNA, 1685 bp, Avena sativa
atcttgacaccctatcccgactcctgaaaagctggggcacattacaaatctacaaatcttgcccacctgttggttcaaaaaaatcagccaagcggagccgccatttctcacgtctcgagccatccacacgcggcaccatgtcatcgtggcgtgtactggctcggtgacacgtcgtcccctcaccctctcagaaattggcacgtctgcaggttcgcgagactgcggccacgagttccgcgagcagagtaggccaccgatttgaaggctcgtcatcttcggcgatgaggtcccgcgttgccggatccgtcctcctccgcaacctgagcccgcgcgtattcggcccggccactccggcggctgcgtcgaggcccctgcttgtcggaggagaagggggcgtgtgggcacggctgctggccacgtccgccgccgaggcggcgaaggaggaggtggctgcgtccaaggacaacgtcgcaagcaccgccgccgcgaaggccgaggcggtgcaggcggcaaaggagggggagaagggcgccgtggtgagtagctactggggcatcgtgccggccaagctggtgaacaaggacggcgccgagtggaagtggtcttgcttccggccgtgggaggcgtacacgtcggacacgtcgatcgatctgacgaagcaccaccagcccaagattctgctggacaagatcgcctactggaccgtcaagtcgctgcgcgtgcccaccgatatcttcttccagaggaggtacggctgccgggcgatgatgctggagacggtggcggcggtgccagggatggtgggcgggatgctgctgcacctgcggtcgctccggcgcttcgagcacagcggcggctggatccgggcgctgctggaggaggcggagaacgagcggatgcacctgatgaccttcatggaggtggccgaccccaagtggtacgagcgcgcgctggtcctggccgtgcagggcgtcttcttcaacgcctacttcgtcggctacctcctctccccaaagttcgcgcaccgcgtcgtgggctacctcgaggaggaggccatccactcctacaccgagttcctccgcgacctcgaggccggcaagatcgagaacgtcccggccccgcgcatcgccatcgactactggcgcctccccgccgacgccacgctcaaggacgtcgtcaccgtcgtgcgcgccgacgaggcgcaccaccgcgacgtcaaccacttcgccgcggacatccatttccaagggttggagctcaacaagacgcctgcgccgctcgggtatcactgaccagtaccgagtccggcttgcgccctgccgagatcagtaagaaacacgagttgttgctaagatgtgtctgctactccctggtaggtaaggttactacactattgatgcttgagaaataaaacgccgctctgtgaggacagctcgaggaattgtatgtcagtgtgtgcgtggacctgagttgatgtacacgtcccgactcttgggaaatgcactactatgggttacagaacatacaatgttggactaactagtactaaaatgacatggtcgttcataagctgtccaagcagactcaaccaatacagaggagcggtgctctatgatggatgcatgtttttccaaggccgtgttgggttcctgtgtgagtttttccccgacgcacgtaacttgcat

SEQ ID NO: 3059 - DNA, 1134 bp, Triticum aestivum
gcaccacaagcccaaggtgctgctcgacaagatcgcctactggaccgtcaagtcgctgcgcgtgcccaccgacatcttcttccagaggaggtacgggtgccgggcgatgatgctggagacggtggcggcggtgccggggatggtgggcgggatgctgctccacctgcggtcgctgcggcggttcgagcagagcggcgggtggatccgggcgctgctggaggaggcagagaacgagcggatgcacctgatgaccttcatggaggtggccaaacccaagtggtacgagcgcgcgctggtgctggcggtgcagggcgtcttcttcaacgcctacttcctgggctacatcgtgtcccccaagtttgcgcaccgcgtcgtcggctacctcgaggaggaggccatccactcctacaccgagttcctccgcgacctcgaggccggcaggatcgagaacgtccccgccccgcgcatcgccatcgactactggcgcctccccgccgacgccaggctcaaggacgtggtcaccgtcgtgcgcgccgacgaggcgcaccaccgcgacgtcaaccacttcgccgcggacatccatttccaggggctggagctcaacaagacgcctgccccgctaggatatcactgacgaatgaatgcccaggccggcttgtactctgccattgtcagtaaagaacaaaagtcgttgctaatatatgtgtcggataggtaaggtagtggtgcttgagaaataaaacggccgtatgtaacgagagctccaagatttctcgaagaactattcggttcgctagcgatgaacggtggtgcacttcggcttgtaatggaagttgcttcctttagcaaaggatatatggcgaaccaacctatggttggatggttagcgggactgtggtattcccagcccatcaggattcaaatcctggtgctcgcatttatttctggatttatttcaggattttcggcgatgtgcatacagtgggaggagacgttcccgtcgacgacgagacgcctacggtgacttcgcaaatatcaagatgatatgctggctcagactttaagaggtgctcatatgggtagggcgtgcgtgtttgcgttcatagggatgaatgtatgcgcgtgtatgagccc

SEQ ID NO: 3060 - DNA, 1189 bp, Saccharum officinarum
gtcgcctaggccaccgctggccctggccggctgcggggaacggggcggggtggccgtgtgggtgcggctgctgtccacctccgccgccgaggcgaaggaggaggcggcggcgtccaaggggaacgcaggaagcaccgcggcggcgaaggcggaggcagcggaggccgctaaagagggtgacggaaagagagacaaagtggtgagcagctactggggcgtcgcgccgtcgaagctgatgagcaaggacggcgtcgagtggaggtggtcttgcttcaggccatgggaggcgtacaagccggacacctcgatcgatctcaccaggcaccacgaacccaaggtgctgctcgacaagatcgcctattggaccgtcaaattgctgcgcgtgcccaccgacatatttttccagaggaggtacggatgccgcgccatgatgctagaaacggtggcggcggtgccggggatggtgggcggcatgctgctgcacctgcgctcgctccgccgcttcgagcccagcggcggctggatccgggcgctgctggaggaggcggagaacgagcgcatgcacctcatgaccttcatggaggtggccaagcccaagtggtacgagcgcgcgctcgtcctcgccgtgcagggcgtcttcttcaacgcctacttcctcggctacctcatctcccccaagttcgcgcaccgtgtcgtcggctacctcgaggaggaggccatccactcctataccgagtacctcaaggacctcgaggccggcaagatcgagaacgtccccgcgccggccattgccatcgactactggcagctcccagctgatgcgacgctcaaggatgtggttatcgtggtgcgctccgacgaggcgcaccaccgcgacgtcaatcactttgcgtcggacattcatttccagggtatgcagctcaaggagacacctgcgccgcttggataccattgaacaatctggatgcttgagagttccagttcttcatttttaccagatataggttgatgcttgggaaataaaatgcctggcggctatgagtagcaaaggtctcgtgggttgttcctaaatcttttacgtgtgtgtttgtaagtagagattcagacattgatacgtgcttgacgctggagctcactgattcttctcctgaatgtaccattgacttggttccgcaaaaaaaaaaaaaaa

SEQ ID NO: 3061 - DNA, 1103 bp, Setaria italica
gcgacgatgagctcccgcgccgccggatccgtcctcctgcgccacctgggcccgcgcgtcttcggcccggtctcctctccggtggccgcggcgccgaggcccctgctcgcccaggccgccgccgccgtgtgggtgcggctgctgtccacatcggccgcagaggtgaaggaggaggcggccgcgtcgaaggggaacgccagcagcaccgcggccgccaaggcggaggcggcggaggccgcgagggagggggacgggaagaagagccccgtggtcagcagctactggggcattgagccgtccaagctggtgagcaaggacggcgtcgagtggaggtggtcttgctttcaccgtctcccgttcagagaccgcgcaccttttgctgatctgggtctcaattggcgtgacccgtccccgtgtgctaatcctgcagccgtgggagtcgtacaaaccggacacctcgatcgatctcaccaggcaccacaagcccaaggtgctgctcgacaagatcgcctactggaccgtcaaatccctgcgctttcccaccgacatattcttccagaggaggtacggctgccgcgcgatgatgctggagacggtggcggcggtgccggggatggtgggcggcatgctgctgcacctgcgctcgctccgccgcttcgagcacagcggcggctggatccgggcgctgatggaggaggccgagaacgagcgcatgcacctcatgaccttcatggaggtggccaagcccaggtggtacgagcgcgcgctcgtcctcgccgtgcagggggtcttcttcaacgcctattttctcggctacctcgtctcccccaagttcgcgcaccgcgtcgtcggctacctcgaggaggaggccatccactcctacaccgagttcctcaaggacatcgaggccggcaagaccccgcgccggccatcgccatcgactactggcagctcccggccgatgccaggctaaaggacgtcgttaccgtggtgagggccgacgaggcgcaccaccgcgacgtcaaccactttgcttcggacgtccatttccaggggatggagctcaaggaggtgcctgcgccgcttggatatcattgaacaaa

SEQ ID NO: 3062 - DNA, 1650 bp, Zea mays
cgaccaaacaggcaaacactgaaacactagtaccacagtagcagcgaggagcaaacagcaaagcacgctctggagaaatccctcgtctaccttcaccagttgaccgcactagtggccgtcgtccgaccacgatgagcacccgcgcggcaggatccgccctcctccgccacctgggtccgcgcgtcttcggcccagttttttctccggcggtcgcgccgccgaggccactgctggccttggccggcggcggggaacggggcggggcgctcgtgtgggtgcgggtgcggctactgtccacctccgccgccgaggcgaaggaggaggtggcggcgtccaaggggaactcaggaagcaccgcggcggcgaaggcggaggcggtggaggccgctaaggagggtgacggaaagagagacaaagtggtgagcagctactggggcgtcgcgccgtcgaagctgatgaacaaggacggcgccgagtggaggtggtcttgcttcaggccatgggaggcgtacaagccggacaccacgatcgatctcaacagacaccacgaacccaaggtgctgctcgacaagatcgcctattggaccgtcaaattactgcgcgtgcccaccgacatattcttccagaggaggtacggctgccgtgctatgatgctggaaacagtggcggcggtgccggggatggtgggcggcatgctgcttcacctgcgctcgctccgccgcttcgagcacagcggcggctggatccgggcgctgctggaggaggcggagaatgaacgcatgcacctcatgaccttcatggaggtggccaagcccaagtggtacgagcgcgcgcttgtcctcgccgtgcagggcgtcttcttcaacgcctacttcctcggctacctcatctcccccaagttcgcgcaccgtgtcgttgggtacctcgaggaggaggccatccactcatataccgaatacctcaaggacctcgaggccggcaagatcgagaacgtccccgcgccggccattgccatcgactactggcagctcccagctgatgcgacgctcaaggatgtggttgtcgtggtgcgctccgacgaggcgcaccaccgcgacgtcaatcactttgcgtcggacatacatttccagggtatgcagctcaaggagacacctgcaccgattgagtaccattgaacaatcggggtcctgtgacgcttgagagttccagttcattttggctagctgtaggtagctaaagatgcttgagaaataaaaagaaaatgcctggctgctatgagtagcaaagatctcgtgggttgatcctaaaatcttttacgtgagtgtttgtaagtagagatacagacattgatacgtgcactgaatcttgtccagaacataccatcgacttggttggttccacagagaaaactttatatccgattgtaacagagtttttttttcctgaaaaggagcaacgaaggagccgcgcgtcgtcgattatctatgccactttgtaacccacccatttagaacttgttcggttaggagtgaattgatgaagatttctctttctatttaattttctcatccggtttgggtaaaaccgaacatgtctttaaagggcttcggtttcatctccgttcatgtggattggatgaaatttgacatg

SEQ ID NO: 3063 - DNA, 1678 bp, Zea mays
gcgtgtaccaatttcgcatcacaagtagatacagattttagcgtgcaaaacgttacacgtgagaaccctaatgacacaggctgcttccaaccataagaaaaaaatcacggggtaattaaaaccattcgacttggagaagaagaaaggacctcctgggtttctggaagcccggggaagcaaggctccttccccgtcactgacggggcggatccaccagtcctgtataaaagtccttccccaaaacatccgcctcacttccaaactgcaacgaaaacccacgtctaaaacaggtggcccaccaacgattcacttccccgatcccagggggcggcgatcggaattcgcaacttctcccacgcggcgaacacggcagagatgatgagctcccgggccggatccatcctcctccgccacgccggctcccgtctcttcaccgcagcggcgatctctccggcggcggcctcgaggccactgctcgccggcggcaatggtgttccggcagtcatgctacggcttatgtccacgtcctcccccgccgctcccacggaggcgaaggacgaggcagccaaggcctccaaggtgggaggagacaagaaggcggtggtgatcaacagctactgggggatcgagcaaaacaacaagctagcgcgggacgacggcaccgagtggaagtggacttgctttaggccatgggagacgtacacggcggacacgtccattgacctcaccagacaccatgagcccaagacgctgatggataaggtcgcatactggaccgtcaagtcgctgcgcttccccacggacatcttcttccagaggcggtatggctgccgggcgatgatgctggaaaccgtggctgcggtgcctgggatggtgggcggcatgctgctccacctgcgctcactccgccgcttcgagcagagcggcggctggatccgcgctttgctggaggaggccgagaacgagcgcatgcacctcatgaccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggctacctggaggaggaggccatccactcgtacaccgagtacctcaaggatctggaggccggcaagatcgagaacgtccccgccccggccatcgccatcgactactggcgcctccccgctaacgccacgctcaaggacgtagtcaccgtcgtccgcgccgacgaggctcaccaccgcgacgtcaaccactttgcatcggacatccattgccagggaatgcagctgaagcagtcccctgcgccgatcggataccactgaggatgtttgtgctcttcttaattttgcatcgctaataagcaattgtctttaagggaaggaaaggatgcttattgagttacgagtactgctacggcgattaggatattttccaaccagttgtttgagagtgaaacctattatatgtacgcatgttacatgtacatatctctaagtgcgagaggtgcttttctggcgtttatcacttcttcctggagttcctttgttcttcatgtcagctgaattgggctcgctaatatcgaatgtacaatttttgcataatccctatcttgtttgtagataatcagttgtgctt

SEQ ID NO: 3064 - DNA, 1413 bp, Sorghum bicolor
acactagcagcgagccagcgaagcaagcagagcactttctagagaaatccttcatccacccttcaccagttcaccgcaccagtggccggcgtccggcgacgatgagcacccgcgccgcaggatccgtcctcctccgccacctgggcccgcgcgtcttcggctcggtttcctcctctcccgcggctgcgccgccgaggccactgctggccctggccggcggcggggaatggcgcggggcggccgtgtgggtgcggctgttgtccacctccgccgccgaggcgaaggaggaggcggcggcgtccaaggggaacgcaggaagcaccgcggcggcgaaggcggaggcggtggaggccgctaaggagggagacggaaagaaggacaaagtggtgagcagctactggggcgtcgcgccgtcgaagctgatgagcaaggacggcgtcgagtggaggtggtcttgcttcaggccatgggaggcgtacaagccggacacctcgatcgatctcaccaggcaccacgaacccaaggtgctgctcgacaagatcgcctactggaccgtcaaattgctgcgcgtgcctaccgacatattcttccagaggaggtacggctgccgcgccatgatgctggaaacggtggcggcggtgccggggatggtgggcggcatgctgctgcacctgcgctcgctccgccgcttcgagcacagcggcggctggatccgggcgctgctggaggaggcggagaacgagcgcatgcacctcatgaccttcatggaggtggccaagcccaagtggtacgagcgcgcgctcgtcctcgccgtgcagggcgtcttcttcaacgcctacttcctcggctacctcatctcccccaagttcgcgcaccgtgtcgtcggctacctcgaggaggaggccatccactcctacaccgagtacctcaaggacctcgaggccggcaagatcgagaacgtccccgcgccggccattgccatcgactactggcagctcccagctgatgcgacgctcaaggatgtggttgtcgtggtgcgctccgacgaggcgcaccaccgcgacgtcaatcactttgcgtcggacattcatttccagggtatgcagctcaaggagacacctgcgccgattgaataccattgaacaatctggatgcttgagaattccagttcttcatttttactagatgtaggttgatgcttgagaaataaaatccctggctgctatgagtagcaaagatctcgtgggttgttcctaatcttttacgtgtgtgtttgtaagtagagattcagacattgatacgtgcttgacgctggagctcactgaatcttctcctgaacgtaccattgatttggttggttccgcatttctgctgtttgatctgaaccttgttttcggaaacattttattttcc

SEQ ID NO: 3065 - DNA, 1519 bp, Oryza sativa
atttgcaaatcgcaaccatctcgtcaacaaaaaggcgcctctaagaattcctcccaaactttttggtgttgtcaagccgtgcgtttcggggtacatcaacggcggcgatgagctcccggatggccggatcggcgatcctccgtcacgtcggcggcgtccgcctcttcaccgcgtcggcgacctctccggcggcggcggcggcggcggcggcgaggccgttccttgcaggcggagaagccgtccccggggtgtgggggttgcggctgatgtccacgtcgtccgtggcgtcgacggaggcggcggccaaggcggaggccaagaaggcggacgcggagaaggaggtggtggtcaacagctactggggcatcgagcagtcgaagaagctggtgcgggaggacggcacggagtggaagtggtcttgctttaggccatgggagacctacaccgcggacacttcgatcgatctgacgaagcaccacgtgcccaagacgctgctcgacaagatcgcctactggaccgtcaagtcgctgcgcttccccactgatatcttcttccagaggaggtatggctgccgcgcgatgatgctggagacggtggcggcggtgccggggatggtgggcggcatgctgctccacctccggtccctccggcgcttcgagcagagcggcggctggatccgcacgctgctggaagaggccgagaacgagcgcatgcacctgatgaccttcatggaggtggcgaacccaaagtggtacgagcgcgccctcgtcatcaccgtccagggcgtcttcttcaacgcctacttcctgggttacctcctctcccccaagttcgcgcaccgcgtcgtcggctacctcgaggaggaggccatccactcgtacaccgagttcctcaaggacctcgaggccggcaagatcgacaacgtccctgccccggccatcgccatcgactactggcgcctccccgccaacgccacgctcaaggacgtcgtcaccgtcgtgcgcgccgacgaggctcaccaccgcgacgtcaatcacttcgcatcggacatccattaccagggcatggagctgaagcagacccctgcgccgatcggatatcactgaggatgtttgtctactgccgaggatttgcatcactaataatcaaatcaaatgagtatacttcgtttttcagggaaagcaaatgagagctctttagctgtatcggatttggtaattgctactagtaactactaagtactgaaaaataaggagtctccttgtttgaagtacaaatctaggagattttttgaaccaactctatctgaattgggcctgtttttcgtacgccgcactgcttcatgtacatatattccatcccctatcttatgtgtggcaagtgtctttctaaattcttggatgtaatgacacctgaatttctttcgttgaactattggcagctgagttatatatactacataccattcttttgttaaagcaggtcagagcatagttttgtccatttgatgtctgtcaca

SEQ ID NO: 3066 - DNA, 1413 bp, Sorghum bicolor
atttccaaactgcaacccacgtcaaaacaggtggcccaccaacgattcacttcccccatcccaggcggcggcgatcgtaaattcgcaacttctcccacgcggcgatcaacgagcgatgatgagctccagggccggatccatcctcctccgccacgccggctcccgtctattcaccgcagcggcggtctcaccggcggcggcctcgaggccattgctcgccggcgggagcaacaacggtgtccaggcagtcatgttacgcctgatgtccacgtcctcccccgccgccgcctcggaggcgaaggacgaggcagccaaggcctccaaggagggaggggacaagaaggcggtggtgatcaacagctactgggggatcgagcaaaacaacaagctggtgcgggacgacggcaccgagtggaagtggacttgctttaggccatgggagacgtacacggcggacacgtccattgacctcaccaggcaccatgagcccaagacgctgatggataagatcgcctactggaccgtcaagtcactacgcttccccacggacatcttcttccagaggcggtatggctgccgggcgatgatgctggagaccgtagcagcggtgcccgggatggtgggcggcatgctgctccacctgcgctcactccgccgcttcgagcagagcggcggctggatccgcgcgctgctggaggaggccgagaacgagcgcatgcacctcatgaccttcatggaggtggcgaagccgaggtggtacgagcgcgcgctcgtcatcaccgtccagggcgtcttcttcaacgcctacttcctcggctacctcctgtccccgaagttcgcgcaccgcgtcgtcggctacctggaggaggaggccatccactcgtacaccgagtacctcaaggacctcgaggccggcaagatcgagaacgtccccgccccgtccatcgccatcgactactggcgcctccccgctaacgccacgctcaaggacgtcgtcactgtcgtgcgcgccgacgaggctcaccaccgcgacgtcaaccactttgcatcggacatccattgccagggcatgcagctgaagcagtcccctgcgccgatcggataccactgaggctgtttgtgctctgctgaattttgcatcgctaataagcaaatgagtgttttttgtcttaagggaaagaaataatgcttatgagtactactactgcgattaggatatattttccaaccagtgaaaccattttattttatgtacgcctcactgagtcactgtcgtctttatcagagcaagcttactctacatatctatgtacatatctttgagtgtgacaggtgcttttctggcgttcatcaagttcctttgttcttcatgtagtacaatttctgcatagctcgtatcttgtttgcagatga

SEQ ID NO: 3067 - DNA, 1341 bp, Saccharum officinarum
ggttcccgggtcaaccacgcgtccgcacgtctaaacaggtggcccaccaacgattcacttccccgatcccaggcggcggcgatcgcaattcgcaacttctcccacgcggcgatcacgaacgatgatgagctcccgggccggatccgtcctcctccgccgcgccggctcccgtctcttcaccgcagcggcggtctctccggcggcggcctcgaggccattgctcgccggcggcaacaacgttgtccaggcagtcatggtacggctgatgtccacgtcctcccccgccgccgtctcggaggcgacgaaggatgaggcagccaaggcctccaaggagggaggggacaagaaggcggtggtgatcaacagctactgggggatcgagcaaaacaacaagctggtgcgggacgacggcacggagtggaagtggacttgctttaggccatgggagacgtacacggcggacacgtccattgacctcaccaggcaccatgagctcaagacgctgatggataagatcgcatactggaccgtcaagtcgctacgcttccccacggacatcttcttccagaggcggtatggctgccgggcgatgatgctggagaccgtggcagcggtgcctgggatggtgggcggcatgctgctccacctgcgctcactccgccgcttcgagcagagcggcggctggatccgcgcgctgctggaggaggccgagaacgagcgcatgcacctcatgaccttcatggaggtggcgaagccgaggtggtacgagcgcgcgctcgtcatcaccgtccagggcgtcttcttcaacgcctacttcctcggctacctcctttccccgaagttcgcgcaccgcgtcgtcggctacctggaggaggaggccatccactcgtacaccgagtacctcaaggacgtggaggccggcaagatcgagaacgtccccgccccggccatcgccatcgactactggcgcctccccgctaacgccacgctcaaggacgtcgtcaccgtcgtgcgcgccgacgaggctcaccaccgcgacgtcaaccactttgcatcggacatccattgccagggcatgcagctgaagcagtcccctgcgccgatcggataccactgaggctgtttgtgctctgctgaattttgcatcactaataagcaaatgatgagtgttttgtctttaagggaaagaaagaatgcttatatgagttatgagtactactaccgcatttaggatattttccaatcagttgtttgagagtgaaacctattttatgtacgcctcaatgcgtcgtcttcatcagagcaagcttactctacatatctatgtacaaaaaaaaaaaa

SEQ ID NO: 3068 - DNA, 1479 bp, Triticum aestivum
cgaccacgagtttcgcgagcagagcggcagcccaccaagcaggctcgtcaccttcggcgatgagctcccgcgtcgccggatccgtcctcctccgccacctgggcccgcgcgtcttcgggccgaccactccggccgcgcagaggcccctgcttgccggaggggaagggggcgccgtggccgtggcaatgtgggcgcggccgctgtccacctccgccgccgaggcggcgagggaggaggcgaccgcgtccaaggacaacgtggcgagcaccgccgccgcgacggccgaggcgatgcaggccgccaaggccgacgctgtgcaggccgcgaaggagggcaagagccccgcggcgagcagctactggggcatcgtgcctgccaagctggtgaacaaggacggcgccgagtggaagtggtcttgcttcaggccgtgggaggcgtacacgtcggacacgaccatcgatctctccaagcaccacaagcccaaggtgctgctcgacaagatcgcctactggaccgtcaagtcgctgcgcgtgcccaccgacatcttcttccagcggaggtacgggtgccgggcgatgatgctggagacggtggcggcggtgccggggatggtgggcgggatgctgctgcacctgcggtcgctgcggcggttcgagcagagcggcgggtggatccgggcgctgctggaggaggcggagaacgagcggatgcacctgatgaccttcatggaggtggccaaccccaagtggtacgagcgcgcgctggtgctggcggtgcagggcgtcttcttcaacgcctacttcctgggctacatcgtgtcccccaagttcgcgcaccgcgtcgtcggctacctggaggaggaggccatccactcctacaccgagttcctccgcgacctggaggacggcaggatcgagaacgtccccgccccgcgtatcgccatcgactactggcgcctcccgcccgacgccaggctcaaggacgtcgtcaccgtcgtgcgcgccgacgaggcgcaccaccgcgacgtcaaccacttcgccgcggacatccatttccaggggctggagctcaacaagacgcctgccccgctaggatatcactgacggatgaatgcccagaccgcctagctctgcccttgtcagtgaagaacaaaagttgttgctaatatatatatgtgtgtcggataggtaagatagtgatgcttgtgtgagaaataaaacggccgtttgtcacgagagctccaagatttctcgaggaaccaatgtacacgtcccaactcttacagcttacagcaacgagtagctagctagctattcgattagctagcgatgaacggtggggcactaggcttgtagtggaagttgcttcggttagcaaaggatgtactgtatgtgctggcattctgcttcagaattcagaagtgcactttcagttgcaggcttggaaatatgaattttcacttgctcctcaaaaaaaaaa

SEQ ID NO: 3069 - DNA, 1488 bp, Triticum aestivum
gcgagcctacgaccacgagtttcgcgagcagagcggcagcccaccaagcaggctcgtcaccttcggcgatgagctcccgcgtcgccggatccgtcctcctccgccacctgggcccgcgcgtcttcgggccgaccactccggccgcgcagaggcccctgcttgccggaggggaagggggcgccgtggccgtggcaatgtgggcgcggccgctgtccacctccgccgccgaggcggcgagggaggaggcgaccgcgtccaaggacaacgtggcgagcaccgccgccgcgacggccgaggcgatgcaggccgccaaggccggcgctgtgcaggccgcgaaggagggcaagagccccgcggcgagcagctactggggcatcgtgcctgccaagctggtgaacaaggacggcgccgagtggaagtggtcttgcttcaggccgtgggaggcgtacacgtcggacacgaccatcgatctctccaagcaccacaagcccaaggtgctgctcgacaagatcgcctactggaccgtcaagtcgctgcgcgtgcccaccgacatcttcttccagaggaggtacgggtgccgggcgatgatgctggagacggtggcggcggtgccggggatggtgggcgggatgctgctgcacctgcggtcgctgcggcggttcgagcagagcggcggctggatccgggcgctgctggaggaggcggagaacgagcggatgcacctgatgaccttcatggaggtggccaaccccaagtggtacgagcgcgcgctggtgctggcggtgcagggcgtcttcttcaacgcctacttcctgggctacatcgtgtcccccaagttcgcgcaccgcgtcgtcggctacctggaggaggaggccatccactcctacaccgagttcctccgcgacctggaggacggcaggatcgagaacgtccccgccccgcgtatcgccatcgactactggcgcctcccgcccgacgccaggctcaaggacgtcgtcaccgtcgtgcgcgccgacgaggcgcaccaccgcgacgtcaaccacttcgccgcggacatccatttccaggggctggagctcaacaagacgcctgccccgctaggatatcactgacggatgaatgcccagaccgcctagctctgcccttgtcagtgaagaacaaaagttgttgctaatatatatatgtgtgtcggataggtaagatagtgatgcttgtgtgagaaataaaacggccgtttgtcacgagagctccaagatttctcgaggaaccaatgtacacgtcccaactcttacagcttacagcaacgagtagctagctagctattcgattagctagcgatgaacggtggggcactaggcttgtagtggaagttgcttcggttagcaaaggatgtactgtatgtgctggcattctgcttcagaattcagaagtgcactttcagttgcaggcttggaaatatgaattttcacttgctcctcaaaaaaaaaa

SEQ ID NO: 3070 - DNA, 1414 bp, Brachypodium distachyon
ccgtctgcaaaccgcacccagcaacaacaaacaacagcagcgaacaacgcaagcgcgcgtcagcatcacacgactgctcccagattttgattcgcggagacggcgatgagctcccggatggccggatccgtcctcctccgccacgccggcgccagccgcctcttctccgcgaccgcgacctctcctgcggcggcggcggcgaggccgtttctggctggcggagagagcgtccctggggcgtgggtgcggctgatgtccacgtccgctggctcgcaggcgaagcaggaggcggcgaaggcggctgcaccgcccaaggacaaggagggcggggagaagaaggaggtggtggtcaacagctactgggggatcgagcaggcgaagaagctggtgcgcgaggacggcaccgagtggaagtggtcttgcttcaggccatgggagacgtacaccgcggacacgtccatcgatctgaccaagcaccacgtgcccaagacgatgctcgacaagatcgcttactggaccgtcaagtcgctgcgcttccccaccgacatcttcttccagaggaggtatggctgccgcgcaatgatgctggagacggttgcggcagtgcccgggatggtgggcggcatgctcctccacctgcgttccctccggcgcttcgagcagagcggcgggtggatccgtgcgctgctggaggaggccgagaacgagcgcatgcacctcatgaccttcatggaggtggcgcagccgaggtggtacgagcgcgccctcgtcatcgccgtccagggcgtcttcttcaacgcctacttcttcggctacctcatctcccccaagttcgcgcaccgtgtcgtcgggtacctggaggaggaggccgtccactcctacactgagttcctcaaggacctggaagccggcaagatcgacgacgtccctgccccatccattgccattgactactggcgcctcccggccaacgccacgctcaaggatgtcgtcaccgtggtgcgcgccgatgaggctcaccaccgcgacgtcaaccacttcgcatcggacgtgtactaccagggcatggagctgaaggccacccctgcgccgatcggatatcactgatgcttgccgtcttccgctgaattttgcatcgctactactaagcaaatgagcatttcgttttaagggaaaagcaaatgagggctcttctgtataggatgttgcaattcttactcgtttggtatctgaatactgagaaataagcagtctgcttgccagttacgaatctaggagattgttggaccattttcgctctagatgagcctattttgtgtgcgccacaatgtcttcttttgtcagaataccattgatctacctggccatgtacatattcccaagtcttaagcagtgaagcgtgacgtcactgtcc

SEQ ID NO: 3071 - DNA, 1337 bp, Brachypodium distachyon
gctcgtcatcttccgcgatgagctcccgcgtcgctggacccgccgtcctcctccggcacctgggccgacgcatcttcagcagcccagtctctccggcgtctccggtcgctgcgcagaggcccttgctttccggcggagaaggggccgtgtgggcgcggctgcggctgctgtccacttcagccgctgaggaggcggcgaaggaggaggcggccgcgtccaaggagaactccgcgagcactgccgccgcgaaggccgaagcggcgcaggccgccaaggacggggacaagaccgtggtgagcagctactggggcatcgtgccggccaagctggtgaacaaggacggcgccgagtggaagtggtcttgcttcaggccgtgggaggcttacacgtctgacacgacgatcgatctgaagaagcaccacgagcccaaggtgctgctcgacaagatcgcctactggaccgtcaagtcgctgcgcgtgcccaccgacatcttcttccagaggaggtacggttgccgcgccatgatgctggagacggtggcggcggtgccggggatggtgggcgggatgctgctgcacctgcggtcgctgcggcgcttcgagcacagcggcggctggatcagggcgctgctggaggaagccgagaacgagcggatgcacctcatgacgttcatggaggtggccggcccgaaatggtacgagcgcgcgctcgtcctggccgtccagggcgtcttcttcaacgcctacttcctgggctacctcctgtcccccaaattcgcgcaccgcgtcgtcgggtacctggaggaggaggccgtccactcctacaccgagttcctccgcgacatcgaggccgggaagatcgacaacgtcccggcaccgcgcatcgccatcgactactggcgcctcccgcccgacgccacgctcagggacgtcgtcgtcgtcgtccgcgccgacgaggcgcaccaccgcgacgtcaaccacttcgcttcggacatccatttccaagggctggagctcaacaagacgcctgccccgctcggataccactgacgactgaatatcagtgccgagttgtgctgcaggctgcagcctcgccagtaagaaacacaagttgttgctagtctgtactctgtactgtccggtaggcaaggtttagttataccttcacgtttaacagtcgaggcttgctgttcggttctactgctgttcattttatccgtggttttactgctgttttacacatccggatgcagttcggtctacatgtatgctgagataaatgttgcctctgtaagcaaggagccatggaaatatatgttgacggtctggttcagaatt

SEQ ID NO: 3072 - DNA, 1331 bp, Leymus cinereus x Leymus triticoides
cggattttgggttcgcggaggcgtttctcggcggccagatgagctcccggatggccggatcggtcctcctccgccacgccggcggcgccagccgcctcttcgccaccaccgcgaccgcgacgtgtccggcggccaggaccgtccttgctgtcgccgatgctgtcgtgggtgcggatgatgtccacttccgcggcctcgcaggccaaggatgaggctgccaaggcggctaagtcggtcaaggcggaggcggccaagggcgacggggagaagaaggaggtggtggtcaacagctactgggggatcgagcagtcgaagaagctggtgcgggaggatggcaccgagtggaagtggtcttgcttcaggccatgggagacgtacaccgcggacacgtcgatcgatctgaccaagcaccacgtgcccaacacgatgctcgacaagatcgcctactacaccgtcaagtcgctgcgcttccccaccgacatcttcttccagaggaggtatggctgccgcgcaatgatgttggagactgttgccgcagtgccggggatggtgggcggcatgctcctccacctgcgctccctccggcgcttcgagcagagcggcgggtggatccgcgcgctgctagaggaggctgagaacgagcgcatgcacctcatgaccttcatggaggtggcgcagccgaggtggtacgagcgcgccctcgtcatcgccgtccagggtgtcttcttcaacgcctacttcctcgggtacctcatctcccccaagttcgcgcaccgtgtcgttgggtacctcgaggaggaggctgtccactcctacaccgagttcctcaaggacctcgaggacggcaagatcgacaacgtccctgccccggccatcgccatcgactactggcgcctccctgccaacgccaccctcagggacgtcgtcaccgtggtgcgcgccgacgaggctcaccaccgcgacgtcaaccacttcgcatcggacgtgtactaccagggtatgcagctgaaggccacccccgcgccgattggataccactgaagctggccgtgttatgctgaattttgcatcgctactaagcaaattgagtgtttcgttttgaaggcggggaaatgagagctctttagctgtataggatgttgcaattgttgctcctttggtaactactgagtactgaaataagcagtgtgcttgcaagttacagtaccaatctctaggatattgttgaaccgttttgctctaagatgaacctatttggcgtacgccacaatgtcttcgttatcagaactacattcatcttttatcaaaaaaaagaactacattcatcttca

SEQ ID NO: 3073 - DNA, 944 bp, Elaeis guineensis
  misc_feature (782)..(782): n is a, c, g, or t
  misc_feature (892)..(892): n is a, c, g, or t
tcggtaggcttaccagtggttattattgccatttgcagaggcggtatggatgccgggcgatgatgctggagacggtagcggcggtgccgggtatggtgggcggcatgctgctccacctccgctccctccgccgcttcgagcaaagcggcgggtggatccgcgcgctcttagaagaggcggagaacgagcggatgcacctgatgaccttcatggaggtggccaagccccgttggtacgagcgcgccctcgtcatcgccgtccaggggatcttcttcaacgcctacttcgtgggctacctcctctctcccaagttcgcccaccgcgtcgtcggctacctcgaggaggaggccatccactcctacaccgagtacctcaaggacctcgacgccggcaagatccccaacgtccccgccccggccatcgccatcgactactggcgcctcctccccgacgccaccctcaaggacgtcgtcaccgtcgtccgcgccgatgaggcccaccaccgcgacgtcaaccacttcgcctcggatgttcactaccaagggatggagctgaaggaggcgcctgcgccgctggggtaccactgagtcgctgctgctgagcctgatgtcgacagtgggttgatggaggtatcaagagagaagaactaaagctgtatatggtgcattaataaagtccgtgctgttagagtatagaggcttatttttgttttggttactcatgactatatggagtttaggttatattgtgtaaccttattcatgtttcattgggtggctctnctcatatggatcgctgtcttccgtctatatatctatggagcatgtatatttttctttggttcattcaatgtgttgtactctggtgcactgttgttgcaagaaagggtcanagtttgaggcttctgtcatgtcgaggcactgttggtctatgtgctggatgta

SEQ ID NO: 3074 - DNA, 944 bp, Panicum virgatum
  misc_feature (232)..(232): n is a, c, g, or t
  misc_feature (246)..(246): n is a, c, g, or t
  misc_feature (354)..(354): n is a, c, g, or t
  misc_feature (375)..(375): n is a, c, g, or t
  misc_feature (546)..(546): n is a, c, g, or t
  misc_feature (599)..(599): n is a, c, g, or t
  misc_feature (627)..(627): n is a, c, g, or t
  misc_feature (629)..(629): n is a, c, g, or t
  misc_feature (669)..(669): n is a, c, g, or t
  misc_feature (681)..(681): n is a, c, g, or t
  misc_feature (744)..(744): n is a, c, g, or t
  misc_feature (754)..(754): n is a, c, g, or t
aaggcggaggccgtggaggccgcgaaggaggggggcggggagaagagccccgcggtcaacagctactggggcatcgagccgtccaagctggtgagcaaggacggcgtcgagtggaggtggtcttgcttcaggccatgggagacgtacaagcccaacacctcgatcgatctcaccaggcaccacgagcccaaggtgctgctcgacaagctcgcctactggaccgtcaaatcgntgcgcgcgcccacngacatcttcttccagaggaggtacggctgccgcgcgatgatgctggagacggtggcggcggtgccggggatggtgggcggcatgctgctgcacctgcgctcgctccgncgcttcgagcacagcgggggntggatccgggtgctgctggaggaggccgagaacgagcgcatgcacctcatgaccttcatggaggtggccaagcccaggtggtacgagcgcgcgctcgtcctcgccgtgcagggcgtcttcttcaacgcctacttcctcggctacctcatctcccccaagttcgcgcaccgngtcgtcggctacctcgaggaggaggccatccactcctacaccgagtacctcanggacatcgaggacggcaagatcgagaangnccccgcgccggccatcgccatcgactactggcagctcccngccgatgccacnctcaaggacgtcgtcaccatggtgcgggccgacgaggcacaccaccgcgatgtcaaccatttngcctcggacntccatttccaggggatggagctcaaggagacacctgcgccgcttgaatatcattgaagaaaccggttttgtgacagttcttcatttttactagatgtaggtagttccacttcacacacacacacactctgtatgtatgaactcctatatttccgttggttaatggagatggggcagggcctcgcgtcgat

SEQ ID NO: 3075 - DNA, 1338 bp, Panicum virgatum
gccgtcaacgcaagcgcgcggcccagggcccaccacgactcgcgtcgcatctgctcccaaaacttctggctcgcgtaaccggtgatcgccggcgatgagctcccggatggccggatccatcctcctccgccacaccggcacgcgcgtcttcgccgcggcggccacgaggcccgcactgctcgctggcgccgacggcgtcccggcggttatggggcgattcatgtccacgtcgtcctcccccgccgcggccgcagcaacgccgccgcagaaggcgaaggaggaggcggccaaggacggaggggacaagaaggccgtggtgatcaacagctactggggcatcgagcagacgaacaagctgatgcgggaggacggcaccgagtggaagtggacttgctttaggccatgggagacgtatacggcggacacgtccatcgatctgaccaggcaccacgagcccaagacgatgctcgacaagatcgcttactggaccgtcaagtcgctgcgcttccccaccgacgtcttcttccagaggcgatatggctgccgggccatgatgctggagaccgtggcagcggtgccggggatggtgggcggcatgctgctccacctgcgctctctccgccgcttcgagcagagcggcggctggatccgcgcgctgcttgaagaggccgagaacgagcgcatgcacctcatgactttcatggaggtggcgaagccgaggtggtacgagcgcgcgctggtgatcgccgtccagggcgtcttcttcaacgcctacttcctgggctacctcctctcccccaagttcgcgcaccgcgtcgtcggctacctcgaggaggaggccatccactcgtacaccgagtacctcaaggacctggaggtcggcaagatcgacaacgtccccgccccggccatcgccatcgactactggcgcctccccgccaacgctacgctcaaggacgtcgtcaccgtggtgcgcgccgacgaggctcaccaccgtgacgtcaaccacttcgcatcggacatccattgccagggcatgcagctgaaggagtcccctgcgcccatcggataccactgaggctgattgcgctctgctgaattttgcatcgctaataagaaaatgagtgttctgtttttattggaaagcatgcctatgagtaatgagttgagttattctactacaatattttcgaaccatttcgatgagagtaaaacctattttatgtacatatttgaagcgtgacaggtgcttttctggcgttttcacctgaagttcctctgttctacatgttaactgaattgtgatctctgttctggtatgaacactttctgcatcag

SEQ ID NO: 3076 - DNA, 1315 bp, Triticum aestivum
ttcgcggaggcgttcctcggcgcccagatgagctcccggatggccggatcggtcctcctccgccgcgccggcgccggcgccggccgcctcttcgccaccaccgcgtccccggcggccaggaccgccctcggtggaggtgagggcgcgtgggtgcggatgatgtccacctccgcggcctcgcaggtcaaggacgaggcggccaagggggtcaaggcggaggcggccaagggcgacggggagaagaaggaggtggccatcagcagctactgggggatcgagcagtcgaagaagctggtgcgcgaggacggcaccgagtggaagtggtcttgcttcaggccatgggagacgtacaccgcggacacgtcgatcgatctgaccaagcaccacgtgcccaacacgatgctcgacaagatcgcctactacaccgtcaagtccctgcgcttccccaccgacatcttcttccagaggaggtatggctgccgcgcaatgatgctggagactgttgccgcagtgccggggatggtgggcggcatgctcctccacctgcgctcgctccggcgctttgagcagagcggtggttggatccgcgcgctgctggaggaggccgagaacgagcgcatgcacctcatgaccttcatggaggtggcgcagccgaggtggtacgagcgcgccctcgtcatcgccgtccagggcgtcttcttcaacgcctacttcttcggctacctcatctcgcccaagttcgcgcaccgcgtcgtcgggtacctcgaggaggaagccgtccactcctacaccgagttcctcaaggacctcgacgacggcaagatcgacaacgtccccgccccggccatcgccatcgactactggcgcctccctgccaacgccaccctcaaggacgtggtcaccgtggtccgcgccgacgaggctcaccaccgcgacgtcaaccacttcgcatcggacgtgtactaccagggtatgcagctgaaggccaccccggcgccgatcggataccactgaggctggccgtgttctgctgaattttgcaacgctactactgctactaccaccaagcaaatgagtgtttcgttttgaaggcagaggaaatgagagctctttagctgtataggatgttgcaattgttgctcgtttggtaactattgagtactgagaaataagcagtgtgcttgtcagttacgtatctaggatattgttgaaccaccatttcgctctaagatgaacctatttggcgtacgccacaatgtcttcgttatcagaccaccattgatctacctcgctatgtacatataccctatttgaa

SEQ ID NO: 3077 - DNA, 1278 bp, Triticum aestivum
cccacccacccccacagcaaccaacgcaggcgaaggcgcgcgtcgacgtcacgcccacgacccgtcccggagttttggggtgattcgcggaggcgtttcccggcgcccagatgagctcccggatggccggatcggtcctcctccgccgcgccggcgccggcgccagccgcctcttcgccaccacccgcgtccccggcggccaggaccgccctcggtggaggtgagggcgcgtgggtgcggatgatgtccacctccgcggcctcgcaggtcaaggacgaggcggctaaggcggtcaaggcggaggcggccaagggcgacggggagaagaaggaggtggccatcagcagctactgggggatcgagcagtcgaagaagctggtgcgcgaggacggcaccgagtggaagtggtcttgcttcaggccatgggagacgtacaccgcggacacgtcgatcgatctgaccaagcaccacgtgcccaacacgatgctcgacaagatcgcctactacaccgtcaagtccctgcgcttccccaccgacatcttcttccagaggaggtatggctgccgcgcaatgatgctggagactgttgccgcagtgccggggatggtgggcggcatgctcctccacctgcgctcgctccggcgctttgagcagagcggtggttggatccgcgcgctgctggaggaggccgagaacgagcgcatgcacctcatgaccttcatggaggtggcgcagccgaggtggtacgagcgcgccctcgtcatcgccgtccagggcgtcttcttcaacgcctacttcttcggctacctcatctcgcccaagttcgcgcaccgcgtcgtcgggtacctcgaggaggaagccgtccactcctacaccgagttcctcaaggaccttgacgacggcaagatcgacaacgtccccgccccggccatcgccatcgactactggcgcctccctgccaacgccaccctcaaggacgtggtcaccgtggtgcgcgccgacgaggctcaccaccgcgacgtcaaccacttcgcatcggacgtgtactaccagggtatgcagctgaaggccaccccagcgccgatcggataccactgaggctggccgtgttctgctgagttttgcatcgctgctactactaccaccaagcaaatgagtgtttcgttttggaaggcagaggaaatgagagctctttagctgtataggatgttgcaattgttgctcctttggtaactattcagtactgagaaataatcagtgtgcttgtcagttgcgtat

SEQ ID NO: 3078 - DNA, 1405 bp, Hordeum vulgare
ggccattcgcaaactcaaccgcaacccccccaccccacccaccacccaccacagcaacgaacctacaagcgtgcgactcgtccccgggttgtgattcgcggaggcgtttctcggcgcccagatgagctcccggatggccggatcggtcctcctccgccacgccggcgccggggccgaccgcctcttcgccaccacggcgtcccccgcggccaggaccgccctcgccggcggcgagggtgcgtgggcgcggatgatgtccacgtccgcggcctcgcacgccaaggacgaggcggccaaggcggcggccacgggcgacggggagaagaaggaggtggcggtcaacagctactgggggatcgagcagtcgaagaagctggtgcgcgaggacggcaccgagtggaagtggtcttgcttcaggccatgggagacgtacaccgcggacacgtcgatcgatctcaccaagcaccacgtgcccaacacgatgctcgacaagatcgcctactacaccgtcaagtcgctccgcttccccaccgacatcttcttccagaggaggtacggctgccgcgcaatgatgctggagaccgttgccgcagtgccgggaatggtgggcggcatgctcctccacctgcgctcgctccggcgcttcgagcagagcggcggctggatccgcgcgctgctggaggaggccgagaacgagcgcatgcacctcatgaccttcatggaggtggcgcagccgaggtggtacgagcgcgccctcgtcatcaccgtccagggcgtcttcttcaacgcctacttcttcggctacctcatctcccccaagttcgcgcaccgcgtcgtcgggtacctcgaggaggaggccgtccactcctacaccgagttcctcaaggacctcgacgacggcaagatcgacaacgtccctgccccggccatcgccatcgactactggcgcctcccggccaacgccaccctcaaggacgtggtcaccgtggtgcgcgccgacgaggctcaccaccgcgacgtcaaccacttcgcatcggacgtgtactaccagggtatggagctgaaggccaccccggcgccgatcggataccactggcttggccgtcttctgctgaattttgcatcgctactactaccaagcaaatgagtgtttcgttttgaaggcttccgaggaaatgagggctctttagctgtataggatgtcgcaattgttgctcctttggtaactatcgagtactgagaaataagcagtgtgcttgtcagttacgtatctaggatattgttgaaccaccatttcgctcaaagatgaacctatttggcttacgccacaatatcttcgttgtcagaccaccattgatctacctcgctatgtacatatcccctatttgaatattactgttccttt

SEQ ID NO: 3079 - DNA, 1415 bp, Hordeum vulgare
ggccattcgcaaactcaaccgcaacccccccaccccacccaccacccaccacagcaacgaacctacaagcgtgcgactcgtccccgggttgtgattcgcggaggcgtttctcggcgcccagatgagctcccggatggccggatcggtcctcctccgccacgccggcgccggggccggccgcctcttcgccaccacggcgtcccccgcggccaggaccgccctcgccggcggcgagggtgcgtgggcgcggatgatgtccacgtccgcggcctcgcacgccaaggacgaggcggccaaggcggcggccacgggcgacggggagaagaaggaggtggcggtcaacagctactgggggatcgagcagtcgaagaagctggtgcgcgaggacggcaccgagtggaagtggtcttgcttcaggccatgggagacgtacaccgcggacacgtcgatcgatctcaccaagcaccacgtgcccaacacgatgctcgacaagatcgcctactacaccgtcaagtcgctccgcttccccaccgacatcttcttccagaggaggtacggctgccgcgcaatgatgctggagaccgttgccgcagtgccgggaatggtgggcggcatgctcctccacctgcgctcgctccggcgcttcgagcagagcggcggctggatccgcgcgctgctggaggaggccgagaacgagcgcatgcacctcatgaccttcatggaggtggcgcagccgaggtggtacgagcgcgccctcgtcatcaccgtccagggcgtcttcttcaacgcctacttcttcggctacctcatctcccccaagttcgcgcaccgcgtcgtcgggtacctcgaggaggaggccgtccactcctacaccgagttcctcaaggacctcgacgacggcaagatcgacaacgtccctgccccggccatcgccatcgactactggcgcctcccggccaacgccaccctcaaggacgtggtcaccgtggtgcgcgccgacgaggctcaccaccgcgacgtcaaccacttcgcatcggacgtgtactaccagggtatggagctgaaggccaccccggcgccgatcggataccactgaggcttggccgtcttctgctgaattttgcatcgctactactaccaagcaaatgagtgtttcgttttgaaggcttccgaggaaatgagggctctttagctgtataggatgtcgcaattgttgctcctttggtaactatcgagtactgagaaataagcagtgtgcttgtcagttacgtatctaggatattgttgaaccaccatttcgctcaaagatgaacctatttggcttacgccacaatatcttcgttgtcagaccaccattgatctacctcactatgtacatatcccctatttgaatattactgttccttttctttgct

SEQ ID NO: 3080 - DNA, 1409 bp, Oryza sativa
cagagcatcaacacgcacacctcagcgaagagcagagcagcgtctccacgatctccggcgatgggctcccgcgctgctggatcagtcctcctccgccacctctgcccccgagtctccagctcgacctctgcggctgcgcatgcgcatgcgcagcggcctccgttagccggcgccggcggagggggcgtggccttgtgggcgcgacttctgtccacctccgccgccgcggcgaaggaggagacggccgcgtccaaggagaacaccgggagcaccgccgccgcgaaggcggaggcgacgaaggccgccaaggaagggccggccagtgcgactgcgagtcccgtggcgagcagctactggggcatcgaggcgtcgaagctcgcgagcaaggacggcgtcgagtggaagtggtcttgcttcagaccatgggagacgtactcgccggacacgacgatcgacctgaagaagcaccacgagccgaaggtgctgctcgacaaggtcgcctactggaccgtcaaggcgctgcgcgtgcccactgacatcttcttccagaggaggtacgggtgccgcgcgatgatgctggagacggtggcggcggtgccggggatggtgggcggcatgctgctgcacctccggtcgctccgccgcttcgagcacagcggcggctggatccgcgcgctgctggaggaggccgagaacgagcggatgcacctcatgaccttcatggaggtggccaagccgaggtggtacgagcgcgcgctcgtgctcgccgtccagggcgtcttcttcaacgcctacttcctcggctacctcctgtcccccaagctcgcgcaccgcgtcgtcggctacctcgaggaggaggccatccactcctacaccgagtacctcaaggacatcgaggccggcaagatcgagaacgtccccgcgccgccgatcgccatcgactactggcgcctccccgccggcgccacgctcaaggacgtcgtcgtcgtcgtccgcgccgacgaggcacaccaccgcgacgtcaaccacttcgcgtcggatgttcattttcaggggatggatctcaaggatatccctgccccgctcgattatcactgaagaaatcttacggcggcttgtgtcctgctcagctctgcagttgttaccaagaaacacgagttgctgttgatctgtgctaccgcagtagtagataggaagttaggaacatacatgagaaatagtatcaaataacaatgttcttatgttcacgagttgacatgatttctcgtgatccggattcatgtgtgcatggaattatgctattgaactccctaccataagatagccactgtttgtgggttaatacattgattattcagtttagcgtagactgcatcattcttggtgcattttgttctgttcgctggaaa

SEQ ID NO: 3081 - DNA, 560 bp, Festuca arundinacea
ggcacgagggaaacggtggcagcggtgccggggatggtgggcgggatgctgctccacctgcggtcgctccgtcgcttcgagcagagcggcgggtggatccgggcgctgctggaggaggcggagaacgagcggatgcacctgatgaccttcatggaggttgccgaccccaagtggtacgagcgcgcgctggtcctggccgtgcagggcgtcttcttcaacgcctacttcgtcgggtacctcctgtcccccaagttcgcgcaccgcgtcgtcggctacctcgaggaggaggccatccactcctacaccgaattcctgcgcgacctcgaggccgggaagatcgagaacgtgccggcgccgcgcatcgccatcgactactggcgcctccccgccgacgccaggctcaaggacgtcgtcaccgtcgtgcgcgccgacgaggcgcaccaccgcgacgtgaaccacttcgctgcggacatccatttccaggggctggaactcaacaagacgcctgcgccgctcggatatcactgatcagttgccgagatcagtaagaaacttagaaa

SEQ ID NO: 3082 - DNA, 975 bp, Triticum aestivum
  misc_feature (402)..(402): n is a, c, g, or t
  misc_feature (445)..(445): n is a, c, g, or t
  misc_feature (456)..(456): n is a, c, g, or t
  misc_feature (459)..(459): n is a, c, g, or t
  misc_feature (468)..(468): n is a, c, g, or t
  misc_feature (486)..(486): n is a, c, g, or t
  misc_feature (495)..(495): n is a, c, g, or t
  misc_feature (510)..(510): n is a, c, g, or t
  misc_feature (840)..(840): n is a, c, g, or t
  misc_feature (846)..(846): n is a, c, g, or t
  misc_feature (856)..(856): n is a, c, g, or t
  misc_feature (862)..(863): n is a, c, g, or t
  misc_feature (872)..(874): n is a, c, g, or t
  misc_feature (876)..(877): n is a, c, g, or t
  misc_feature (879)..(880): n is a, c, g, or t
  misc_feature (887)..(887): n is a, c, g, or t
  misc_feature (889)..(889): n is a, c, g, or t
  misc_feature (914)..(914): n is a, c, g, or t
  misc_feature (916)..(918): n is a, c, g, or t
  misc_feature (922)..(924): n is a, c, g, or t
  misc_feature (926)..(934): n is a, c, g, or t
  misc_feature (936)..(944): n is a, c, g, or t
  misc_feature (948)..(949): n is a, c, g, or t
  misc_feature (951)..(951): n is a, c, g, or t
  misc_feature (953)..(958): n is a, c, g, or t
  misc_feature (960)..(963): n is a, c, g, or t
  misc_feature (965)..(965): n is a, c, g, or t
  misc_feature (967)..(968): n is a, c, g, or t
  misc_feature (970)..(972): n is a, c, g, or t
  misc_feature (975)..(975): n is a, c, g, or t
gcagagggtgaccttggtatcacagctgatgatgacaagggagatgatgagaagcccaccatggaagaatcatcgagcctgcaaagacaagcagaactttcatgtgtcatttgctggactgatttctcttcctcgaggggcatcttaccatgtggacatcggttctgttattcatgcattcaaggatgggcggattgtctgtcttccaggggaaaggtctcaacgtgcccactttgcaaagccagtttctcctggatcagcaaggtggacgaggccggaacttcagatcagaagatatactcgcagacccccgttccctgtggagcttcaaccagcatcttcatgtttactgacgaaggccacggcgactttcctggatcatcatcgtctgctgcccaaggngcctgctacatgtgccacagccgtgagcccgaagagcttatantgagctgccangtntgccgatcncagtgggtacactcgtantgcctcgancctccactgaccccntggacgtgcatacactgccgagatctgcggaggatgtaccagcgctatcgctagtccgagttctggaattccgcgtctcgacctcttggattcttggcatcactgggctgctggagattcttggggcagatataccaatcgcaggcgtgttggcatagctggtaattaacttcagggaggaagaagcagagacaggaaaagtgatgccgtcaggctgtggcacgctttgagattgcatcttactttaatttttagcatatatgggctgtcaagggtcaacatcttgttgatctggacatagtgcaaatgcatatggtacggttgctgctnggctcnaaattgtaancggtcnngagagtagnnntnntnngaagatncntgcatgttgctagaatcttttttcntnnnaagnnngnnnnnnnnncnnnnnnnnntttnnantnnnnnntnnnncntnnannngtn

SEQ ID NO: 3083 - DNA, 1780 bp, Brachypodium distachyon
gctatcccgcggccggaaccatgccggtggaggggatggacaaggtggtcgcgacggtgagcggctaccacgccgacgagcggcacaggctcgtcaagctcatctcggagaccggcgcgagttacgtcggcgccatgagcagatcaataacccacctggtttgttggaggctcgaggggaagaagtatgacatcgcgaagaagcttgggacacgcgtcgtgagccaccggtggttccaggactgcctcaaggaagggaggcgcctccccgagggtccctacatgatggaaagtggtgaagaagcagggccagtccaagagccacccactctgccaggcaagcggtccaagagaaatgctttcatggaggatacatgtttggaagagttacctactgattgctgcaatacttcatatgctaaggatgtgctcaacattggtgattctgattctgattttgagctccagggattgttggattcatcccttttaaaagaatatgcttatcctgtgaatttactaacagagcttggtttccctgttggcttcagaattttgtcactcgtaggaatgctaagaagattgattcacgagatgtcaaacaaaaaaggaagtgttcaaagcgtgcacggaaatcaacagataaagatattctacatccgcgagacaatgcctcaagtgtcatgtccagagtcccgactactcaaggacctattaacgaccaaaactggaaataatgtctacatgtatgaagctttttgttattactatgacctcaattttttgagttatccatgcccaagtcatacttcatctcggggcatgtcaagacagaagggaaacttgtcagctctcctgcacaatgagatttctggacgcatgggtgaaagaaatgatctcatgagaaaggaatcgcaaagcaagcatgcccgttatcttacagaaatctctgatgatgatggttccactgacagcttcgaggaagtacaaatattagatattccgactacagaagctcgaacaaaaatagggaggagaaatgcttcagcatcattccgacagtctacattggacagtatatacagttttggagaaaatagttcacatgtttatgaatcagaagaaagtgaggagcaagtaaatgttgaaattggtcagagttcaagaagcttgcaacctggtgacttgtttggagatgagccacctttctgtactcaagagaaaatagatcaaagcaaccttgacattgtagctgatcatgaaaagacagatgaggagaagcctaccatggaagaatcatccaacctgcaaagacaagcagaactttcttgtgtcatttgctggaccgatttttcttccacaaggggcatcttaccgtgtggacatcggttctgttactcatgcattcaaggatgggcagattgtctgtcttctaggggaaaggtctcaacatgccctctttgcaaagcaagtttctcctggatcagcaaggtggatgaggccggcacgtcagatcaaaagatatactcgcagaccattccttgcggagcttctactgacgttttcgtgtttgctgatgatggctacgaccttccaggatcatcgtctgctcaaggagcctgctaccagtgccacagccgtgagcctgaagagcttctgctgagctgccatgtctgccggtcacggtgggtacactcttactgcctcgatcctccactgactccctggacgtgcatacattgcagagacctacggaggacgtatcagcgctatcgctagcc

SEQ ID NO: 3084 - DNA, 2089 bp, Oryza sativa
gcggaaggaggaggggaatcgcaaaaggcgcctccagaaatttctctcctctcctcttcccccaccgcgtcgccccatctcgccgccgccgccgccgccgccgccgctcgccgccggttcggagaccgcgtcactgattggcctgcctctcctcgcaccgggggtttttccagcgcccaaatctctcggcggggacctccatgccggcggtggaggggatgcgggacgtggtcgccaccgtgagcggctaccacggcgacgagcggcacaggctggtcaggctcatcgcggagaccggcgcgagctacgtcggcgccatgagcagatccatcacccacctggtgtgctggaggcttgaggggaagaagtatgacatcgcgaggaggcttcggacgcgcgtcgtcagccaccggtggttcgaggactgcctcaaggaggggaggcgcctccccgagaaaccctacatgctggaaagtggtgaagaagcagggccagtccctgagctgcccactttcccgcgttcacgatccaagagaaatgcaagcatggaggatagatgcttgaaagaattacctgatgatttctgcaatacttcatatgcgaccgatgtgcttgtggttgctgattcaggttctgattgcaatcatcagcgatggtctgattcctccctactgaaagaaaattttgttggtgatcgcgataattctaagattggtgcaacacacgtgaaggaaagaagaaaacgtttaaagcatgcacaaaattcaaccaatgaagatgcactagatgcagaagacaatatttctaggctcatggcaagacaagggcgttatgagtcaagttatacttcatctcggagcgcatcaaatcagaagggagatttgttaaagcttctgcataatgatgatgctagcatgatgagaaaaagaaatagtctcatgaaaaaggaaacaagaaccaagcttgcaggctatcttatagaaagctgtgaaaatggaagtttgacagacagcttcgatgaacctcaaatgtcggatactccgcccactgaagatcgaagaaaaataaggaagacaagactgcgacaaagtacgttggacagtatatatgattatggtgaagccagtgagcatgatcctgaaaaaagtgaggatcaagaaaattttgaattgggtgaaagttcaagaagctttcagtcaagtgattcatccagacaagaaccagctttctgtactgagaaaacaaatcaaggaagcattgacattgcagctgatgatgacaagggagatgatgagaaagccactttggaagaaccaaccagttgtcaagggcaagctgaactttcctgtgtcatttgctggactgatttttcatccacaaggggcatcttaccatgtggacaccgattttgttattcatgcattcaagaatgggcggattctctgtcttctaggggaaaagtttcgacatgtcctctgtgcaaaacaagttttgcctggatcagtaaaatagatgaggctggtacatctgatcaaaagatatactctcaaactataccttgctcaacttctaccgacactttcatatttgatgatagagtctacggcctcccagaatcaccgtctgggcaaggggcatgttaccagtgccactgtcgtgagcctgaggagcttcttctgagctgccatgtttgccggtctcaatgggtacactcgtattgtcttgatcctccattgacgccatggacgtgcatacactgcagagatcttcggatgctctatcagcgttatcgctagtctgaactctgaaacctggatattcgttgattagaggttatatatggctttcgcatttgaaatgcatcttctctgagctgatcatttgcttcaggccttgttatataggttgagaattgacaattactggcttcataattgcagtatgcaaattgttgtactaattgtgaagttgtactgtttttgggtaaatcttacgtgcccagtctaccaaattggagtactccctccagttccattttaattgacgttttggacaatgacacggtctataagatacatctttgatctta

SEQ ID NO: 3085 - DNA, 2084 bp, Triticum aestivum
gatttggtcacttgtcttgctcatcgtcagatgttgaaatatacctccacatgctatcgggtgatgaaataacggagttgctagatacaatttccagatcttttgatgcatcatccgtttcagtaaaagcattgggtttgacaataactacttttaaggttcaagaacttttgggaactttattatcaaagtcaactacagatcttcagcgcattgcaaaaggaatggtcgagacattttacaaaaacttacctctctcaagagacttagatcctcaggaaagcatgcatggagaagaactgctgtctatggctagcaatattcttgtgcagcttttttggcgtacaaggaacttagggtacttacttgaagcagttttggtgctagagtttggattgactgttcgcaagcatgtctggcaatacaagattactctggtgcatctgtactcttacttgggagctcttccgttagcacatcgatggtatgtaagcctggaggtcaaaaacattcttctagaatccgtctcacaccacatcttgccacagatgttgagttctcctttcttgcaacaaactgccagtcttgtgaaggattatcttaggttcatggatgatcatttgaaagaatctgctgatcttacctgtcttgcatataggcaccgtacttactcaaaggtaattgaatttgtgcagttcaaaaatcgcttgcaacgctccatgcagtatcttgctgtaaaatctgattctgtaatactgagtctgaagcagaagtctgagtctcttgacgaagtggagtctgttcttgaaaatgtgaatcatggaggaggcttggttgatctatcaagtgaagacaacatgaaacatttaacttttaatgaagatctcgaggcacgcccttggtggacaccaacaaccagtgtaaattttctttcagaaccaattgatgaaagttcgacacctgcgtgctttagggccaaagtgtgcaagcacaaatctactgagaaggatggccctaagatgagagatgctgagagaaaatgtcttgtcccccggcttgtttacctttccatgcatggttgtgtatcttccctcagggagactgagcccaacgggtctgtttctgatataactgttggggaaatgaaaaccttacttgagaaatatgctaggactattggctattccatggatgatgctctaagcatgattcttggtatatcttcaggcaagaagtctatgaaggattttgctcctgatattgtgagctggatgagttttgctgtatttattaatgcaatgaacttgtggtcaaatgaatcagtgatccccagaactgatccgagcagcccaagttcttgggagattgtggacagcttagtgaaaatttgcatagaggagcacctgactgatgccaatcgaatcctgacttgtcctggaaataaaattccactgttagttcagatggttacagaacccatttcttggcatctcatcataatccagtcctgcatgagagtggtggccccgcaaggaaagaagaaaaagaaaagcggcccatcggtgcgaccaaacatgcctcagttgcaaggaattcaaagatctgttcagtgcttgattgaaacactccgaagtgtccaaaaatggttatctgatcagatgagtccagaggagcaaggtttggatatcttaatgtcatatttgcaaggaactggcgatgaaggcccaggacagacattcagagtcttggaagagaaaccaattgcacatgcctctgagcttggtgatcgaattgctcagtctctggaagcatggagttctactggcgtggtaagaagaattgttggagcagaacatgaggtgctagccgagttcaagaaaatggttgactctaaactcaagctgctcatgtcagaatcggcttctctatcttcgatgttacactagagttgatgaaattttgcacatgaattttgttctattcttgttgtggcattccattatacatatgttgtaacagtataacagaatggctgtgcgcttttgttgtttgacttgcttttattcgattgaggacatcttttt

SEQ ID NO: 3086 - DNA, 1581 bp, Pseudoroegneria spicata
  misc_feature (460)..(460): n is a, c, g, or t
ttgaaagaatctgctgatcttacctgtcttgcatataggcaccgtacttactcaaaggtaattgaatttgtgcagttcaaaaatcgcttgcaacgctccatgcagtatcttgctgtaaaatctgattctgtaatactgagtctgaagcagaagtctgagtctcttgaggaagtggagtctgttcttgaaaatgtgaatcatggagggggcttggttgatctatcaagtgaagacaacatgaaacatttaacttttaatgaagatctcgaggcacgcccttggtggacaccaacaaccagtgtaaattttctttcagaaccaattgatggaagttcgacacctgcgtgctttagggccaaagtgtgcaagcacaaatctactgagaaggatggccctaagatgagagatgctgagagaaaatgtcttgtcccccggcttgtttacctttccatgcatggtngtgtatcttccctcagggagactgagcccaacgggtctgtttctgatatcactgttggggaaatgaaaaccttacttgagaaatatgctaggactattggctattccatggatgatgctctaagcatgattcttggtatatcttcaggcaagaagtctatgaaggattttgctcctgatattgtgagctggatgagttttgctgtatttattaatgcaatgaacttgtggtcaaatgaatcagtgatccccagaactgatccgagcagcccaagttcttgggagattgtggacagcttagtgaaaatttgcatagaggagcacctaactgatgccaatcgaatcctgacttgtcctggaaataaaattccactgttagtgcagatggttacagaacccatttcttggcatctcatcataatccagtcttgcatgagagtggtggccccgcaaggaaagaagaaaaagaaaagcggcccatcgctgcgaccaaacatgcctcagttgcaaggaattcaaaggtctgttcagtgcttgattgaaacactccgaagtgtccaaaaatggttatctgatcagatgagtccagaggagcaaggtttggatatcttaatgtcatatttgcaaggaactgaaggcccaggacagacattcagagtcttggaagagaaaccagcagcacatgcctctgagctaggtgatcgaattgctcagtctctggaagcatggagttctactggtgtggtaagaagaattgttggagcagaacatgaggtgctagctgagttcaagaaaatggtcgactctaaactcaagctgctcatgtcagaatcggcttctctatcttcggtgttacactagagttgatgaaattttgcacatgaattttgttctattcttgttgtggcgtttcattatacatatgttgtaacagtataacagaatggctgtgcgctgttcgttgtttgacttgcttttattcgattgaggacatcttttttccctttgctttcgtgtctccgctcctgatttggtattgtggtatagttgttgtattactccaatttgatttggtgcaataagacgatacatgccatttttgttggcgatttgttgagcaca

SEQ ID NO: 3087 - DNA, 1093 bp, Triticum aestivum
tttttcttcgctataacaaaacagtggtggagaaagtcccttctttgaaaggaggtggagcatattggtttactgatttgacaactcctgatgaactttacatcctcccagtgttgacatcagtgacattcttggctacggtggagctcaatatgcaagaaggtatggagggaaatcctatgctgcaaacgatgaagaagttctctagaatattggctcttatgactataccatttacaatgcactttcccaaggcaattttctgttactgggtaacggcaaacttgttctctcttgggtatggttttgctctccggaagacagccgtaaggtatttcttgaatcttccagaggttgtaccacagcccgaagctgcgcaagtgtcgaccttcaaccttttcgaggcaccaaagccagtgtcagcagttgatacacccactggaaacaacggtgattcacccactggagacaacggtgattcacccaccgcagccaacgggtcagagcagtctaatgctgagctaagcgatcgggttgtgtttcttgagaagaagattgcagaacttgagaggcgggctaaagctagaggcgaatctcaagagtaataagctaacaggtaagttttgatcgagcacgtgaatcctatcctaaagaagcactgtttgtaacctctgtctggtggcgaagggatatctggcaccgacttacccatatagcaccaagatttgacttggactatccaattttgtgagcatgtgtgtgtggcaactgttgtttcgagcgaataaaccggagggatcctggcagataaaatcgccagtgtttgttggattaaccgcagtgatgctggccgagcagagaccagagggtacttttattcttgtatcacttgcttgacatttgagaatggaacgatgtaatagtattagcttttagtttgcgatcaagataaaacgaggctgtcgaaaacatatggcgggaccgtcgattcctgttacattgtttgatgataaagtgactaagtaataccctgttattctgagacagattcttctctagctcgtgcttataaacgtcttatctaaaaaaaaaa

SEQ ID NO: 3088 - DNA, 809 bp, Triticum aestivum
attgcagatgcagcactattgttgattgagatggccggcaataacaatgtgaaggagaaactgaggaagcttcctttgttgtccctgcgaagatcacccaaagattgtaccctccttgaatccagaatcttgcccaatggacaagaatcggttgaaagcgcaacacagaagctggaagcgttcaagttgcagttgagaaaaacagataatgcgagtttagctgaaaatggaactgaggggacgctcaacacaagcatgccagagaaacgtaataggtggtctatagcgaagtcctggaccccctgtccgctaggaatgataccatgttcatatagttcaactgctgttctgccggtccttgatgtcattgatgatgaactgaagcatgacacagcagaacatgaaaattttgagcctgatggtcaaatcgaaattttcgactgctattctcaaccggagcagcagttggatggtgaaggcatcctagaaatatcaagattaccacctgaacatgggatttctgatatgccagaatcgacctttggtctcaggggtacattactggttggtggcgtgtggaaaaaggtgaccgaagaagagttgctctccataaagtcaagcatgaaaattttgttgtaatattggctagttaatctcccttcagcagtaaattagttttcttctttatgcgcaaaaaaaagttagttttcttctgaacaatcaaacagtactacagcttttactggggcatgacaaaaccctctttaatcagttgtgctcagtttcttcactatttgagataaaaaaaa

SEQ ID NO: 3089 - DNA, 790 bp, Brachypodium distachyon
attgcagatgcagcactattgttgattgagatggccggcaataacaatgtgaaggagaaactgaggaagcttcctttgttgtccctgcgaagatcacccaaagattgtaccctccttgaatccagaatcttgtccaatggacaagaatcggttgaaagtgcaacacagaagctggaagcgttcaagttgcagttgagaaaaacagataatgtgaatttagctgaaaatggaactcaggggacgctcaacacaagcatgccagagaaacgtaataggtggtctatagcgaagtcctggaccccctgtccgctaggaatgataccatgttcatatagttcaactgctgttcttcctgtccttgatgtcattgatgatgaactgaagcatgatacagcagaacatgaaaattttgaacctgatggtcaaatcgaaatttttgactgttattctcaacccgaacagcatttggatggtgaaggtatcctagaaatatcaagattaccacctgaacatgggatttctgatatgccagaattgacctttggtctcaggggtacattactagttgatggcttgtggaaaaaggtgaccgaggaagagttgctctctatgaagtcaaacatgacaattttgttgtactattggctagtttaattctcccctcattagtaaaatatttttcttctgtgaacgatcaaatgttagctttttactggggcatgacaaaaccctctttaatcagttttgctcagtttcttcattatttgagataaaaaaaattttattcgtt

SEQ ID NO: 3090 - DNA, 1033 bp, Triticum aestivum
aagatatcgatgtacggatgcttggatctggtcgtccatttctaattgaagtcctgaatgtgcgatcaattccatctgcgattgaaattcaacaaatttctgacaagattaatagctccgaaaagaaacatgtcagaatcagaaatctcaagttggtagacaatgaaatatgggccatgatgcgtgaaggggaagcggagaagcagaagcagtatgctgccctcatatggacttctagtcctctgacggatgatgacctgcagaaaatttctgttattaatgatatggaaattgtacaaaatacccccataagggttcttcatcgaagaagcccgttggagcggaaacggattatacattggatggagattgagaaagttgaaggcagctcaaactattacttgttgcatctatgcactcaggcaggaacgtacattaaggagtttgtgcacggtgatcttggacgcacaaatccgagtatcggttccatgctacgttgcagagccgagatactgcaactcgatgtcacggacgttaagatggacttgctgcaatagtatgcagctgccacatgataccatttggggcaattactttggtagtggaggcgctctgataagccaagattcccgcggaagactatgccgttggcaagtgctctaggaacggcgaattgtttttctcatggagtgcgtaacttgatgtcaattgtaaaatgtacaccagccaggggaacccagcaacaattttgagaaattggggggaatttggccccatttggctccaacgtttaccttttcccagagcaacaatttagagaaaattgagaaactgaaccattcggtcccaatgccttatctgttttgccaccacgtgtcgttgtgctgctaaacaatcatattcccctcgagaggaagtactagatgatattcaatgagcagcatcacatggacgacaggaaaatttgatatcgagaatttactgcagtgaggctgatactcagtttttaatgtactttgtttttccatttcta

SEQ ID NO: 3091 - DNA, 664 bp, Triticum aestivum
cgaagaagcccgttggagcggaaacggattatacattggatggagattgagaaagttgaaggcagctcaaactattacttgttgcatctctgcactcaggcaggaacatacattaaggagtttgtgcacggtgatcttggacgcacaaatccgagtattggttccatgctacgttgcagagccgagatactgcaactcgatgtcacggacgttaagatggacttgctgcaatagtatgctgctgccacatgataccatttggggcaattatattggtagaagaggcgcgctgataagccaagattcccgcgggaaccgctggcaagtgcgctaggaatgacgaatcgtttttcttttcatcgagtgtgtaactggatgtcaattggaaaatgtacagcagccaggggaaaccagcaacaattttgagaaactggggggaatttggccccgttcagctccaatgtttgcctgtgcccagcaacaatttagagaaagttgagaaactgaaccattcggccccaatgctttatctgttttgccaccacgtgttgttgtgctgctaaacatttgtattcccagatttttttgacggagctacggcgggcttacgccggcctgaaccatttcagatgatattcattgagcagcatcacatggacgacag

SEQ ID NO: 3092 - DNA, 712 bp, Triticum aestivum
cttcaccgaagaagcccgttggagcggaaacggattatacattggatggagattgagaaagttgaaggcagctcaaactattacttgttgcatctctgcactcaggcaggaacatacattaaggagtttgtgcacggtgatcttggacgcacaaatccgagtattggttccatgctacgttgcagagccgagatactgcaactcgatgtcacggacgttaagatggacttgctgcaatagtatgctgctgccacatgataccatttggggcaattatattggtagaagaggcgcgctgataagccaagattcccgcgggaaccgctggcaagtgcgctaggaatgacgaatcgtttttcttttcatcgagtgtgtaactggatgtcaattggaaaatgtacagcagccaggggaaaccagcaacaattttgagaaactggggggaatttggccccgttcagctccaatgtttgcctgtgcccagcaacaatttagagaaagttgagaaactgaaccattcggccccaatgctttatctgttttgccaccacgtgttgttgtgctgctaaacatttgtattcccagatttttttgacggagctacggcgggcttacgccggcctgaaccatttcagatatattcattagcagcatcacatggacgacagaacaaatttgatattgagaatttactgcagtgaggctgatactc

SEQ ID NO: 3093 - DNA, 1305 bp, Avena sativa
gtaaaagaaaaacagagtcgagagaaggaaatgatactagaagaaattcaacatatgatgacaaacagatattaagagaaacagattcattcatccacaagacccttgagggtattaaagatcaagagttctgcagtttatttcagttgcctcctgaaaaggtgttcaaaccttgccatcttgtgatatcctgcctaaggtcacccatatatattggcggaagatacttgaagctttcaagaaatgttagtcagtcatgttggataattgatgatgaaagaatgggggaagcatcagttgaggagataattggggagaatgtccgtgccatctgcaaaggtgatgggtacaagttccacgccgctggaagagaagatatcgatgtacggatgcttggatctggtcgaccatttctgattgaagtcttgaatgtgcgatctatcccatctgcggttgacgttcaacaaattgctgagaatataaatagctccgaaaagaaatacgtcagagttcgaaatctcaagttggtagacaatgagatatgggccatgatgcgtgaaggagaagcggagaagcagaagcagtacgctgccctcatatggacttctagtcctctgacggatgatgacctgcagaagatttctgctgttaaggatatggaaattatacaaaataccccaataagggttcttcatcgaagaagcccattagagcggaaacggattatacattggatggagattgagaaagttgagggcagctcaaactattgcctgttgcatctgtgcactcaggctggaacatacattaaagagtttgtgcatggcgatctcggccgcacgaatccgagtattggtgccatgttaggttgcagagccgagatactgcaactcgatgtcactgatgttaagatggacttactgcagtaatgtgctactgccacaaggtatcgttccttgccagtttggcagaggaggcgtactgataagccaagattcccgtggaagatgtatgccggtagcaaatgcgctaaagaatgacaggctgtttcttttcatcgagtgcgtatcaattggaaaatgtacaccaaccaagcaggcgaccagaaacagttttgagagaattggggaatttgaccccacttgactccaatgttttctttttcccagcatcagtttttgtgagaattgaggaattggccccttcagctccaatgtgtatctcctctgtcactttgtgttgtactaaacaatcatactccccacaagagagtgatagatatatatggtagattttaatcttgcg

SEQ ID NO: 3094 - DNA, 774 bp, Setaria italica
gaacgttcgttccatcccatctgaaattgaagttcaacaaattgaagacagaattaacaactctgaaaagaaatatgtcagagtccgaaatctcaagttggtaggcaatgaaatatggacaatgatgcgtgaaggggaatcagagaaacagaagcaatatactgcccttatatggacttctcgtgaattggcggaaaatgatctacataatatatctgttacgaaggatatggaaattgtacagaagaccccaataagagtacttcaccgtagaagcccattagagcggaaacgtattatacactggatggagattgagaaagtcaaaggcagctcaaactattacttgttgcatctatgcacgcaggctggaacatacatcaaggaattcgtgcacggcgatcttggacgcacgcaccccagtatcggagccatatttgggtgcagagctgagattttgcaactcgacgtcactgatgttaagatggacttcctccaataggccatgctcaattagcggatggctctcgcgggtgcccctgcaatctacactaacaggtcgccacccctgcagtcttctgcagataatgaggcaatgcagcattgagaagcggctccaaaatatgttccgctcgctgcccgtacaagctcggctatatttttttactcctgcgttgttgagaaactcaacatgttattccttgtgctgttgtacaatggcattatatgtacattgagtaacactgcgcaatgcacgactttatcttttttttt

SEQ ID NO: 3095 - DNA, 1911 bp, Sorghum bicolor
cggaggccagtgcatcggcggaggcggaggctaggagcatccttgaacgcgcagcggagtcttccttcccgccgctgcacgccgtccaccacctcctttccgtcggggtctgtgtgcgctgcatcctgcgcctgcttggagcctatagcagtgcctgctcatatgcatctcttacggcatcagttttgcattcgtttcttgaagaacacgacgattccatgaaaggagattcctgtccatgtctgtcgatgaatgatgcatattgctctgtctgcttgggagtattgctgccagccttccatcgagatgaaggtctggaaacacctaatggcatttctcatattgacaacatctcttcaatgatatctcaagtagtgcaaagggagggttaccaagttgatgagttttctctagaaatttcactaccgccggttatagccgctaatgagcgtgcaattagattatatatgaaacaaaaatatgtcaacgagaattggttcaaggacaaaatgtttccacaacaaacaatttcagtgaaggaagccttgcgacttttgatagcaccatcactcgagaaactaacgaatgcaaaacatggtaacaattcatttagaattcgcttagcatatactcacggtgatgcttcacaaaagcttcatagtttactgccgaatgagcacagccgtaaaaggaaaacagattcaagaaatggaggtgatacttcaaatgaggcccataaaaggaattcagcagatggcaacaataaacaatcaagtgaatcagattcattcatctacaagactcttgagggcatccaagatcaagaattctgtaatgtatttcaattgcctcctgaaaaggtgttcaaaccctgccatcttgtaatatcatgcttgaggtcacctatatttcttggtggaagatatttgaagctttcaaggaatgtcagtcagtcatgttggataatagatgatgagagaatgggtgaagcttcagttgaggagatagttggggagaatgttcgtgccatctgcagaggtgatagctgcaagttccatgctgctgggagagaagacattgatgtacggatgcttggatctggtcgtccatttctagttgaagtattgaatgttcgatccattccatctgaaactgaagttcaacaaattgaagagagaatcaacaactctgaaaagaaatatgtcagaattcgaaatctcaagttggtaggtaatgaaatatggaccatgatgcgtgaaggagaagcagagaaacagaagcagtatactgcccttatatggacttctcgtgatctgacagaggatgatctgcataatatttctattacgaaggatatggaaattgtacagaagaccccaataagagtacttcatcgtagaagcccattagagcggaagcgcattatacactggatggagattgagaaagttgcaggcagctcaacttactacttgctgcatctatgcacacaggctggaacatacatcaaagaatttgtgcatggtgatcttggacgcacgcaccccagcatcggagccatcctagggtgcagagctgagatattgcaactcgatgtcactgatgttaagatggacttcctccagtagccggacctttagctgtttagcatgtctggcgtgcagtccctatgcctgcagaatgcagatgatgaggtagcggcgtagcgcggcaatgacgagctcagaagaacgctaatcttttctctctactccccgaacaacctcgtggcaaattctgcatacctacatttttgctaagcgaacctagcttatccagtcacccaagtcaagtcctctccaactcaaacttttggtgtatattttcttaatgaaaacccgtctagtttatgatcacatttttccctacctt

SEQ ID NO: 3096 - DNA, 773 bp, Panicum virgatum
  misc_feature (295)..(295): n is a, c, g, or t
  misc_feature (315)..(315): n is a, c, g, or t
  misc_feature (357)..(357): n is a, c, g, or t
  misc_feature (366)..(366): n is a, c, g, or t
  misc_feature (369)..(369): n is a, c, g, or t
  misc_feature (400)..(400): n is a, c, g, or t
  misc_feature (468)..(468): n is a, c, g, or t
  misc_feature (513)..(513): n is a, c, g, or t
  misc_feature (543)..(543): n is a, c, g, or t
  misc_feature (546)..(546): n is a, c, g, or t
  misc_feature (551)..(551): n is a, c, g, or t
  misc_feature (553)..(553): n is a, c, g, or t
  misc_feature (558)..(558): n is a, c, g, or t
  misc_feature (564)..(564): n is a, c, g, or t
  misc_feature (574)..(574): n is a, c, g, or t
  misc_feature (597)..(597): n is a, c, g, or t
  misc_feature (599)..(599): n is a, c, g, or t
  misc_feature (613)..(613): n is a, c, g, or t
  misc_feature (615)..(615): n is a, c, g, or t
  misc_feature (630)..(630): n is a, c, g, or t
  misc_feature (637)..(637): n is a, c, g, or t
  misc_feature (646)..(646): n is a, c, g, or t
  misc_feature (676)..(676): n is a, c, g, or t
  misc_feature (680)..(680): n is a, c, g, or t
  misc_feature (689)..(689): n is a, c, g, or t
  misc_feature (706)..(706): n is a, c, g, or t
  misc_feature (751)..(751): n is a, c, g, or t
  misc_feature (753)..(753): n is a, c, g, or t
agtacggatgcttggatctggtcgtccatttcttgtgaattattgaatgttcggtccatcccatctgaaatcgaagttcaacaaattgaagacagaattaacaactctgaaacgaaatatgtcagagttcgaaatctcaagttggttggcaatgaaatatggtcaatgatgcgtgaaggagaagcagagaaacagaagcaatatgctgcccttatatggacttctcgtgaattggcggaaaatgatctgcataatatttctgttacaaaggagatggaaattgtacagaagaccncaataagagtacttcatcgnagaagcccattagagcgaaaacgtattatacactggatgganattgagaangtngctggcggctcaaactattacttgttgcaantatgcacccaggctggaacatacatcaaggaattcgtgcacggtgatcttggacgcacgcaccccagnatcggcaccatattaggttgcagagctgagattttgcaactcgangtcactgatgttaagatggacttcctccantanaagcncntgctnaagtanccatgcaatncggcatttacaagcacaggagcnanggtgccaaatctgntntgttcgttgcccgtncaagctnggctatatnatgttggagatgtacaacagaattatatgnacantgagtaacnctggcaatgcacgactnttgtcatgtaatgctgttaaactaatccgataatctccaaattgnantattgatgtcctgcttggtc

SEQ ID NO: 3097 - DNA, 2349 bp, Zea mays
gctcggcgcctctgcctcggccgctccccgttcccgtcaccgcgccgccggccgccaggatcgcccgccccaccatcctggctcatcagtcctcgccgcgagcccgtgcctggaacgccgcttgcgctaccacgccgcggtcccacgcccgctcccgttccagcgacagggggttactgggacgagatcaaccgtaacctgactgactcactgacggccttgcactctcagcaaaaccgtggcacaagtgggcaccggggaatcagctaggatttaagcttgagccttcgctccaaacctccatggaggcggaggccaggaacatccttgaacgcgccgcggagtcttccttcccaccgctgcacgccgtccaccacctcctttccgtcggggtctgtgtgcgttgcatccttcgcctgcttggagcctatagcagtgcctgctcatatgcatgtcttacggcatcagttttgcattcgttccttgaagaacacgatgagtccataaaaggagggtcatgtccatgtctatcgatgaatgatgcatattgctctgtctgcttgggagtattgctcccaaccttccatcgagatgaaggtctggagacacctaatggcatttctcatattgacaacatgtcttcagtaatatctcaagcagtgcacggggagagttaccaagttgatgagttttctctagaaatttcactaccgccggttatagccgccaatgagcgtgcagttagattatatatgaaacaaaaatatggcaatgagaattggttcaaggacaaaatgtttgcacaacaaacaatgtcagtgaaggaagccttgcgacttttgatagcaccatcactcgagaaactaatgaatgctaaacatggtaacaattcatttagaatccgcttaacatatactcatggtgatgcttcacaaaagcttcatagtttattgccaaatgagcacagccgtaaaaggaaaccagattcaagaaaaggaggtgatgcttcgaatgaggcccataaaaggaattcagcagatggcaaccctatacaaacaagtgaatcagattcattcatctacaagagtcttgagggcatccaagatcaagaattctgtaatgcatttcagttgcctcctgaaaaggtgtttaaaccctgccatcttttaatatcgtgcttgagatcacctacatatcttggtggaagatatttgaagctttcaaggaacgtcagtcagtcatgttggataatagatgatgagagaatgggtgaagcttcagttgaggagataattggggagaatgttcgtgccatctgcagaggtgatagctgcaagttccatgctgctgggagagaagacattgatgtacggatgcttggatctggtcgtccatttctagttgaagtactgaatgttcgatccattccatctgaaactgaagttcaacaaattgaagagagaattaacaactctgaaaagaaatatgtcatagttcgaaatctcaagttggtagataatgaaatatggaccatgatgcgtgaaggagaagcagagaaacagaagcagtacactgcccttatatggacttctcgtgatctgacagatgatgatcttcataatatttctattatgaaggaaatggaaattgtacagaagaccccaataagagtacttcatcgtagaagccccttagagcggaagcgcatcatacactggatggagattgagaaaatcacaggcagctcaaactactacttgctccatctatgcacacaggctggaacatacatcaaggaatttgtgcatggtgatcttggacgcacgcatcccagcatcggagccataatagggtgcagagctgagatattgcaactcgatgtcactgatgttaagatggactttctcccgtagccggaccttcagctgtttatagcatggatagcatgcagtcccaactcctgcagatgatgaggtggtgcgggataacgagctcagaagaacctcatggcagattctgcacggtgcacgcctacatttttgctaaccgagccaagctcaactggtttggtggaaggtgtaatcatatatccagtccccgaagtcttctccaactcaaaacttggggggcgtctattttcctctaatactaacattttcgctagatcctggtcacattttcgctacctttttcttcaaagaaagaaacatttttcccaggtagattgaagtgcaactcccatagtaacatttttgtctacattgtggagaagatcatcccaactcatttggatccattgttatgccttaggttgttgtgcaatgaaattttatgtactttctccgttcc

SEQ ID NO: 3098 - DNA, 2025 bp, Oryza sativa
ggaggtctctctctccataggactagtctgaactagaggggattaactagggtttaatcaaccgcgtcgaggaccatggcggccgcagcggaggtggatgcggaggcgaggagcatcctcgaacgcgcagcggcgtcctccttcccaccgctccacgccatccaccacctcctctccgtcggggtctgtgtgcggtgcatctttcggttctttggagcctttagttatgcagcaccatgcctttctcttacggcatcagttctgcattcgtttcttgaagagcatgacgattccgcaaaaagtgggtcttgttcatgtttgtcaaaagatgaggcgtactgctctatttgctttggagtgttactgcccacctgctatcaagatgatggtgtagaaccactccgtagtgtttctcctatcgataatgttacttcaattatatctgaagcagtccagagagagggtcaccaagtcgatgagttctccctagaaatttcactgcctgcagttatagcagctaatgatcgtgccattaggttatatatgaaagagaaatatggcagtgcaaattggttcgatgaaaaaatattttctcaacagacaatgtcagtgaaggaggccttgagaatattgctagtaccgtcagtagaaaaacaaatgaatgtgaaacatggtaataattcatttcgaattcgcttaacttatactcatgatgaaggttcacaaaagcttctaaggcttctgccaaatgaccgtggtcgtaaaagaaaaacagaatcaagagatggaagcagtaaaaggggctcaacagatgatgataaacaaatattaagtgaatcagatgcattcatcaacaagaaccttgaaggcattcaagatcaagacttccgtagtttatttcaattgccacctgaaaaggtgttagaaccctgccatcttgtgatatcttgccaacggtcacccatatatattggtggaagatacttgaagctttcaaggaatgtcagccagtcatgttggataattgatgatgagagaatgggggaagcatcagttgaggagataattggggagaatgtccgtgccatctgcaaaggtgatggctataagttccatgctgctggaagagaagatattgatgttcggatgcttggatctggtcgtccattcttagttgaagtcttgaatgtgcgatctattccatctgctactgaagttcaacaaatagcagataagattaatgactctgaaaagaaacatgtcagggttagaaatctcaagctggtaggcagtgaaatatggacaatgatgcgggaaggagaagcagagaagcagaagcagtatgctgccctcatatggacgtctcgccctctgacggatgatgacctacataatatttctcttatcaaagatatggaaattgtacaaaagacgccaataagagtcttacatcgtagaagtccattagagagaaaacggattatacactggatggagattgcaaaaatttctggcgggtcaaactattacctgttgcatctatgcactcaagctgggacatacataaaggagtttgtgcacggagatcttggacgcacacacccaagtgttggcgtcatgttaagctgcagagctgagatactgcaactcgatgtcactgacgttaagatggacttcctgcagtaatatgctattgtcatattgtatcatgctcagttcgtatcattggttattggtgttgtacactatctgtactgatgaaatgcgcagcctgcagaagaccacaaggcaagttcagaaaatatgtcattttactatagtataaccttctgatgagaggctatttgagaaattgagctcagtctgctccaatgtcaacttacagctatgtattatgagccacagttttgccaaaaaaaacatcatgcttatactggcttagggcctgtttaggaagcttatagctgctccaatgttaacttacagctatatattatgagccacagttttgccaaaaaaaaaaaa

SEQ ID NO: 3099 - DNA, 595 bp, Pennisetum glaucum
gatgcttggatctggtcgtccatttctagttgaactcttgaatgttcgttccataccatctgaaattgaagttcaacaaattgaagacagaattaacagctctgaaaagaaatatgtcagagtccgaaatctcaagttggtaggcaatgaaatatggacaatgatgcgtgaaggagaatcagagaaacagaagcaatatactgcccttatatggacttctcgtgagttggcagaaaatgatctacataatatttctgctatgaaggatatggaaattgtacagaagaccccaataagagtacttcaccgtagaagcccattagagcggaaacgtattatacactggatggagattgagagagtcgcaagcgactcatactattacttgctgcatctatgcacacaggctggaacatacatcaaggaattcgtgcacggtgatcttggacgcacgcagccaagtatcggagccatattggggtgcagagctgagattttacagctcgacgtcactgacgttaagatggacttcctccagtaggccatgcttcaggtggccaccctgcagtctgcagatgacgaggcaatgcagtat

SEQ ID NO: 3100 - DNA, 1673 bp, Cucumis sativus
atgtttgatcgttactttgcttgcaggtatgcatcccctgcatcattcgcctatctggcattgaaaggcacagttattccttttcattgtcagcaccaatcctaggttctgataacgaggcaattgatgatgctaatgataggaacacttgctgtctatgtttaggtattttacagttcagttacattgatgataaaggtgactttataaaatgtaaaggagttgatgatttagctgtctcgatttctgagatggtaaagaaagagggccatcagattgatagcttttctcttgaggtgtcagttccttcaatcattctggagaatgagaagcgtgtttggctgtatttgaaaagaaaatatgggtctgaacagtggtttcaaggcaagcctcctcctatatgtctttcagcgaaggatgccttaaaaatctgtataacaaagcctcttgaaactttactggattgcaagtctagttcaagtggcttgcgcatccggttaacttatagtcatcctaaagcttcaaatagcaatggtaattccatcaaaagaaaccaggatggcttcaagatgagaaaaatcggttaatttttgttacatattttattggttactaatggtggtactctctgtttctcgtcaattctacgtagatcaaagaaccatgccatttggctttaacttgttatagaacttcgatatacatagttggcagatatataaagtattcaagaaatgtgagtcagacacgttgggtaattggtgaagagagaatgggagaagcatctgtcgaggagattttaggcaacaatattcttcccttctgtcgtggtgatagttacaagtttcatgctgccggtagagaggatctcgatgttcgaatgttgggttcaggtagacctttcttggttgagatacagaacgcacgtcttctcccatctgagatgattataaatgaaatacagtcgaagataaatagttcagaaaataaattgattggcgtaagaaatctgaaagtcgtaggcagcgagggttgggccctggttcaagaaggagaagcagagaagcagaaacaatatgctgcacttgtgtggacatctcgcccactcgaggatgctgatcttttatcaatatcatcactcaaagacttgaaaattttgcaaagaactccaataagagtgcttcatcgccgaagtccattagaacgtgaaaagatcatccactggatgaagattgagaaggttgctgaaagttctcagtattatctcctacatttgtgtacccaggctggaacatacattaaagaattcgtccatggggatcttggtcggactcatcccagtataggatccattcttagttgccgagccgagattctgcaacttgacgttacggatataaaaatggactgtcatttgggtgaataaaagaaaggttagatcaaggttcattgatagaagaaggagaaggatgattccatattagttagttttcgtttcatcacttcactttggtgcccttctactcctccctcaatttggtaatttcaaatagatttatttgatttggtaattttaaaatttgattaacctaaacttttattttccccgtgattcattgttggaggcgtattgaatttacaagttataaagggtaaggtcaaaacgtactttc

SEQ ID NO: 3101 - DNA, 857 bp, Curcuma longa
ggatgttaggatctgaacgaccttttcttatgaaaattgcaaattcacgccacattccatccaaggttgacattgggctaatttctgaaaagataaacaacaatgatcaaaatcatgtcagggtgagaaatcttagtctgattggtaatgaggcatggacccttatgcgtgaaggagaagcagagaagcagaagcaatatgctgccctagtctggatttctcgctcactgactgatggtgacatgcagaacatttcatctttaaaggacttggacatcatacaaaggaccccgatcagggtgcttcaccgccgaagcccattagagcgcaatcgtatcatacattggatgttgattgagaaaacttccagtagttcccagtattttctgctacatctttgtacacaggcaggaacttatataaaggaattcgttcatggggatcttggacgaacacatcccagcatcggttccatcttaggatgcagagcagagatactgcagctggacgtcacagacgtgaaaatggacatatttaattgatttatctgttttatgctactgcagctcaatttctaacacacttccagagatcacgtcgcatgtcttcagcatccagtggaagttgaaactccattttaccaagtcagaatggattccagagatcaacaataactcgacattttcctccaaatatcatcttttaagattgtataatcccagtttttttgccttcagattagttgcagtttggttagctttgattagaagaatgttaaatattgtgccgtaatgttctcaatcactaaatagattatatggactatattttgtatttttctgttatttaatagaacc

SEQ ID NO: 3102 - DNA, 1963 bp, Populus trichocarpa
aatccagagagcggagagtagcgaaagtgagactgccgccaagagaagaaagagctcgtttaaaatgtctagcgagactgaagctgcgcaatttagcaacggcaccgatgcggtgcaagttatctctccaaacgatgatcaccgcgtcacccccggcgacgatgagagacggcacctcaacgacgccgttcgttctttgccttctcacgctgtcaaagacctgctctccgctgggggagattcaagtagttctgaatctatggaatcagaactcaaacccgaagtgtgcagaatttgtttaggtatcttacaatttatttatcgcgatgaaaaagaaatgctggtgaaaagaaagaatggtgatgagttagctgcatcaattgctgagctaataaggcaagaaggacatcaaattgatggtttttctcttgaagtttcaataccgcctattatcttcgaaaatgaacaagctgttagattgtacatgaaaaagaagtatggatcggagctttggttccaagaaaggctttctgaatgcatttctacaaaggatgccttgaagtttgcgattgtgaatccccttgaaataatattggatgttaaatctggcccaagctatgtccgcatccgtttgacatacactgaaacgaagccatcaatcataccttcgaaatcagtagacaggaatggggggacaaacaatggtttggatactgttcatgttgagttagtggggaatggaactggttgttgtgatttatcattgggtcaaggaagtcctgcctctggaaggtcttctactggtttggctgaacatgaatcttctgaatgctccaacttccctctagagagggtcaatgaaccctgccacttggttttcctatgctacaggacacctatctattttggtgggagatatctgaagttctctagaaatgtgagtcaaactcgttggatcattgatgatgaaagaatgggagaagcatccattgaggagataataggtggcaacattcttccaatgtgtcaaggtgacagttacaagtttcatgctgctggtagagaggatatcgatgttcggatgttgggttcaggcaggcctttcctggtagaggtacaaaatgcacgcgaggtcccatctgaggctctggtaaaagaaatagaaacaaggatgaataacttggggaataaattggtaggggtgaaaaatcttagtctagtaaccagtcatagctgggacttgatgcgtgaaggggaagcagaaaagcagaagcaatattctgcactggtatggatttcacgaccacttgaggatgaagacttgcagtgtatagcttcacacaaagatttgcaaattttgcagagaaccccagtaagggtgcttcaccgccggagtccgctagaacgcgggaagattatacattggatgaaaattgagcagatcactggtagctctcaatattttcttttgcatctatgtacccaggctggcacgtatatcaaagaatttgttcacggggatctaggacgtacgcatccaagcattggatcgattctaagatgcagagcagagatactacaacttgatgttaccgacgtgaaaatggattgttttttggctgaataagattcttgcgtttattttgaggttttttaattgactattttctgatttgcaatattttggaaatatctttatcttaagttatgagtgcctgggtcttgtttattccgtgcccgtccatgcaacatgcagtggtcatctcttatgagtttattgctctatccctggcccgattgagagtttgcaagagtgactcgggtgaatttaaaaggtcattctaagttcatttttaagctgaaacgatgtgtctcattgggttttggttgggtcttaaattgacttgattgagtcaacttccaacttatggcggttaacttgtatatcactggttctatttca

SEQ ID NO: 3103 - DNA, 436 bp, Cucurbita pepo
atcactcaaagacctgaaaattttgcagtagaactccaattaagagtgcttcatcgccgtagtccattagaacgtgaaaagatcatccactggatgaggattgagaaggtagctgaaagttctcagtattatctcctgcatttgtgtacccaggctggaacgtacattaaagaatttgtccatggagatcttggtcgcacgcatcccagtataggatctattcttagttgcagagcagagattcttcagcttgacgttacggatataaaaatggacggccatctcgctgaataaaaaggttcattaatgggagcatgattcgagattgtattcgagtcatcactcagaattcggtgctcaagtgctcacatggacgaaatggtaatttaatttttagaaaatagtatttattcgtctttgataatttaaatagtac

SEQ ID NO: 3104 - DNA, 681 bp, Catharanthus roseus
taataggtggcaacattcttcctttgtgccaaggtgacagttacaagtttcatgctgctggcagagaggatatagatgtccgaatgttgggtacaggacgcccgtttctggtcgagatacagaatgctcgtcaagttccttctgtagagcttataaaccaaatacaaatgaaaataaatacctggaaataaatttgggtcaagaatctcaaggttttaggcagtaatggatgggacctaatgcgtgagggagaagctgagaaggagaaacagtatgcagcactagtctggatttctcgtcctctaaacaatgatgatttgcagagtatatctttgctcaaggatatgcaaattctgcagaaaacacctataagagttctccaccgtcgaagccctttagagcgtgaaaagattatacactggatggaagtagaaagaatagctggaagttcccagtattttctcttgcatctttgtacacaggctggaacttacatcaaggaatttgtgcatggggatcttgggcgtactcatcccagtattggctcgattctagggtgcagagcagagattctgcaacttgatgttacagatgtcaaaatggattgcttctaaaaatagaagacggttctacggtctgggcctcctcaactggctagcaagattattgctggttaaggtt

SEQ ID NO: 3105 - DNA, 2136 bp, Malus domestica
gcgactcttggccagccctttggccggttcttccatttttgaacggtgagcacatgaaccctttgacctaactctcaatcaaggatgaatttcgtgtcataggggcctatttttagcctaccactttggccggtcggttggagagggcctaacttgcccagtttacccgttattcgacaaagctaaaggggcttaggtctagggtttatcggcacaatatacatcgtattgttctgagaagtagcaaagtaatcacccactccattgagctttagggcttttcgaaatggcaaacgagacccaagatgcttcgcaggccaccgttaatggcgacaatgcgcaatctctctgcgacgtcgtccgagggttgcctagtcgcgccgtcgtagacttatggtcctccggcgtatgcaccagatgcatcttacggttgtttgggatcagagagcatgattactatcgttcttcactatcgcggtcaatcttgagttcagttcttggagattcagagaaacatttggtggatagtaatgttagagaaccggtagtttgtagagtttgtttggggatcttgcagttcacttattctgcggataacaagttggtggtagaaagggagagtgccagtgaattggctgtttccatttccgatctgattaggcaacagggctttcagattgacggcttttctcttgaagtatccatacctccaattatccaggaaaatgatcgtattgcttggctatatatgaaaagaaagtttgaatctgaactttggttccaaggaaaatcactctctgaatgcatttctgcaaaggatgctctaaaaatttctcttacggagatccttgaaacaatgttgggttgtaagtccagcataagcagtttccgcatccgtttgacatacactcaccgtatagcaacaataacagttgatagttctaatgaggggtgcaaaagaagaaaaacaggttcaggcaatggtttggacagaattaatgatgacatcaaatgctctgggttttcgacaagtgaagctgatgcggttgttcaaaggtcttttgtgagtttgcaagctattgaatcgcctgagtgcctgaagttacctctagagcagtccagtgaaccttgctgtttagagtttctctgctaccggacgcaaatttatgttggtgggagatacctgaagtactcgagaaatgtgagtcaatcctgttggattattgatgatgagagaatgggagaagcatctgtcgaggagatactaggtagcaacgttcttcctatatgtcgtggtgataactacaagtttcatgctgccggaagagaagatatcgatgtaaggatgttgggttctggaaggccgttcctgcttgagatacaaaacgctcgccttgtcccgtctgatgactctgtaaaaagtttggaaatagcgataaataacttggaaaataaattggtaggcgtgaaaaatctgaagctggttgatagtcagtcatgggatctaatgcgtgaaggggaagcagagaaacagaagcagtatgttgcgttagtgtggatttctcgccctctcaaggatgaggacttgcattttatatcttcacttaaagacactcatattcagcagagtactcccatcagggtgcttcaccgccgaagtccattagaacgagaaaagatcatacattggatgagaattgagaagattgttggaagttctcagtattttcttttgcatctgtgtacccaggctggaacgtacattaaggaattcgttcatggggatcttggacgcacccaacctagcattggatcaatttttagttgtagagcagagatactgcagctcgatgtaacagatgtgaagatggattgctttctcactgaatgaggaccgtaattctagaaaaccaccctgctgcagctgcggctttttggggttgatctaagcttatggaactagacggcgaagaagatgaatcagttggagctatggatccaagcttatgcccacttcggcaatgtcttttgtccggcacattcatgtaggctgatttatattatattcttgttttgtttatcttctacttttgctttgctgatatccatttgataatccggcttagaatggaacaa

SEQ ID NO: 3106 - DNA, 932 bp, Malus domestica
tgagtcaatcctgttggattattgatgatgagagaatgggagaagcatctgtcgaggagatactaggtagcaacgttcttcctatatgtcgtggtgataactacaagtttcatgctgccggaagagaagatatcgatgtaaggatgttgggttctggaaggccgttcctgcttgagatacaaaacgctcgccttgtcccgtctgatgactctgtaaaaagtttggaaatagcgataaataacttggaaaataaattggtaggcgtgaaaaatctgaagctggttgatagtcagtcatgggatctaatgcgtgaaggggaagcagagaaacagaagcagtatgttgcgttagtgtggatttctcgccctctcaaggatgaggacttgcattttatatcttcacttaaagacactcatattcagcagagtactcccatcagggtgcttcaccgccgaagtccattagaacgagaaaagatcatacattggatgagaattgagaagattgttggaagttctcagtattttcttttgcatctgtgtacccaggctggaacgtacattaaggaattcgttcatggggatcttggacgcacccaacctagcattggatcaatttttagttgtagagcagagatactgcagctcgatgtaacagatgtgaagatggattgctttctcactgaatgaggaccgtaattctagaaaaccaccctgctgcagctgcggctttttggggttgatctaagcttatggaactagacggcgaagaagatgaatcagttggagctatggatccaagcttatgcccacttcggcaatgtcttttgtccggcacattcatgtaggctgatttatattatattcttgttttgtttatcttctacttttgctttgctgatatccatttgataatccggcttacaatggaac

SEQ ID NO: 3107 - DNA, 1859 bp, Lactuca sativa
cccgtatgacctcaaacctcgccgcttaacgtaaaacccccaaccgataatggccgacgaatccgtcagcgcgccggttgttaacgatcaagatcccgcaatagcggccgcggacgagatgaagcttcttggatatgccgtgcaagaactacctgctcacgcagtgaaagacctgtttgcgcacgaggtgtgtgtccgatgcatttttcggttatttaacattcatgagggtatttatgctttgctatcaccaacaaccatatattccattattaaaaaagctataaattcagaagatatggcaattaagagcactgaagatactgtagatgcaaagagtttgcagtcatctccagagttagaagtgaagtcaagtatttgttcagtttgcttaggtgtcttgcaatttagttatcttgatgagagagatactttgttggggaaggatcatgctgaagactttgccatggcagttgctgaaagtgtgaaagagaaaggtcatgaaattcccagttttacccttgaagtctcgttgccaacactcattacagaaaatgaacaagtgattctgttgtatttgaagaagaagtatgcttctgaagtttggtttcaagagaaattctcatctgaacatatttcagtaaaggatgcactcaagctatctatgacacatccccttgaaaaacttttgggtgttaaatctggtgttagtgattttcgtattcgtttgacattcgaacatgttgatgctacatctgctgaaaacaggatagggaaaaaccaagggaataagagaataaaatcagatgaaagtaatggacttgttaaatgtagcaatggaacaatgcaaagtggtgatgcatctgacattaattccccactgaaaaaagtggtcaaccttgtcacatgacattggtttgttctagggcacctgtcttcattggtggtcgatatctcaagttctcaagaaatgtgagtcagacccgttggataattgatgaagaaaggaagggagatgcatctgttgaggagcttattggtggcaatatccttcccatgtgtaatggtgatagctacaagtttcatgctgctgggagagaggatatagatgtgaggatgttggggtcaggtaggccatttttggttgagatacaaaatgcccgttttgtcccttctgaagtatccatcaaggaaatggaaaacaagataaatagtctcgaaagtaacctggttagagtaagacatctcaaggttgtagggagtcaaggatggagtttaatgcgtgaaggagaagcagaaaaacagaaacaatatgctgctttagtgtggatatctcgacctattagtgatgatgatgtggaagctgtgacatcgctcaaggaattgaaagttttgcagagaacaccggtaagggttcttcataggcgaagtcctttggatcgagaaaagactattcattggatgaaaattgagaaaattgctggaagttgtcagtattttctacttcatctatgcactcaagctggaacttatatcaaagaatttgttcatggagatcttggacgtacaaatcctagcattgggtctattctcgggtgtagggctgaaattctgcaacttgatgtgacagatgtcaaaatggataccttaaccgaatgactgctgtatgtggtggattttgaagtgattttgagtggatgtcatgcaattacgttgtttttgtaactgtgaaatcttgtgcgtgttgttgattgacacataagggagcatgaaatgatgggaagaaaacatggttgtattttttctatgtaatgacttgtatctcatgcattataagttgtaaattaatttgcacacac

SEQ ID NO: 3108 - DNA, 1249 bp, Cucumis melo
caattctgttgctgatgattgtatcaacccttcacaagaagttatttttcctcaagaaacgatcaaagaaccatgccatttggctctaacttgttatagaacttcgatatacatgtttggcagatatataaagtattcaagaaatgtgagtcagacacgttgggtaattggtgaagagagaatgggagaagcatctgtcgaggagattctaggcaacaatattcttcccttctgtcgaggtgatagttacaagttccatgctgccggtagagaggatctcgatgttcgaatgttgggttcaggtagacctttcttggttgaaatacagaacgcacgtcttctcccatctgagatgataataaatgaaataaagtcaaagataaatagtccagaaactaaattggttggcgtaagaaatctgaaagttgtaggcagcgaaggttgggccctggttcaagaaggagaagcagagaagcagaagcaatatgctgcacttgtgtggacatctcgcccactcgaggatgacgattttttatcaatatcatcactcaaagacttgaaaattttgcaaagaactccaataagagtgcttcatcgccgaagtccattaaaacgtgaaaagatcatccactggatgaagattgagaaggttgctgaaagttctcaatactatctcctacatttgtgtactcaggctggaacatacattaaagaattcgtccatggggatcttggtcggactcatcccagtataggatctattcttagttgccgagctgagattcttcaacttgacgttacggatataaaaatggactgccatttggccgaataaaagaaaggtttggtcttaaggttcattcatagaagaaggagaaggatgagattcactttggtgccctcacatgccctcctccccgtccgtcaatttggtaatttcaaatagatttatttgatttgataatttaaaattgattaacctaaacttttcttttccccattttcttgggggaatcattgttggaggtcgtattgaatttatgagtgctataaaggggagggtcaagacgtactttcaaattaagcaatgtggcaatgtattgtcagtaaggttagttggtaaactccttttatttttttagactagattatgatatctttctttttgtagagagtagtttcgccctcatttttgtctaaatttaatttattgtggtctatctcgttaggtaaggcaagcccggtaggg

SEQ ID NO: 3109 - DNA, 763 bp, Rhizophora mangle
cctatcccctgtgtgccttggtgggagatacctcaaattctcgagaaatgtcagacaaacccgttggatcattgacgaggaaaggatgggggaagcatcagttgaggagataataggcggcaacattcttccggctttttggggtgacagttataagtttcatgctgcgggtagagaggatattgatgttcgaatgttgggttctggtagatctttcctggttgagatacaaaatgcacgccaagtaccctgtgatgcttcagtcaagcaaatagaaacaaacataaatgatttggataagaatttggttggagttaaaaatctaaaagtggtaactagtcatggttggactctgatgcatgaaggagaagcagaaaaacagaagcaatactgtgctctagtgtggacttcacggccaattgaagatgaagacttgcggtctatagcttcactaaaggacatgcaaattctgcagaggactcctatcagggtgcttcatcgtcgaagtccattggaacgtgcaaagattattcattggatgaaaattgagaggatagctggaagctcttactattttcttctgcatctatgtacccaggctggaacatacatcaaagaatttgttcatggggatctagggcgcaccaatccaagttttggatcaattctgcggtgcagggcagagatactgcaacttgatgttacaagcgtaaaaatggactgttttctgtctgagtgatttagttgcctttaccatggagga

SEQ ID NO: 3110 - DNA, 1012 bp, Helianthus annuus
ggacggggaaaaaccaatgcaacaagagaataaaatcagataatggatttgcaaaacataccaatgagacggcgcagataatggatttgaaaaaggttggtcaaccttgtcacatgacattgacttgttctacggcacctgtctacatcggtggtcgatatttgaagttgtcacgaaatgtgagtcagacgcgttggataatcgatgatgaaaggaagggagaggcatctgtagaggaacttattggtgaaaacattcttcccatgtgtaaaggtgaaggctacaagtttcatgctgcagggagagaggatatagatgtaaggatgttgggttcaggaagaccgtttttgatcgaggtacaaaatgcgcgtcatcttccttctggggcgtccgttaaggaaatggaaaagaagataaatagtcttgaaagtaatctggttagagtgaaacatctccagattttggggagtcaaggttggagcttaatgcgtgaaggagaaaccgaaaaacagaaacaatatgctgctttggtatggatatctcgctctattaacgataacgatcttgaagcagtgtcatcgcttaaggacttgaaagttttgcagagaacaccgataagggtacttcatcgtcgaagtcctttagaccgtgaaaagattatacattggatgaaaattgagaaaattggcgggagttctcaatattttctacttcatctatgcacacaggctggcacttacatcaaggaattcgttcacggagatcttgtacgtacccatcctagcattgggtctattcttgggtgcagggcagaaattttgcaacttgatgtgacagatgtgaaaatggatatcctaaacgaataagtcgtttttttagttttatttatttgctgtttttgcagatttttagtggatattataatattatgtaacgatttgtagcaagctcatgtttaatttttgtatcctgttttatgtaacatttacagacacaattttcataaaattta

SEQ ID NO: 3111 - DNA, 2047 bp, Triticum aestivum
gcacgaggctggttactgtcggtgatctcatcatcaacatgtacgtgagatacttgttttcagaggggcaggaagagttggttggagtatatgcctctcagcttgaacgtgatgtttgcattgatttgtttgtggacatgatggaactaaggttaaatagcagcttgcataccatgtacaagcttttcctctctgctgtggagtatctgccattctcatctggagatgcatccaaggcttgttttgaagagataattgagagagttctttcaaggtctcgagaaataaaaccccatcagtacaatgaagatttctctgatgtcgcagaacagcatcacctgcaagcacttcagaaggcaatgatcattcagtggctttgcttcacaccaccatcctcaattccagactttgagatgatcacagggaaacttctgatacgggcattgatgcatagcaacacactattcagagaattttccttaatatcaatgaggagagtccctgaactaccagtaggaccacataagttgcttgccatccttgccgaaccattgaaacaaaaggaaaatttattttcgctggaagatcaagaggtgtctgataacttagaagagtttgaagattggcacgaatattactccctggatgcaacataccggggttggcttagatgcgagatggagaattcttctgttccccctgaaatgctttcggcagaagaaaaggatcaagctgttgctgcagcaacacaaacactggagttagcattcttgttattagaaagggaagagagaccatggttaaatgctgtcgagacaagcccatttgagtcatcagagcttgttttccttgagttgcatgcaacggcaatactctgtctaccttctggggaatgcatgataccagatgcaacatcatgcacggctctgactagtgcactttattcaactgtcagcgaagaggatatgctgcatcgtcagctgaaggtggaagttaaggtctcgtctaaagatccttgctgtattgaagttgcgctccgttgcttagcaacagaaggtgatgggtttgggcttcatgaagccaatgatggaggtcttctcgctgcaattatggccgctggctttaaaggtgaactcaatcggtttcaacctggagtttcaatggaaatttcacgacttgatacttggtattctgattgtaatggttcggttgaaagtactgctgcttatatcattcgagggctttgccgaagatgctgcctgccggaaacaattctacgctccatgcaggcatccatctccctttccgaagctggcgattctctagatcgttgtgataaactcatcgagttagttgcttcatcagattctgggatgatgcacttgttcagccagcagcagttacaggagttcctgatttttgagagggagtgcttcatatgtaaaatggagcttgaggaagagcagaggcctgctgatggctaagccactcatgtttaaattatcaggtgccgcagtttattgaagcctgaatctcttccaaggtcttgccttttgtcactggcatgttcttacaatgaacagaatagccatggcgcaaacgaaggcgaagaacttcttcctgtaagatttgaaggcgaaggagaagaatgttgctgcaagatttgcattagcagacaaatgtccctggatgattcatgtaagaaatcataggcgtccaatctgattgaccatgtcaatgtaacttccaatttctcagattatatggtgttgtagaaatcttgagcgatgtgaattgagcgtagctcagatggtcaggtttcttgtgctggaagtgctggaacctgtctgacagtctacctgcgttcaagtcactgtgttctgtcaagttgagtggtgagtgtagcccagatgttcagcatgggtggtgagtgtatgcgcgtgtgtgagcgtcactgtgttctgccaagttgcttaagcaaaacaaagcgtaccaatatgctagtgagtgcgacgattaggaaccattctttcccataaaaaaaaaa

SEQ ID NO: 3112 - DNA, 1994 bp, Triticum aestivum
  misc_feature (229)..(229): n is a, c, g, or t
  misc_feature (286)..(286): n is a, c, g, or t
  misc_feature (304)..(304): n is a, c, g, or t
  misc_feature (314)..(314): n is a, c, g, or t
  misc_feature (323)..(323): n is a, c, g, or t
  misc_feature (325)..(326): n is a, c, g, or t
  misc_feature (389)..(389): n is a, c, g, or t
  misc_feature (406)..(406): n is a, c, g, or t
  misc_feature (443)..(443): n is a, c, g, or t
  misc_feature (473)..(473): n is a, c, g, or t
gcacgaggctggttactgtcggtgatctcatcatcaacatgtacgtgagatacttgttttcagaggggcaggaagagttggttggagtatatgcctctcagcttgaacgtgatgtttgcattgatttgtttgtggacatgatggaactaaggttaaatagcagcttgcataccatgtacaagcttttcctctctgctgtggagtatctgccattctcatctggagatgnatccaaggcttgttttgaagagataattgagagagttctttcaaggtctcgagaaanaaaaccccatcagtacantgaagatttntctgatgtngnngaacagcatcacctgcaagcacttcagaaggcaatgatcattcagtggctttgcttcacaccnccatcctcaattccagnctttgagatgatcacagggaaacttctgatacgggcnttgatgcatagcaacacactattcagaganttttccttaatatcaatgaggagagtccctgaactaccagtaggaccacataagttgcttgccatccttgccgaaccattgaaacaaaaggaaaatttattttcgctggaagatcaagaggtgtctgataacttagaagagtttgaagattggcacgaatattactccctggatgcaacataccggggttggcttagatgcgagatggagaattcttctgttccccctgaaatgctttcggcagaagaaaaggatcaagctgttgctgcagcaacacaaacactggagttagcattcttgttattagaaagggaagagagaccatggttaaatgctgtcgagacaagcccatttgagtcatcagagcttgttttccttgagttgcatgcaacggcaatactctgtctaccttctggggaatgcatgataccagatgcaacatcatgcacggctctgactagtgcactttattcaactgtcagcgaagaggatatgctgcatcgtcagctgaaggtggaagttaaggtctcgtctaaagatccttgctgtattgaagttgcgctccgttgcttagcaacagaaggtgatgggtttgggcttcatgaagccaatgatggaggtcttctcgctgcaattatggccgctggctttaaaggtgaactcaatcggtttcaacctggagtttcaatggaaatttcacgacttgatacttggtattctgattgtaatggttcggttgaaagtactgctgcttatatcattcgagggctttgccgaagatgctgcctgccggaaacaattctacgctccatgcaggcatccatctccctttccgaagctggcgattctctagatcgttgtgataaactcatcgagttagttgcttcatcagattctgggatgatgcacttgttcagccagcagcagttacaggagttcctgatttttgagagggagtgcttcatatgtaaaatggagcttgaggaagagcagaggcctgctgatggctaagccactcatgtttaaattatcaggtgccgcagtttattgaagcctgaatctcttccaaggtcttgccttttgtcactggcatgttcttacaatgaacagaatagccatggcgcaaacgaaggcgaagaacttcttcctgtaagatttgaaggcgaaggagaagaatgttgctgcaagatttgcattagcagacaaatgtccctggatgattcatgtaagaaatcataggcgtccaatctgattgaccatgtcaatgtaacttccaatttctcagattatatggtgttgtagaaatcttgagcgatgtgaattgagcgtagctcagatggtcaggtttcttgtgctggaagtgctggaacctgtctgacagtctacctgcgttcaagtcactgtgttctgtcaagttgagtggtgagtgtagcccagatgttcagcatgggtggtgagtgtatgcgcgtgtgtgagcgtcactgtgttctgccaagttgcttaagcaaaacaaagcgtacc

SEQ ID NO: 3113 - DNA, 1114 bp, Lolium multiflorum
ttcagatgatcacagggaagcttttgatgcggacactgatgcatagcaacacactatttagagagttttccctgatatcaatgaggagaggctctgaactaccaataggaccacataaattgcttgccatccttgctgaaccattgaaacaaaaggagaacttttcgctggaagatcaagagatatctgataacttacaagagtttgaagattggcacgaatattactccctggatgcaacttaccggggttggcttagatgtgagatggagaattcttctgttcctcctgacatgctttcagcagaagaaaaggatcaagctgttgctgcagtgacacaaacactggagctggctttcttgttattactcagggaggaaagaccatggctaaatgctgtcgagattagtccatttgagtcgtcagagcttgttttccttgagttgcatgcaactgcaatactctgtctaccgtctggagaatgcatgccaccagatgcaacgtcatgcacggctcttacaagcgcactttattcaactgttagcgaagaggaggtgctgcatcgccagctcaaggttgatgtcaaggtctcgtctaaagatccttgttgtattgaagtcgcgcttcgctgcttagcaacagaaggtgatgggtttggacttcatgaagccaatgatggaggtcttcttgctgcaataatggccgctgggtttaaaggcgaactcaatcggtttcagcctggagtttcgatggaaatttcacgacttgatgcttggtattctgatggtcatggttcggttgaaagtactgctgcttatatcatccgagggctctgtcggagatgctgcctgccagaaactattctacgatccacgcaggcatctatctccctttctgaagcaggcgattctctagatcattgtgataaactcattgagttggttgcttcatcagattccggaatgatccatttgttcagccagcagcagatacaggagtttctgatctttgagagggagtgcttcatatgtaaaatggagcttgaggaagagcagatacctactgatggctaattcatctgagtttacattatcagaatcagacatgttctact

SEQ ID NO: 3114 - DNA, 3724 bp, Brachypodium distachyon
gtggacccgtcgccgtccgcgtccccgcggcggccgctgccgacgccgggatacctggacctggagtcctcccgcctccgggaggagtaccgccgctacagaaagagactatcttcttcaaatgactccccactgttggggacctcagtctccagattctctgaagcaagggtgttgcgtgatggcaacagcatacacaggcagcccaatgctggtctactccttgaagaaatcaaacaggaggcttctgattattctgacattgatggcttggatggatcgaagctgtttggatcagcaaaaagaaggacatcactggatggtggttctgcaccagacacggatttcagttcaggtaggaaggcggcgaggtcggcatttaatccggtcaagctggagggtgatgtgccacaagaaggagaaacaacttttacaatctttgcatcccttcttgattctgcgatacaaggattgattcccttcccagatgcaattttacaatttgagagagcatgcagaaatgcttcagagtcaataaggtctgctaccacaggaaagctccgaatggtggacgataaacttatgcagcaaaaagcacaactattgctcgacgaagctgcttcttggtcacttctttggtacctctatgggaaaggaaacgaggagtttcctgaagagctattcgtgtcaccaactacatcccatcaggagtcttgccgctttgttgcaacagatcttacagcacaattgtgtctcaggattgtactttggcttgaaggacttgcttctgaaggtctcgatttggagaaaaaagtgagaggatctcatgttggttcatatctaccaagttctggtgtttggcatcgtacgcagaggtacttaaagagaaagaataatgatgattctaccatagtgaagcatgtggattttgatgctccgactcgtgaaggagcccaacttcttcccgatgacaagaagcaaggtgaattgcttttagaagatatctggactctcttaagagctggaagattagaagaggcgtgtgaattgtgccggtctgctggacaggcatggagagctgccactctttgcccctttggtggcatagatctctttccttccctggaggccatgctaaagaatggaaaggctagaacactacaagccattgaattggaaagtggtgttggacggcagtggcgtctttggaaatgggcatcatatagtgcttcagaaaaaattgctgaacatgatggtggtcggtatgagatggctgtatatgctttatagtgcagtaacttgaagcgtaccttgccgatctgtactgactgggagtcagcttgttgggcaattgcaaaatcctggctagatgttcaagtggatttagaattatctcaataccaaacgagcagaccagaagagaaacagtttgatgatgacatgaatggaacccagcctatggtcagctcagccggcccagaaaattggccacaccatgttcttgatcagcaacctcgtgatattgctgcacttctgcagaaactccattcaagtgaccttgttcatgaaactgtttctcgagcatgtcgggagcagcaccgtcaaattgagatgaatctcatgagtggaaatatagctcatcttcttgaccttctatggtcatgggtgtcaccctctgaagaggatcaaaacattttaaggtcccgtgatgatcctgagatgatacgttttggggcacatattgttcttgttctgagatacctattcggcgaggaaatggaggacgagtttgaggaaaagctggttactgttggtgatctcatcatcaacatgtatgtgaggtacttgttttcagagcagcaagaggagttggttggagtatatgcctctcagcttgaacgtgatgtttgcattgatttgtttgtggaaatgatggaactaaggttaaatagcagcttgcataccatgtacaagcttttcctctctgctgtggagtatctgccattctcatctggagatgcgtccaaggcttgttttgaagagataattgagagagttctttcaagatctcgagaaatgaaacctagcaagtatgatgaagatttttctgatgttgcggaacggcatcacttgcaagcacttcagaaggcaatggtcattcagtggctttgcttcacaccaccatcctcaattccaggctttcagatgatcacagggaaacttctgatacgggcgttgatgcatagcaacacgctattcagagagttttccctgatatcaatgaggagagttcctgaattaccaataggcccacataagttacttgccatccttgcggaaccattgaaacagaaggaaaatttattttcatttgaagatcaggaggtatctgataatttacgagagtttgaagattggcatgaatattactccctggatgcaacataccggggttggcttagatatgagatggagaattcttctgttcctcctgaaatgctttcagcagaagaaaaagatcaagctgttgctgcagcaagacaaacgctggaattggcattcttgttactactcagggaagaaagaccatggttaaatgccgctgagaaaagtccatttgagtggacagacactgttttccttgagttgcatgcaactgcaatactctgtctaccttctggagaatgcatgctaccagatgcaacatcatgcacggcactgacaagtgcactgtattcaactgtcagcgaacaggatgtgctgcatcgccagttgaaggttgatgttaaggtttcttctaaagatccttgttgtatagaagttgcacttcgctgcttggcaaaagaaggtgatgggattgcacttcatgaagccaatgatggaggtcttcttgctgcaattatggctgctggttttaaaggtgaactcaatcgttttcaacctggagtttcaatggaaatatctcgacttgatgcttggtattctgatggtcatggttcggttgaatgtactgctgcttatattattcgagggctttgccgaagatgctgcctaccagaaacaattttacgatctatgcaggcatctatctcgctttccgaagcaggggattctctagatcattgtgacaaactcatcgagttagttgcttcatcagattccggattgatgcatttgttcagccagcagcagttacaggagttcctgatttttgagagggaatgcttcatatctaaaatggagcttgaggaagagcagatacctactgatggctaagtctcatcagggccagaatcttggaatagtagtcatggggcatgctctactagttgacaaaatcagaagtcaggacttgcaagtggcgacatgtcacaccatcggtcgagaaccggctgtaatttatgtgagattgtgaccttgtcgatgtcgagaaaggcggagatgaaatttgttgtataggtgttatataatattatttgactgcatgcccatcgctctcagctgatgacagcagcagatgagatttggctcactttagatcgttctgtcatactactactgtggaagcacaaagactggtctcaaatctaacagaagaggcacttgtaactctatttgaaggatagatacatcaatgcatcaattttctgtgtcgtttggctgccctgattttatcaaggacagtatagagcacctgtggcatatccatctttgttacatattc

SEQ ID NO: 3115 - DNA, 2669 bp, Avena sativa
gactggaagaggcatgtgaattgtgccggtctgctggacaggcatggagagctgctactctttgccctttggtggcatagatatgtttccttccctggaggccatgctcaggaatggaaaggctagaacgttacaagccattgaattggaaagtggtattggacgtcagtggcgtctttggaaatgggcatcttattgtgcttcagagaaaattgctgaacatgatggtggtcgttatgagatggctgtatatgctttacagtgtagtaatttgaagcgtaccttgccaatctgcactgactgggagtcagcttgttgggcaatggcaaaatcttggctggatgttcaagtggatctagaattatctcaatacaaaccagcagaccagaagagaagcagtatgatgatgatatgaatggaacccaacctatgctcagttcagtgggtccagaaaattggccataccttgttcttgatcagcagccacgtgatatagctgcacttttgcagaaactccactcaagcgaccttgttcacgaaactgtttctcgagcatgtcgggagcagcatcgacaaattgagatgaatctcatgagcggaaatgtagctcatcttcttgaccttctatggtcatgggtgtcaccttctgtagaggatcataacgtctcgagtccacttagatcccgtgatgatcctgagatgatacgttttggggcacatattgttcttgttatgagataccttttcagcgaggaaatggaagatgagtttgaggaaaagctggttactgttggtgatctcattatcaacatgtatgtgaggtacttattttcagagcagcaaggagagttggttggagtatatgcctctcagcttgaacgtgatgtttgcatcgatttgttcgtggaaatgatggaactaaggctaaatagcagcttgcataccatgtacaagcttttcctctctgctgtggagtatctgccattctcgtctggagatgtgtccaaggcttgttttgaagagataatcgagagagttctttcaagatctcgagaaaccaaacccaacaagtacagcgaagatttttctgatgttgcggaacgacatcatttgcaagcacttcacaaggcaatggtcattcagtggctttgctttaccccaccatcctcaattccaggctttcagatgatcacagggaagcttctgatgagggcattgatgcatagcaacacactattcagagagttttctctgatatcaatgaggagagtctccgaactaccaataggaccacataaattgcttgccatcctggctgaaccattgaaacaaaaggaaaacttttcgctggaaagatcaagagatatctgataacttacaagaatttgaggattggcacgaatattactccctggatgcaacttaccggggttggcttagatgtgagatggagaattcttctgttcctcctgaaatgctttcggcagaagaaaaggatcaagctgttgctgcagcaacacaaacactggagctggctttcttgttattacacagggaggaaataccatggttaaacgctgtcgagactagtccatttgagtcgtcagcgcttgttttccttgagttgcatgcaactgcaatactgtgtctaccttctggagaatgcatgccaccagatgcaacatcatgcacggctcttacaagcgcactttattcaactgttagcgaagaggaggtgctgcatcgccagctgaaggtggatgttaaggtctcatctaaagatccttgttgtattgaagtcgcgcttcgctgcgtagcaacagaaggtgatgggtttggacttcatgaagccaatgatggaggtcttcttgctgcaattatggccgctgggtttaaaggggaactcaatcggtttcaacctggtgtttcaatggaaatttcacgacttgatgcttggtattctgatggtcatggttcggtgaaaatactgctgcttatatcattcgagggctctgtcggagatgctgcctgccagaaacaattctacgatccatgcaggcatctatctccctttctgaagcaggcaattctctagatcattgtgataaactcattgagttggttgcttcatcagattccagaatgatccatttgttcagccagcagcaattacaggaatttctgatttttgagagggagtgcttcatatgtaaaatggagcttgaggaagagcagatacctactgatggctaattcatccgagtttaaattatcaggtgtgacacctgaaatgttattcaccagttcctagaggaatggaatcagacatgttctacctactgactaaacctgaagtcaggacttgatagtccggacaggtcataccatctgttctgtggccaagaactagctctactgtattgtgaccctgtcgaaagaaggggtagatgaaattttctgtataggtgttatttctgagtgcaagtctgttactctcagctgataacagaagcagatgagagtgcactcactttagttcgtttgtatcaatactgatctataagtacaaagaggaggcaattgcaaatctatatgaatgttcatgatgatctgctgcttatccatcttcgatgcagtttacgtcgacttcaattgcatgtgcaaacagt

SEQ ID NO: 3116 - DNA, 3729 bp, Setaria italica
cccggccgatccgcgcggccatggaggtggacccctcgccgtcgccgcccccgtcgcggccgccgccgctgccgggctacttcgacccgggaggagtaccgccgctacaggaagaggttatcttcttcaaatgtctcgccgctgctggggagctcactctccaaatcctctgaagcaaggctgttatacgacggggacagcatcccgaggcggcctaatgctggtttactccttgaagacatcaagctgaggattattccaactttgaaggcttggatggatcgagaatgttcagttcagccaaaagaagggcaccattcgatggtggttctgcctcggacgcagcttacagttcggggaggcaggcggtgaggcagacgctgaaaccagtcaagatggaggacgatatgtatgcgccacatgaaggagaaacatcgttttcaatgtttgcatctctccttgattctgcgatccaaggtttgatgccctttccagatgttacagtttgagaggacatgtcgaaatgcttccgagtcgatcaggttgtcatcttctgagcttcgggtggtggaagataagcttatgcagcaaaaggcacaacttttacttgatgaagctgcttcctggtcacttctttggtacctctatggcaaaggaaatgaggagctttcaggagagctttttgtgtcaccaactacatcccatcaggaggcgtgccgctttgttgcagcagatcttacagcgcaactgtgtctgcggattgtactttggcttgaaggtcttgcttctgaagctcttgatttggagaaaaaggtgagagggtctcatgttggttcatatctaccaagttctggtgtttggcaccgtacacagaggtacctcaaaagaaacaataatgattctactatagtgaagcatgtggattttgatgctccaactcgtgaaggagcacaacttctccctgatgataaggtaggatgaattgcttctagaagatatctggactcttttaagagcgggaagattggaagaggcatctgagttgtgccgttctgctggccaggcatggagagctgccactctttgtccttttggtggcatagatatgtttccttccctggacgcattgctcaagaatggaaagtccagaacactacaagccattgaattggaaagtggtattgggcggcagtggcgtctttggaaatgggcatcatattgtgcttctgagaaaattgctgaacaagatggtggccgttatgagatggctgtatacgctttacagtgcagtaacttaaagcgtatcttgccaatctgtactgactgggagtcagcttgttgggcaatggctagatcctggctggatgttcaagtggatcttgaattatctcagtaccaaaccagtagaccagatgagaaacagctcgatgatgatatgaatggagcccaaagttggtccagaaagttggccgtaccatgttcttgatcaacaacctcgtgatataactgcacttctgcagaaactccactcgagtgaccttgttcatgaaactgtgtctcgagcatgccgggagcagcatcgacaaatcgagatgaatctcatgagtggaaatatatctcatcttcttgaccttctatggtcatggttgtcccccgctgaagaggaccaaaatattgctaggatttcgccccttgatgacccagagatgatacgtttcgcggcacatgtcgttcttgtactgagatacattttcatcagtgatgaaatggaagatgagttggaggaaaagctggttgctgtcggtgacctcatcatcaacatgtatgtgagatatttgttctcagaggaccaagaggagttggttggagtatacgcttctcagcttcaacgtgacctttgcattgatttgtttgtggaaatgatggaattaaggttaaatagcagtttgcatactatgtacaagctcttcctctctgctgtggagtatctgccattctcatctggagatgcatccaaggcttgttttgaagagatcattgagagggtgctttcaagatctcgacaaacaaaacccagcaagtacgatgaggatttctccgatgttgcacatcaacatcacttacagtcacttcaaaaggcaatggttattcagtggctttgcttcacaccaccaccctcgattccagactttcaaatgatcactgggaagcttctgattcgggcattgatgcatagagagttttccttgatatcaatgaggagagtccctgaactaccagcagggccgcacaagttgcttgccatcctggctgaaccattaaagcaaaaggaaaatttattttcgctggaagatcaggaggtatctgataacttacaggagtttgaagattggcatgaatattactcccttgatgcgacttatcggaactggcttaaagttgagatgcagaatgatgctgtttctcctgaaatgctttcagcagaggaaaatgatcaagctgttgctgcagcaaaagaaacactggagttggcattcttgttattaaagaaggatgaaagaccatggttggatgctgtcgagagcagtccatttgaatcctcagatcctattttccttgagttgcatgcatctgcaatgctctgcctaccttctggagaatgcatgttacccgatgcaacatcatgcacagctttgactagtgcactatattcaactgccagtgaagaggatgtgctgcatcgcaagttgaaggtggacattcaggtctcgtctagagacccttgctgtattgaagttgctctaagctgcctagcagcagaaggtgatggatatgggcttcatgaagccaatgatggaggtcttcttgctgcaatcatggcagctggctttaaaggtgaactcagtcgattccaacctggagtttcaatggccatttcacggcttgatgcttggtactctgatgggaatggctctgtggaaagcactgctgcttacataattcgagggttgtgtcgaagatgctgcctacctgaaacgattctacgatccatgcaggcatgtatttcgctttcggcagcaggtgattctctagatgattgtgataaacttattgagttagttggttcgtccgaatccggaatgatgcatttgttcagccagcagcagttgcaggaattcctgattttcgagagggaatgcttgatatgtaaaatggagcttgaggaggagcagcagttaccgtctgatggctaagtccttcatgttctcagagaatcaattgcaaatcacgggcgggtttcaatgtccggcgaatcactttctgaaccacctgctgacattcagaaagtaatgacccacaaatttggaggttggcgtcaagattgaaggacactgaagaacctgttgtaatgtgtttctaatggcttggcgtcacgattgaaggacactgaagaacctgttgtaatgtgtttcaatgccattagaggaggaactttggatttccgtgtataggtaggtgtttggtaacaccatggattgtaaaactgtcattttagtcccatcgtatgtgtaagaatgaatacgcattttggtggcaaatacagtacaagaggcacctgcaaatccaacatggttcatgaaaaactgaactttcacggtgtttcggcgaaactttgttgaaatacgctgttatgtaccatttgatctgtcctcgttattcagtactcag

SEQ ID NO: 3117 - DNA, 2179 bp, Pennisetum glaucum
aacaagctgactagatgagaaacagctcgatgatgatatgaatggcgcccagagttcagttggtccagaaagttggccgtaccatgttcttgatcaacaacctcgtgatataactgcgcttctgcagaaactccactcaagtgaccttgttcatgagactgtgtctcgagcatgccgggagcagcatcgacaaattgagatgaatctcatgagcggaaatatatctcatcttcttgaccttctgtggtcatggttgtccccctctgaagaggaccaccatattgcaaggccccttgatgacccagagatgatacgtttcggggcacatgttgttcttgtactgagatacattttcatcagtgatgaaatggaagatgagttggaggaaaagctggttactgtcggtgacctcatcatcaacatgtatgtgagatatttgttctcagaggaccaagaggagttggttggagtatacgcttctcagcttcaacgtgacctttgcattaatttgtttgtggaaatgatggaattaaggttaaatagcagtttgcatactatgtacaagctcttcctctcagctgtggagtatctgccgttctcctctggagatgcatccaaggcttgttttgaagagatcattgagagagtgctttcaagatctcgacaaacaaaacccagcaaatacgatgaggatttctctgatgttgcacatcaacatcacttgcagtcacttcaaaaggcaatggttattcagtggctttgcttcacaccaccaccctcgattccagactttcaaatgatcactgggaagcttctgattcgggcattgatgcatagcaacacactattcagagagttttccttgatatcaatgaggagagtccctgaactaccagcagggccacacaagttgcttgccatcctggctgaaccattaaagcaaaaggaaaatttattttcgctggaaaatcaggaggtatctgataacttacaggaatttgaagattggcatgaatattactcccttgatgcgacttatcggaattggcttaaagttgagatgcagaatgctgctgtttctcctgaaacgctttcagcagaggaaaatgatcaagctgttgctgcagcaaaagaaacactggagttggcattcttgttattaaagaaggatgaaagaccatggttggatgctgtcgagagcagtccattcgaatcctcagatcctatttttcttgagttgcatgcatctgcaatgctctgcctaccttctggagaatgcatgttaccagatgcgacatcatgcacagctttgactagtgcactgtattcaactgccagtgaagaggatgtgctgcatcgcaagttgaaggtggacattcaggtctcgtctagagacccttgctgtattgaagttgctctaagctgcctagcagcagaaggtgatggatatgggcttcatgaagccaatgatggaggtcttcttgctgcaatcatggcagctggctttaaaggtgaactcagtcgattccaacctggagtttcaatggccatttcacggcttgatgcttggtactctgatgggaatggctctgttgaaagcactgctgcttacataatccgagggctgtgtcgaagatgctgcctacctgaaacaattctacgatccatgcaggcatgtatctcgctttccgcagcaggtgattctctagatgattgtgataaacttattgagttggttggttcgtccgaatatggaatgatgcatttgttcagccagcagcagttgcaggaattcctgattttcgagagggaatgcttgatatgtaaaatggagcttgaagaggagcagcagcagttaccttctgatggctaagctttccatgttctcagatgatcgattgcaaatcttgggtgggtttcaatatttggcgaatcactttcataaccacctgctgacagattcaagtcatgacccacaaatttggaggttggcgtcaagactgaaggacactgaagaacctgctgtaatgtattgcaacgccagtagacaatggagcacttcgaacttgtataggtgtttcggtaacatcgtggatggtatgtgtaagaatgaatgcacattttggtggcaaatacggttcatgtaaaactgaatttgaattttgtggatccaaaaaaa

SEQ ID NO: 3118 - DNA, 821 bp, Pseudoroegneria spicata
  misc_feature (45)..(46): n is a, c, g, or t
cagaaggtgatgggtttgggcttcatgaagccaatgatggaggtnntcttgctgcaattatggccgctggttttaaaggtgaactcaatcggttccaacctggagtttcaatggaaatttcacgacttgatgcttggtattctgattgtcatggttcggttgaaagtactgctgcttatattattcgagggctttgccgaagatgctgcctgccagaaacaattctacgctccatgcaggcatccatctccctttccgaagctggcgattctctagaccgttgtgataaactcatcgagttagttgcttcatcagattctgggatgatgcacttgttcagccagcagcagttacaggaattcctgatttttgagagggagtgcttcatatgtaaaatggagcttgaggaagagcaggggcctgctgatggctaagtcactcacgtttaaattatcagtttattgaagcctgaatctcttccaaggtcttgccttctgtcaccggcatgatcttcacaatgaacagaatagccatggtgcaaacgatggtgaagaagaacttcctggaagatttgaaggcgaaggagaagaatgttcctgcaagatttgcattatcagacaaatgtccctggatgattcatgtattagacaacaaccataggcgtccaatccgattgaccatgtcaatgtaacatccaatttctcagattatatgttgtaagaaatcttgagcgatgtgaactgagtgtagcttagatggtcaggtttcttgtgctggaatctgtctgacagtctacctgcgttcaactcctatatttagca

SEQ ID NO: 3119 - DNA, 3402 bp, Panicum virgatum
ctaaccttgaaggcttggatgggtcgagaatgttcagttcagccaaaagacgggcatcgctagatggtgggtctgcctcagacgcagcttacagttcggcgaggcagacacttaaaccagtcaagatggaagacgatatgtatttgccacatgaaggagaaacatcttttacaatgtttgcatctctccttgattctgcgaaccaaggtttgatgccctttccagatgtaattctacagttcgagaggacatgtcgaaatgtttccgagtcgatcagatccgctgccactggaaagcttcgggtggtggaagataaacttatgcagcaaaaggcacaacttttactggatgaagctgcttcctggtcacttctttggtatctctatggcaaagaaaatgaggatcttcccggagagctttttgtgtcaccaagtacatcccatcaggaggcttgccggtttgttgcagcagatcttacagcgcaactgtgtctgcggatcgtactttggcttgaaggtcttgcttctgaagctcttgatttggagaagaaggtgagagggtctcatgttggttcatatctaccaagttctggtgtttggcaccgtacacagaggtacctcaaaagaaacaataatgattctaccatagtgaagcatgtggactttgatgctccaactcgtgaagaagcccaacttcttcctgatgataagaagcaagatgaattgcttctagaagatatatggactcttttaagagcaggaagattagaagaggcatctgagttgtgccgttctgctggccaggcatggagagctgccactctttgtccttttggtggcattgatatgtttccatccctggatgcattgctcaagaatggaaagtccagaacactacaagccattgaattggaaagtggcattggacggcagtggcgtctttggaaatgggcatcatattgtgcttcagagaaaattgctgaacaagatggtggccgttatgagatggctgtatatgctttacagtgcagtaatttaaagcgtgtgttgccaatctgtaccgactgggagtcagcttgttgggcaatggctagatcctggctggatgttcaagtggatctacaattatttaagtaccaaaccagtagatcagatgaaagacagctcgatgatgatatgaatggagcccaaaattcagttggtccagaaagttggccataccatgttcttgatcaacaacctcgtaatatcacagcgcttctgcagaaactccactcaagtgactttgttcatgaaactgtgtctcgagcatgccgggagcagcatcgacaaattgagatgaatctcatgagtggaaatatagctcatcttcttgaccttctatggtcatggttgtcccctgctgaagaggaccaaaatattgcaaggacccttgatgacccagagatgatacgtttcggggcacatgttgttcttgtactgagatacattttcagtgatgaaattgaagacgagttggaggaaaagctggttactgtcagtgatctcatcatcaacttgtatgtgaggtatttgttctcagaggatcaagaggagttggttggagtatatgcttctcagattcaacgtgatctttgcattaatttgttcgtggaaatgatggaattaaggttaaatagcagtttgcatactatgtacaagctcttcctctctgctgtggagtatctgccattctcatctggagatgcatccaaagctagcttcgaagagatcattgagagggtgctttccagatctcgacaaacaaaacccagcaagtatgatgaggatttctctgatgttgcacatcaacatcacttgcagtcacttcaaaaggcaatggttattcagtggctttgcttcacaccaccaccctcgattccagactttcaaatgatcactgggaagcttctgattcgggcattgatgcatagcaatacactattcagagagttttccctgatatcaatgaggagagtccctgaactcccagcagggccgcacaagttgcttgccatcctagctgaaccattaaagcaaaaggaaaatttgatttctccggaagatcaggaggtatctgataacctacaggagtttgaagattggcatgaatattactcccttgacgcgacttatcggaactggcttaaagttgagatgcagaatgctgctgtttctcctgacatgctttcagcagaggaaaatgatcaagctgttgctgcagcaaaagaaacactggaattggcattcttgttattaaagaaggatgaaagaccatggttggatgctgtcgagagcagtccatttgaaccctcacagcctattttccttgagttgcatgcatgtgcaatgctctgcctaccttctggagaatgcatgttaccagatgcaacatcatgcacagctttgactagtgcactatattcaactgccaatgaagaggatatgctgcatcgccagttgaaggtagacgtgcaggtctcatctagagacccttgctgtattgaagttgctctttgctgcctagcagcagaaggtgatggatatgggcttcatgaaaccagtgatggaggccttcttgctgcaatcatggcagctggttttaaaggtgaactcagtcgatttcaacctggagtttcgatggcaatttcacggcttgatgcttggtactctgatgggaatggttctgtggaaagcactgctgcatacataattcgagggctatgtcgaagatgttgcctacctgaaacgattctccgatccatgcaggcatgtatctcgctctctgcagcaggtgattctctacatgactgtgataaacttatcgagttggttggttcgtctgaatctggaatgctgcatttgttcagccagcaacagttacaggaattcctgattttggagagggaatgcttgatatctaaaatggagattgaggaggagcagcagttatcttctgatagctaagtcttccatgttctcagagaatcactcccaaatcaccggcgtgttttgatgactggtgaatcactttcagaattacccgctgatgatagattcaggagccatgacccacggatctggacatcgtggcatcaagactggaacaccgaagagcctgtgtagtgtactgtgatgccattagagaagggccgggacacttcgaaattcagtgtataggtgctgctcagtaacatcatggattgtgaaaccgccccactttagtccccattgtctgtataaggatgaggatgaatgcagatttcgttcgcaaatgcggtacaagaggctactgcatatccaacatggttcatgaaagattgaattttttccctgttttggtgaaattttgttgaattcgtac

SEQ ID NO: 3120 - DNA, 9002 bp, Zea mays
aaatcgttaaaagttattcgatatacattttcacagttccatctaaaagtcactaaaaacaggtctagtggtgctttcaattttgcactgcgagaaagtcagttttttgaaaaaagctgctttcttgatccagtcctttgatttagcttttgacttttaggggataaaagtcaaaaccaaaagtcaaaccaaacacactcttaatctttgtgagtacgaatgatctatatctatatgatataggtacgctcaggagtgacagacgagagactattttttttggtgtgtgtatgatatgcgatatagccggtggcggtggggttgccatctctatctcggcgtgcagtcagtcagtcacagactccagcgagcgagggaccaaaaccctagctgaaccctcccggcccgcgcagcaactgcgtccatggaggtggacccctcgccgtcgtcgcgctcgcccaggccgccgcctccgccgctggcggcgatgccgagctacttcgacccggagtcgtccggccgtcgggaggagtaccgccgctacaggaagaggttgtcttcttcaaatgtctctcctctgctgggaagatcactctccaagacctctggaccaaggctgttatatgatggagaaagcatcccaagacagcctaatgccggtttactccttgaagacataaagcaggaagctgccgattattccaacgtagaaagcttggatggattgagactgttcggttcgccgaaaaggacatctctcgatggcggttctgcatcaggcgcagcttacagttcgggcaggcaagcagtgaggcagacgctgaagccagtcaaactggaggacgatatgtatgtgccacatgaaggagaaacgccttctacaatgtttgcaactctccttgattctgggatccaaggtttgatgcacttccctgatgtaattcaacaatttgagaggacatgtcgaaatgcttcggagtcaatcagatctgctgcaactggaaagcttcgtgtggtggaagagaaacttatgcagcaaaatgctcaacttttactggacgaagctgcttcctggtcacttctttggcacatatatggcaaagaacatgaggagctttctggagagctgttggtgccgccaattacatctcatcaggaggcttgccgctttgttgcagcagacattacagcacaactgtgtctgcggatcatactttggcttgaaggtcttgcttctgaagctcttgatttggagaagaaggtgagaggacctcatgttggttcgtacctaccaagttctggtgtttggcaccgtacacagaggtacctaaaaaggaacaatgctgattctactatagtgaagcatgtggattttgatgctccaactcgtgaaggggcccaacttcttcctgatgacaagaagcaagatgaattgcttctagaagatatatggactcttttaagagcaggaagattagaagaggcatctgacttgtgccgttctgctggccaggcatggagagttgccactctttgtccttttggcggcataaatatgttcccttccctgaatgcattgcacaaaaatggaaagtacagaacactacaagccatggaattagaaagtggtgttgggcggcagtggcgtctttggaaatgggcatcatattgtgcttcagagaaaatcgctgagcaagatggaggccgttatgagatggctgtatatgctttacaatgcagtaacttaaagcgtgtcttgccaatctgtactgactgggagtcagcttgttgggcaatggcaagatcctggctagatgttcaagtggatctagaattatctcagtaccaaacaagtagaccagaaaagcaacttgatgacgacatgaatggagcccaaagttcagttggtccagaaagttggccataccatgttcttgatcagcaacctcatgatttaactgctcttctgcagaaactccactcaagtgaccttgttcatgaaactgtctctcgagcatgccgagagcagcatcgacaaattcagatgaatctcatgagtggaaatatatctcatcttcttgaccttctatggtcatggttatcacctgctgaagagaaccataataatactgcaaggccccttgatgaccctgagatgatacggttcggggcgcatattgttcttgtgctgaggcaccttttcagtgatgggatggatgatgagttagatgaaaaactggttactgtcggtgatctcatcatcaacatgtacgtgaggtatttgttctcagaggatcaagaggagttggttggaatatatgcctcacagcttcaacatgacctttgcattactttgtttgtagaaatgatggaactaaggttaaatagcagtttgcatactatgtacaagctcttcctttctgctgtggagtatctgccattctcatctgataatgtatccaaggcttgttttgaagagatcatcgagagggtgctttcaagatctcggcaaacaaaacccactaagtatgatggggatttctctgatgttgcgcatcaacatcacctgcaatcacttcaaaaggctatggttattcagtggctttgcttcacaccaccatcctcgattccagactttcaaatgatcagttggaagcttctgatacgggcattgacacatagcaatacactgttcagggagttttctctgatatcaatgaggagagtccctgagctaccagcagggccacacaagttgcttgccattttagctgaaccgttaaagcaaaaagaaaatttaatttcacgggaagatccggaggtatctgataacttgccggagtttgaagattggcatgaatattactcccttgacgcgacttaccgcagttggcttaaaattgagatgatgaatgccgctgtttctcctgagatgctttcggcagaggaaaagggtcaagctgttgctgcagctaaagaaacactgaacttggcatgttcgttactacgcagggatggaagaccatggctgtatgctgtcgagagcagtccatttgaatcccccgatgttattttccttgagctgcatgcttctgcaatgctctgcctaccttctggagaatgtatgttaccagatgcaacatcatgcacagctttgacaagtgcactatattcaactgtcagtgaagatgatgtgctgcatcgcctgttgaaggtggatgtccaggtctcttctagagacccctgctgtattgaagtcgctcttcgctgcttagcagcagaaggtgatggatatgggcttcatgaagccaacgatggaggtcttcttgctgcagtcatggctgctggctttaaaggtgaactcagtcggttccaacctggagtttcgatggcaatttcacggcttgatgcttggtattctgaccggagtggttccgtggagagcaccgctgcttacataattcgagggctgtgtcggaggtgctgccttcctgaaacaattctaagatctatgcaggcatgtatcgcactctccgcggctggtgatgatctagattactctctagataaatgtgacgaacttgttgagttagttggttcagccgagtctggaatgatgcatttgttcagccagcagcagttgcaggagttcctgattttcgagagggaatatctcatatgtacaatggagtttgaggaggaccggttgccttgtgatggctaagctttttccccacttgctgactaatccatgagacatgaccggcatgtgcattttgtggcgccgtgacccaagaacctgctgtgatgtatcgctacaccatttcaaagcgaaaagatggaatttagtgcgtaacgtggttctgcccgtttgtgcacgagaattggcccgttttggagagtcaatataagattattcaagtcgaaatccaagatttttgttcatgataaaaacaatgttcggcaagcctttttgtcccgcccgtgctacgcgcactccgcctcggctgcttttgcatcgatccgatctgccgtccctggacacgctgcagctgacaagggtcaccggcagttccatcccaaaggctgcgaaggcgcacacaagccaagttctactcaacatcgttccctaatcatggtagtaagcacactctgcagccgcttgccacttctacccaacatcatcgtcctcctcttgttcacaaccatttccgactccacgaacagcaacagcgatctcaatgcactcttgtcattcaaatccctcataacaaaggacccaatgggtgcactgtcatcttgggatggggacgcttctaacaggagcgctcctcatttctgccggtggaacggcgtgacgtgcagcagcgaccagcacggcagccatgtcactgccttgcgcctgcgagccttcggtctggaaggcaacatctcccagtcgcttgggaatcttagccacctccaaaccctggatctgtcgaacaacaacctagagggcgagataccttccagtatcggtaacttgtttgctctccattttctcaacctaagtgttaaccacctgtccgggaacgttcctcagtccatcggccgtctttccgaactcgaaattctgaatttccgcgacaatgacatcgtaggaagcatcccttcttcagtgctgaaccttacaggactcacaatgcttagtgccaccgaaaactacatgacagggaggattccagattggttggggaacttgacagatctgacagatttgaacttggcatggaataacttcagtggacagatcccacaagctttaggtaagctacctaaccttgctagattgactatgcaaggtaatcaattggaaggtttaatctctcctacactgtttaacatttcatctcttgagaatttaaatctcggctataacaagctttcaggttctctacctccagatattggatttacacttccaaatattgtagcatttagtgtatgctataacaaatttgagggtccagttccatcctccctgtccaatatttctgtgctccaacagctcatcctccacgggaacagatttcatggccgaattccacctaatattggtgtccacggcagcttaactaatcttgaattaggcaacaatcagcttcaagtcgtggatactaaagattgggattttctaacccctttggtcaattgcagtcatctgaaatatcttaatcttgagctaaataacatttctggcattttgccaaatgctgtttctaatctctcctatgagctggaagcgttactgatgggtggaaaccaaataaccgggaccgtaccttcggggataggtaggcttcaaaagctccaaatactagatctgtcagataacctgtttacaggcgccgtaccttcgagtataggtaaactctccagcctagacagccttgtgctattcagtaataaatttgacggggagatcccttcatcacttggaaatcttacaaaactaaccgagctagttttacattccaatgacctgcatgggagcatgcctccaagccttggtaatatgacaatcttagaatccatcgatctttcatataaccgcctcagtggccaaattccccaagagatcttaagcatgtattcccttacaaaatttctaaatctctccaacaattttttcagcggacccatttcccaacagatcaggctcttgatcagtcttggtacaatggatctctcaagcaataatttatctggtgagactccacatactcttggtagctgtgttacactgcagttcctgtatttgcaaggaaacctcctacaaggtcaaataccagtggaactgaatgcactaagaggcttagaaatctccatccttatttgtgcactgactggcaatccaaatttagggagtttgatgcacttccctgatgtaattcaacaatttgagaggacatgtcgaaatgcttcggagtcaatcagatctgctgcaactggaaagcttcgtgtggtggaagagaaacttatgcagcaaaatgctcaacttttactggacgaagctgcttcctggtcactttggcacatatatggcaaagaacatgaggagctttctggagagctgttggtgccgccaattacatctcatcaggaggcttgccgctttgttgcagcagacattacagcacaactgtgtctgcggatcatactttggcttgaaggtcttgcttctgaagctcttgatttggagaagaaggtgagaggacctcatgttggttcgtacctaccaagttctggtgtttggcaccgtacacagaggtacctaaaaaggaacaatgctgattctactatagtgaagcatgtggattttgatgctccaactcgtgaaggggcccaacttcttcctgatgacaagacgtgctcaccattgccgacgcattgggctgctgcgctttgtccttgcattgggagcggcgcactgcacagatggatgttcctgccgaacattgtgactggaaacgacgccatcaccgctggaatcctcctggacatcaagccggtacaggcggtgcaacacccccagcgatggtggaattgggtcagacagctcgttccccatgaggaacagcaacctcagccccgtgagtggcgaaagaagcaagatgaattgcttctagaagatatatggactcttttaagagcaggaagattagaagaggcatctgacttgtgccgttctgctggccaggcatggagagttgccactctttgtccttttggcggcataaatatgttcccttccctgaatgcattgcacaaaaatggaaagtacagaacactacaagccatggaattagaaagtggtgttgggcggcagtggcgtctttggaaatgggcatcatattgtgcttcagagaaaatcgctgagcaagatggaggccgttatgagatggctgtatatgctttacaatgcagtaacttaaagcgtgtcttgccaatctgtactgactgggagtcagcttgttgggcaatggcaagatcctggctagatgttcaagtggatctagaattatctcagtaccaaacaagtagaccagaaaagcaacttgatgacgacatgaatggagcccaaagttcagttggtccagaaagttggccataccatgttcttgatcagcaacctcatgatttaactgctcttctgcagaaactccactcaagtgaccttgttcatgaaactgtctctcgagcatgccgagagcagcatcgacaaattcagatgaatctcatgagtggaaatatatctcatcttcttgaccttctatggtcatggttatcacctgctgaagagaaccataataatactgcaaggccccttgatgaccctgagatgatacggttcggggcgcatattgttcttgtgctgaggcaccttttcagtgatgggatggatgatgagttagatgaaaaactggttactgtcggtgatctcatcatcaacatgtacgtgaggtatttgttctcagaggatcaagaggagttggttggaatatatgcctcacagcttcaacatgacctttgcattactttgtttgtagaaatgatggaactaaggttaaatagcagtttgcatactatgtacaagctcttcctttctgctgtggagtatctgccattctcatctgataatgtatccaaggcttgttttgaagagatcatcgagagggtgctttcaagatctcggcaaacaaaacccactaagtatgatggggatttctctgatgttgcgcatcaacatcacctgcaatcacttcaaaaggctatggttattcagtggctttgcttcacaccaccatcctcgattccagactttcaaatgatcagttggaagcttctgatacgggcattgacacatagcaatacactgttcagggagttttctctgatatcaatgaggagagtccctgagctaccagcagggccacacaagttgcttgccattttagctgaaccgttaaagcaaaaagaaaatttaatttcacgggaagatccggagcatgaatattactcccttgacgcgacttaccgcagttggcttaaaattgagatgatgaatgccgctgtttctcctgagatgctttcggcagaggaaaagggtcaagctgttgctgcagctaaagaaacactgaacttggcatgttcgttactacgcaatgcaacatcatgcacagctttgacaagtgcactatattcaactgtcagtgaagatgatgtgctgcatcgcctgttgaaggtggatgtccaggtctcttctagagacccctgctgtattgaagttgctcttcgctgcttagcagcagaaggtgatggatatgggcttcatgaagccaacgatggaggtcttcttgctgcagtcatggctgctggctttaaaggtgaactcagtcggttccaacctggagtttcgatggcaatttcacggcttgatgcttggtattctgaccggagtggttccgtggagagcaccgctgcttacataattcgagggctgtgtcggaggtgctgccttcctgaaacaattctaagatctatgcaggcatgtatcgcactctccgcggctggtgatgatctagattactctctagataaatgtgacgaacttgttgagttagttggttcagccgagtctggaatgatgcatttgttcagccagcagcagttgcaggagttcctgattttcgagagggaatatctcatatgtacaatggagtttgaggaggaccggttgccttgtgatggctaagctttttccccacttgctgactaatccatgagacatgaccggcatgtgcattttgtggcgccgtgacccaagaacctgctgtgatgtatcgctacaccatttcaaagcgaaaagatggaatttagtgcgtaacgtggttctgcccgtttgtgcacgagaattggcccgttttggagagtcaatataagattattcaagtcgaaatcca

SEQ ID NO: 3121 - DNA, 1058 bp, Pseudoroegneria spicata
  misc_feature (902)..(904): n is a, c, g, or t
ccacaattgctctttgtggatcagaggctcaaaagcagaagtacttaccatcgttagctcagtttaaaactgttggttgctgggctttaacagagccagattatggaagtgatgcaagctccttgaaaacttcagcaaccaaggtacctggcggttggcaattagatggccaaaagcgctggataggtaacagcacgtttgcagatgtgcttgtaattttagctaggaatgcagacacaaagcaactaaatggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctatgacatgtgccatcggtatttgaaagaaaggaagcagtttggagctcccctggcagcctttcagctcaaccaagaaaagcttgttcggatgcttggtaacatccaggccatgcttcttgtcggctggcgcttgtgcaagctctatgagtctggcaaaatgacaccaggccatgctagtttgggcaaggcatggacgtccagcaagtcaatggaggtagtttctctgggtcgagagctattgggcggcaatggaattttggctgattttctagtagcgaaggcgttttgcgatctggagccgatttactcgtacgagggcacctatgacatcaacagtctggtgaccggaagagagatcaccgggattgcgagcttcaaacccgctgcagtagcaaaatctcggctttaattcttcttctgcctccannnatgatgaacaacaaagtatgaccccccccccccccccaccttgcattctggtgggtacgagtaagatcggaataagtgcaaccgaatgatcgaatgatcaaatgtaatttgtaaggcggaaggataaagtcagagctggatttgtatctatgta

SEQ ID NO: 3122 - DNA, 1101 bp, Setaria italica
gtgctcgtggtattagctaggaatgcagatacaaaacaattaaatgggtttattgtgaggaaaggagctcctggtttgaaagctacaaagattgagaacaaaattggtcttaggatggttcagaacggtgatatagtttttaataaagtgttcgtccctgaggaggaccgattgccaggtgtcaattcatttcaggatataagcaaggtcctcgctatttcgcgtatcatggtggcatggcaaccaatcggcatatcaatgggggtcttcgatatgtgccatcgatacctgaaagaaaggaagcagtttggagttcccctgacagcttttcagctgatccaagagaaacttgtccggatgctcggtaacatccaatccatgcttcttgttggctggcgcctatgcaagctttacgagtcggggaaaatgacgccaggccacgctagcctaggaaaggcttggaactccagaacggcccgcgaggtggtttccctcggccgagagctgctaggtggaaacgggattttggctgatttccttgtggccaaggcgttctgcgacctggagcccatttactcgtacgaaggcacgtacgacatcaacagcctggtgaccggcagggagatcaccggggtcgcgagcttcaagccggccgcattagcgaaagcccggttgtaaaatttgtacacagctaggaaaagaaaaaggttctacacggctgtgacgacggttcttctcgtgtcagcaacggtgtggaagcgaataaaatcaggtctcctcgtatactgaggtggttggcacaggattaaacggcagcgtaacctgatgcggacgaaaagatgttcctcgcaagtgcccggaaaccgacggtcaatgttggctggctgctcatgatgtgagtgaggacttgtagcgaactcccttgtgaatttgtactgtatggtggaggaaccaaaaacgtagaaaggtatttgttcagcctggttttttgacacggtttttgtgcatcaggcttgctgccggaatcttttgatcgttcaccgactttccgtcgggagggattggagcaccggtctcagactctcaaaggccaaattcgtg

SEQ ID NO: 3123 - DNA, 1614 bp, Amsonia hubrichtii
acagtgtccatccttgatcctcaataagctccgttactcctgcttggctactctctgtcttctttaccatgaaggttccagcttccaagactcaagaggatatgtataaagaggcgaagagctcctattttgatttgccagctttggatgtttcgcttgcatttcctcaagcaactccagcatccatctttcctccttgcacctcagactattatcaatttgatgaacttttgacccctgcggagaaggtcatcagacagagagtgagagaatgcatggaaaaagaagtagcaccaattatggcaaagtactgggagaaggcagagtttccatttgaggttgttccaaagcttggtgccttgcacattgcaggtggcacaatcaagggatatggctgtccaggtctgtcagttactgcaaatgctattgctacagcagaggttgctagagttgatgcaagttgctcgactttcattttggtacattcttctttggcaatgctcactattggattatgtggatcagaagcacagaagctaaagtatctgccatcaatggctgaaatgaaggccgtaggttgttgggcactgactgaacctgaccatggaagcgatgcaagttctctaaggacaactgcaaggaaggttgaaggaggttggatcctcgaaggtcagaagcggtggataggaaacagcacatttgcagatgtgttggttatatgtgcaagaaatacaacaaccaaccaaataaatggatttattgtgaaaaaggatgctcctggattgcaagctactaaaatagaaaataagatagggctgcggattgttcaaaatggagatattctattgaagaaagtttttgtccctgatgaagacagattgcctggtgtaaattctttccaggacacgaacaaggtgcttgctgtttctcgtgtaatggttgcttggcaacctattggcatctcaatgggtgtctatgatatgtgtcacagatacctgaaagagagaaagcagtttggtgctcctttggcagcttttcagctcaatcaacaaaagctagttcaaatgttaggcaatattcaagctatgcttctgattggttggcgcctatgcaagttgtatgagagtggtaaaatgactccaggtcatgccagcttggggaagtcatggatttctttgagggcgagggagactgtatctcttggccgagaattacttggtggcaatggaatattggcggactttttagttgctaaggcattttgtgatttggaacccatttacacgtatgaaggcacctatgatatcaataccctggtaacaggaagagagatcaccggtatagccagttttaagcctgctgctgcaagccagaggagccgcctgtaaattgtaatcttcctttctttcttttgcctggaactgtattattacatctttctctctttgggctgggttaacctgcaaggtaaatttgagagaatgaaataaaaggagggaagagcaactatgtgccaaattatctttactcagttgttggaaatttggaatacaaggtcttgtgtaaatcatagcaaatagaagttacaaatgacaaataatgttaataaattgc

SEQ ID NO: 3124 - DNA, 1728 bp, Musa acuminata
ggaaatctcttcggagctgacgtttgcccgccttcccttgtcctctctcctcgaagccctcatccatggcctcttccaaccaagatgatcatcacacggctagcatgggttcacattctggactgccaccactaaatatctcagttgcgtttcctcaagcaacaccagcatcagtctttcccccttcatcatccgactactatcaattcgatgatttattgaatcctgaagagcaggctttgcggaaaagagttcgagatgtcatggaaaaagaagtagctcctataatggcagtgtattgggagaaggcagaatttccttttcatgttattccaaagcttgctacactaagtattgctggagggactataaagggttatgggtgtccagggctatctattactgctagtgctatcgccaccgccgaagttgcaagagtggatgctagctgctctacttttattttagttcattcttccttggcaatgcttaccattgcactctgtggatcagaggcacaaaaagtgaaatacttgtcatcattggccaaatttgatactgttgcttgctgggcattaactgaaccagattatggaagtgatgccagttcattgagaaccacagctacgaaggtttcaggaggttgggttctggatggtcaaaagcgatggataggaaacagtacgtttgctgatgtgttgattgtttttgcgaggaacactagcacaaaccaaataaatggatttattgtgaagaaaggtactcctggattgagggtcacaaagattgaaaacaagattggcctaaggattgttcaaaatggtgatattattttgaacaaagtttttgttcctgatgaagacaggttgccaggtgtcaattcatttcaagatactggcaaggttcttgctgtttcgcgtgttatagttgcatggcaaccaattggcatatcaatgggggtatttgacatgtgtaaccggtacttgaaagagagaaagcagtttggagccccattggcagcatttcagattaaccaagaaaagcttgtccgtatgcttggtaacattcaagccatgcttcttgttggatggcgcttatgcaagttgtatgaatctgggaagatgaccgcaggacatgctagtttgggaaaggcatggacctctttaaaggcaagggagactgtttcccttggccgagaattacttggcggcaacggtatcttggctgattttctagtggcaaaggcattctgtgatttggagccaattttcacgtacgaaggaacctacgatataaacagcatggtgaccgcaagagaaatcaccgggattgcaagctttaaacctgctgttttggggcggtcaagtcgcctctgatctcaacaatcggacacagcagtcactccggaagaccgaaaaaaaaaaaaccgaaagcagctccaacaaacaaatggagccaacatgatgggagtatgaatagggcttctttctgtagagtcttttcttgtgggactccctctctcaaacttttttgtgttattgatgactcgataagattatgtgtaatgggcggaacgtgttggtttggaacggtgttgtggccactatgtgccttgtcgtggattagcggttggtggtcaggggggatgaactcgaggttggttgtgtcggcggtcgatctcacactcgggagattgaagtgcagtcgtcggatgtaatggactcgtcc

SEQ ID NO: 3125 - DNA, 1734 bp, Vinca minor
accatgaaggttccagcttccaagactcaagaggatatgtataaagagtccaagagctcctattttgatttaccagctttggatgtttcccttgcattcccacaagctactccagcatccatctttcctccttgtgcctcggactattatcaacttgatgaacttttgacctctgaggagaaggtcaccagacagaaagtgagagaatgcatggaaaaagaagtagccccaattatgaccaagtattgggagaaggcagagtttccattcgaggtagttccaaagcttggtgccttgcgcattgcaggtggcaccatcaagggatatggctgtcctggtctctctatcactggtaatgctgttgctacagctgaagtcgctagagttgatgcaagttgctccactttcattttggtgcattcttctttggcaatgctcactattggattatgcgggtctgaagaacagaagcaaaagtatctgccatcattggctgaaatgagaaccgtagcttgttgggctctgactgaacctgactatggaagtgatgcaagttctctaagaacgacagcaacgaaggttgaaggagggtggatccttgaaggccagaagcgatggataggaaacagcacattcgcagatctgctgctcatatttgcaagaaacacaaaaaacaaccagataaatggatttatagtgaagaaggatgctcctggattgcaagctactaaaatagaaaataagatagggctgcggatggttcaaaatggggatattctgatgaaaaatgtttttgtccctgatgaagacagattgcctggtgtaaattctttccaggatacaaacaaggtacttgctgtttctcgtgtaatggttgcttggcaacctattggcatttcaatgggtgtttatgatatgtgtcacagatacctgaaagagagaaaacagtttggcgcacctttggcagctttccaaatcaatcaacaaaagttggttcaaatgttgggcaatattcaagctatgcttttgatgggttggcgcctatgcaagttatacgacagtggtaaaatgactccaggtcaagccagcttggggaagtcatggattaccttgagagcaagggagaccgtatctcttggccgagaattacttggtggcaatggaatattggcagattttttagttgctaaggcattctgcgatttggagccaatctatacatacgaaggcacttatgacatcaattcgctggtaactggaagggagatcaccggcatagccagttttaaaccagctgcttcgagccaaaggagccgactgtgaattttaaccttcatttctttagcccggggactctttcgttaaatcattcccttttgttttctgggttttaacctgtaaggtaaatttgagaggatgaattgaaagaagggaaaataacctgcaaggtcttgtatacatcacatagcaaatagaaatgataaatcacagtgatgttaacacactatggaacagatttccttgcaaatgatttaataatatcattttatttccgtaaggtaccggaaaattctaatatcgacaggtccttgtggtactggccctacatccctctcacatgagttgagacgggatctattttgtaagtaggttccatcccaactcatatgagagggatgtggggcagtcccacaaggaccggtcaatgcctaaggtacctgttgagcaaatatc

SEQ ID NO: 3126 - DNA, 976 bp, Nicotiana tabacum
  misc_feature (901)..(901): n is a, c, g, or t
ggccatacggccggggatgcaagtgctttagggacaactgccagaaaggttgaaggaggttggatccttgaagggcaaaagcgttggataggaaatgcaacttttgcagatatactggttatttttgctagaaatacatcgacaaaccagataaacggttccatagtaaagaaggatgctccaggattgcaagctactaaaatagaaaacaaaattggactacggatggttcaaaatggagacattctcttaaagaaagtttttgtccctgatgaggatagactacctggtgtcaattctttccaggatacgaacaaggtgcttgctgtatcacgtgtcatggttgcatggcagcctattggcattacaatgggtgtttatgatatgtgtcacaggtacttgaaggagaggaagcagtttggagctccattggccgctttccagatcaaccaacagaaattggttcagatgttgggcaacattcaggcaatgattcttgtcggttggcggctttgcaagctatatgagagtggtaaaatgactcctggccatgcaagcttggggaaatcatggattactttgagggccagagagacagtttctcttggacgggaattactaggtggcaatggaatcttggctgagtttttagttgcaaaggcattttgcgatttggagcccatctacacatatgaaggtacttacgatatcaacacgttggtaacaggcagagaaattactggtcttgccagtttcaagcctgcaccattgaggcaaaagagtcgcctgtaacaatcttccttccatctgttttagcacctgtaactctggaatacttataggcaaagaaagaactacttaagaatttaaattccgtggagattttttaacgttaataacngcaacgaagttagtttaccacatattgtaataatggcaacctatatatgattcaactttgttagcggccgcatga

SEQ ID NO: 3127 - DNA, 2131 bp, Theobroma cacao
atggaatagatttaaataaaattttaatatctgctctaagtttagataaatttctgatattacccttaaaatatttgttactcaaacctaattatattaattttcaaatattataaaataccctaacgctcttaaccctgattatacatatatattaaacattattataaaataaatcttaaaagaacaaataaagataatttgaaagaataattaaagagaagaaagaaagtgtttagggagagaaaagagatcttattgaattgtatatttacaaatgaagtgaaggggtctatttataagctaacaacccattgaatcatagtcctaatctaattctatctaagagttcaaatcatattacattccatgtatcttgccttttagatgagattaatgtcgaagtttagctctttaagtatagtatttaataaaggaatttaggagcccaaactttgattactaaggtttgacgcccaccgttcgacactgtcagttcctgccttggttttttgttttgtctcaaaccagaagcaaaacagcctaaacttgcgtgccaactctatcttcctccagctgccgatctgtcactttctattttatccaaaaaccgaaagaaaaaacctctcctttccatcaccatggcccttctctctaagtttcgagatgaaactgacaaaagtgccaagagttcttatttcaacttaccacccttggatgtttcggttgcattccctcaagcaactcccgcatctacttttcctcctcctgcttccgactattatcaatttgatgatctattgagtcctgaggagcaggcgatccgtaagaaagtaagagagtgtatggaaaaagaagtagctcctgtgatgacagagtattgggagaaagcggagtttccattccaaattgttccaaaacttgctgctcttcgtattgctggtggtactatcaagggttatggatgccctggtctttccatcactggaagtgctatatctactgcagaggtcgctagagttgatgcaagctgctcaacttttatcttggttcattcatctctagccatgcttactattgcattatgcggatcagaggaacagaagcagaagtatttaccttctttggcacaactcaaaactatagcttgttgggctttgactgagcctgactatggaagtgatgctagtgctctgaagacaacggcaacaaaggtaaagggaggttggatgcttgagggacaaaagcgatggatagggaacagtacttttgcagatgtgttggttatttttgccaggaataccacaaccaatcagataaacggatatctagttaagaaggattcccctggattgacagctacaaaaattgcaaacaagattgggttgagaattgttcaaaatggagatattcttttaaagaaagtctttgttcctgatgaggacaggttacccggtgtaaactcttttcaggatacaagcaaggtactggctgtttcgcgagtaatggttgcatggcagcctattggcatatcgatgggtgtctatgacatgtgtcagaggtatctgaaggagaggaaacagttcggagcaccattggcagccttccaaattaaccagcagaaacttgctctcatgctaggtaatgttcaagcaatgaccctagttggttggcgcctttgcaaattgtatgaggggggtaaaatgactcccggtcaagccagcttgggaaagtcatggattaccttgaaggcaagagaaacagtctctctcgggcgggagttactcggcggcaacggaatcttggctgattttcttgttgcaaaggcattctgtgatttggagcccatttatacatatgaaggcacttatgacatcaacagcttggtcactggtagggaaattactggttttgccagttttaagccagccgcactgagccagcgcagccgcctttgatcgtgtaaacctccttcctggactctgtataaggtctaaaacaaagtcgataaacttctcacagaaagttaaataagttcagtgcctttgcacaattgtaataataaaagaaatagtgcaaatatttctgccattgcttgcttaatgctcacgtaaatcagcctttttattct

SEQ ID NO: 3128 - DNA, 1564 bp, Gossypium hirsutum
ttccattttcgttccgatccgtagctctcatttcagcaccatgactgttcactcccagattcaagatgaaactggcagaagtgtcaagccttcttattttaactcgccacctttggacgtttcggtcgcattccctcaggcaactccagcatctacttttcctcctcttgcttccgactattatcaatttaatgatctattgagtcctgaggagcaggctctacgtaagaaagtaagagagtgtatggaaaaagaagtagctcctataatggcagagtactgggagaaggcagagtttccattccaaattgttcccaaacttggtgctcttcatatttctggtggtactatcaagggttatggatgcccaggtctctccctcactggaagtgctattgcaatggcagaggttgctagggttgatgcaagttgctcaacttttatcttggtgcactcatctctagccatgcttacaattgcattgtgtgggtcagaggaacagaagcagaagtatttaccatcattggcacagttaaaaactgtagcttgctgggctttgactgagcctgactatggaagcgatgctagttctctgaagacaactgcaacaaaggtagaaggaggatggatacttgagggacaaaaacgctggataggaaacagtacttttgcagatgtgttggttatctttgccaggaatactacaaccaaccagataaacggatatttagttaagaaagattcccctggattgacagctacaaaaataccaaacaagattggattgcgaattgttcaaaatggagatattctcttaaagaaagtctttgttctggatgaggacagattacctggtgtgaactcttttcaggatacaagcaaggtacttgctgtttctcgagtaatggttgcatggcaacctatcggcatatcgatgggtgtctatgatatgtgtgccagatacctgaaggagaggaaacagtttggtgctccattggcagccttccaaattaaccagcagaaacttgctcgcatgttgggtaatattcaagcaatgacccttgttggttggcgcctttgcaaattgtatgaagagggtaaaatgactcccggtcatgccagcttgggaaagtcgtggattacctcaatggcaagagagacagctgctcttgggcgggagttacttggtggcaatggaattttggccgattttcttgttgcaaaggcattctgtgatttggaacccatttacacatacgaaggcacttatgacatcaacagcttggtaactggtagggaaatcactggttttgccagttttaagccagcctcagtgagccagcgaagccgcctatgagaagtaccgtgtagactttcttcccttcgaacttgttacagtaaaagttgaataatgtaaaaaagaatcctaaacagagtcaatcaacttattacagtagaagttaaataaattattgcttctgttgccattacttgcttaatgcttttgaatgtgaatcaacatttttttatcattataatattgaggaagaggtaaggggaataa

SEQ ID NO: 3129 - DNA, 1386 bp, Orobanche aegyptiaca
aaagttcgagagtgcatggagaaagaagtagctccgataatggcgaagtattgggagaaagcggaatttccttttgaagtggttccaaaacttggtgcgttgcgtgttgctggtggtagtatcaagggctacggttgtccaaacctctccatcactgcaaatgccattgcaacagcggaagttgcaagagttgatgccagttgttctactttcattttggtgcactcttctttggctatgcttactattgcattgtgtgggtccgaagaacagaagcaaaaatacttaccgtctcttgcagagctaaagactgtaggatgttgggctttgacagaacctgattatggtagtgatgcaagtgcgttgagaacaactgcaagaaaggttgagggtggttggatactcgatggccaaaagcggtggataggaaacagcacatttgcagatgttttacttatttttgctagaaatactgccacaaatcagataaatggattcatcctaaagaagaacactccaggcttacaagctactaaaatagaaaacaaaattggtctaagaattgttcaaaatggtgatattctcatgaagggcgtttttgtccctgatgaagacaggcttcctggagtcaattcttttcaggatacgaacaaggtgcttgctgtctcgcgcgtcatggtggcctggcagcctattggcatatccatgggtgtttatgatatgtgtcacaggtacttgaaggagaggaagcaatttggtgccccattagcagctttccaactaaaccaacaaaaactagttcggatgttaggtaatgttcaagcgatgcttcttgttggttggcgtctgtgcaagctgtatgagagtggtaagatgactcctggtcatgctagcatgggcaagtcatggatttccttgaaggcgagagagaccgtttctcttgggcgggagttacttggtgggaacggaattttagccgactttcttgttgcaaaggctttctgtgatttggagccgatattcacgtatgaaggtacttatgacatcaacaccctggtaaccggcagggagattactggaattgctagttttaagccgcctgcattgagcaaccgaagccgtttgtagtatttgcctgatgcccaagatactaaaattcactctgtaagttgtatttggctcatgtgctcaacaatggaactgtgttgagcaagcgaagccgttttgtgtgattcatataggaatcaacatgacaatgtcccagtagtaaagcaagaacgaagtccagtcaaataaattttatttataccatagaactgtcgttgttcgagacttgttttgaataatgaacgattttattaataaataataataaatgttgttcta

SEQ ID NO: 3130 - DNA, 1682 bp, Prunus persica
ctcatttgtttttcgttaaagctccaccgaaagaaaacgaaaaaacagaggaaggcctcctttttctatccctcatcgttttctcttgaagtttcacagccatgacagtacctccgaatcaagatgatgttaacaagaatgagaggactaattacttcaattcacctgcaatggatgtctcacttgctttcccgcaagcaacaccagcatctacctttcctccctgcacttcagactattatcagtttgatgatctattgacgcctgaggagcaggctgtcagattgagagtaagacagtgtttagagaaagacgttgcacctattatggcagagtattgggagaaggcagagtttccatttcatgttattccaaagtttggtgcattgcgtattgctggtggcacgatcaagggttatgggtgtcccggtctttctattacagcaaatgcttttgctacagctgaaattgctagagttgatgcaagctgttctactttcttcctagttcattcctcacttgcaatgctaactattgcattatgtggatcggaggctcaaaagcaggaatatttaccttccttggctgaattaaaaactgtagcctgctgggctttgactgagcctgactatggaagtgatgcaagtgccttgagaacaacagcaacaaaggtggaaggcggttggatacttgagggccaaaagcgctggatagggaatagtacctttgctgatgtattggttatttttgctaggaatacaacaacaaatcagattaatggatatatagtaaagaagaatgtccctggactgactgctacaaaaatagaaaataaaattggtttgcgaattgttcaaaatggagatattctcttaaagaaagtctttgtccctgatgaggacaggttacctggtgttaattcttttcaggatactagcaaggttcttgctgtttcacgtgtcatggtcgcctggcaacctattggtttatctatgggagtctatgatatgtgtcacaggtatctgaaggagaggaaacaatttggagccccccttgcagctttccaaatcaaccaagagaaacttgttcgtatgctgggtaatgttcaagctatggtacttataggttggcgcctctgtaagttgtatgagaagggtaaaatgactccaggtcacgctagcttggggaaggcatggattactctgagggcaagggaaacggttgctctagggagggaattactaggtggcaatggaattttagctgattttcttgttgcaaaggctttcggtgatttggaacccatctacactttcgaaggtacttatgacatcaacgccctggtgacaggtagggaaatcaccggcattgccagcttcaagccagctgcatcaagccaacgaagccgcctgtagcggtgaagcttctctgaatttccacagctctcgggacaactttgtttaattagtaacagtgttggctgatgccaaggtggatttaaataagaaacaatcatgagacatgggagtgaatacatctatcggcgaccacaacaataaatttgcattataaattcttcttgttgaacattgtattcttatagttgtgaaagacagaaatcttagcagaaacaaatgtcccgtcaccaaactagagtttaccctgaatcttttgtagactta

SEQ ID NO: 3131 - DNA, 1314 bp, Plantago ovata
tgctggtggtagtatcaagggctatggttgtccaacctatcaattactgcaaatgctattgctactgcggaacttgcaagagttgatgccagctgctctactttcatattggtgcattcttctttgggaatgcttactattgcactctgtggatcagaagaacaaaagcagaaatatttgccatctctcgccgaactgaagactgtagcttgctgggctcttacagaacctgattatggtagtgatgcaagtgcattgaagacaactgcaaggaaggttgatggaggttggatactcaatggccaaaagcgctggataggaaacagcacttttgcagatattttagtcatttttgcaagaaatccttcaacaaaccagataaatggatttatagtcaagaagaacagcccaggtctaaaagctactaagatagaaaataaaattggcttgaggatggtgcaaaatggagatatccttttgaagaatgtctttgttcctgatgaagacaaactgcccggagttaaatcttttcaggatacaagcaaggtccttgctgtttcacgtgtcatggttgcttggcagcccatcggcataacaatgggtgtatacgacatgtgtcacaggtacttgaaagagaggaagcaatttggtgctccactggcagctttccagatcaaccaacaaaaattggtccgcatgttaagtaatattcaagcgatgcttcttatgggatggcgcctatgtaagctttatgagagtgataaaatgactcctggtcaagctagcttgggcaagtcgtggattagcttgacagcacgggagactgtttctattggacgagaattacttggcggaaatggaattttagctgactttctcgtagccaaggctttctgtgatctggagccaatatatacctatgaaggtacttatgatatcaacaccttagttaccggaagggagatcactggaattgctagttttaagccagctgcattgggaaaccggagccgtctgtagaaatgcatctcatgtccagaatagtgcatgtttggggaatggagatcctatccatacggatattgtcctcatgttctttgaagtgttgtacatctaaagcacgacagtacaactcaataaagcatttgaggacaatgtcctcaaggatagattgaaataatctgtatgtttggacatttggatgtactaatatcgacacaacactgtacaataatatgaaccaggggcgtaaattatgagattgtaggataataacgtaacaagttctaattttatttagctctacggacgggc

SEQ ID NO: 3132 - DNA, 931 bp, Platanus occidentalis
agcaacaaaggtagcaggaggttggatacttgatggccaaaagcgttggattggaaatagtacttttgctgatttgttggttattttttgctcggaacacaaacaccaaccaaataaatggatttattgtgaaaaaggatgctcctggattaacagctacaaaaatagaaaataaaattggtctaaggattgtccagaatggggatattgtcttgaagaaagtgtttgtccctgatgaagacagattacctggtgtgaattcatttcaggatacaagcaaggttcttgctgtttcacgtgtcatggttgcctggcaaccaattggggttgcaatgggtgtctatgatatgtgtctccggtatttgaaagagaggaaacagtttggagctccattggctgcttttcaaattaaccaagagaaacttgtacgcatgttgggaaatattcaagcgatgttcctgcttggttggcgcttatgcaagctgtatgagtcagaaaagatgactccgggtcatgctagtttggggaaggcatggatttccttgaaggcgagggagactgtttctcttgggagagaattacttggtggcaatgggatcatagctgattttctagttgcaaaggcatttggtgatttggagcccatttacacatttgaaggcacttacgatattaacagcttgatcacagggagagagatcactggcattgcaagtttcaaacctgctgtatcgactcaacgaagccgtctgtaaagtgtcaagtccctctttccagtctcagatcctcgagtttcttctctctgcaagggtaatccataagtccatgttaccattcggctggattgttggaagataatgaacagaatggattacgtagaacgattaataaatccgtgttgtatttttttaattaataattaattcatgtt

SEQ ID NO: 3133 - DNA, 1292 bp, Tabernaemontana elegans
aagggatatggctgtcctggccactccattactgctagtgctattgctatagcagaagttgctagagttgatgcaagttgctccacttcattttagtgcattcttctttggcaatgcttactattgcattatgtggctctgaagcacagaagcaaaagtatctgccatcattggctgaagtgaacactgtagcttgctgggctctgactgaacctgactatggaagtgatgcaagttctctaagaacaactgcaaggaaggttgaaggaggttggatccttgaaggccagaagcggtggataggaaacagcacatttgcagatgttttagttatatttgcaagaaacacaacaaccaaccagataaatggatttatagtgaagaaggatgctcctggattgcaagctactaaaatagaaaataagatagggctgcggattgttcaaaatggggatattctattaaagaaagtttttgtccctgatgaagacagattgcctggtgtaaattctttccaagacacaaataaggtgcttgctgtttcccgtgtaatggttgcttggcaacctattggcatttcgatgggtgtttatgatatgtgtcacagatacctgaaagagagaaagcagtttggtgctcctttggccgctttccagatcaatcaacaaaggctagttcaaatgttgggcaatattcaagctatgattctggttggttggcgcctatgcaagttatatgagtgtggtaaaatgactacaggtcatgccagcttggggaagtcatggattactttgagggcaagggagaccgtatctcttggccgagaattacttggtggcaatggaatattgtctgactttctagttgctaaggccttctgcgatttggagcccatctacacgtatgaaggcacttatgacatcaataccctcgtaacaggaagggagatcactggtatagccagttttaagcctgctgcttcagggcagaggagccgcctttaaattgtaaacttccttccttcctttgtcttggggactctatcattacatcattgtctctttgggctggctaactttccagataaaattgagaggatgaattggaaggagggaagagcgagtattgagatgtggagggtttgctggttaggattccagggtcaataatcttgtgtagtgttgaaaatttggaataggaagtcttatataaattttagcaaatagaaatgataaatcacaatgatgtaatgtaacacacgatggggagcattttcgttgaaaataactcaa

SEQ ID NO: 3134 - DNA, 1677 bp, Fragaria vesca
ggagtgtccttgcaacatagtaggtaaccaaatgattacatttttgccaatatttggatgaccacataaaagcctagagttgcgtgccaactctatcttcctcgtcactgatccgccataacccgtcttgagctcaccaatatcgccactcaccacaacgaaccggcagcactgaaaaagcccaattcttgcctcaccatgacgatacctccaaatcaagatgatggtaaagcgaggactacttatttcaattcgcctgcactggatgtctcccttgcttttccccaagcaactccggcgtctaaatttcctccctgcacttccgactattatcaatctaatgatctattgacgcctgaggagcaggctctcaggatgagagttagacactgtgtagagaaagaagtagctccaatcatggcagagtattgggaaaaggcaaagtttccatttcatattattccaaagctcggtgccttgcgaattgctgggggcacaatcaagggttatgggtgtcccggtctttctgttacagcaaatgctattgctacagcggaagttgctagagttgatgctagctgttctactttcatcctagtgcattcatcactagcaatgctcactattgcattatgtggatcagaggctcaaaaacagaaatatttaccgtctttggcagagttcaaaactgtagcctgttggggtttgactgagcctgattatggaagtgatgcaagtgccttgaaaaccaccgcaacaaaggtggaaggaggttggatacttgacggccaaaagcgctggataggaaatgctacctttgctgatgtgttggttatttttgcaaggaatacaacaacaaatcagatcaatggatatatagtaaacaagaatgtccctggactgaaagctacaaaaatagaaaataaaattggtttgcgcatggttcaaaatggagatattctcttaaagcaagtttttgtccctgatgaggacaggttacccggtgttaattcttttcaggataccagcaaggtacttgctgtttcccgcgtcatggttgcctggcaacctattggtatatctatgggtgtctatgatatgtgccacaggtatctgaaggagagaaaacaatttggagcacccctagcagctttccaaatcaaccaagagaaacttgttcatatgctgggtaatgttcaagctatgatacttataggttggcgtctctgcaagttgtacgaagcaggtaaaatgactccgggtcaggctagcatggggaagtcatggatcactgtgaaagcaagggaaactgttgctctagggagggaattactgggcggcaatggaatcttatccgattttctggttgcaaaggctttctgtgatttggaacccatctacacctacgaaggcacctatgacatcaacagcctagtgacaggtagggaaatcactggggttgccagcttcaaaccagctccatcaagcaaacgaagccgcctgtagcagcattactttctagatctcaactctgtaaaactctttctagatctcaactctgtaaaaccaagtgttgtttcatgtcaacacggtttaaataagaaagatagaccggtacttctgtatcatccattcaagtgttgaatagttgacaacagaaaatatagttataataac

SEQ ID NO: 3135 - DNA, 1597 bp, Fragaria vesca
tgcgtgccaactctatcttcctcgtcactgatccgccataacccgtcttgagctcaccaatatcgccactcaccacaacgaaccggcagcactgaaaaagcccaattcttgcctcaccatgacgatacctccaaatcaagatgatggtaaagcgaggactacttatttcaattcgcctgcactggatgtctcccttgcttttccccaagcaactccggcgtctaaatttcctccctgcacttccgactattatcaatctaatgatctattgacgcctgaggagcaggctctcaggatgagagttagacactgtgtagagaaagaagtagctccaatcatggcagagtattgggaaaaggcaaagtttccatttcatattattccaaagctcggtgccttgcgaattgctgggggcacaatcaagggttatgggtgtcccggtctttctgttacagcaaatgctattgctacagcggaagttgctagagttgatgctagctgttctactttcatcctagtgcattcatcactagcaatgctcactattgcattatgtggatcagaggctcaaaaacagaaatatttaccgtctttggcagagttcaaaactgtagcctgttggggtttgactgagcctgattatggaagtgatgcaagtgccttgaaaaccaccgcaacaaaggtggaaggaggttggatacttgacggccaaaagcgctggataggaaatgctacctttgctgatgtgttggttatttttgcaaggaatacaacaacaaatcagatcaatggatatatagtaaacaagaatgtccctggactgaaagctacaaaaatagaaaataaaattggtttgcgcatggttcaaaatggagatattctcttaaagcaagtttttgtccctgatgaggacaggttacccggtgttaattcttttcaggataccagcaaggtacttgctgtttcccgcgtcatggttgcctggcaacctattggtatatctatgggtgtctatgatatgtgccacaggtatctgaaggagagaaaacaatttggagcacccctagcagctttccaaatcaaccaagagaaacttgttcatatgctgggtaatgttcaagctatgatacttataggttggcgtctctgcaagttgtacgaagcaggtaaaatgactccgggtcaggctagcatggggaagtcatggatcactgtgaaagcaagggaaactgttgctctagggagggaattactgggcggcaatggaatcttatccgattttctggttgcaaaggctttctgtgatttggaacccatctacacctacgaaggcacctatgacatcaacagcctagtgacaggtagggaaatcactggggttgccagcttcaaaccagctccatcaagcaaacgaagccgcctgtagcagcattactttctagatctcaactctgtaaaactctttctagatctcaactctgtaaaaccaagtgttgtttcatgtcaacacggtttaaataagaaagatagaccggtacttctgtatcatccattcaagtgttgaatagttgacaacagaaaatatagttataataac

SEQ ID NO: 3136 - DNA, 1759 bp, Arabidopsis thaliana
gaaaaaaacattatcttacaaaaatccaaatactccgacttaaccgggtcggatcctggtgagtactagtatctatctcattacaattcatatccttccttcaacattcgatcatcacgaagccaaagaacaatttctccgtcactatcataaccatggcggtgctttcatctgcagatcgagctagtaatgagaagaaggtgaagagttcatactttgatttgccacctatggaaatgtctgtagcatttcctcaagcaactccagcctctacatttccaccttgtacttcagactattatcatttcaatgatctactgactccggaagaacaagctatccggaagaaagtgagggaatgcatggagaaagaagttgctccaataatgacagagtactgggagaaagcagaatttccattccatatcactccaaagcttggggctatgggtgttgctggtggctcgatcaagggttatggatgtcctggtctctccatcaccgccaatgcaattgccacagcagaaatagctagagttgatgcaagttgttcgactttcattttggtgcattcttctttgggcatgctcactattgcactctgtggatcagaagcacagaaggagaagtatttgccttctttggctcaattgaatactgtggcttgttgggctttgacagagcccgacaatggaagcgatgcaagtggtctaggaacgactgcaacaaaggttgaaggaggttggaaaattaatggacaaaagcgttggattggaaacagcacctttgcagatctgttgatcatctttgcgaggaatacaacaactaaccaaatcaacggattcatagtcaagaaagatgcgcctggcctaaaggctactaagatcccaaataaaataggtttacgtatggttcaaaatggagatattctactacagaatgtctttgttccagatgaggatcggttacctggggtaaattcttttcaggacaccagcaaggttctggctgtctcacgtgtaatggtggcctggcaaccaatcggcatatcaatgggaatctacgatatgtgccacaggtatctgaaggagaggaaacagtttggagcaccgttggctgctttccagttaaaccaacagaagcttgtgcagatgctgggtaacgttcaagcgatgtttctaatgggttggcgtctctgcaagctgtatgagacgggtcagatgactccaggtcaagccagtttaggaaaggcatggatttcatcaaaagcgagagaaactgcttcgctaggtcgggaattacttggtgggaatggaattctagcagattttctggtagcaaaggctttctgtgaccttgaacccatttatacatacgaagggacttatgatataaacaccttagtaacagggagggaagtaacgggtattgcgagtttcaaaccggctacacgtagccgtctctaagttaaaaggttgtccattgtttgttgttgtctgttggttagtattgatattgtgatgtggggtttacatctacaaatgtgccaaataatctgacccaaaaagatttagggtccaatgggggaataatatcgttgttgcaaaacttaatccagttattgcttcttgcaatatggattcgtcttgtggcttgtactgggggaaataccatttgttaaccttttattaattcaaattgccaatgtcaataacttttggtgaatgtcaaagtgtcaattaagttgtgtttctttgtt

SEQ ID NO: 3137 - DNA, 1935 bp, Citrus sinensis
aaactgaattattttattaatcatataaaaagagacctaaacttgcgtgccaaatttatccttcaattagctcccccagtacgatccgatactctcatctcatctccttcagtttcttatttttgccttttttttttccaaagcttaagacttcgctttggcgcgctctgagtttcctccgtcacatcacacacactgttatccgtaatcaccatgactattcactcatccaaacatcaagatgatgttgacaaaaatgccaggagttcgtattttaatttaccagcattggatatttcagtcgcattccctcaagcaacaccggcgtctaagtttcctccttgtgcgtcagactactatcaatttgatgatctcttgacttcggaggagcaggctgttcggatgaaagtgagagagtgtatggagaaagaaatagcccctataatggcggagtattgggagaaagcagaatttccctttcatgttattccaaagcttggtgccctacgcgtagctggtggcacaataaagggttatggctgtcctggtcactctgttactggagctgctattgctatagcagaaattgctcgagttgatgctagttgttctacttttatattggtgcattcctctctggcgatgctgactattgcattgtgcgggtcagaggaacagaagcagaaatatctgccttctttggctcagttgaacaccattgcctgttgggctttgactgaacctgcctatgggagtgatgcaagtgctttgaacacaactgctactaaggtggaaggaggttggatacttgaaggtcaaaagcgctggataggaaatagtacctttgcagatgttttggttatttttgctcggaatacaacaacaaatcagataaatggttatttagtgaagaaggatgctcctggattaacagttacgaaaatagaaaacaaaattggtctacggattgttcaaaatggagatattctcttaaagaaagtctttgtgcctgatgaggacagattgcctggtgtcaattcttttcaggatacaagcaaggttcttgctgtttcacgtgtaatggtagcctggcaacctattggtatatcaatgggcgtctatgatatgtgtcacaggtatctgaaggagaggaaacagtttggagcaccattagcagcttttcagatcaaccagcagaaacttgttcagatgctgggaaatattcaagccatgattctggttggttggcgcctttgcaaattatatgagaaaggtgcaatgactcctggtcatgccagcttgggaaagtcttggatcactgcaagggctagggaaacagttgctcttggacgtgagttacttggtggcaatggaattttatctgattttctagttgcaaaggcattctgcgatattgaacccatctacacatatgaaggaacctatgatattaacactttggtaactggtagagaagtcacgggtattgcaagcttcaagcctgtggctttggcaactcgcagccgtctttgatggtacactctttccctacactcgtgttggtggatagagtgtgctttgattggaaaaataaaacctgtaatatcttggaagatgaaagcaaataagttaatacaagatgtgtatagaacatgacaaattaaaaaatgaaaaaggcactcgtctccttatcagcctttagtattacatggcctacccagattaatctggccatacgaacattatttttgttgttgattgctggttttgtctatcaatgtctgaagctgattctaaggagtcaatgttcttcataatgggcaaacacgaaaaatagcagacattttgtcagggtatcgtttctaagtattgtgttttgccttaatttttagaatataaaatttgagagtatgaattcttatttggcacctgata

SEQ ID NO: 3138 - DNA, 923 bp, Curcuma longa
gcaccagtgaaacagtacatttgctgatctgctaatcatttttgccttgaatactagtagcaaccagataaatggatttatgtgaagaagggtgctcctggattaaaggccacaaaaattgaaaataagattggcctgaggattgttcagaatggtgatattgttttggaaaaagtttttgtccctgatgaagataggttaccaggtgtcaactcctttcaagacacaaacaaggttcttgctgtttcacgtgttatggttgcatggcaaccaattgggatagcaatgggggtctttgatatgtgcaacaggtacttgaaagagagaaagcagtttggtgccccattagcagcatttcagcttaatcaggaaaagcttgttcgcatgcttggtaatattcaagcaatgcttctcattggttggcgtctctgcaaattgtatgaatctgggaagatgactgcagggcaagcaagcttgggaaaggcatggactaccttaaaggcaagggagactgtttcccttgggcgagaattactcggcggcaatggaattttggctgattttctagttgcaaaggcattttgtgatctggaaccaatttacacatacgaaggaacctacgatataaacagtatggtaactgccagggagattacagggatctctagctttagacctgctgctttgaggacatcaagtcgtctttgatgccatctatctacttcaagtgcatactctgttaactttccaggcataaataaaatctgcactgttggactcgaagataaagtacatcctgccactaaactgacaggagcataaaagtctttcatgcaatgacctggttaagtctttccatgtctaaatgttatttcagatatcaaatttcaatatgtaaactataataaatatcatcttatttt

SEQ ID NO: 3139 - DNA, 1676 bp, Vitis vinifera
gccatatttctaagctttgactctcttctcttctgcgaaaacccttaacttcaccggatcttccatttctctccgtccttcgtcaatccccatgacgatttattcatccaataacgcaggttattcatccaacaatccagatgattctgaaaaggctaaaaagggttcttattttggtttaccatccttggatgtttctgtcgcattcccccaagcaactccggcatccatatttcctccctgtgcttcagactattatcagtttgatgatcttctgactcccgaagagcaagccctccggatgaaagtgagaaagtgcgtggaaaaggaaattgctccgataatgacagagtactgggagaaggcagagtttccatttcatgttgttccaaagcttgctgccctgcgtattgctggtggaacaatcaagggttatgggtgcccaggtctttccgttactgcaagtgctattactactgcagaagtttccagggttgatgcgagctgttctactttcattttggtccattcttctctggcaatgcttactattgcactgtgcggttcagaggcacaaaagcagaaatatctaccttctttggcacaattaaacactatagcttgttgggctttaactgagcctgactatggaagtgatgcaagttctctgaaaacaacagcaacaaaggtggaaggaggttggatacttgaaggccaaaagcgttggataggcaatagtacctttgctgatgtgttgattatttttgctaggaatacgaccaccaatcagataaatggatacatcgtaaagaagggtgcccctgggctaactgctacaaaaatacaaaataaaattggtctacgaattgttcaaaatggtgatattcaatttaagaaggtttttgtccctgacgaggacagactaccaggtgttaattcttttcaggatacgaacaaggtgcttgctgtttcacgtgtcatggttgcctggcaacctataggcatttcaatgggagcctatgatatgtgtcacaggtatctaaaggagaggaaacagtttggagcacccttggcagctttccagatcaaccaacagaaacttgttgaaatgctgggtaatattcaagcgatgactcttgttggttggcgactttgcaagttgtatgagaagggtaaaatgactccaggtcatgccagcttggcaaaggcatggatcaccttgaaggcaagggagactcttgctcttgggcgtgagttactaggtggcaatggaatcttggctgattttctagttgcaaaggcattctgcgatttggagccaatctacacatatgaaggcacctatgacataaacaccttggtgacaggtagggaaatcactggtattgccagcttcaagcctgccgcactgaaccgacgtagccgcctgtaacctgtagactagtgtcagctgatacagctatcatgcggacagaccaagaataaataaaagatggatgcaatttatcagtgctgcttgtagaagtaaccaaaggaaatgaaataaaaaggtgtaacagatcttttacctatgggtattaaattatcagcgattctattcaaattactaaattttatgaagcatggttggatgatataaccaacatgagatgcagattacctttcctgtggcttat

SEQ ID NO: 3140 - DNA, 845 bp, Petunia hybrida
tgattatttttgctagaaacatatccacaaaccaaataaatggtttcatcataaagaaggatgctccaggcatgcaagctactaaaatggaaaacaaaattgggctgcggattgttcaaaatggagatattctcttaaacaaagtctttgttcctgatgaggatagactacctggcgtcaattctttcaaggatacaaacaaggtgcttgctgtatcacgtgtcacggttgcgtggatgcctataggcattgcaatgggtgtatatgatatgtgtcacaggtatttaaaagagaggaagcagtttggagctccgctggctgctttccagatcaatcaactgaagctggttcagatgttgggcaacattcaggctatgattcttgttggctggcgcctttgcaagttgtacgagagtggtaaaatgactcctggtcaagctagtttggggaaatcatggactaccttgcgggcaagagagactgtttctcttgggcgggaattacttggtggcaatggtatcttggctgactttctagtggcaaaggcattctgcgacttggagcccatctatacatatgagggtacctatgatatcaacaccctggtcacaggtagagaaattacaggttttcctagcttcaagccagcaacattgaggcaaaagagtcgcctgtagtatctcaacaatcttcgtacgctctgaaaatggttctgctgaattgaatgtacctgtacaatacctgtgtgtaaaaggaaaggaagtcgataatattagtcccttcaatattagggatgataatcataaagaaggtaaaatgccactgtgataatgcaaacattgtat

SEQ ID NO: 3141 - DNA, 1546 bp, Aquilegia formosa
ttctttttctttagttttatcgtcttctttcttctttcttcttcttcagtttcaacgataaaacatgactattaatccttcttcacaaaagccagataataatgattctaaatatgatgtcaagattggattacctgctttggaggtttcccttgcatttcctcaagcaactccagcatcaacgtttcctccttgtgcttcagactattatcagtttgatgatctattgacatccgaggaacagaatctcagaagacatgtcagagcaattatggaaaaagaaattgctcctataatgactgagtactgggaaaaggccgagtttccatttcacgccataccaaagcttgctgacttgagggttgctggtggcacagtaaagggttatgggaatccagggctctctattactggaagtgctattgctacagcagaagtggccagagttgacgctagctgttctacatttattttggtgcactcatctttggctatgctgacaattgcactctgtggatctgaggcacaaaaacaaaaatatttaccttccctggcccaatttcgcactgtagcttgctgggctttaacagaacccgactatggaagtgatgcgagttcattaagaaccacagcaacaaaggtagatgggggctggattgttgaaggtcaaaaacggtggatagggaacagtacttttgctgatgtgttggttgtttttgctagaaacagaactacgaaccagattaatggatttattgtgaacaaaggtgcccctggactcaaagttaccaaaatagaaaacaaaattggcctaagaatggttcagaatggtgatattctcttacagaaagtatttgtccctgatgaggataggttacctggtgtcaactcgttccaggatacaagcaaggtacttgctgtttcacgtgtcatggttgcatggcaaccaattggcattgcaatgggtgtctatgatatgtgtctcaggtatttgaaagagaggaaacagtttggagttcctctggcagcatttcaaatcaaccaagagaaacttgtccgcatgttaggaaatgtccaagcaatgtttcttgttggctggcgcctttgcaagctgtatgagtcaggaaagatgaccgctggccatgctagcatggggaaggcatggattacgttgagggcaagagagaccgtttcccttgggcgagagttacttggtggcaacggaattttggcagatttcctagttgcaaaggcattttgcgacttggagcccatatttacctatgagggtacatacgatattaacagcttggtgacaggaagagaagttacaggtgttgctgccttcaaaccagctgctctgaagcaacacagccgcatgtaattgtttgttatctttgtttttgaacacgaggtctctttccctggaagaatggatttgtacggcggtgaaagataatgaacacaaagtatcttctaaggccatctcaatttgtacggaaaacatctaacttaattctgatgaattgatctgttgatccgtgta

SEQ ID NO: 3142 - DNA, 981 bp, Aquilegia formosa
tgtagcttgctggggctttaacagaacctgactatggaagtgatgcgagttcattaagaaccacagcaacaaaggtagatgggggctggattgttgaaggtcaaaaacggtggataggaaacagtacttttgctgatgtgttggttgtttttgctagaaacagaactacgaaccagattaatggatttattgtgaacaaaggtgcccctggactcaaagttaccaaaatagaaaacaaaattggcctaagaatggttcagaatggtgatattctcttacagaaagtatttgtccctgatgaggataggttacctggtgtcaactcgttccaggatacaagcaaggtacttgctgtttcacgagtcatggttgcatggcaaccaattggcattgcaatgggtgtctatgatatgtgtctcaggtatttgaaagagaggaaacagtttggagttcctctggcagcatttcaaatcaaccaagagaaacttgtccgcatgttaggaaatgtccaagcaatgtttcttgttggctggcgcctttgcaagctgtatgagtcaggaaagatgaccgctggccatgctagcatggggaaggcatggattacgttgagggcaagagagaccgtttcccttgggcgagagttacttggtggcaacggaattttggcagatttcctagttgcaaaggcattttgcgacttggagcccatatttacctatgagggtacatacgatattaacagcttggtgacaggaagagaagttacaggtgttgctgccttcaaaccggctgctctgaagcaacacagccgcatgtaattgtttgttatctttgtttttgaacacgaggtctctttccctggaagaatggatttgtatggcggtgaaagataatgaacacaaggtatcttctcaaggccatctcaatttgtacggaaaacatctaacttaattctgatgaaatgatctgttgatccgtgta

SEQ ID NO: 3143 - DNA, 842 bp, Cenchrus ciliaris
ttaaaaacacaattggactcaggatgctacaaaatggagacataattctaaataaagtatttgtccctgaggaagacagattacctggcatcaattcatttagggatatagacaaggtgtttgccatatctcgtgttacggggacatggcagctaataggcatatcaatgggagtttttgacatgtgccataggtatttgaaagaaaggaagcaatttggagctccgctggctgcttttcagctcaaccaagaaaagcttgtccggatgctcggcaacattcaggccatggttctcgttggctggcgactgtgcaagctctacgagtcgggcaaaatgacatcaggccatagtagtttaggcaaggcatggatatccaggaaggccagggaggtagtttctcttggacgagagctattgggtggcaacgggatcttggctgattttctggttgcaaaggcgttctgtgatcttgagccaattttctcgtacgagggcacctatgacatcaacagcctggtgaccggcagagagatcactggggtggcgagcttcaagcctgccatgctagcgaaatcacgcctctgaagctatttgcccgtttcccttgagttgatgtgttgtgtagtggctgcaactgtgggtctgtgtgcttgagtgcctgcaaactttggctgaatgctctattggtgcgtaaacggtatgtgtgtttaattatgcccgttgcgtcgcgatgagacttgggcgtagtcccaaagtgtgggaataataagtgcagcaaaagaatgatgttgatatttaagtgagtttctcagctaatggtaagtggagcaatcattttca

SEQ ID NO: 3144 - DNA, 992 bp, Brassica juncea
ctttgacagagcctgacaatggaagcgatgcaagtgctctaacaacaactgccacaaaggtggaaggaggttgggtacttgagggacaaaagcgttggattggaaacagcacctttgcagatctattggtcatccttgctaggaatacgacaacgaaccaagtcaacggattcttagtccagaaagatgcgcctggcctaacggttactaagatcccgaataaaataggtttacgtattgttcagaatggagacattctactaaagaatgtctttgttccggatgaggagcggttacctggggtaaattcatttcaggacacaagcaaggtcctggctgtgtcacgtgtaatggtggcttggcaaccaattggtatatcaatgggagtctacgatatgtgtcacaggtatctaaaggagaggaaacagtttggagcaccgttggctgctttccagataaaccaacagaagcttgtgaagatgctgggtaatgttcaagccatgtttctgatgggttggcgcctctgcaagctatatgagacgggtcagatgactccaggtcaagccagtttaggaaaggcatggatttcatcgaaggcaagggagactgcttcgttaggacgggaattactcggtgggaatggaattgtagctgattttctggtggcaaaggctttctgtgaccttgaacccatttatacatatgaagggacttacgatataaacaccttagtaacggcgagggaagtaactgggatcgcgagttttaaacctgctgcttcacgtagccgtctttgaggttgtgtagtgtttgttgttgtctgtgggttaagaacaaagtgcgtcaaataaacttggacctctaaaagggacatgtgcaaaccattattgcaatttatggatttcatgctgtatttgtcatgtagtttcttcgcattaaattaactcaaggaataatactagttatgatttaaaatgttacaaaagaaaaaa

SEQ ID NO: 3145 - DNA, 917 bp, Lippia dulcis
ggttgagggaggctggatacttgatggcaaaaacgttggattggaaacagcacctttgccgatgttttagttatttttgctagaaatacttccacaaatcagataaatggatttatcgtagaaaagaactctcctggtttacaagctactaaaatagataacaagattggcctaagaattgttcaaaacggtgatattctgttggaaaatgtttttgtacccgacgaaggaaggcttactggagtcaattcttttcaagatactaacaaggtccttgctgtttcaagggtcatggttgcctggcagccaatcggcataacaatgggtgtttatgatatgtgtcacaggtacctgaaggagaggaagcaatttggtgccccattggcagctttccagattaaccaacagaaactagttcagatgttaagtaatatccaagcaatgttcctaattggttggcgtttgtgcaagctatacgagagtggtaagatgactcctggtcatgctagcatgggcaagtcatggattaccttgaaggcaagagagactgtttctcttggacgagaattacttggtggaaatggaattttagctgattttcttgttgcaaaggctttctgtgatttggaacctatatacacgtatgaaggcacttacgacatcaatacccttgtaactgggagggagattactgggtttgctagttttaagccccctccattgagcaagcggagccgtttgtaggactagatgccttttatcgcctcctggcacacaatgctttgatttgctgaatacttatcaagttaaaagatagttagcttgtgttcaataatctgacttggttcaattcggatgtatgattgggaagaaatagtgaagaaactcccagtcattacgtatcttaagatatacta

SEQ ID NO: 3146 - DNA, 1414 bp, Malus domestica
tcctctcccaacgggaaaaaggaaaagaaaattcccccgaacgccaacagttcgagctccgagctcccaattttcctccttgtcgccatgacagttcctccgaatcaagatgatgttaagaagaatgaaaggacgaattatttcaattcccctgcattggatgtctcacttgcttttccacaagcaacgccggcatccacctttcctccctgcgcctcggattattaccagtttgatgatctattgactcctgaggagcaggctatgagattgagagtaagaaagtgtatggagaaagacgtcgctccaattatggcagagtactgggagaaggcagagtttccatttcaaattattccaaagcttggtgcattgcgcattgctggtggcacaatcaagggttatgggtgtcctggtctttctattacggcaagtgcttttgctacagctgaacttgctagagttgatgcaagctgttctactttcgtcttggttcattcctcactagcaatgcttactattgcattatgtggttcagaagctcaaaagcagaaatatctaccttcattggctgaatttaaaactgtagcctgctggggtttgactgagcctgactacggaagtgatgcgagtgccttgagaacgacagcaacaaaggtggaaggaggttggatacttgagggccaaaagcgatggataggaaacagtacatttgctgatgtcttggttatttttgctaggaatacaacaacaaatcagattaatggatttataataaagaagaatgcccctggactggcagctacaaaaatagaaaataaaattggtctgcgcattgttcaaaatggagatattctcttaaataaagtatttgttcctgatgaggaaaggctgcctggtgttaattcttttcaggatactagcaaggttcttgctgtttcgcgtgtcatggttgcctggcaacctattggtttatctatgggagtctatgatatgtgtcacaggtatctgaaggagaggaaacaatttggagccccccttgcagctttccaaatcaaccaagagaaacttgttcgtatgcttggtaatgttcaagctatggttcttataggctggcgcctctgcaagctgtatgaggcaggtaaaatgactccaggtcatgctagcatggggaaggcatggatcactctgagagcaagggaaacagttgctctggggagggaattgctaggtggcaacggaatcttatctgattttcttgttgcaaaggctttcggtgatctggaacccatctacacattcgaaggcacgtatgacatcaactccttggtcaccggcagggaagtcactggcattgccagcttcaagccacctgcgtcaagccaacggagccgcctggagcagtgtaacttct

SEQ ID NO: 3147 - DNA, 1568 bp, Brassica oleracea
  misc_feature (703)..(703): n is a, c, g, or t
  misc_feature (707)..(707): n is a, c, g, or t
  misc_feature (713)..(713): n is a, c, g, or t
  misc_feature (733)..(733): n is a, c, g, or t
  misc_feature (742)..(742): n is a, c, g, or t
  misc_feature (745)..(745): n is a, c, g, or t
  misc_feature (752)..(752): n is a, c, g, or t
  misc_feature (758)..(758): n is a, c, g, or t
  misc_feature (776)..(776): n is a, c, g, or t
  misc_feature (790)..(790): n is a, c, g, or t
  misc_feature (796)..(796): n is a, c, g, or t
  misc_feature (823)..(823): n is a, c, g, or t
  misc_feature (832)..(832): n is a, c, g, or t
  misc_feature (842)..(842): n is a, c, g, or t
  misc_feature (859)..(859): n is a, c, g, or t
  misc_feature (880)..(881): n is a, c, g, or t
  misc_feature (889)..(889): n is a, c, g, or t
  misc_feature (895)..(895): n is a, c, g, or t
gcgtccgcggacgcgtgggctcgaacccaaagaaacgttttccatcgcaatcgtcgccaccatgactgtgctatcatctacagatcgagatgaggctgagaagaaggtgaagagttcgtatatcgatttgccggctatggacgtatccgttgcatttcctcaagcaaccccagcttctaagttcccaccttgcacttcagactattaccatttcaatgaactgttgactccggaggagcaggctgtgcggaagagagtgagggagttcatggagaaagaagttgctccgattatgacagagtactgggagaaggcagagtttccattccatatcattccaaagcttggagctttaggtattgttggtggctctattaagggttatggctgtcctggcctctccatcacagccaacgccattgcaacagcagagatatctagagttgatgcaagctgtgggacttttaatttggtgcatacctctttgggcatgctcactattgcactttgtggatcagaagaacagaagcacaagtatttgccttctttggctcagatgaaaactgtgacttgttgggctttgacagaacctgacaatggaagtgatgcaagtgctctacaaacaactgccacaaaggtcggaggaggttgggtacttacgggacaaaagcgttggatcggtaacagcacctttgcagatctnttgntcatcnttgctaggaatacgacaacnaaccaagtnaanggattcntagtcnagaaagatgcgcctggcntaacggttactaanatcccnaataaaataggtttacgtattgttcanaatggaganattctactanagaatgtctttgttccngatgaggagcggttacctggnntaaattcntttcangacacaagcaaggtcctggctgtctcacgtgtaatggtggcctggcaaccaattggtatatcaatgggagtctacgacatgtgtcacaggtatctaaaggagaggaaacagtttggagcaccgttggctgcattccagataaaccaacagaagcttgtgaagatgctgggtaatgttcaagcgatgtttctgatgggttggcgcctctgcaagttatatgagtcgggtcagatgactcctggtcaagccagtttaggaaaggcatggatttcatcaaaggcaagggaaactgcttcgttaggccgagaattactcggtggaaatggaattgtaggagattttctggtggcaaaggctttctgtgaccttgaacccatttatacatatgaagggacttacgatataaacaccttagtgacggcgagggaagtaacagggattgcgagtttcaaacctgctgcttcacggagccgtagccgtctttaaggttgtgcagtgtttgttgttattctgtctgtgagtttactttggtaatgtaccgtggagaacaaagttcgtcaaataaacttgacctctaaagggacatgtacaaaccataattgcagtttggattcgtgctgtatttgtctcctcacattaaattaactcaaggaataatactaaattatgtttt

SEQ ID NO: 3148 - DNA, 953 bp, Citrus sinensis
agaaggatgctcctggattaacagttacgaaaatagaaaacaaaattggtctacggattgttcaaaatggagatattctcttaaagaaagtctttgtgcctgatgaggacagattgcctggtgtcaattcttttcaggatacaagcaaggttcttgctgtttcacgtgtaatggtagcctggcaacctattggtatatcaatgggcgtctatgatatgtgtcacaggtatctgaaggagaggaaacagtttggagcaccattagcagcttttcagatcaaccagcagaaacttgttcagatgctgggaaatattcaagccatgattctggttggttggcgcctttgcaaattatatgagaaaggtgcaatgactcctggtcatgccagcatgggaaagtcttggatcactgcaagggctagggaaacagttgctcttggacgtgagttacttggtggcaatggaattttatctgattttctagttgcaaaggcattctgcgatattgaacccatctacacatatgaaggaacctatgatattaacactttggtaactggtagagaagtcacgggtattgcaagcttcaagcctgtggctttggcaactcgcagccgtctttgatggtacactcttttcctacactcgtgttggtggatagagtgtgctttgattggaaaaataaaacctgtaatatcttggaagatgaaagcaaataagttaatacaagatgtgtatagaacatgacaaattaaaaaatgaaaaaggcactcgtctccttatcagcctttggtattacatggcctacccagattaatctggccatacgaacattatttttgttgttgattgctggttttgtctatcaatgtctgaagctgattctaaggagtcaatgttcttcataatgggcaaacacgaaaaatagcagacattttgtcagggtatcgtttc

SEQ ID NO: 3149 - DNA, 1651 bp, Mimulus guttatus
ctaacttgttcatttccattaccgctaaaacatcttgtaccatttcgttcgtcgccatgaaagtaccgccttccgaagctcaagaggatatgtatagaaaggaaaagagctcctattttgattcgccggcgttagatgtttccgtcgcatttcctcaagcaactccagcttccgtctttcctccttctgtatcggactattatcagtttgatgatctgctgactcctgaggagcaagctgtcagaattaaagtaagagagtgcatggaaaaggaagtagctccgattatgactaagtattgggagaaggcggaatttccatttgaagtggttccgaagcttggagcattgcgagttgctggtggcagtatcaagggttatggttgtcccaacctctccattactgcaaatgccatagctacggctgaggttgcaagagttgatgcgagctgctctactttcattttggttcactcttctttggcgatgcttactattggactttgtgggtctgaagcacagaagcagaaatatttaccatctcttgcggaattaaagacagttgcatgttgggctctaacggaacctgattatggtagcgatgcaagtgctttgaagacaactgcaaggaaggttgagggtggatggatacttgatggccaaaagcgctggatagggaacagtacttttgcggatgttttagttatttttgctagaaacttaaccacgaatcagataaatggatacatcgtaaaaaaggacactccggggttacaagctactaaaatcgaaaataaaattggactaagaattgttcaaaatggtgatatcgtaatgaagaacgtttttgtccccgatgaagacaggcttcctggagttgattcttttcaagatacaaacaaggtgcttgctgtttcgagagtcatggttgcctggcagcctattggcatatcgatgggtgtttatgatatgtgtcacaggtacctgaaggagagaaagcaatttggtgttccgttggcatctttccaaatcaaccaacagaaattagttcgcatgttaggtaatgtgcaagcaatgtttcttgttggttggcgactatgcaagctttacgagagtggtaagatgactcctggtcatgctagcatgggcaagtcatggatttctctcaaggcaagggagactgtttctcttggacgtgaattacttggtggcaatggaattttatccgactttcttgtcgcaaaggctttctgtgatttagagccaatatacacttatgaaggaacatatgacattaacaccctggtaactggaagggagatcactggaattgctagttttaagccagctgcatcgagcaatcgaagccgactgtagtattgctcgctcgtactaaagatactggaattactcttgaagctgggtggatctgtgcaagctatttggattatttatgtatgtaattcaaaagaaatcaacgtgataaaagttccaaacgtaataaagaaatctacatcaagagggttgggtcgaaataaggtttactttgtataagcagaagtattagttattaaattaatttaaaaacttgtatctgcagaaatattgttgtttgaaaccagtttcagttcttatgttagttagttaatctt

SEQ ID NO: 3150 - DNA, 1743 bp, Carica papaya
gaaccagattatcattcatcagcatcagctgcatctctccactgccattttcacctcgacagaatcctaccctcaatatcatacagtttctcttcttccatcatgacacttccctcatctacaaatccagatgggaacaaaagggaaagaagtgcttattttaattcaccagcactggatatttctgtggcatttcctcaagcaactccagcatctatatttcctccttgtgcttcagattattatcagtttgatgatctattgactcctgaggagcaggctctccgcttgaaagtaagagaatgtatggaaaaagaagtagctccagtaatgacagagtactgggagaaggctgagtttccatttcacgttgttccgaagcttgccgccttgagaattgctggtggaacaatcaagggttatggttgtcctggtttgtccatcactgccagtgctattgctacagcagaggttgctagagttgatgcgagctgttctactttcattttggtgcattcatccttggcaatgcttacaattgcattgtgcggttcggaatcacagaagcagaagtatttaccttctttggctcggtttaacactgtggcttgttgggccttaacagagcctgactatggaagtgatgcgagtgctttgagaacaactgcaacaaaggttgaagggggttgggtactcgagggtcaaaagcgctggataggaaacagtacatttgccgatttgttagttatttttgctaggaatacttcgacaagtcaaataaatggattcatagtaaaaaaggacgcaccaggattaacagctacaaaaatacaaaacaaaattgggctgcgtatggtacagaatggagatattctcttacaaaaagtctttgtccctgatgaggactggttaccaggcatcaattcgtttcaggataccaataaggttctggctgtctcacgtgtgatggtagcctggcagccgattggtatatcaatgggcatctatgatatgtgtcacaggtaccttaaagagagaaaacagtttggagcaccgttggcagcttttcaaatcaatcaacagaaacttgttcagatgttgggtaatgttcaggcaatggtgcttgttggctggcgtctctgcaaattgtatgagaagggtaaaatgactccaggtcaagccagtttgggaaagtcatggatcaccttgagggcaagagaaacagcagcccttgggagagaattacttggtggaaatggaattttggccgactttctagttgcaaaggcattttgtgatttggaacccatctacacatatgaaggcacttatgacatcaacagcttggtgactggtagggaagttactggacttgccagtttcaagccagcaatgctgaacaagcggagccgcctgtaacaatgaagtttgttcttgctgtctgatcacgagcgaatttgttcatcacctaaataattggtttagaggggttgccctgttacagtataatataccgagcaagctgtaataatcacataaagaaaaagtagattaagctaaattatttcttgtatggaacagtacccaagtgaaatatagagtaagatatctccttgctttatcatgatcaattgatgctaaattttaggcactgttgatcactgtttagatttgacactgccgctgatttgaagccaagatcgaccaaagtttcaaagtattctattataatttatgcttatt

SEQ ID NO: 3151 - DNA, 1165 bp, Fagopyrum esculentum
acttactactactgtgcactctcttgtcaggcttacgattgcactctgtgatccgaggacaagcagaaatacctgccatcttggcagattaacgttgcgtgctggctgcgagcgggtggagcctatccctgtagtgccttgaaaaacaactgccacaaaggttactggaggttggatacttgaaggtcaaaagcgctggattggtaatagtacgtttgctgatgtgcttgttatctttgccaggaatacaaaaacaaatcaaataaatggatacattgtaaagaaggacgcccctgggcttactgctaccaagattgaaaataaaataggccttcggatggtccaaaatggtgatatcctcctaaaggaagtgtttgtccctgatgaggatcggctacccggtgtcaattccttccaggatacaagcaaggtgttggccgtttctcgtgtgatggttgcttggcagcctattggcatatcaatgggtgtctatgatatgtgtcaccggtatttgcatgaaaggaagcaatttggtgcaccattagctgccttccagataaaccagcagaaacttactgagatgcttggtaacgtgcaagcaatgtatctaatgggttggcgcctttgcaaattgtatgaggaagggaaaatgactgcgggtcatgctagtctgggaaaggcatggataagctcgaaggctagagagacggctgctcttggaagggaactccttggaggaaatggtatcctggctgactttttaattggaaaggcgttctgtgatctggaacccatttacacatatgaaggaacctatgacatcaacacattggttacggctagggaaattactggcattgcaagcttcaaaccagctgtatcagttaaaaggagccgcttgtgaatcatgatgaacttgtagcagcaggacactgcagtttaacagttgtttcggtaagtaagattccgacatgcccggttcgaaattgaattgcaatgcaatgtaggaagatgcttgaaagtagaaaaataaaatagaaatcaaagaataatataaactattatgttttcctgttatagatgtacttaaatgggataataaatcgctggtgtttgcacgcggaagggaatcccttatgcgaagccgaacccgaaccggaaacgt

SEQ ID NO: 3152 - DNA, 1544 bp, Arnica chamissonis
agatcctccaaattcaatcaccatggctattcaattatctaaaccccaagatgaccagaacaaggattcaaagagcttatactttaatcatccagcactggatgtctccatggcattccctcaagcaacaccagcttcaatctttccaccttgcacctcagactactatcagtttgctgacttattgacccccgaggagcaatctctgagactgaaagtaagagaatgtgtcgagagagatgttgctccagtaatgaccaagtactgggagaaagctgaatttccattcgaaattgttccaaagcttggtgctctgaatatagctggtggaactatcaagggttatggatgtccaggtctgtctgtcactgcaaatgctttagctacagcagaaatagccagagttgatgctagttgctctactttcattttagtgcattcttctttggcaatgctcacaatatctctgtgcgggtcggaaatacaaaaacacaagtatttgccttcattggctaaacttgacacaatagcatgttggggtttgactgaacctgactatggaagtgatgcaagtggccttagaacaacagcaacaaaggtggaaggaggttgggtcattgaaggccagaaaagatggattggaaacagcacttttgcagatgttttggtcatttttgctaaaaacaaaaacacaaaccagataaacggattcattgtaaagaagaatgcacctgggttacaagctaccaagatagaaaataaaattgggctcagaatggttcaaaatggagatattctcttacaaaaagtttttgtccctgatgaagacagattacctgggatcaactcttttcaagatactagcaaggtgcttgcggtttcccgtgtcatggttgcctggcaacctattggcatcacaatgggtgtctacgacatgtgccacagatacttacaagagagaaagcagtttggggcccctttggcagcattccaaataaaccagcagaagcttgtacaaatgttgtcgaatgtccaagcaatgttcctcatgggttggcgcctttgtaagttatatgagagtggtaaaatgactcctggtcaggccagcttgggcaagtcatggatcacactgagggctagggagacggttgcattaggtcgtgagttacttggtgggaatggaatactatccgattttttagtcgcaaaggcttttaatgatttggagccaatctacacatacgaaggaacatacgacattaacaccttagtcactggtcgggagatcactggtattgccagtttcaagcctgttgcaaagacgactctaaccagccgcttgtagttcttgtttcctatttggaggaaattgtttgttgtttagtgtgttatttgtaataacttataaagtttggataaccataataaataactagacattttctagtctaactaggacctccaagagaatatgaaaatccttggtcaatgtttatggtgatggttaaaaagtagcagtgctgatttctacttgtttctacaaa

SEQ ID NO: 3153 - DNA, 1289 bp, Silene vulgaris
cattgagggttgctgggggaactattaagggttatggttgcccaggcctttctgtcactgccaacgctattgcaacagctgaggttgctagagttgatgctagttgttcgacgttcatattagtccactcttcattggcgatgcttaccattgcactatgcggttcagaggaacagaagcagaaatatttgccttctttagcagaatttaaaactgtagcgtgttggggattgacggagcctgacaatggtagtgatgcaagtgcgttgaatacaacagcaacaaaggttgatggaggctggttgatagaaggtcagaaacgctggattgggaacagtactttcgcagacgtgcttgtcatattcgcaaggaacacgactacaaatcagataaatggattcatagtaaaaaaggatgctcctggtctcacttcaacaaaaatagagaataaaataggattgcggatggttcagaatggagacatagtcctgaaaaaggtttttgtcccggatgaggataggctaaccggtgtcaattccttccaagatacaagcaaggttcttgccgtttccagggtcatggttgcttggcagccaattggcatttgtatgggtgtttatgacatgtgtcacaggtacttgaaagagcggaagcagtttggggttccgttggccgcattccaattaaaccaacaaaaacttgttcagatgctgggaaatgttcaggcaatgttactaattggttggcgcctctgtaaattatatgaaagtggaaaaatgactgctggccatgcaagcttgggaaagtcatggataactgttaaggccagagagacagttgctcttggccgggagctacttggaggcaatggaatccttggcgacttccttgttgcaaaggctttctgtgatcttgaacctatttacacatatgaaggaacctatgacatcaacacactgataactggaagggaagttactggcattgccagcttcaaaccagcctcaaggagtcgcctatagtgtagaacttcaggttctgtgcagtcccgtaccttcaacaacactaataatccgatgcgaagaaaatactagatatctggaagtctctgaagttatttgcagtaaggaaatgtgcgtatgcttgaaatgaaaggaacatttttcagctttgatgtgaacatgcatggattgtaacttaacggaggtggccgcagtgaaaaggcccaggcgactagtttaacaaaaacttaggtactctgacaactcgaaagagatgtatagggctga

SEQ ID NO: 3154 - DNA, 1492 bp, Arabidopsis lyrata
atcacgaagccaaagaaatttctccatcacgatcatagccatgacggtgctttcatctgcagatcgagctagtactgagaagaaggtgaagagttcatattttgatttgccgcctatggaaatgtctgtagcatttcctcaagcaactccagcttctacatttccaccgtgcacttcagactattatcatttcaatgatctgttgactccggaggaacaagccatccggaagaaagtgagggagtgcatggagaaagaagttgccccgataatgactgagtactgggagaaagcagaatttccattccatatcactccaaagcttggggctatgggtgttgcaggtggctcgattaagggttatggatgtcctggcctatccatcactgccaatgcagttgccacagcagaaatagctagagttgatgcaagttgttcgactttcattttggtgcattcttctttgggcatgctcactattgcactttgtggatcagaagcgcagaaggagaagtatttaccttctttggctcaattgaataccgtggcttgttgggctttgacagagcccgacaatggaagcgatgcaagtggtctaggaacgactgccacaaaggttgaaggaggttggaaaattaagggacaaaagcgttggattggaaacagcacctttgcagatctgttgatcatctttgctaggaatacaacaactaaccaaatcaacggattcatagtcaagaaagatgcgcctggcctaaaggctactaagatcccaaataaaataggtttacgtatggttcaaaatggagatattctactacagaatgtctttgttccagatgaggatcggttacctggggtaaattcttttcaggacaccagcaaggtcctggctgtctcacgtgtaatggtggcctggcaaccaatcggcatatccatgggaatctacgatatgtgtcacaggtatctgaaggagaggaaacagtttggagcaccattggctgctttccagttaaaccaacagaagcttgtgcagatgctgggtaatgttcaagcgatgttcctaatgggttggcgcctctgcaagctatatgagactggtcagatgactccaggtcaagccagtttaggaaaggcatggattacatcgaaagcgagggaaactgcttcgctaggtcgggaattacttggtgggaatggaattctagcagattttctggtggcaaaggcattctgtgaccttgaacctatttacacatacgaagggacttatgatataaacaccttagtaacagggagggaagtaacgggtcttgcgagtttcaaaccggctacacggagccgtctctaagttaaaaggttgtgcagtgtttgttgttactgcttgttagtattgatattgtaatgtggggtttacatctacaaatcacaaatgtgccaaataatctgaccttaaaaaatttaggggccaatgggggaataatattcgttg

SEQ ID NO: 3155 - DNA, 796 bp, Elaeis guineensis
  misc_feature (170)..(170): n is a, c, g, or t
  misc_feature (682)..(682): n is a, c, g, or t
atttgttcctgatgaagacaggttgccaggcgttaattctttccaggatacaaacaagcaggtccttgctgtttcacgtgttatggttgcatggcaacctattggcatatcaatgggtgtgttcgatatgtgccacaggtacctgaaagagaggaaacagtttggagctncattggcagcattccagattaaccaagaaaagcttgttcgcatgcttggtaatattcaagcaatgcttcttgtaggttggcgcttatgcaaattgtacgaatctggcaagatgactccaggtcatgctagcatgggaaaggcatggacttccttaaaggcaagggagactgtctctcttggtcgagaattacttggtggaaatggaatcttggctgattttctagtggctaaggcattctgtgatctggagcctattttctcgtatgaaggcacctacgatatcaacagtttggtgacagctagagaaatcacagggtttgcaagctttaaacctgctgcgctgggaaaggcaagtcggctttaaattgagtggtatgaatgcatacaaaccttaatttccgttataatccagcaaacaaaccatactggatgataataccaggcgtgggccatagggtcgatgatggctactgaaacattgtagatgcaactggtttcaacaacaggatancgttgtgtgaataagatcagtccaaaatttatgtcatgtttgaagttacaatggattattctgatatgtaagacagcttattttagacatatgcatcgaaaaaagaacttcgta

SEQ ID NO: 3156 - DNA, 2259 bp, Brassica rapa
  misc_feature (672)..(672): n is a, c, g, or t
ggtcaaaaccagaaacatatgacccagctcctcttttaccagttaccacccaagaatcaaaatacactcagttaaatactttactacaagtcttgtcactagtcatagtatggcaagtacctttaacacattctcactataattgtgaggttgtaaacccaattctactcaacaaacaattgaattgggggaacttaatcttttaaagcatgtccaatactaattgctgtaagaaacagtgttggaaacgataaactgtttctaggacttctccctcattttagctctggcaaacacaactccagccacaagaccaaagagtatgcttgctgagttctgcaaactggtcggtacatggaaaagaacgatcccagcaatagacaacggtatcttgtttagtgatcccaccaagctgtatgttgtagctccggtttgatgaagaaaccacattgaagtgaagctaatagcaagaccaagaagtccactgagtgtcatgaccatccagaaacttggcaatcgaagaagtggcgtgttgaaaagataatccatctcgttgaaagcaaaagaaagaataaggccaagcggtaatgaaagtgtgttattaagcaagaccatggagaactcgttcaagtttccagattgagtaacttgcttggccgtatccattgtctntccgaaacccaaagaaacgtggaagaaacgtttccatcgcaaccgtcgccaccatgactgtgctatcatctagagatcgagatgaggctgagaagaaggtgaagagttcgtattttgatttgccggctatggacgtatctgtggcatttcctcaagcaactccagcttctaagttcccaccgtgcacttcagactattatcatttcaatgaactgttgactccggaggagcaggatgtgaggaagagagtgagggagttcatggagaaagaagttgctccgattatgacagagtactgggagaaggcagagtttccattccatatcattccaaagcttggagctttaggtgttgttggtggctctatcaagggttatggctgccctggcctctccatcacagccaacgccattgcaacagcagagatatctagagttgatgcaagctgtgggacttttaatttggtgcatacctctttgggcatgctcactattgcactttgtggatcagaagaacagaagcagaagtatttgccttctttggctcagctgaaaactgtgacttgttgggctttgacagaacctgacaatggaagtgatgcaagtgctctacaaacaactgccacaaaggttgaaggaggttgggtacttacgggacaaaagcgttggatcggtaacagcacctttgcagatctgttgatcatccttgctaggaatacgacaactaaccaagtgaatggattcatagtcaagaaagatgcgcctggcttaacggttactaagatcccaaataaaataggtttacgtattgttcaaaatggagatattctactacagaatgtctttgttcctgatgaggagaggttacctggactaaattcttttcaagacacaagcaaggtccttgctgtctcacgtgtaatggtggcctggcaaccaattggtgtatcaatgggtgtctacgatatgtgtcacaggtatctaaaggagaggaaacagtttggagcaccgttggctgcattccagataaaccaacagaagcttgtgaagatgctgggtaatgttcaagcgatgtttctgatgggttggcgcctctgcaagctatatgagtcgggtcagatgactcctggtcaagccagtttaggaaaggcatggatttcatcgaaggcaagggaaactgcttcgttaggccgagaattactcggtgggaatggaattgtaggtgattttctggtggcaaaggctttctgtgacctggaaccgatttatacatacgaagggacgtacgatataaacaccttagtgacggcgagggaagtaacggggatcgcgagtttcaaacctgctgcttcacggagccgtagccgtctttaagggttgtgcagtgtttgttgttgtctgtgagtgtactttggtaatgttacgtggagaacaaagttcgtcaaataaacttgacctctaaagggacatgtgcaaaccataaatgcagtaaactcatttagtgtcctgtatttgtcatttaattagtttcttcacattaaattaactcaaggaataatactaaattatgtttttaaattcaaaaaaa

SEQ ID NO: 3157 - DNA, 1199 bp, Theobroma cacao
  misc_feature (653)..(653): n is a, c, g, or t
  misc_feature (659)..(659): n is a, c, g, or t
  misc_feature (688)..(688): n is a, c, g, or t
  misc_feature (701)..(701): n is a, c, g, or t
  misc_feature (726)..(726): n is a, c, g, or t
  misc_feature (768)..(768): n is a, c, g, or t
  misc_feature (833)..(833): n is a, c, g, or t
  misc_feature (835)..(835): n is a, c, g, or t
  misc_feature (837)..(837): n is a, c, g, or t
  misc_feature (854)..(854): n is a, c, g, or t
  misc_feature (869)..(869): n is a, c, g, or t
gggaagtgctatatctactgcagaggtcgctagagttgatgcaagctgctcaacttttatcttggttcattcatctctagccatgcttactattgataaaccatgaatttggacctttcaataccttgtctggaccatcaagaatagcattatgcggatcagaggaacagaagcagaagtatttaccttctttggcacaactcaaaactatagcttgttgggctttgactgagcctgactatggaagtgatgctagtgctctgaagacaacggcaacaaaggtaaagggaggttggatgcttgagggacaaaagcgatggatagggaacagtacttttgcagatgtgttggttatttttgccaggaataccacaaccaatcagataaacggatatctagttaagaaggattcccctggattgacagctacaaaaattgcaaacaagattgggttgagaattgttcaaaatggagatattcttttaaagaaagtctttgttcctgatgaggacaggttacccggtgtaaactcttttcaggatacaagcaaggtactggctgtttcgcgagtaatggttgcatggcagcctattggcatatcgatgggtgtctatgacatgtgtcagaggtatctgaaggagaggaaacagttnggagcnccattggcagccttccaaattaaccagcngaaacttgctctnatgctaggtaatgttcaagcaatgnccctagttggttggcgcctttgcaaattgtatgaggggggtnaaatgactcccggtcaagccagcttgggaaagtcatggattaccttgaaggcaagagaaacagtntntntcgggcgggagttactnggcggcaacggaatnttggctgattttcttgttgcaaaggcattctgtgatttggagcccatttatacatatgaaggcacttatgacatcaacagcttggtcactggtagggaaattactggttttgccagttttaagccagccgcactgagccagcgcagccgcctttgatcgtgtaaacctccttcctggactctgtataaggtctaaaacaaagtcgataaacttctcacagaaagttaaataagttcagtgcctttgcacaattgtaataataaaagaaatagtgcaaatatttctgccattgcttgcttaatgctcacgtaaatcagcctttttattcta

SEQ ID NO: 3158 - DNA, 1716 bp, Brassica napus
cgaacccaaagaaacgttttccatcgcaatcgtcgccaccatgactgtgctgtcatctagagatcgagatgatgctgagaagaaggtgaagagttcgtatttcgatttgccggctatggacgtatccgttgcatttcctcaagcaaccccagcttctaagttcccaccttgcacttcagactattaccatttcaatgaactgttgactccggaggagcaggctgtgcggaagagagtgagggagttcatggagaaagaagttgctcccattatgacagagtactgggagaaggcagagtttccattccatatcattccaaagcttggagctttaggtgttgttggtggctctattaagggttatggctgtcctggcctctccatcacagccaacgccattgcaacagcagagatatctagagttgatgcaagctgtgggacttttaatttggtgcatacctctttgggcatgctcactattgcactttgtggatcagaagcacagaagcacaagtatttgccttctttggctcagatgaaaactgtgacttgttgggctttgacagaacctgacaatggaagtgatgcaagtgctctacaaacaactgccacaaaggttgaaggaggttgggtacttacgggacaaaagcgttggatcggtaacagcaccttttcagatctgttgatcatccttgctaggaatacgacaactaaccaagtgaatggattcatagtcaagaaagatgcgcctggcttaacggttactaagatcccaaataaaataggtttacgtattgttcaaaatggagatattctactacagaatgtctttgttcctgatgaggagcggttacctggactaaattcttttcaagacacaagcaaggtccttgctgtctcacgtgtaatggtggcctggcaaccaattggtgtatcaatgggagtctacgacatgtgtcacaggtatctaaaggagaggaaacagtttggagcaccgttggctgcattccagataaaccaacagaagcttgtgaagatgctgggtaatgttcaagcgatgtttctgatgggttggcgcctctgcaagttatatgagtcgggtcagatgactcctggtcaagccagtttaggaaaggcatggatttcatcaaaggcaagggaaactgcttcgttaggccgagaattactcggtggaaatggaattgtaggagattttctggtggcaaaggctttctgtgaccttgaacccatttatacatatgaagggacttacgatataaacaccttagtgacggcgagggaagtaacagggattgcgagtttcaaacctgctgcttcacggagccgtagccgtctttaaggttgttgtgcagtgtttgttgttatgctgtctgtgagtttaccttggtaatgtaccgtggagaacaaagttcgtcaaataaacttgacctctaaagggacatgtacaaaccataattgcagtttggattcgtgctgtatttgtctcctcacattaaattaactcaaggaataatactaaattatggttaaaaaaaaacaataaaaaaacttcaagggggggccccggttcccaaatttgcccctattaggggagtcggattaacaattccactggggcggtcgtttttaccaacgttcctgaatggggaaaaacccttgcggtttccccaacttaaattgggcctttgaggcacc

SEQ ID NO: 3159 - DNA, 1507 bp, Brassica napus
cgaacccaaagaaaagttgtccatcgcaaccgtcgccaccatgactgtgctatcatctacagatcgagatgaggctgagaagaaggtgaagagttcgtattttgatttgccggctatggacgtatctgtggcatttcctcaagcaactccagcttctaagttcccaccgtgcacttcagactattatcatttcaatgaactgttgactccggaggagcaggctgtgcggaagagagtgagggagttcatggagaaagaagttgctccgattatgacagagtactgggagaaggcagagtttccattccatatcattccaaagcttggagctttaggtgttgttggtggctctattaagggttatggctgtcctggcctctccatcacagccaacgccattgcaacagcagagatatctagagttgatgcaagctgtgggacttttaatttggtgcatacctctttgggcatgctcactattgcactttgtggatcagaagaacagaagcacaagtatttgccttctttggctcagctgaaaactgtgacttgttgggctttgacagaacctgacaatggaagtgatgcaagtgctctacaaacaactgccacaaaggtcgaaggaggttgggtacttacggggcaaaagcgttggatcggtaacagcacctttgcagatctgttgatcatccttgctaggaatacgacaacgaaccaagtgaatggattcatagtcaagaaagatgcgcctggtttaacagttactaagatcccgaataaaataggattacgtattgttcaaaatggagatattctactacagaatgtctttgttcctgatgaggagcggttacctgggctaaattcttttcaagacacaagcaaggtcctggctgtgtcacgtgtaatggtggcttggcaaccaattggtgtatcaatgggagtctacgatatgtgtcacaggtatcttaaggagaggaaacagtttggagcaccgttggctgcattccagataaaccaacagaagcttgtgaagatgctgggtaatgttcaagcgatgtttctgatgggttggcgcctctgcaagctatatgagtcgggtcagatgactcctggtcaagccagtttaggaaaggcatggatttcatcgaaggcaagggaaactgcttcgttaggccgagaattactcggtgggaatggaatcgtaggtgattttctggtggcaaaggctttctgtgacctggaaccgatttatacatacgaagggacgtacgatataaacaccttagtgacggcgagggaagtaacggggatcgcgagtttcaaacctgctgcttcacggagccgtagccgtctttaaggttgtgcagtgtttgttgttgtctgtgagtttacgtggagaacaaagtgcgtcaaataaactcgacctctaaagggacatgtgcaaaccataactgcagtttggattcgtgatgtatttgtcatgtagtttcttcacattaaatta

SEQ ID NO: 3160 - DNA, 1681 bp, Capsicum annuum
gcttcttcttccttttttttttaccagcacaaaaaaatttcattgcatctttctcttcatctccctgaattttttcatcataaaaaaactcagcaaaaatgcacaaagaggcgaaaagctcctattttgatatgccagcattggatgtttctgttgcatttcctcaagcaactccagcgtccaactttcctccatgcacttcagactattatcagttagctgatctgttgactccggaggagcaagccgtcagaatgaaagtgagggaatgcatggagaaagaagttgctcctataatggcaaagtactgggagaaggcagagtttccttttgaagtcattccaaaatttgctgctttgcacattgctggtggcacaatcaaggggtatggttgtccaggttcctcgataactggaagtgctgttgctgcagcggaagttgccagagttgatgcaagttgctctacattcattttggtgcattcatcattagcaatgctcactattgggctatgtgggtctgaaatgcaaaagcaaaaatacttgccgtcattggctgaacttgacactatagcttgttggggcctaactgagcctgactatggaagtgatgcaagtgggttggggacaactgccagaaaggttgaaggtggttggatccttgaagggcaaaagcgttggataggaaacagcactttcgccaatatactggttatttttgctagaaatacatccacaaaccagataaacggtttcatagtaaagaaggatgctccaggattgcaagctactaaaatggaaaacaaaattggactacggattgttcaaaatggagacattctcttgaagaaagtttttgtccctgatgaggatagactacctggggtcaattctttccaggatacaaacaaggtgctcgctgtatcacgtgtcatggttgcgtggcagcctattggcattgcaatgggtgtttatgatatgtgtcacaggtacttgaaggagaggaagcagtttggagcaccattggccgctttccagatcaaccaacagaaattggtccaaatgttgagcaacattcaagcaatgattcttgttggttggcggctttgcaaactgtatgagagtggtaaaatgactcctggtcatgcaagcttagggaaatcatggaataccttgagggcgagagagacagttgctctcggacgagaattactaggtggcaatggaatcttgtccgactttcatgtcgcaaaggcattttgcgatttggagcccatctatacatttgaaggtacttatgacatcaacacgttggtaacgggtagagaaatcactggtttggccagtttcaagcctgcaccatcaaggcaaaagagtcgtctgtgacaaattttcctcttctcgaggaagcaagtgttctgctggattaaattcttgttttggcaattgcaactctagaatagttttatacaaagaaagaattgattatgtccccttttttaaatactaataatagtgaagttagaatacacctattgtaataatagcaacatattattaagtttgaataccacctgttgaaacaataatacaagaatggccttggaggtggtggttcgtgcgtgcatggtcttgaatttctgaccacgcttgcttcataagtgaaattccgaattttctta

SEQ ID NO: 3161 - DNA, 1629 bp, Solanum phureja
gtttcttcttcttcttctctcagttgaagagtcgacagaattcttccttttttcaaccatgaaagttccagcaactaaaattcaagaggaaatgtctatagaggcgaaaagttcctattttgatctaccagctttggatgtttctgttgcatttcctcaagcaacaccagcgtccgtctttcctaaatgcacttcggactattatcagcttgatgatctcttgacttctgaagagaaagccatcagactgaaagtgagagagtgcatggaaaaagaaattgctcctataatgacaaagtactgggagaaagcagagtttccgtttgaagtcattccgaaacttggtgctttgcacatatctggtggcactataaaggggtatggttgcccaggtttatcagtaactggaagtgccattgccctagcagaaattgccagagttgatgcaagctgctctacattcattttggtgcattcatctttggcaatgctcactattggactattgggatcagaaatgcaaaggcaaaaatacttgccatctctggctgatcttagcagtatatcttgttggggtctaactgagccagactatggaagcgatgcaagtgctttgaggaccactgccacaaaggttgaaggaggctggatccttgaagggcaaaaacggtggataggaaacagcacttttgcagatgtgttggttatatttgctagaaacacagccacaaaccaaataaatggtttcattgtacagaaggatgctccaggcttgcaatctactaaaatagaaaacaaaattgggctgcggatggttcaaaatggagatatcctctttaagaaagtgtttgttcctgatgaggatagactaccaggtgtcaattctttcaaggatacaagtaaggtgcttgctgtatcacgtgtcatggttgcatggctgcctataggcattgcaatgggtgtatatgatatgtgtcacaggtatttaaaagagaggaagcaattcggagctccattggctgctttccagctaaatcaacagaagctggttcagatgttgggaaacattcaggctatgcttcttgttggatggcgcctttgcaagttgtacgagagtggtaaaatgactcctggtcaggctagcttggggaagtcatggaataccttgagggctagagagaccgtttctcttggacgagaattacttggtggtaatggtatcttggcggatttcctagttgcaaaggcattctgtgacttggagcccatctatacgttcgagggtacctatgatatcaacaccctagtaacaggtagagaaattacaggtcttcctagcttcaagccagcaccattgaggccacagagtcgtctgtaatgcttcgaccatcttcctattctctggaaattgttctgctgaattcagtgcacattagagtacttgtgctgaaaaaagggaacaaacttgaggatgtttaatctcttttaatttccattattattataaataagtcttagaataaagtgaacattgttatatgtgaacttgttcattattacgtatcgatttggctatgtaagccgctatctacagttatctttctgattttatatgaattttcttatttg

SEQ ID NO: 3162 - DNA, 1385 bp, Amaranthus tuberculatus
ggcagagtactgggaaaaggcagaatttccattccagattattccaaagttgggggccttgcacatctccggtgggacaatcaagggttatggttgcccagggctatccattatcggaagtgctattgccacagcggaagttgctagagttgatgccagttgctctacatttatactggtgcattcttccctggcaatgctaacaattgcattgtgtggctcagaagatcaaaagcagaaatatttgccttctttagcacaattaaaaactgtagcatgttgggcgttgactgagcccaacaatggaagtgatgcgagtgggctacaaacaactgctacaaagggttgcggggggctggattttggatggtcaaaaacgatggattggtaatagtacatttgcagacttgctcatcatttttgcaaggaaccctgcaacaaatcagataaatggatatattgttaaaaaagatgcacctgggctcactgctactaaaatacagaacaagataggattgcggattgttcagaatggagatattatcctaaagaaggtttttgtccctgatgaagacagacttccgggtgtcaattctttccaagatacaaataaggtacttgcagtttcgcgtgtcatggttgcttggcaacctattggaatttccatgggtgtttacgatatgtgtcataggtacttaaaagagaggaaacaatttggtgcaccattggccgccttccaaattaaccagcaaaaacttgtacagatgctcggcaatgttcaggcaatgtttcttattggttggcgtctttgtaaattgtacgaaagtgggaaaatgactcctggtcaggcgagcttgggaaagtcatggataaccagcaaggcaagagagacagttgctcttggtcgagaattactcggaggcaacggaatcctcgccgagttccttgttgcgaaggcgttctgcgaccttgagcccatctacacctatgaaggaacatacgatatcaacacattggtgacagcaagagaagtcacgggcattgccagcatcaaagctcctgcaaggagccgcctgtagtgtattcagggttcgaatcaataaagcggaatgctgatctaggaggtatttattcgctgaactcgaaaaatcgtactgctcttctagttgttccgatgaagagatgccttagtacgtgttgtatgctttaaacttatggtagtattctacaagaaaccgggcacacatgtaataataacatggaagttcttgtacatctaagatatatttggtacatcatcacacaaataatatactatacgaaggtttagttcgatgtagagatactattggtttggttcgaaaaatattgatatgcccaaaaaa

SEQ ID NO: 3163 - DNA, 1570 bp, Chelidonium majus
agctgactctggaattccatacacaattataagggcaggagcatgtcgatttcttcaactcagaagcaagatggtcttcataagggtgtcggattaccagcgttggacatctcgcttgcattccctcaggccactccagcatcaatctttcctccatctgcttcagactattatcagtttgatgatctattgactcctgaggagcaggccctcaggagaaaagtcagagagattatggagaaaaaaattgctccagaagttactgagtactgggagaaagctgagtttccgttccatataattccaaatcttgctaccttgagagtagcaggtagcaccattaagggttatgggtgtccagaactctccattactggatctgctgttgcaacggcagaagttgccagagttgatgctagctgttcgacatttattttggtgcattcttctttggcgatgctcactattgggcttttgggatcggacgaacaaaacaaaaatatttaccctctatggccgatttgcgcatgataggttgttgggccttgacagagcctgataatggaagtgacgcaagtgctttgaagacgaccgcaacaaaggtagccggaggttggttacttaatggccaaaaacggtggataggaaacagtacttttgcggatgtattagttatttttgctcggaacacaactacaaaccagattaatgggtatgttgtgagaaagggtagtcctggcttgtcggctactaaaatagaaaacaaaattggcttgaggatggttcagaatggggatattctcttaaagaatgtctttgtccctgacgaagaaaggttacctggtgtcaattctttcaaggatacaaacaaggtacttgctgcttcacgtttaatggttgcatggcaaccaatcggcatttcaatgggtgtgtacgacatgtgccacagatatttgatggagagaaaacagtttggagctccattggcagcattccaactcaaccaagagaaactcgttcgcatgttgggtaatgttcaagcgatgtttcttgttggttggcgcctctgcaagctgtatgagtcagggaagatgacaattggtcatgctggcttgggaaaggcatggattagcaaaagggcaagggagactgttgcccttgggagagagttgctcggtggcaatggaattttggctgattttctagtcgcaaaggcattctgtgatttagagcccattttcacatacgaaggtacttacgatattaactgtctggtaactggaagagaaataactggtattgcaagcttcaaaccagtagtagccaaacatagtaggatgtaacagctgaagctttctgtccattagttttctgaaaaccttcggtggggggcgttctctcttttcttttttagaaatgggtatttcaataatcccttagcatgtcgtaattttactgctatgaaggaactgaatctggctgtggaagaatagaatgtgatagtgtaatcaagattttaagaataattaatgtataaacaacactacggtgccgaccctcgacagacttc

SEQ ID NO: 3164 - DNA, 1579 bp, Manihot esculenta
cacgtctctgtgttctcccttcctcttaacatcctcaatcatgactgtggacgcttctaaaaatcgagatgatcatgatgaaagtgtgaagagttcttattttaatttaccaccgctggatgtttccattgcatttcctcaagcaactccagcatccatatttcctccctgcgcttccgattattatcactttgatgacttattgactcctgaggagcaggctatcagaatgaaagtaagacagtgtatggagaaggaagtagcacctataatggcagagtactgggagaaggcaaaatttccctttcatattattcccaagcttggtgccctgcatattgctggtggcacaatcaagggttatggatgtcccggtttatctctcactgcaagtgctgttgctacggcagaagttgctagagttgatgcaagttgttctaccttcattttggtgcactcatctctggcgatgattaccatagcactttgtggttcagaggtacagaaacagaaatatttgccttctttggctcagttaagcaccgtagcttgttgggctttgactgagcctgactatggaagtgacgcaagttctctgaaaactacagcaacaaaggtggaaggaggttggatacttgaggggcaaaagcgatggataggaaacagcacctttgcagatgttttagtcatatttgcccggaatacttcaacaaatcagatcaatggatacatagtaaagaaggatgcactgggattgacagccacaaaaatagaaaataaaattggcttacggattgtgcagaatggcgatattcagttaagaaaagtgtttgtccctgatgaagacaggttacctggggtcaattcctttcaagatacaaataaggttcttgcggtttcacgtgtaatggttgcttggcaacctattggcatatcaatgggggtctatgacatttgtcacaggtatctaaaagagaggaaacagtttggagcaccattggctgctttccaaatcaaccaacagaaactagttcacatgcttggtaatgttcaagcaatgttgctagttggttggcgcctttgcaagttgtatgaaaagggtaaaatgactccaggtcgtgccagtatggcaaaggcatggattactctaagagcaagggaaacagttgctattgggcgggagttacttggaggcaatggcattttggctgattttctagttgctaaggcattctgtgatttggaacccatctacacatatgaaggaacctacgacataaacagcttggtaacaggtagggaagtcactggattacccagttttaagccagcggcagtgagccaacgaagccgcctttaactcattgcaaattatcttcctcagcctgcatggcaagttttgtgttgcacacagcacattttcttgtcgttcaaggatcttaataatctgtagaaatgaacattgtagaataaaatcctgtatagaccatggcatatgtattaagaagttcgtgactggcaagttggggtcgattcccgttttacggtttgaagggaataaaatcggactgtattctcc

SEQ ID NO: 3165 - DNA, 1790 bp, Ricinus communis
gtcgttagcaccatcatcatcgaaaaccaaaactactgatacctctctctcttcctctccctctccctctccctctctctatatctttctatcctccataaactcctttctgctgcacatcaattattccccctttctaaaattctaattatttaattgagttccaatcactcgatcaatcatgacaatttacgcttcttctaaaaatcaagatgatcttgatcacagtcaaaagagttcttattttaatttaccaccattgaatgtgtctattgcattccctcaagcaactccagcatccatatttcctccttgtgcttccgattattttcaattggatgatctattgactcctgaggagcaggctattaggataaaagtaagacaatgtatggaaaaggaaatcgcacctataatgacagagtattgggagaaggcaaagtttccgtttcatgttattcccaagctcggtacccttcgcattgctggtggcacaattaagggttatgggtgtccgggcctctccctaactggaagtgctgttgctactgcagaagtcgccagagttgatgcaagctgttctacgttcattttggtgcattcatctctggcaatgcttacaatagcactttgtgggtcagaggcacagaagcagaaatatttaccttctttggctcagttaagcaccgtagcttgttgggctttgactgaacctgaatatggaagtgatgcaagtgctctaaaaactacagcgagaaaggtggaagggggttggatactggatggccaaaagcgctggataggaaacagtacctttgcagatgttttggttgtatttgctcgtaatacttcaacagagcagatcaatggatacatagtaaagaaggatgccccagggttaacagctacaaaaatagaaaataaaatcggcttgcggatggtacagaatggagatattctgctaaaacaagtttttatcccagatgaggacaggctgcctggtgttaattcctttcaagatacaaataaggttcttgcagtttcacgtgtaatggtcgcctggcaacctattggcatatcaatgggaatttatgacatgtgtcacagatatttaaaagagaggaaacagtttggagccccattggctgcttttcaaataaatcaacagaaacttgttcaaatgcttggtaatgttcaagcaatggtacttgttggctggcgcctttgcaaattatatgaaacgggtaaaatgacttcaggtcatgccagcatggcaaaggcatggatcacttccaaagcaagggaaactgctgccactgggcgggagttacttggcggcaatggaattttggcagattttctagttgccaaggcattctgtgatttggaacccatatacacatatgaaggcacctacgacatcaacaccttggtaaccggtagggaagtcactggtatagccagttttaagccagctgcattgagcaatcgaagccgattataaagttgcagtttcaagctctcttcctcgcggttcctgcatggcaactctgcctcgcaccatataaatgtgttacacaggtttgatatatgccaacaacagaaggcagcttaataatctttagaagggtcagttgttgaataacgttccgatacagattatggcacatgaaaataagaagtttgtattcagtaaagcttttacctttcaaaaatatttattatttacggccctaacattgcagactatggcaaccccattgatcttttcctgtgcaaggccctagagg

SEQ ID NO: 3166 - DNA, 1630 bp, Raphanus sativus
acgaacccaaagaaaagtcctccatcgcaatcgtcgccaccatgactgtgctatcatcatctacagctcgagaagacgctgagaagaaggtgaagagttcgtatcttgatttgccggctatggacgtatctgtggcatttcctcaggcaactccagcctctaagttcccaccgtgcacttcagactattatcatttcgatgaactattgactccggaggaacaggctgtaagaaagaaagtgagggagttcatggagaaagaagttgcccctattatgacagagtactgggagaaggcagagtttccattccatatcattccaaagcttggagctttgggtgttgttggtggttccatcaagggttatggctgtcctggcctctccatcacagccaacgctattgcaacggcagagatatctagagttgatgcaagctgtgggacttttaatttggtgcatacctctttgggcatgctcactattgcactttgtggatcagaagcacagaagcagaactatttgccttctttggctcagatgaaaactgtgacttgttgggctttgacagaacctgacaacggaagtgatgcaagtgctctacaaacaactgccacaaaggttgaaggaggttgggtacttacgggacaaaagcgttggatcggtaacagcacttttgcagatctgttgatcatccttgctaggaatacgacaacgaaccaagtgaacggattcatagtcaagaaagatgcgcctggtttaacagttactaagatcccgaataaaataggtttacgtattgttcaaaatggagatattctattacagaatgtctttgttcctgatgaggagcggttacctggagtaaattcttttcaagacacaagcaaggtgctggctgtctcacgtgtaatggtggcttggcaaccaataggtatatcaatgggagtctacgatatgtgccacaggtatctgatggagaggaaacagtttggagcacagttggctgctttccagataaatcaacagaaacttgtgaagatgctaggtaatgttcaagcgatgtttctgatgggttggcgcctctgcaagctatatgagacgggtcagatgactcctggtcaagccagtttaggaaaggcatggatttcatcaaaggcaagggagactgcttcgttaggccgagaattactcggtgggaatggaattctaggggattttctggtggcgaaggctttctgtgaccttgaaccgatttatacatacgaagggacgtacgatataaacaccttagtgacggcgagggaagtaactgggatcgcgagtttcaagcctgccgcttcacggagccgtagccgcctttaaggttgtgcagtgtttgttatttgttgtctgtgagtttactttggtaaaaatgttacgtggaaaacaaagtgcaagtgcaagtgcaagtgcaactgtgcaagtgcgtcaaataaacttgacctcctaagggacgggacatgtgcaaaaccataattgcagtttggattcgtgctgtatttgtcatgtagtttcttcacatttaactaactcaaggaataatacaaaaattatgtttttaaatgtcagtgacgacgttacttttcagc

SEQ ID NO: 3167 - DNA, 1453 bp, Primula obconica
gaaaaagaggtagctccagtgatggccgagtactgggagaaggcaaaatttccattccatgtggttccaaagtttggtgccctaggtattgctggcgggtcaattaaggggtatggttgtccaggtctttccatcactgcaaatgccattgccacagcagaagtagcaagagtagacgctagctgttcaacatttattttggtgcattcttctttggcaatgagcaccatagctattggtggttctgaagctcagaagcagagatatttgccgtcgatggcacaacttaagaccataggttgttggggtctgaccgaacctgactatggaagcgatgcaagtgctttgagaacaacagcgacaaaggttgcaggaggttggctccttgatggtcaaaagcgctggataggaaacagtacatttgcagatgtactggtaatttttgcaagaaacataactacaaatgagctacacgcctttttagtaaagaaggattcccctggactacaagctaccaagatagaaaataagattggcctgcggattgtccagaacggagacattctcatgaaacaagtttttgttcctgaagaagacagactacccggtgtcacttcttttcaggatatcaacaaggtccttgggccttcacgtctcatggttgcttggcagcctattggtatatcaatgggtgtatatgatatgtgtcacaggtacttaaaagaaagaaagcagtttggagcaccactggcagcttttcaaatctcacaacaaaagctagtgcagatgttgggtaatattcaggccatgttacttgttgggtggcgtctttgtaagctttacgaaaaggatgaaatgactgtgggcaaagttagcttaggcaaggcgtggatttcctcgaaagcaagggaaactgtatcacttggccgagagttgcttggtggcaatggcattttgacagactttctagttgctaaggcattttgcgatttggagcctatttacacatacgagggcacttatgacataaacacattggttgcaggcagagaagttacagggattcccagtttcaagccagcattcacctctcgtagccgtctctgatatattgttacaatatacaagcactaattgtaaggaaataatccggttgaaactgatagttaatattttagtatcgatttgttgcacgatacccgaaagagacaagaaggaagaataaataagtgtaaagccattttatgcgttcacaagtgttcattttgtgtaagctgcaaggaatttttttattaattgtgcttggaatttaaggtttattctgtggatcataaagaagccatagcccataggagtgcttcagaaaaatgtgatggcctgatgggtcattaaaccctttattttaattgtttgcgagatgattggttcaatacactaaaacgaggaatatgaa

SEQ ID NO: 3168 - DNA, 785 bp, Ipomoea nil
ccagataaacgattcatagtaagaagaacgtaccaggactgcaagctacaaaaatggaaaataaaattggcctgaggatagttcagaatggagatattctccttaacaaagtttttgtaccagatgaggacaggttacctggcgttaattctttccaggatacgagtaaggttcttgctgtttcacgtgttatggtggcctggcaacctattggcatttcgatgggtgtttatgatgtttgccacaggtacttgaaagagaggaagcagtttggcgctcctctggcagctttccagatcaaccaacagaaactggtccagatgctgtcaaacattcaagcaatgcttcttgttgggtggcggctttgcaagctgtacgagagtggtaaaatgactcctggccatgcgagcatggggaaatcctggattacactgaaggcaagggagactgtttcacttggccgggaattactaggaggcaatggcatcttgactgactttctagtagcaaaggcgttttgcgacttggagccaatctacacgtacgaaggaacctacgacatcaacaccctagtaacaggcagagaaatcactggtattgcaagctttaagcctcctgctgctgctttgagtaaaaggagtcgcctataatcaactcttcttcattaataatcctagtgtgtggttgactggttggtagtcccattgtgaactctgttgaatagggaaggtaaaacatttacatttgcacaagctgaaacaataaagtgcaaaattacaattttt

SEQ ID NO: 3169 - DNA, 1477 bp, Cynara scolymus
  misc_feature (64)..(64): n is a, c, g, or t
  misc_feature (96)..(96): n is a, c, g, or t
  misc_feature (101)..(101): n is a, c, g, or t
cgggatatctctgaacgaaacatacggatccaacctctgagtcaatccttcctctccagaatcnccatggccattcaatcatcgaaacctcaagangaccngagcaaggattcaaagagctcgtattttaactttccagcactggatgtctccgttgcatttcctcaagcaacaccagcttcagtctttccaccttgcacctcagacttctatcacttcgatgacctactaacccctgcggagcaagctctaagattgcgagtaagagagtgtgtggagagagaagttgctccaataatgaccaagtactgggagaaggcggaatttccatttcaaattgttccaaagctaggtgctctgaatatagctggtggaactatcaagggttatgggtgtccaggtctgtccgtcactgcaaatgcgatagttacggcagaactagccagagttgatgcaagctgctctactttcattttagtgcattcttctttaggaatgctcactatatctctatgtgggtcagaaatacaaaaacagaagtatttgccttcactggccaaactagatacgatagcgtgttggggtttgaccgaacctgactatggtagtgatgcaagtggccttagaacaacagcaacaaaagtggatggaggttgggtccttgaaggccaaaagcgatggattgggaacagcacttttgcagatattttgattatttttgctaaaaacaaagacacaaaccagataaatggattcatcgtgaagaagaatgcacctgggttgcaagctaccaagatagaaaataaaattgggctcagaatggttcaaaatggagatattctgttacagaaagtttttgttcctgatgaagacaggttacctggggtgaactctttccaagatacaagcaaagtgcttgctgtttctcgtgtcatggttgcctggcaacctattggcatcacaatgggtgtctacgatatgtgccacagatacttactagagagaaagcagtttggagccccattggcagctttccagatcaaccagcagaagctagttcaaatgttgtctaatatccaagcaatgtttctcatgggttggcgcctttgcaagttgtatgaggctggtaaaatgactcctggtcaagccagcttgggcaagtcatggatcagcttgagagctagggagacagttgcactaggccgagagttacttggtgggaatggaatattatccgactttttagtcgcaaaggcattcggagatttggagccaatctacacatacgaaggaacatatgacattaacacattggtgacaggtcgggagatcacaggtatcgccagtttcaagcccgttgtaaagaagccctcaatgagtcgcttgtagcactcttcctatcaggaaatgaattgtgtgtgtatgtttaagatagtacagtagtagtaactatgaactggactagttttgatatgct

SEQ ID NO: 3170 - DNA, 1498 bp, Solanum lycopersicum
atgaaagttccaccaactaaaactcaagaagaaatgtataaagaggcgaaaagttcctattttgatctaccagctttggatgtttctgttgcatttcctcaagcaacaccagcgtccgtctttcctaattgcacttcggactattatcagcttgatgatctcttgacttctgaagagaaagccgtcagactgaaagtgagagagtgcatggaaaaagaaattgctcctataatgacaaagtactgggaaaaagcagagtttccgtttgaagttattccgaaacttggtgctttgaacatatctggtggcactataaaggggtatggttgtccaggtttatcagtaactggaagtgccattgctctagcagaaattgccagagtagatgcaagctgctgtacattcattttggtgcattcatctttggcaatgctcactattggactattgggatcagaaatgcaaaggcaaaaatacttaccatctctggctgatcttagcagtatatcttgttggggtctaactgagccagactatggaagcgatgcaagtgctttgaggaccactgccacaaaggttgaaggaggttggatccttgaagggcaaaaacggtggataggaaacagcacttttgcagatgtgttggttatatttgccagaaacgcagccacaaaccaaataaatggtttcattgtacagaaggatgctccaggcttgcaatgtactaaaatagaaaacaaaattgggttgcggatggttcagaatggagatatcctctttaagaaagtgtttgttcctgatgaggatagactaccaggtgtcaattctttcaacgatacaagtaaggtgcttgctgtatcacgtgtcatggttgcatggctgcctataggcattgcaatgggtgtatatgatatgtgtcacaggtatttaaaagagaggaaacagttcggagctccattggctgctttccagttaaatcaacagaagcttgttcagatgttgagcaacattcaggctatgcttcttgttggatggcgtctttgcaagttgtatgagagtggtaaaatgactcccggtcaggctagcttggggaagtcatggaataccttgagggctagagagaccgtttctcttggacgggaattacttggtggtaacggtatcttgaccgacttcttagtggcaaaggcattctgtgacttggagcccatctatacgttcgagggtacctatgatatcaacactctagtaacaggtagagaaattacaggtcttcctagcttcaagccagcaccattgaggccacagagtcgtctgtaaaatgcttcaaccatcttcctattctctggaaattgttctgctgaattcagtgcacattagaatacttgtgcaaaaaaaattgaacaaacttgaggatgtttaatctcttctaatttccaggatcattatcataaataagtctgagaataaagttaacattgttatatgtgaacatgtt

SEQ ID NO: 3171 - DNA, 1709 bp, Cucumis melo
aagtagccacatggttcattcctgtcctttttaccggttcgaatcggcggttccgccatattcatttccctcgatctcttttttttcttttctctccattgttgatctccgattaacaagatacgaggctcgtttcaaatctcaaacccactccagtgtcatagcttcttattattcgtccaatcatgacggttgacgccaaagtgaatcgccaagatgataaggacaagaatgcaagaagtgcctacttcggtttaccggcgctggatgtttctgttgcattccctcaagccacgtctgcatcctcctttcctccttccgtctcagacttctatcagttcaacgacctattgactcctgaggagcaagctctcagaaaaaaagtgagacagtgcgtggaaaaagaagtagctccaattatgacaaagtattgggagaaggcagagtttccatttgaagttgtcccaaagcttggtagcttgtgcattgctggtggtactatcaagggttatgggtgtcctggtctgtctattactggaagtgctgttgctgttgctgaagtagcaagagttgatgcaagttgttccactttcattctggtgcattcatcgctcgcaatgctcaccatcgctctatgtggatcggaggagcaaaagcataaatatttaccttccttggcaaagtttgataccgtcgcatgttgggctttgactgagcctgaaaatggaagtgatgccagtggtttaagaacaacggcaacaaaggttgaaggaggttgggtaatagaggggaaaaaacgctggataggaaacagcacattcgctgatgtattggttatttttgccaggaatacaattacaaatgaaataaacggatttataataaaaaaaatgcccctggtctgacggttacaaagatagaaaataaaattggtttgcggatcgttcaaaatggagacattgtaatgaataaagttttcgtaccggatgaagataggttacctggtgtaaattctttcaaggatacaaacaaggttcttgccgtttcgcgtgtaatggttgcctggcaacccattggcatagcaatgggggtttatgacatgtgtcacagatatttgaaggagagggaacaatttggagcaccattagccgcttttcagcttaaccaacagaaacttgttctcatgctgggaaatgttcaagcaatgttcctcattggttggcgactttgcaaattatatgaaaagggaacaatgactccaggtcaagctagcttgggaaaggcatggatcactctgagagctagggaaaccgtttctctaggacgtgagttgcttggaggcaatgggattttatcagactttctagttgcaaaggcattctgtgatttggaaccaatatatacgtatgaaggtacgtacgacatcaacacattggttactgggagagaaataactggtgttgccagtttcaagcctgctgctctagccaaaagaagccgcctatgatctttttgttcatgcatggtgagccaaacaatgatatataataaaataatatatatctctattctataaataaaacaaattacatgtgtatttagttggtttttgcatcgcttgcctctaccgaatgcttcatcataatatgtgagtaactacttctattaataaaactatagttattaattatgtagagtttaggttaaaa

SEQ ID NO: 3172 - DNA, 2088 bp, Populus trichocarpa
aatacaaaataaaacacatcttaggtgtctctcttcgcgttatattttccaaccatgtcaatccctaaaaacaaagatgaggttgagcaaaatccaaggagctcgtattttaatttaccgccgttggatgtttccgtcgccttccctcaagcaactccagtttccacatttcctcctagcgtttcagattactatcaattcagtgatttattaaccgtggaggatcaggcactcaggatgagagtgagggagtgtatggagaaggaaatagctccgatgatgacagagtattgggagaaggcgaagttcccgtttcatgctattccgaagctcggtgccttgggtatagctgggggaacgatcaagggttatgggtgccctggtctttccatcactgcaagtgccatcgcgatggcagaagttgctagagttgacgcgagctgttcgacttttattttggtgcattctctggcaatgctcaccatagcattttgtggttcagaggaacagaagctgaaatatttaccttctttggcacagttcagcaccgtagcttgttgggctttgaccgagcctgactatggaagtgatgcaagtggtctgaaaacaacagcaataaaggtggaaggaggttggatactcgagggcaaaaaacgctggataggaaacagtacctttgcagatttgcttgttgtattcgctcgcaataccactactaatcagattaacggatttatagtaaagaaggacgctcctggattaacagttacaaaaattgaaaataaaattggtctgcgcatcgtacaaaatggagatattgtcatgaaaagagtttttgttcctgatgaggacaggttgcctggtgtcaactcttttcaagatacaaataaggttctagctgtttcgcgcataatggttgcctggcaacctattggcatatcaatgggggtctatgacatgtgtcacaggtatctaaaggaaaggaaacaatttggagcaccattggcagctttccaaatcaatcaacagaaacttgttcacatgcttggtaatgtccaagcaatggtactagttggttggcgtctttgcaagttgtatgaaaaggaaaaaatgaccccaggtcaagctagcttggcaaaggcatggatcagtttgaaggcaagggaaactgctagtattgggagggagttacttggtggcaatggaattttggctgattttctagttgccaaggcactatgtgatttagaacccatttacacatatgaaggcacctatgacatcaacagcttgataacaggcagggaaatcactggtcttgccagttttaagccagcgatgttgagcaagcgaagtcgcatgtagcagtgtaaactttcacgtgccatctgaatgtgatttactaccttttctgctgtgtcggggaagctgcttgataacctcataagggaaaattgtaaaataaacttcttctcgctccatgcacatcgatgtcttgaatctttttttttttttttttgggggggggggggggtaatatatttagctcatgtacagacactggtttgggagctttgaaataaaaagttacacgtcctcagcagtcttttcttcctgctcatcctttttcttaggcatcatttacatgatttgctaaatcccaatcaaatggtggagaaaacttggaattggatcccaatttgggtgggtttttcatcttccttatttacatatattctttatgttatattgtaattattcttacccatttatgggcctgcgtctacatggaaaccagcccctgctctaggctaaaacgtaggttgttacttctcaggtttcaagttaaccttgctgaattgtgacagatgtctttgttaaacctccattaagtaaagcagatgctactggaagatactgcaaaattcattgggtgcttgcaggccaactgaatctgcgtattatttggtgaagaacatgagtatttttctggcccagagcttttggagcaaatgtgttaagccatgaactcctgtcgaactgaagatttcagcaggctcaatctcaagctagtaggtttaagtgaag

SEQ ID NO: 3173 - DNA, 1684 bp, Solanum lycopersicum
gatttccgtgccaactttatatccttcattttattttcttttttcatcttcatcattctgaattttctctcagttgaagagtccacagaattcttttttttttttatccatgaaagttccaccaactaaaactcaagaagaaatgtataaagaggcgaaaagttcctattttgatctaccagctttggatgtttctgttgcatttcctcaagcaacaccagcgtccgtctttcctaaatgcacttcggactattatcagcttgatgatctcttgacttctgaagagaaagccgtcagactgaaagtgagagagtgcatggaaaaagaaattgctcctataatgacaaagtactgggaaaaagcagagtttccgtttgaagttattccgaaacttggtgctttgaacatatctggtggcactataaaggggtatggttgtccaggtttatcagtaactggaagtgccattgctctagcagaaattgccagagtagatgcaagctgctgtacattcattttggtgcattcatctttggcaatgctcactattggactattgggatcagaaatgcaaaggcaaaaatacttaccatctctggctgatcttagcagtatatcttgttggggtctaactgagccagactatggaagcgatgcaagtgctttgaggaccactgccacaaaggttgaaggaggttggatccttgaagggcaaaaacggtggataggaaacagcacttttgcagatgtgttggttatatttgccagaaacgcagccacaaaccaaataaatggtttcattgtacagaaggatgctccaggcttgcaatgtactaaaatagaaaacaaaattgggttgcggatggttcagaatggagatatcctctttaagaaagtgtttgttcctgatgaggatagactaccaggtgtcaattctttcaacgatacaagtaaggtgcttgctgtatcacgtgtcatggttgcatggctgcctataggcattgcaatgggtgtatatgatatgtgtcacaggtatttaaaagagaggaaacagttcggagctccattggctgctttccagttaaatcaacagaagcttgttcagatgttgagcaacattcaggctatgcttcttgttggatggcgtctttgcaagttgtatgagagtggtaaaatgactcccggtcaggctagcttggggaagtcatggaataccttgagggctagagagaccgtttctcttggacgggaattacttggtggtaacggtatcttgaccgacttcttagtggcaaaggcattctgtgacttggagcccatctatacgttcgagggtacctatgatatcaacactctagtaacaggtagagaaattacaggtcttcctagcttcaagccagcaccattgaggccacagagtcgtctgtaaaatgcttcaaccatcttcctattctctggaaattgttctgctgaattcagtgcacattagaatacttgtgcaaaaaaaattgaacaaacttgaggatgtttaatctcttctaatttccaggatcattatcataaataagtctgagaataaagttaacattgttatatgtgaacatgttcattattgcgtattgatttggctatgcaagccagtatctgcagttatctttctgatttatatgaattttcttattcg

SEQ ID NO: 3174 - DNA, 1333 bp, Tragopogon dubius
ctttccgccttgcacctcagactactatcacttcgctgaccttctcacccctgaggaacaagctctaagactccgagtaagagaatgtgttgaaaaagaagtagccccaataatgacaaagtattgggagaaggcagagtttccatttcaaattattccaaaactaggtgctctgaatgtagctggtggaactatcaaggggtatggatgtccaggtttgtctgtgactgcaaacgcattagttacagcagaaatagcgagagttgatgcaagctgctctactttcattttagtgcattcttctttagcaatgctcactatatcactgtgcggttcagagatacaaaaacagaagtatttaccatcacttgcaaaactagacacaatagcttgttggggtttgactgaacctgattatggaagtgatgcaagtggtcttagaacaacagcaacaaaggtggaaggaggttgggtgattgaaggccaaaaaagatggattggaaacagcacttttgctgatattttggttatatttgctaaaaataaagacacaaatcagataaacggatttattgtgaagaaaaatgcacccgggttacaagctacaaaaatagaaaataaaattgggcttagaatggttcaaaatggagatattttgttacagaaagtttttgttcctgatgaagataggttacctggggtcaactcttttcaagatacaagcaaagtgcttgctgtttcgcgtgtcatggttgcgtggcaacctattggaatcacaatgggtgtctatgatatgtgccatagatacttacaagaaagaaagcaatttggagccccgttggcagctttccaaattaatcagcaaaagctggttcagatgttggctaatattcaagcgatgtttctgattggttggcgtctttgcaaattgtatgaaagtgggaaaatgactccgggtcaagccagcttgggcaagtcatggatcacgttgagggctagggaaaccgttgcattgggccgtgagttacttggtgggaatggaataatatctgactttttagttgcgaaggcttttggagatttggagccaatttacacatacgaaggaacatatgacattaacacattggtcacgggtcgggagattacgggtatcgcgagtttcaagcctgttggaaagaagcctcagatgagccggttataatatgtaatcgcattttgtgttgcagaaattgttgtgttatttaggtggttcatttgtataagactgttttttttccgtaattgtcgtccagataaactgttatcaggataaataatgtttaaagaatat

SEQ ID NO: 3175 - DNA, 686 bp, Triphysaria pusilla
aagagtgtttttgtccctgatgaagacaggcttccgggagttaattcttttcaagatacgaacaaggtgcttgctgtctcacgcgtcatggttgcatggcagcctattggcataacgatgggtgtttatgacatgtgtcacaggtatctgaaggagaggaagcaatttggtgccccattagcagctttccaaataaaccaacaaaaactagtccgcatgttaggtaatgttcaagcaatgcttcttgtaggttggcgtctatgcaagctgtatgaggctggtaagatgactcctggtcatgcgagcttgggcaagtcgtggatttcggcaaaggcaagagagactgtttctcttggacgtgagttacttggtggaaacggaattttagctgactttcttgttgcaaaggctttctgtgatttggagcctatatacacgtacgaaggcacttacgacatcaacaccctggtaaccggcagggaggtaactgggattgctagttttagaccagctgcaccgaacaaccgaagtcgcttgtagtgtaagatactaaaaaatcaatttacggtcgttcaataatggaactattttggaatctggttatatatgattcatatggaatcaacatgtcaaagcccagtaaacaaagtttgtttatttatttatataggagaaaactattgttg

SEQ ID NO: 3176 - DNA, 1901 bp, Eucalyptus grandis
gccatcgccaacgtcatcctcgtctcgtcgtcatcttccttggatgaactttcggagtagaccgacaagcaagaatagcttcgtttctctccctgccttcttctcgtcgatccttcgtcatcgtcttgaccccgcctcgccatgacggttcgcgcgtctccgaaaccagataatctggaaaaggaggagaggagttcttatttcggtttaccgggattggatgtttcagttggatttcctcaagcaactccagcttctgtcttccctccttgcacatcggattattatcattttgatgacttattgactcctgaggagcaagctatccgtaagagagtcaaagaatgtatggaaaaggaagttgctccaatcatggcaaagtattgggagaaggccgaattcccatttcatatcattccaaagcttggcgcccttggtattgctggtggcactattaagggttatggttgccctggtctctccattactggaagtgctatttctacagctgaagttgctagggtggatgctagcttttctacgtttattttggttcactcttccttggcgatgctcactatttcattatgtggttccgaggaacagaagcagaaatacctaccttctttggcaaaattggatactgtggcttgctgggctttgacagaacctgattatggaagcgatgcgagtgctttgaaaacatcagctacaaaggtggaagggggttggattctcgaaggccaaaagcgctggattgggaatagtacctttgcagacttgctggtcatttttgctagaaatagttcaaccaatcaaataaatggatatatagtaaagaaaaatgctcctggattaacagctagaaaaatggaaaataaaattggcctgcgcattgtccagaatggagatattatccttaagaaagtctttgtccctgataatgataggttgcctggtgtcaattcattccaggatacaaacaaggtgcttgcagtttcacgtgttatggttgcttggcagcccattggactttcgatgggagtatatgacatttgtcacaggtatttgaaggagaggaagcagtttggtgcaccactggctgctttccaaataaaccaacagaaacttgtccagatgttgggaaatgttcaagctatgtttcttgttggttggcgcctttgcaaactctatgaaagtggtacaatgacccccggccatgctagtttgggaaaggcatggatcactgcgagggcacgggaaacagtagctttgggcagagagctgcttggtggcaatgggatcttgtctgatttcttggttgcaaaggcattctgcgatttggagccaatctacacatttgaaggcacttatgatatcaacaacttggtcacaggcagggaagtcacaggtttggccagcttcaaaccagctgcatcgagtcaaagaagtcgcctgtaactgagtaaacatcttccctgtaaccttctacagaccttctacggggtttgtttgttcacgtgggttctgtaatctggtactataataaaccaggaacaaacagtcttgatcatttagactggcgtaaaaataagttatgcaggcgtttactgtttacatcttgtctaaggtaaaatgcacagcatagacttaagaaataacattagatacttgcgcttggttcaatagccattatctattgtttcaaactgggtaaatctcctttgtcattctttgaagatttctcgggcaacaaacatctctattgccactcataatttgtttcctgagaagacgacgtgtgaattgtgaagatttactcgttttgccaagataaatccaaaattgaaatgtcatttcaagttttgagctagaggctccaagttaaatcaaccaaaaaa

SEQ ID NO: 3177 - DNA, 1262 bp, Euonymus alatus
gcatggaaaaagaagtagctcctgtaatggcagagtattgggaaaaggcaaagttcccttttcatgttattccaaagcttggtgccttggatattgctggtggtacaatcaagggttatggttgtcctggtctctcagccactgcatactctgttgctgtggctgaagttgctagagttgatgcaagttgttctacttttattctggttcattcgtctctggcaatgctcactattgcgctttgtggttcggaggtgcagaaacagaaatacctaccatcgttggcccaattacagactgttgcttgttgggctttaactgagcctgactacggaagtgatgcaagttctctggaaacaaccgcaacaaaggtagaaggaggatggatgcttgagggtcagaagcgctggatagggaacagcacctttgcagatgtattggttatatttgctaggaatatcaccacaaatcagataaatggatttttagtgcagaaagatgcccctggattaacagccagaaaaatggaaaataaaatcggtctccggattgtacaaaatggagatattcttttgaaaaaagtctatgttactgatgaggacaggttacctggtgtcaattcatttcaggatacgagcaaggttttggcagcttcccgtttagcggtttgctggcaacccattggcatatcaatgggtgtctatgacatgtgtcacaggtatctcaaggagaggaaacagtttggagccccattggcagcttttcagatcaaccaacagaaacttgttcaaatgcttggtaatattcaagcaatgatccttattggttggcgcctttgtaagttgtatgaagacagcaaaatgacaccaggccaagtcagcttggcaaaatcatggatcagcttgaaggcaagggaaactgttgctcttgggcgggagttacttggtggcaatggaattttggctgatttcctcgttggaaaggcattttgtgatttggagcctatctacacatatgaaggcacctatgatatcaataccttggtaacgggcagggaaatcactggttttgccagtttcaagccagctgcattgggcaatcgaagccgcttgtgatagtgtgaagtggtaaacttttctgctgttggttgttacgaccactctatggatttgtcatttgtgggtgtcatttttgtgagcaagagagataaatcatatgaaaccttactatatttgttaaaataaaactacattgaagtttta

SEQ ID NO: 3178 - DNA, 1611 bp, Tripterygium wilfordii
agactcagcttccgtagttattggactttgtaatctgaatctcactgcgtcattaattgctttcttccggcaaaccgtttcattccaacaagcggagcgttatccgattcttattcaccatggcaaccatgaaccggcgctcatcggaaaataaagacgatataggcaaaggtcaaaagagttcatacttcaatttgccaccgttggatgtttccattgcattccctcaggctactcctgcatccatctttcctccttgtgcttcagattattatcagtttgatgatcttttaactcctgaggagcagtctatcaggatgaaagtaagagaatgcatggaaaaagaagtagctcctgtaatggcagagtattgggagaaggcaaagtttccttttcatgttattccaaagcttggtgccttggatgttgctggtggtacaatcaagggttatggttgtcctggtctctccatgactgcatacgctgttgctgtggctgaaattgctagagttgatgcaagttgttctacttttattctggttcattcatctctagcaatgctcactattgcactttgtggttcggaggtgcagaagcagaaatacctaccatctttggcccaattacagactgtagcttgttgggctttaaccgagcctgattacggaagtgatgcaagttctctggaaacaaccgcaacaaaggtggaaggaggatggatacttgagggtcagaagcgctggatagggaacagcaccttcgcagatgtattggttatatttgctaggaataccaccacaaatcagataaatggatttttagtcaagaaagatgcccctggattaacagcaacaaaaatagaaaataaaatcggtctccggattgtacaaaatggagatattcttttgaaaaaagtctctgtcaccgatgaggataggttacctggtgtcaattcatttcaggatactaacaaggttttggcagcttctcgtttaatggttgcctggcaaccgattggaatatcaatgggtgtctatgacatgtgtcacaggtatctaaaggagaggaaacagtttggagcgccattggcagcttttcagatcagccaacagaaacttgttcaaatgcttggtaatattcaagcaatgatccttattggttggcgcctttgtaagttgtatgaggacggcaaaatgacagcaggccatgtcagcttggcaaaatcatggatcaccttgaaggcaagggaaactgttgcgcttgggcgtgagttacttggtggcaatgggattttgaccgatttcctcgttgcaaaggcattttgtgatttggagcccatctacacatatgaaggtacctatgatatcaacaccttggtaacgggcagggaaatctctggtcttgccagtttcaagccagccgcattgggcaagcgaagccgcttgtgatagtgtaatgttgtaaacctttctgcctatctcatagtcataggagagttacgggagacactcatacaaaataaaattcttgcatatgttgtttggtatgtaccacttaccctaccacttactatggatctactattgatatgtggatgtgtcattcttggga

SEQ ID NO: 3179 - DNA, 1521 bp, Cucumis sativus
aagaagccacatggttcaatcgtgtcctttttaccggttcgaatcggcggttccgccatttttcatttcactcaatctctttcttttctctctattgttgatctccaattaacaagatacgaggctcgtttcaggtctcaatcccactccagtgttatagcttcttattctttttccaatcatgacgattgacgccaaaatgaatcgccaagatgataaggacaagaatgcaagaagttcctacttcggtttacctgcgctggatgtctctgttgcattccctcaagccacatctgcatcctcctttcctccttccgtctcggacttctatcagttcaacgacctattgactcctgaggagcaagctctcagaaaaaaagtgagacagtgcgtggaaaaagaagtagctccaattatgacaaagtattgggagaaggcagagtttccatttgaacttgtcccaaagcttgctaacttgggcgttgctggtggtactatcaagggttatgggtgtcctggtctgactatcactggaagtgctattgctgttgctgaagtagcaagagttgatgcaagttgttccactttcattctggtgcattcatcgctcgcaatgctcaccatcgctctatgtggatcggaggagcaaaagcagaaatatttaccttccttggcaaagtttgataccgtcgcttgttggggtttgactgagcctgaaaatggaagcgatgccagtggtttaagaacaacggcaaccaaggttgaaggaggttgggtaatagaggggagaaaacgctggataggaaacagcacatttgctgacatattggttatttttgccaggaatacaattacgaatgaaataaacggatttataatcaagaaaaatgcccctggtctgacggttacaaagatagaaaataaaattggtttgcggatggttcaaaatggagacattgtaatgaataaagttttcgtacctgatgaagataggttagttggtgtaaattctttcaaggatacaaacaaggttctagcggtttcgcgtgtaatggttgcctggcaacccattggcatagcaatgggggtttatgacatgtgtcacagatatttgaaggagagggaacaatttggagcaccattagcagcttttcaacttaaccaacagaaacttgttctcatgctgggaaatgttcaagcgatgttcctcattgggtggcgactttgcaaattatatgaaaagggaacaatgactccaggtcaagctagcttgggaaagtcatggatcactctgagagctagggaaaccgttgctctaggacgtgagttgcttggaggcaatgggattttatcagactttctagttgcaaaggcattctgtgatttggaaccaatatatacttacgaaggtacgtacgacatcaacacattggtaactgggagagaaataactggtgttgccagtttcaagcctgctgctctagccaaaagaagccgcctgtaatctttttgttcatgcat

SEQ ID NO: 3180 - DNA, 1654 bp, Tropaeolum majus
atcctcatcaacaaacgtacggaacctcagtctgattcgttcggtatttttcattcgctttagagcaagctccgttgagtaatttcatttcggagagaaaaatttctcaatcatgacacttccaggctcatctacgaagcaagataattccgataacaaggatagaagttcgtattttaacctaccggcattggatatatatgctgcatttcctcaagcaactcctgcctctaagttccctccttcggtttcggattattataagtttgatgatctattaactcctgaggagcaggctctccgaattaaagtaagagaatgtatggaaaaagaagtggctccaataatgacagagtactgggagaaggctgaatttccattccatattgtcccaaagcttggtgcgttgcgtattgctggtggcactatcaagggttatggttgtcctggtctctcgatcactggcagtgccattgctacagcagaggttgctagagtggatgcgagttgttctactttcatcttggttcattcatctcttgcaatgcttacaattgcactatgtgggtcggaatcgcagaagcaaaagtacttaccttctttggctcaattaagcgatgtggcttgttgggctttgacagagccagactatggaagtgacgctagtggcttgagaacaattgctacaaaggtagaaggaggttggttactagagggtcaaaagcgttggataggaaacagtacctttgcagatatcttgattatttttgcaagaaacacttcaacaaatcaaataaatggatttatagtaaagaaggatgcccctggattaacagctacaaaaattcaaaataaaattggtctgcgcattgttcagaatggagatattctcttgaagaaagtctttgtccccgatgaggaccggttacctggtgtcaactctttccaggataccaataaggtcctagctgtttcacgagtaatggttgcctggcaaccgataggcatatccatgggcatctatgacatgtgccacagatacctgaagcagaggaaacagtttggagcaccactagcagctttccagatcaaccaacagaaacttgtaaccatgcttggtaatgttcaagcaatggttcttgttggttggcgcctttgcaagttgtacgagaagggtcagatgactactggtcaggccagtttggggaaggcatggatctcctcaaaagcgagggaaacagctgctcttggacgagaattactcgggggaaatggaattttatctgattttctagttgccaaggcattttgtgatttggagcccatctatacatacgaaggcactttcgacattaacaccttggtgactggtcgggaagttactggacttgcgagtttcaaaccagctacatcaagccagcggagccgcctataagagagagtctggtttggtccgagggatggaatggaattcccaataaaataaactgaaaaaaaatatcaagctgatgggacaataatgttgatgtagaacatgattatgcttgaagaattttagtaatattattacttaaacaagtgagaaagtagggcattctatcgcaataaatcacaactccacaactcgcataaaaaaattgattgatctcaatca

SEQ ID NO: 3181 - DNA, 1545 bp, Solanum phureja
cttcttcgtttctcaaacacaagatttgatttttcttcgtgaaattcttcatcattcaaaatgcagcgaaaatgcataaagaggcaaaaagctcctattttgatatgccagcattggatgtttctgttgcatttcctcaagcaactccagcctccaactttcccccatgcacttcagactactatcagcttgccgatctgttgactcctgaggagcaagccatcagaatgaaagtgagggaatacatggagaaagagattgctcctataatgacgaagtattgggagaaggcagaatttccatttgaaatcattccaaaatttggtgctttgcacatagctggcggcactatcaagggatatggttgcccaggtcactcaataactggaagtgctgttgctgcagcagaagttgccagagttgatgcaagctgctctacattccttttggtgcattcatctttagcaatgctcactattgggctatgtgggtctgaaatgcaaaaggaaaaatacttgccatcattggccgaatttgacactatagcttgttggggtctaactgagcctgactatggaagtgatgcaagtggattggggactactgccaaaaaggttgaaggaggttggatccttgaagggcaaaaacgttggataggaaacagcacttttgccgatatattggttatttttgctagaaatacatccacaaaccagataaacggtttcatagtaaagaaggatgctccaggattgcaatgtactaaaatagaaaacaaaatcggactacggattgttcaaaatggagacattctcttaaagaatgtttttgtccctgatgaggatagactacctggggtcaattcatttcaggatacaaacaaggtgcttgctgtatcgcgtgttatggttgcatggcagcctattggcattacaatgggtgtttatgatatgtgtcacaggtacttgaaggagagaaagcaatttggagcaccattagccgctttccagatcaaccaacagaaattggtccaaatgttgagcaacattcaagcaatgattcttgttggttggcggctttgcaaactacacgagagtgataaactgactcatggtcacgcaagtttagggaaatcatggattacgttgagggcaagagagactgttgctctcggacgagaactactaggtggcaacggaatcttggctgactttcacgtcgcaaaggcattttgcgatttggagccgatctatacatttgaaggtacatacgatatcaacacgttggtaacaggtagagaaattaccggtttggccagtttcaagcctgcaccagtaaggcaaaagagtcgcctgtgaaaaatttcatcttctctgtgttgtaagtattctgctgaataatgttctgtttaggcaattgtaactctacaatgcttttacccaaaggaagtactttaagaattgaagttccttttcttttaaaaaaaaattgtatctaataatgataagttagactatcacctattgtaattaaaaaatagcatca

SEQ ID NO: 3182 - DNA, 1534 bp, Solanum lycopersicum
acctagaagtaagtgccatataatccacttcttttttcctctttgttcgtttatacttcttcgatacacaaacacagagatttatttttcttcgtgaaattcttaatcattcgaaacccagcgaaaatgcataaagaggcgaaaagctcttattttgatatgccagcattggatgtttctgttgcatttcctcaagcaactccagcctccaactttcctccatgcacttcagactactatcagcttgccgatctgttgactcctgaggagcaagccatcagaatgaaagtgagggaatgcatggagaaagagattgctcctataatgacgaagtattgggagaaggcagaatttccatttgaaatcattccaaaatttggtgctttgcacatagctggcggcactatcaagggatatggttgcccaggtcactcaataactggaagtgctgttgctgcagccgaagttgccagagttgatgcaagctgctctacattccttttggtgcattcatctttagcaatgctcactattgggctatgtgggtctgaaatgcaaaaggaaaaatacttgccatcattggcggaatttgacactgtagcttgttggggtctaactgagcctgactatggaagtgatgcaagtggattggggactactgccagaaaggttgaaggaggttggatccttgaagggcaaaagcgttggataggaaacagcacttttgccgacatattggttatttttgctagaaatacatccacaaaccagataaacggtttcatagtaaagaaggatgctccaggattgcaatgtactaaaatagaaaacaaaattggactacggattgttcaaaatggagacattctcttaaagaatgtttttgtccctgacgaggatagactacctggggtcaattcattccaggatacaaacaaggtgcttgctgtatcgcgtgttatggttgcatggcagcctattggcattacaatgggtgtttatgatatgtgtcacaggtacttgaaggagaggaagcagtttggagcaccattagccgctttccagatcaaccaacagaaattagtccagatgttgagcaacattcaagcaatgattcttgttggttggcggctatgcaaactacacgagagtgataaactgactcatggtcacgcaagtttagggaaatcatggattacgttgagggcaagagagaccgttgctctcggacgagaactactaggtggcaacggaatcttggctgactttcacgtcgcaaaggcattttgcgatttggagccgatctatacatttgaaggtacttacgatatcaacacgttggtaacgggtagagaaattactggtttggctagtttcaagcctgcaccagtaaggcaaaagagtcgcctgtgaaaaatttcatcttctcctctgggtagtaagtattctgctgaataatgttctgtttaagcaattgtaactctagaatacttcttgtagattaataaatatcatactttaatttatcgatcaa

SEQ ID NO: 3183 - DNA, 1565 bp, Solanum lycopersicum
gtttatacttcttcgatacacaaacacagagatttatttttcttcgtgaaattcttaatcattcgaaacccagcgaaaatgcataaagaggcgaaaagctcttattttgatatgccagcattggatgtttctgttgcatttcctcaagcaactccagcctccaactttcctccatgcacttcagactactatcagcttgccgatctgttgactcctgaggagcaagccatcagaatgaaagtgagggaatgcatggagaaagagattgctcctataatgacgaagtattgggagaaggcagaatttccatttgaaatcattccaaaatttggtgctttgcacatagctggcggcactatcaagggatatggttgcccaggtcactcaataactggaagtgctgttgctgcagccgaagttgccagagttgatgcaagctgctctacattccttttggtgcattcatctttagcaatgctcactattgggctatgtgggtctgaaatgcaaaaggaaaaatacttgccatcattggcggaatttgacactgtagcttgttggggtctaactgagcctgactatggaagtgatgcaagtggattggggactactgccagaaaggttgaaggaggttggatccttgaagggcaaaagcgttggataggaaacagcacttttgccgacatattggttatttttgctagaaatacatccacaaaccagataaacggtttcatagtaaagaaggatgctccaggattgcaatgtactaaaatagaaaacaaaattggactacggattgttcaaaatggagacattctcttaaagaatgtttttgtccctgacgaggatagactacctggggtcaattcattccaggatacaaacaaggtgcttgctgtatcgcgtgttatggttgcatggcagcctattggcattacaatgggtgtttatgatatgtgtcacaggtacttgaaggagaggaagcagtttggagcaccattagccgctttccagatcaaccaacagaaattagtccagatgttgagcaacattcaagcaatgattcttgttggttggcggctatgcaaactacacgagagtgataaactgactcatggtcacgcaagtttagggaaatcatggattacgttgagggcaagagagaccgttgctctcggacgagaactactaggtggcaacggaatcttggctgactttcacgtcgcaaaggcattttgcgatttggagccgatctatacatttgaaggtacttacgatatcaacacgttggtaacgggtagagaaattactggtttggctagtttcaagcctgcaccagtaaggcaaaagagtcgcctgtgaaaaatttcatcttctcctctgggtagtaagtattctgctgaataatgttctgtttaagcaattgtaactctagaatacttcttgtagattaataaatatcatactttaatttatcgatcaacatttatatttttctttttaatcttcatgtatatcacatatcttttaataataatactagcagcatatttaagataatc

SEQ ID NO: 3184 - DNA, 749 bp, Triticum aestivum
aatggttcagaatggcgatatccttctgaataaagtattgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggagctcccctggcagcctttcagctcaaccaagaaaagcttgttcggatgcttggtaacatccaggccatgcttcttgtcggctggcgcttgtgcaagctctatgagtcaggcaaaatgacaccaggtcatgctagtttgggcaaggcatggacgtccagcaagtcaagggaggtagtttctctgggtcgagagctattgggcggcaatggaattttggctgattttctagtagcgaaggcgttctgcgatctggagccgatttactcgtatgagggcacctatgacatcaacagcctggtgaccggaagagaaatcaccgggatcgcgagcttcaaacctgctgcagtagcgaaatctcggctgtaattcttcttctgcctccagctatgatgaacagcaaagtatgacccccatcttgtattctggtgggtacgagtaagattgaaataagtgcaaccgaatgatcaaatgtaagggggcgcttggaatggatgtaattcgatacggagctgtttcagttacacgcggatcataccggtcactgagcaatt

SEQ ID NO: 3185 - DNA, 1530 bp, Cichorium intybus
aggttgcagacggtagtaaataactaaataagaaaaccaaaatttcctcttgcttcatcttctctttgtctaacggatcctgggctctgacttgatccttcctctccggaatcaccatgactatacaatcatctaaacctcaagatgaccaaaacaacaattcaaagagctcatattctgattttccagcattggatgtctcccttgcatttcctcaagcaacaccagcttcaatctttccaccttgcacctcagactactatcactttgctgaccttcttacccctgaggaacaagctctaagactacgagtaagagcatgtgttgaaaaagaagttgctccaataatgaccaagtattgggaaaaagcagaatttccatttgaaattgttccaaaactaggtgcgttgaatatagctggtggaactattaaggggtatgggtgtccaggtttgtctgttactgcaaatgcattagctacagcagaactagccagagttgatgcaagctgttctactttcattttggtgcattcttctttggcaatgctcactatatcactgtgcgggtcagaaacacaaaaacagaaatatttaccatcacttgcaaaactagacactatagcttgttggggtttgactgaacctgataatggaagtgatgcaagtggccttacaacaacagcaacaaaggtgcaaggaggttgggtgattgaaggccaaaaacgatggattggaaacagcacttttgcagatattttggttatttttgctaaaaacaaagacacaaaccaagtaaacggattcattgtaaaaaagggtgcaccagggttacgagctacaaaaatagaaaataaaatcgggcttagaatggttcaaaatggagatattctcttacagaaagtttttgtccctgatgaagataggctacctggtgtcaactctttccaagatacaagcaaagtgcttgctgtttcccgtgtcatggttgcctggcaacctattggcatcacaatgggcgtctacgatatgtgccatagatatttactagaaagaaagcaatttggagccccgttagcagcttttcaaatcaaccaacaaaaattagttcaaatgttggcaaatatccaagcgatgtttctgattgggtggcgtctttgtaaattatatgaaagtggtaaaatgactccaggtcaagctagcttgggcaagtcatggatcacattgagggctagggaaaccgttgcacttggtcgcgagttacttggtgggaatggaataatatctgactttttggtcgcaaaggcttttggagatttggagccaatctacacttatgaagggacatatgatattaacacattggtgacgggtcgggagattacaggtattgctagttttaagcctgttataaggaagcctcaaatgagtcgtttgtaattggggttaagttgatgtggaaattgttgtgatttttagttggtttattgtttaagatagtggttcttttggtccgtcaaggtgataggtt

SEQ ID NO: 3186 - DNA, 1757 bp, Vigna unguiculata
  misc_feature (291)..(291): n is a, c, g, or t
  misc_feature (501)..(501): n is a, c, g, or t
ttgatataatgaagttttcggattttgtcaaacaagagaacaccgcatacatggagggatgaaagtagtagtcatcaacaccaacacgtaacgttgtgctgacgcggacaacaatcattgccttggattgcgtattatttgttacttcatagccccgaagttccatttactcgctcttcttccgatttcctataatattgtgccacctgacctgaacccctaattttcactttccatttcttcgatctctctccgaccatgacgattccctcttctacgaatccagacggntctgtcaaaaatgcaatgccctcgtatttttatttaccaccactagatgtttctgcagcatttccacaagcaacaccagcatcaacgtttccaccttctgcttcagattattttcaattggatgacttgttgacagcggaggagcatgccattaggaggaaagtaagagagtgtatggaaaaagaaattgctccaataatgactgagtantgggagaaggccaagttcccatttcatgttattccaaagcttggtgccttgcgcattgctggtggcacgatcaaggattatggttgtcctggtctttctatcaccggaaatgcaatagctacggcagaagttgcaagagttgatgccagctgttcaacttttattttggtccattcatccttggctatgcttactattgcattgtgtggatcagaagctcagaagcaaaagtatctgccttctttggcacagtttcatactgtagcatgctgggctttgactgaacctgactatggaagtgatgccagtgctttgaagaccactgccacaaaggtggagggtggatggatccttgagggccaaaagcggtggataggaaacagtacatttgctgatgtattggttgtctttgctaggaatgcagccacgaatcaaataaatggatttatcattaaaaaggacgcacctggtttaacagtaacaaaaatagagaataaaattggacttaggattgtacagaatggtgacatcgttatgagaaaagtttttgtccctgacgaggacagaattgcaggagtaaactcttttcaggacacaaacaaggtgcttgctgtttcacgtataatggttgcttggcaacctattggtatatcgatgggcatctatgatatgtgtcataggtatctaacagagagaaaacaatttggagcaccattagcagctttccaaatcagccaacagaaacttgtccaaatgcttggaaatattcaagctatgattcttgttggttggcgcctgtgcaaattgtatgagagtggtaaaatgactccgggtcatgctagcttgggaaagtcatggatcaccttgagagcaagagaaacagctgctctgggccgagaattgctaggtggcaatggaattttggcagattttcttgtggcaaaggcattctgtgatttagaacccatctatacttacgaaggcacgtatgacatcaacaccttgattacaggtagagaagtcactggcgttgccagctttaaaccagttgcgcaaagaagtcgattgtagaagtgtaatacattgtttctttagtacactccaccaggcaacttcaatgtatgcaatgtggctgtgactacaatgtgttggttaatgtatgaaattgagaaacgggaaacatttaatacttataaagacgcttgggtaaatgactaataatgaccaaagaatcataagatttttcagtttcgtct

SEQ ID NO: 3187 - DNA, 1615 bp, Lactuca sativa
tgttggacccgggaaaccgacatgatggccggttgacgggggagtgggggaagacaatagtaaatagaaaaccaagattgcgtcttgcttcaaccactttctctctatacggatcctcagctcttccttgatccttcgtctcgggaatcaccatgactatgcaatcatctaaacctcgcgatgaccaaaacaacgattcagagagctcatattccaattttccaccaatggatgtctccattgcatttcctcaagcaacaccagcttcaatctttccaccttgcacctcagactactatcactttgctgaccttcttacccctgaggaacaagctctaagactgagagtaagagcatgtgtggagaaagaaattgctccaataatgaccaagtattgggaaaaggcagagtttccatttgaagttgttccgaaactaggagctttgaatatagctggtggaactatcaaggggtatggttgtccaggtttttctgtcactgcaaatgcattagctacagctgaaatagccagagttgatgcaagttgctctacttttattttagtgcattcttcattggcaatgctcactatatctctatgtggatcagaaacacaaaaacagaaatatttaccttcacttgcaaaactagacactatagcttgttggggtttgactgaacctgattatggaagtgatgcaagtggccttagaacaacagcaacaaaggtggaaggaggatgggtgattgaaggccaaaaaagatggattggaaacagcacttttgcagatattttggttatttttgctaaaaacaaaaatacaaaccagataaatggattcattttaaagaagaattcaccagggctaaaagcgacaaaaatagaaaataaaattggtctcagaatggttcaaaatggagatattcttttacaaaaagtttttgtccctgatgaagataggttacctggggtcaactctttccaagatacaagcaaagtgcttgcggtttcccgtgtcatggttgcctggcaacctatcggcatcacaatgggtgtctacgatatgtgccatagatacttattagagagaaagcaatttggagctccattagcagcatttcaaatcaaccaacaaaagttagttcaaatgttggctaatatccaagccatgtttttgattggttggcggctttgcaagttgtatgaaagtggtaaaatgactccgggtcaagccagcttgggaaagtcatggatcaccttgagggctagagaaaccgttgcattgggtcgtgagttacttggtgggaatggaataatatccgactttttagttgcaaaggcttttggagatttggagccgatttacacatatgaaggaacgtatgacattaacacgttggtgactggtagagagatcacgggtattgctagttttaagcccgttataaagaagccccaaatcagccgtttgtaatttgaatgtgttgtggaatttgttgtgttatttaggtggttcatttgtgtaagacaaagttaagtgttgtttaaataaagttgtcttttataaatgatgattaaaaaatattttaataaatgatgacttgaaaaaataaa
